United States Patent 10,760,088 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 3

SEQ ID NO: 4407 - DNA, 531 bp, Plantago ovata
tacataataaattcgactcctccttcctagggtttcggctttctcaaatttctcagcacacaacacacacgcctttgaggagctgctagtctctgtaatttgttgttgtttgctttcagcagaatggattcccaaatcaagcacgcaattgtggtgaagatcattggcaggacaggttcccgagggcaagtcactcaagtcagggtgaagtttattgatgaccagaaccggttcatcatgaggaacgttaagggaccggtcagagagggagatgttctgaccttgctagagtctgaaagagaagcaaggaggttgcgttgagtggcatttattctgttgtcatgtcttgtgtgcttatggttctgtagtgcaagattcgtactttgagactgggattattgcagagatgcattttatttaagtcgtgaggtgacctaaagattttgttacttcattttacattaatcaagttataagacctgaatcagttttaaatctgtttctggctactactatatgttgtcgtattcc

SEQ ID NO: 4408 - DNA, 523 bp, Pteridium aquilinum
ggagcacgtctgtgtgagaaacgcagccaaaatggatacccctgtgaagcttgcagttgtaatgaaggtcatgggacgcaccggttcaagaggacaggtgactcaagtccgagttaagttcattgatgatcaaaaccggctcattatgaggaatgtgaaaggcccagtcagagaaggtgatattctgactttgctggagtctgagcgggaggccaggaggcttcgatgagctttccatctacaattttgcattcaggagggatgagaactctgttttacttttattggtagtgcagaatgagatgggctaaactttatattttcgagagagttttgagatgaagggtactctaccagacccatataagattgtgctttttgtgggtttcttaaattaagtcttataatgcaaggctgagttatgtgaacttttgtgacttgttagtccgctgtttacacaaatggtgctgtgttgcttttattgtcctgtgaagcctgacattatattttgtgcaaaaaagaa

SEQ ID NO: 4409 - DNA, 452 bp, Eutrema halophilum
aagccatataaaagcccaagaaatccctcttcctcgcgttttcgatttgcctctcactttatcgccgcaaaagctttatcgtcgcatcgttctccgttagccgtcgtctccaggatggattctcagatcaagcacgccgtggtggtcaaagtgatgggtcgtaccggatcaaggggtcaggtgactcaggttcgagtcaagttcacagactctgatcgtttcatcatgcgcaatgtcaaaggaccagtgagagaaggagatatcctcactttgctcgagtccgagagagaagctaggagacttcgttgatgcgcctctacttcttccaatgtctttggttatctctcttttgattcctctcgacttggattagtgatatgatgttgttgcgtttaagacaattgctggattgatatctgttctggtttttctgatattcaaagtctctgtta

SEQ ID NO: 4410 - DNA, 253 bp, Eutrema halophilum
tctttgctcgttttgtaaatcagaatggattctcagatcaagcacgccgttgtggtcaaagtgatgggtcgtaccggatccaggggtcaggtgactcaggttcgagtgaagttcaccgattccgatcgttttattatgcgaaatgttaaagggcccgtgagagaaggcgatatcctcactttgctcgagtccgagagagaagctaggagacttcgttgatgcgcctgcagttatttctgtcttttgatattat

SEQ ID NO: 4411 - DNA, 210 bp, Eutrema halophilum
atggattctcagatcaagcatgccgtggtggtgaaagtgatgggtcgtaccggatcaaggggtcaggtgacccaagttcgagtgaagttcacagactctgatcgttttattatgcgcaatgttaaaggaccagtgagagaaggagatatcctcactttgctcgagtccgagagagaagctaggagacttcgttgatgtttctctcttttt

SEQ ID NO: 4412 - DNA, 201 bp, Eutrema halophilum
atggattctcagatcaagcacgccgttgtggtcaaagtgatgggtcgtaccggatccaggggtcaggtgactcaggttcgagtgaagttcaccgattccgatcgttttattatgcgaaatgttaaagggcccgtgagagaaggcgatatcctcactttgctcgagtccgagagagaagctaggagacttcgttgatgcgcc

SEQ ID NO: 4413 - DNA, 210 bp, Eutrema parvulum
atggattctcagatcaagcacgccgtggtcgtgaaggtcatggggcgaaccggttctcgtggtcaggtgactcaggttagagtcaagttcacagattcagaccgttttattatgcggaatgtgaagggaccggtgagagaaggagacatcctcactctcctcgagtcggagagagaagccagaagactccgctgattcatatatgccatt

SEQ ID NO: 4414 - DNA, 217 bp, Eutrema parvulum
ctgtatttgtcaatcagaatggattctcagataaagcatgctgttgtggtcaaagtgatgggtcgtacggggtccaggggtcaggtgactcaggttcgagtgaagttcacagactctgatcgtttcattatgcgtaatgttaagggacccgtgagagaaggcgacattctcaccttgctcgagtccgagagagaagccaggagacttcgttgatgcg

SEQ ID NO: 4415 - DNA, 434 bp, Arabidopsis lyrata
ttttggcctctctctcgcctatcgccgctaaactcttgcgtctccgtcagccttcatcctcagaatggattctcagattaagcatgctgtggtggttaaggtcatgggtaggactggttcaaggggtcaggttactcaggttcgagtgaagtttaccgactctgatcgttacatcatgaggaacgttaaaggaccggtgagggaaggcgatatcctcaccttgctcgagtctgagagagaagctaggagactccgttgatgcgtctttggttcttcttcttcttcctactccataatgcggaaacaagaaaacattttggttattttctcttttgctttctatgattggattagtggattatgctttggagtcttaatttcgttgttgctttaagacaattgccggattgataagtgtgttatggttctttggt

SEQ ID NO: 4416 - DNA, 240 bp, Arabidopsis lyrata
tttttttgtctgttgaatcagaatggattctcagattaagcacgctgttgtagtgaaagtgatgggaaggactggatcaaggggtcaagtgactcaggttagagtgaagttcactgactcggaccgttacatcatgaggaatgtcaaaggacctgtcagagagggagatattctcaccctgctcgagtccgagagagaagctagaagactccgttgaattctttctttactatatcgttt

SEQ ID NO: 4417 - DNA, 356 bp, Arabidopsis lyrata
gcgtctctcgaattagggttctagtatctctgctctttaaactcttatcgacgctaaaactctctacccatcgcagagcctatctaaagaatggattctcagatcaagcacgctgttgtagtgaaagtgatgggaaggactgggtcaaggggtcaagtgactcaggttagagtgaagttcactgactcggaccgttacatcatgaggaacgtcaaaggaccagtcagagagggagatattctcaccctgctcgagtctgagagagaagctagaagactgcgttaattctttctttgcaaattggattgtgatgttaaaaatattaattactatcaaagatggatgctttagagtct

SEQ ID NO: 4418 - DNA, 565 bp, Arabidopsis lyrata
atcaacgcagagtacgcggggggaaacttttagggtttttgactctttgcttatcgccgctaagctctctagcctccgcgaaccgcggtttctacaggtcatcaagcagaatggattctcagattaagcatgctgtggtggttaaggtcatgggtaggactggttcaaggggtcaggttactcaggttcgagtgaagtttaccgactctgatcgttacatcatgaggaacgttaaaggaccggtgagggaaggcgatatcctcaccttgctcgagtctgagagagaagctaggagactccgttgatgcgtcttgttcttgttccttctccactagtagaaacaagaagacagaaccatgtctgctttttctctctttttttctgttttctgtgtctggattagtgattatgccttcgaattgaattttgttttgctataagacatttcatggattgatttatgttctcgtcttatcatatttttgtttgaaatcatcagtacatcatcactctccaaaatctcttggattaatcaaccgaaatgatatagaaagttctaagccat

SEQ ID NO: 4419 - DNA, 235 bp, Arabidopsis lyrata
cacatttatgtaaatgcagaatggattctcaaatcaaacatgccgtggtcgttaaggtcatgggtaggactggttctcgtggtcaggtcactcaggttagagtcaagttcactgattcagaccgttacatcatgaggaacgtgaaaggaccggtcagagaaggagatatcctcactctcctcgagtccgagagagaagctagaagactccgttgattccatatcccaatcctctt

SEQ ID NO: 4420 - DNA, 492 bp, Arabidopsis thaliana
ggtcgacattattttatttttataagtcctctctcacgaaaccagttaattattggtgcgtctctcgaattagggttctaggatctctgctcttaaaactcttatcgccgctaaaactctctacccatcgcagagcctctctaaagaatggattctcagatcaagcacgctgttgtagtgaaagtgatgggaaggactggatcaaggggtcaagtgactcaggttagagtgaagttcactgactcggaccgttacatcatgaggaacgttaaaggacctgtcagagagggagatattctcaccttgctggagtccgagagagaagctagaagacttcgttgattctctttgcaaattgtttttggttgctttgaagaacaaatgttatatcgtttggataattaaattcttattatgatgttaaaaaatttaattatcaaagattgatgctttagactctaaatctataatatattaaaaatcatttcttta

SEQ ID NO: 4421 - DNA, 571 bp, Arabidopsis thaliana
ttcgtctctgtaaaattagggtttttgcctctcacgcttatcgccgcatctccgtcaaccttcatctacagaatggattctcagatcaagcacgctgtggtggttaaggtcatgggtaggactggttcaaggggtcaggttactcaggttcgagtgaagtttaccgactctgatcgttacatcatgaggaatgttaaaggaccagtgagggaaggtgatatcctcaccttgctcgagtctgagagagaagctaggagacttcgttgatcttcttcttcatactccaaaatgcggaaacaagaaaacatttggttatttctcttttgctttctttgattggattagtggattatgcatttggagtcttaattttgttgttgctttaagacaattgctgctggatttataagttgtttggtattcaaaatctcttcatcccttttttatattgttcatcaagaatttgctctattctccatcttgttctacctgaatcatgtgttttgggttatgtttataacttgggtaagcagtggtgtggtcttgccatcgccacagatcttggattcgt

SEQ ID NO: 4422 - DNA, 438 bp, Brassica juncea
ggggctggaaaattagggttctcgcttcttctctaaccgccgctaagctcccaccatctctacagaatggattctcagattaagcacgccgtggtggtgaaggtgatgggacgtacggggtccaggggtcaggtgactcaggttcgagtcaagttcactgactctgaccgtttcattatgcgaaatgttaaaggacccgtgagggagggagacatcctcaccttgctcgagtccgagagagaagccaggagacttcgttgatccacctgcaagaacacagagcaatgtctgcttagttcccttttttctttgcttcttgtgtctggattagtgattatgcacttttggattgtgtttggttgttgctataagacaattcctggattgatttctggcttttctgggtcttcagagtttattgtgatgaaattcaaatca

SEQ ID NO: 4423 - DNA, 825 bp, Brassica juncea
cgatctgaatggattctcagatcaagaagctacgcggggaggtttctttttagcaaactcgatttcacgtagcttcttgagcaccccgccgcatcactcaacagaatggattctcagatcaagcacgcggtggtagtgaaagtgatggggaggacaggttctcgtggtcaggtgacacaggtcagagtgaagttcacagattcagaccgttttatcatgaggaatgtgaaaggaccggtgagagaaggagacatcctcactcttctcgagtccgagagagaagcaagaagactccgttgattcaatatgcccaccatcattctcttccaaagccacaagtgttttggcttcttttttgtttttggttgcgtataagaatatgctctgttttaattactcgagtctttattgttaagacaatgttttgaatctagaaacaaatttttttagagacaaaaaaaaagttttcacaatcatttatttaagagtttataagtgacaacacacatcctttatcacaccaaattaacagtaaaaatacacataaacttggtaaatacagacttcgggtagccttattttatttaaacaaagagaatggctttttaacttataatggactccaatatgatgacaaactattattattattattttggacaacatctgatgaaacttataattaccaggttttacgtagaacccaacgatcttttaaccagaaccagtctcgaagtgagccccaatggcatcgatggcagtaccatcgcgtccataaattccaagaagctttcctccattttcacctttgagttcgaagtcttt

SEQ ID NO: 4424 - DNA, 379 bp, Brassica juncea
ctccgccgcctctccctgagccgtcgtctttagaatggattctcagattaagcacgccgtggtggtgaaagtgatgggtcgtactggatccaggggtcaggtgacccaggtacgagtgaagtttacagactctgatcgttacattatgaggaacgttaagggaccagtgagagaaggcgatatcctcaccttgctcgagtctgagagagaagctaggagacttcgttgattcgtcttgttcttgttccttctccagtagaaacaagaagacagaaccatgtctgctttatctctcttttttttctgttttctgtgtctggattagtgattatgccttcgaattgaattttgttttactataagacatttcatggattga

SEQ ID NO: 4425 - DNA, 475 bp, Brassica juncea
cggcgatgcaaaaaccctaagttctctctccgccgcctctccctgagccgtcgtctttagaatggattctcagattaagcacgccgtggtggtgaaagtgatgggtcgtactggatccaggggtcaggtgacccaggtacgagtgaagttcacagactctgatcgttacatcatgaggaacgttaagggaccagtgagagaaggtgacatcctcaccttgctcgagtctgagagagaagctaggagacttcgttgattcgtcttgttcttgttccttctccactagtagaaacaagaagacagaaccatgtctgctttatctctcttttttctgttttctgtgtctggattagtgattatgccttcgaattgaattttgttttgcaagacatttcatggattgatttatgttctcatcttatcatttttgtttgaaatcatcagtacatcatcactctccaaaatctcttggatt

SEQ ID NO: 4426 - DNA, 492 bp, Brassica juncea
acgcagagtacgggggctctagaaattagggtttttgcatcgccgctaagctctctcaccttcgcgtcttcttcagattgaatcagaatggattctcagattaagcacgccgtggtggtgaaagtgatgggacgtactggatccaggggtcaggtgactcaggttcgagtcaagttcacagactccgatcgttacattatgagaaacgtcaagggacccgtgagagaaggcgatatcctcaccttgctcgagtctgagagagaagctaggcgacttcgttgattcgccttttgttcttgttccttctccactagtagaaacaagaggacagaactatgtctggttctttctctttttgccttctttgactggattcgtgttggattttgttttaagacatttcatgttttgatttttgttctggtcttatcatattttgtttgaaactcttatatcatatcttcgcgtaaccaggcctcttggccgagtctg

SEQ ID NO: 4427 - DNA, 497 bp, Brassica juncea
cgctgagtacgcgggggttctagcttcttcgcttgccgccgctaagctctcaccttcgtctacagaatggattctcagattaagcacgctgtggtggtgaaagtgatgggacgtacggggtcaaggggtcaggtgactcaggttcgagtcaagttcacagactctgatcgttacatcatgcgcaatgttaaaggacctgtgagagaaggtgacatcctcaccttgctcgagtccgagagagaagctaggagacttcgttgatccaccttcctccacaggtggaagcaagaatactgaaccaaatgtctctgcttgtttctctctttttttgcttcttgtgactggattagtgattatgcactcaggttgtgtttggttgttactggtataagacaattcctggattggtatttgttctgtctttttttgggtcttcagagtttattgtgtgaaactcatattatcttcccatcaagaattcatagattagcatgttc

SEQ ID NO: 4428 - DNA, 446 bp, Brassica juncea
gatttgacgtagctttttgagcacccgccgcaaacagtaaacagaatggattctcagatcaagcatgctgtggttgtcaaagtgatggggaggactggttcgcgtggtcaggtgactcaggtgagagtgaagttcacagactcggaccgttttatcatgaggaatgtgaaaggaccggtgagggaaggagacatcctcactcttctcgagtccgagagagaagccagaagactccgttgattctcttatgcaaagtcttctcaggatttacattttgatgctcatttagctttttgttttcgtctgagattgaagcctttgttgttaagacaatgtttgaatctagaaatgaatcttttatgacaaacgttttgtgccaccattgtcattaccgtaaacgttacaacgattaatacaatttttcgacaaaaaaaaaaaaaaaaaaa

SEQ ID NO: 4429 - DNA, 488 bp, Brassica juncea
tcgccgctaagctctctcacctccgcgtcgtcttcagattgaatcagaatggattctcagattaagcacgccgtggtggtgaaagtgatgggacgtactggatccaggggtcaggtgactcaggttcgagtcaagttcaccgactctgatcgttacattatgagaaacgtcaagggacccgtgagagaaggcgatatcctcaccttgctcgagtctgagagagaagctaggagacttcgttgattcgccttttgttcttgttccttctccactagtagaaacaagaggacagaactatgtctggttctttctctttttgccttctttgactggattcgtgttggattttgttttaagacatttcatgttttgatttttgttctggtcttatcatattttgtttgaaactcttatatcatatcttcgcgtaaccaggcctcttggccgagtctgaaccattcatcaaccaaagcgatttagactcggcc

SEQ ID NO: 4430 - DNA, 407 bp, Brassica juncea
ggaaacttagggtttttgtctcttcgcttatcgccgctaagcgctctccgtcgtctctacagaatggattctcagattaagcacgccgtggttgtgaaagtgatgggtcgtactggatccaggggtcaggtgactcaggttcgagtgaagttcacagactctgatcgttacattatgagaaacgtcaagggacccgtgagagaaggcgacatcctcaccttgctcgagtctgagagagaagccaggagacttcgttgattgattgtcttttttctaccgcaaagtggaaacagaacaatgtcttttttatcttctgtgactggtttagtcattgtgatttggtttgttgctttaagacagttgctggattgatatggttatttggtgttcaaaaaagcctcttcgta

SEQ ID NO: 4431 - DNA, 372 bp, Brassica juncea
ccgccgcctccttttacagaatggattctcagatcaagcacgccgtggtcgtgaaggttatggggagaactggttctcgtggtcaggtgactcaggttagagtcaagttcacagattcggaccgttttatcatgaggaatgttaaaggaccggtgagggaaggagacatcctaactcttctcgagtccgagagagaagccagaagactccgttgattcatatgccattctctatgaaagtgttaccatgatctacagttgccctcttatgtttcttaaccttatggttgtctttttgtctaagaaatactctgttttaattacttgaattttgttgagacaatgtttgaatcgagaaatgaatcttttttca

SEQ ID NO: 4432 - DNA, 473 bp, Brassica juncea
aacgcagagtacgcggggatctctggaaattagggttctagcttcttcgcttgccgccgctaagctctcaccttcgtctacagaatggattctcagattaagcacgctgtggtggtgaaagtgatgggacgtacggggtcaaggggtcaggtgactcaggttcgagtcaagttcacagactctgatcgttacatcatgcgcaatgttaaaggacctgtgagagaaggtgacatcctcaccttgctcgagtccgagagagaagctaggagacttcgttgatccaccttcctccacaggtggaagcaagaatactgaaccaaatgtctctgcttgtttctctctttttttgcttcttgtgactggattagtgattatgcactcaggttgtgtttggttgttactggtataagacaattcctggattggtatttgttctgtctttttttgggtcttcagagtttattgtgtgaaac

SEQ ID NO: 4433 - DNA, 410 bp, Brassica juncea
gcttacttgaaatcgattctgctcccgccgcctccttctacagaatggattctcagatcaagcacgccgtggtcgttaaggtcatgggtagaactggttctcgtggtcaggtgactcaggttagagtcaagttcacagattcggaccgttatattatgaggaatgtgaaaggaccggtgagagagggagacatcctaactcttctcgagtccgagagagaagccagaagactccgttgattcatatgcgccattctctatgaaagtgttaccatgatttacagtttgatgatgccctcttatttttcttgaccgcatggttgtctttttgtctaagaagtactctgttttaattacttgagttttgctaagacaatgtttggatctagaaatgaatcacttttaaatcgg

SEQ ID NO: 4434 - DNA, 444 bp, Brassica juncea
gtttaaacagtttttaggtttcattttagcagagactcgattcacgtgagcactcgccgcctcctcctccgtctacagcagaatggattcgcagatcaagcacgccgtggtcgtgaaagtcatggggagaactggttctcgtggtcaggtgactcaggttagagtcaagttcacggattcagaccgttttattatgcggaatgtgaaaggaccggtgagggaaggagacatcctcactcttctcgaatccgagagagaagccagaagactccgttgattccatcatattttcttttctttcttccattgttctaccaatatttttatgttttcatgagatagaaaggattataaaccttgtcggattaagtatcttcttcctctctctctattcataatcacttgagataagtgttactaagctttaaatgataattcatgtga

SEQ ID NO: 4435 - DNA, 436 bp, Brassica juncea
ttagggttctcgcttcttctctaaccgccgctaagcccccaccatctctacagaatggattctcagattaagcacgccgtggtggtgaaggtgatgggacgtacggggtccaggggtcaggtgactcaggttcgagtcaagttcactgactctgaccgtttcattatgcgaaatgttaaaggacccgtgagggagggagacatcctcaccttgctcgagtccgagagagaagccaggagacttcgttgatccacctgcaagaacacagagcaatgtctgcttagttcccttttttctttgcttcttgtgtctggattagtgattatgcacttttggattgtgtttggttgttgctataagacaattcctggattgatttctggcttttctgggtcttcagagtttattgtgatgaaattcaaatcatcttcacatc

SEQ ID NO: 4436 - DNA, 297 bp, Brassica juncea
ggggatctctggaaaattagggttctcgcttcttctctaaccgccgctaagctcccaccatctctacagaatggattctcagattaagcacgccgtggtggtgaaggtgatgggacgtacggggtccaggggtcaggtgactcaggttcgagtcaagttcacagactctgatcgttacatcatgcgcaatgttaaaggacctgtgagggaaggagacatcctcaccttgctcgagtccgagagagaagccaggagacttcgttgatccaccttcctccacaggtggaagcaagaata

SEQ ID NO: 4437 - DNA, 445 bp, Brassica juncea
gttactctctccgccgcctctccctcgagccgtccgtcgtttagtaatggattctcagattaagcacgccgtggtggtgaaagtgatgggtcgtactggatccaggggtcaggtgacccaggtacgagtgaagtttacagactctgatcgttacattatgaggaacgttaagggaccagtgagagaaggcgatatcctcaccttgctcgagtctgagagagaagctaggagacttcgttgattcgtcttgttcttgttccttctccagtagaaacaagaagacagaaccatgtctgctttatctctctttttttctgttttctgtgtctggattagtgattatgccttcgaattgaattttgttttactataagacatttcatggattgatttatgttctcgtctcatcatatttttgtttgaaatcatcagtacatcatcactc

SEQ ID NO: 4438 - DNA, 437 bp, Brassica oleracea
gatctctggaaaattagggttctcgcttcttctctaaccgccgctaagctcccaccatctctacagaatggattctcagattaagcacgccgtggtggtgaaggtgatgggacgtacggggtccaggggtcaggtgactcaggttcgagtcaagttcactgactctgaccgtttcattatgcgcaatgtgaagggacccgtgagggaaggagacatcctcaccttgctcgagtccgagagagaagccaggagacttcgttgatccacctgcaagaacacagaacaatgtctgcttagttccctattttttttttgcttcttgtgtctggattagtgattatgcacttggattgtgtttggttgctgctataagacaattcctggattgatatttgttctggtttttttttgggtcttcagagtttattgtttcacac

SEQ ID NO: 4439 - DNA, 427 bp, Brassica oleracea
gctctagaaattagggtttttgcatcgccgctaagctctctcacctccgcctctccctgagccttcgtcttcagaatggattctcagattaagcacgccgtggtggtgaaagtgatgggtcgtactggatccaggggtcaggtgacccaggtacgagtgaagttcacagactctgatcgttacattatgaggaacgttaagggaccagtgagagaaggtgacatcctcaccttgctcgagtctgagagagaagctaggagacttcgttgattcgccttgttctttgttccttctccactagtagaaacaagaagacagaactatgtcttgctttatctctcttttttctgttttctgtgtctggactagtgattatgctttcgaattgaattttgattttgctataagacatttcatggattgattt

SEQ ID NO: 4440 - DNA, 411 bp, Brassica rapa
gaggtattttagcaaactcgacgatttgacgtagctttttgagcacccgccgcaaacagtaaacagaatggattctcagatcaagcatgctgtggttgtcaaagtgatggggaggactggttcgcgtggtcaggtgactcaggtgagagtgaagttcacagactcggaccgttttatcatgaggaatgtgaaaggaccggtgagggaaggagacatcctcactctcctcgagtccgagagagaagccagaagactccgttgattctcttatgcaaagtcttctcaggatttacattttgatgctcatttagctttttgttttcgtctgagattgaagcctttgttgttaagacaatgtttgaatctagaaatgaatcttttatgacaaacgttttgtgccaccattgtcat

SEQ ID NO: 4441 - DNA, 472 bp, Brassica rapa
ggcctctctctctctctcatctctggaaaattagggttctcgcttcttctctaaccgccgctaagctcccaccatctctacagaatggattctcagattaagcacgccgtggtggtgaaggtgatgggacgtacggggtctaggggtcaggtgactcaggttcgagtcaagttcactgactctgaccgtttcattatgcgaaatgttaaaggacccgtgagggagggagacatcctcaccttgctcgagtccgagagagaggccaggagacttcgttgattcacctgcaagaacacagaaccatgtctgcttagttcccttttttatttgcttcttgtgtctggattagtgattatgcacttttggattgtgtttggttgttgctataagacaattcgtggattgatatttgttctggttttttgagggtcttcagagtttattgtgatgaaattcaaatcatcttcacatc

SEQ ID NO: 4442 - DNA, 481 bp, Brassica rapa
ggcttctctagaaattagggtttttgcatcgccgctaagttctctctccgccgcctctccctgagccgtcgtctttagaatggattctcagattaagcacgccgtggtggtgaaagtgatgggtcgtactggatccaggggtcaggtgacccaggtacgagtgaagtttacagactctgatcgttacattatgaggaacgttaagggaccagtgagagaaggcgatatcctcaccttgctcgagtctgagagagaagctaggagacttcgttgattcgtcttgttcttgttccttctccagtagaaacaagaagacagaaccatgtctgctttatctctctttttttctgttttctgtgtctggattagtgattatgccttcgaattgaattttgttttactataagacatttcatggattgatttatgttctcgtctcatcatatttttgtttgaaatcatcagtacatcatctctctgc

SEQ ID NO: 4443 - DNA, 427 bp, Brassica rapa
atctctggaaaattagggttctcgcttcttctctaaccgccgctaagctcccaccatctctacagaatggattctcagattaagcacgccgtggtggtgaaggtgatgggacgtacggggtcaaggggtcaggtgactcaggttcgagtcaagttcactgactctgatcgtttcattatgcgaaatgttaaagggcctgtgagggagggagacatcctcaccttgctcgagtccgagagagaggccaggagacttcgttgattcacctgcaagaacacagagcaatgtctgcttagttccttttttttttgcttcttgtgtctggattagtgattatgcacttttggattgtgtttggttgttgttataagacaattcctggattgatatttgttctggttttttgagggtcttcagagtttattgt

SEQ ID NO: 4444 - DNA, 424 bp, Phaseolus coccineus
  misc_feature (46)..(46): n is a, c, g, or t
ggactctggttagcaagcatcgcaaaaccctaccctactttcttcnctcgttttttatttcaggatggactctcaggtgaagcatgcttttgttgtcaaagttatgggtcgtactggatccagagggcaggtgccccaggttagagtgaagtttttggatgatcagaatcgtcccttcatgaggaatgtgaaaggccctgttagagaaggagccattctccccctcctcgattccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtctaagttttaagattgaagtatgattggcttgat

SEQ ID NO: 4445 - DNA, 425 bp, Phaseolus coccineus
  misc_feature (113)..(113): n is a, c, g, or t
  misc_feature (115)..(115): n is a, c, g, or t
  misc_feature (147)..(147): n is a, c, g, or t
  misc_feature (176)..(176): n is a, c, g, or t
  misc_feature (282)..(282): n is a, c, g, or t
  misc_feature (343)..(343): n is a, c, g, or t
ggactttggttagcaagcatcgcaaaaccctaccctacttttttcactcgttttttatttcaggatggactctcaggtgaagcatgctcttgttgtcaaagttaggggtcgtncnggatccagagggcaggtgccccaggttagagngaagtttttggatgatcagaatcgtcccntcatgaggaatgtgaaaggccctgttagagaaggagacattctccccctcctcgaatccgagagggaagcaagaagattgcgctagatggtttaaatcgaaccagnggcttgatttttgtggtagttagtggatgccaaaggttatatcaccctatcttgatgtttnggatctatttttattcgaattatggacggaattttgttgtttttagtctaagttttaagattgaagtatgattggcttgata

SEQ ID NO: 4446 - DNA, 481 bp, Brassica napus
atcaacgcagagtacgcggggaggtttttcagcagaatcgatttcacgtaaagctcccgccgcctccttctacagaatggattctcagatcaagcacgccgtggtcgtgaaggttatggggagaactggttctcgtggtcaggtgactcaggttagagtcaagttcacagattcagaccgttttattatgaggaatgttaaaggaccggtgagggaaggagacatcctaactcttctcgagtccgagagagaagccagaagactccgttgattcatatgccattatctatgcaagtgctaccatgttttacagtttgatgatgccctcttatgtttcttgaccttatggttgtttttttgtctaagaaatactctgttttaatttacttgaattttgttaagactgtttgattcgagaaatgaatcttttttcatacatgaaacttttaaatcggtaaaatatttaggtggcaacattttt

SEQ ID NO: 4447 - DNA, 465 bp, Brassica napus
agaatcgatttcacgtaaagctcccgccgcctccttctacagaatggattctcagatcaagcacgccgtggtcgtgaaggttatggggagaactggttctcgtggtcaggtgactcaggttagagtcaagttcacagattcagaccgttttattatgaggaatgttaaaggaccggtgagggaaggagacatcctaactcttctcgagtccgagagagaagccagaagactccgttgattcatatgccattatctatgcaagtgctaccatgttttacagtttgatgatgccctcttatgtttcttgaccttatggttgtttttttgtctaagaaatactctgttttaatttacttgaattttgttaagacaatgtttgaatcgagaaatgaatcttttttcatacatgaaacttttaaatcggtaaaatatttaggtggcaacatttttcatctatggtatatc

SEQ ID NO: 4448 - DNA, 432 bp, Brassica napus
gctctagaaattagggtttttgcatcgccgctaagttctctctccgccgcctctccctgagccgtcgtctttagaatggattctcagattaagcacgccgtggtggtgaaagtgatgggtcgtactggatccaggggtcaggtgacccaggtacgagtgaagtttacagactctgatcgttacattatgaggaacgttaagggaccagtgagagaaggcgatatcctcaccttgctcgagtctgagagagaagctaggagacttcgttgattcgtcttgttcttgttccttctccagtagaaacaagaagacagaaccatgtctgctttatctctctttttttctgttttctgtgtctggattagtgattatgccttcgaattgaattttgttttactataagacatttcatggattgatttatgttctcgt

SEQ ID NO: 4449 - DNA, 552 bp, Brassica napus
tggttgatccccagttactatatggcgatttgtgtaccgggcccccccatcgccgctaagttctctctccgccgcctctccctgagccgtcgtctttagaatggattctcagattaagcacgccgtggtggtgaaagtgatgggtcgtactggatccaggggtcaggtgacccaggtacgagtgaagtttacagactctgatcgttacattatgaggaacgttaagggaccagtgagagaaggcgatatcctcaccttgctcgagtctgagagagaagctaggagacttcgttgattcgtcttgttcttgttccttctccagtagaaacaagaagacagaaccatgtctgctttatctctctttttttctgttttctgtgtctggattagtgattatgccttcgaattgaattttgttttactataagacatttcatggattgatttatgttctcgtcttatcatatttttgtttgaaatcatcagtacatcatcactctccaaaatctcttggattaatcaaccgaaatgatatagaaagttctaagccat

SEQ ID NO: 4450 - DNA, 433 bp, Brassica napus
atcaacgcagagtacgcggggaggttttttagcagaatcgatttcacgtaaagctcccgccgcctccttctacagaatggattctcagatcaagcacgccgtggtcgtgaaggttatggggagaactggttctcgtggtcaggtgactcaggttagagtcaagttcacagattcggaccgttttatcatgaggaatgttaaaggaccggtgagagaaggagacatcctaactcttctcgagtccgagagagaagctagaagactccgttgattcatatgccattatctatgaaagtgttaccatgatctacagttgccctcttatgtttcttgaccttatgattgtctttttgtctaagaaatactctgttttaattacttgaattttgttaagacaatgtttgaatcgagaaatgaatcttttttcatacat

SEQ ID NO: 4451 - DNA, 504 bp, Brassica napus
gaagcactcctataaaagctaaagagaacgcctctcgctctcatctctggaaaattagggttctcgcttcttctctaaccgccgctaagctcccaccatctctacagaatggattctcagattaagcacgccgtggtggtgaaggtgatgggacgtacggggtcaaggggtcaggtgactcaggttcgagtcaagttcactgactctgatcgtttcattatgcgaaatgttaaagggcctgtgagggagggagacatcctcaccttgctcgagtccgagagagaggccaggagacttcgttgattcacctgcaagaacacagagcaatgtctgcttagttcctttttttttttgcttcttgtgtctggattagtgattatgcacttttggattgtgtttggttgttgctataagacaattcctggattgatatttgttctggttttttgagggtcttcagagtttattgtttcatcttcacatcaagaattcgtatattagtat

SEQ ID NO: 4452 - DNA, 431 bp, Brassica napus
tttttagcaaactcgacgatttgacgtagctttttgagcacccgccgcaaacagtaaacagaatggattctcagatcaagcatgctgtggttgtcaaagtgatggggaggactggttcgcgtggtcaggtgactcaggtgagagtgaagttcacagactcggaccgttttatcatgaggaatgtgaaaggaccggtgagggaaggagacatcctcactcttctcgagtccgagagagaagccagaagactccgttgattctcttatgcaaagtcttctcaggatttacattttgatgctcatttagctttttgttttcgtctgagattgaagcctttgttgttaagacaatgtttgaatctagaaatgaatcttttatgacaaacgttttgtgccaccattgtcattaccgtaaacgttacaacgattaat

SEQ ID NO: 4453 - DNA, 403 bp, Brassica napus
ctttttgagcacccgccgcaaacagtaaacagaatggattctcagatcaagcatgctgtggttgtcaaagtgatggggaggactggttcgcgtggtcaggtgactcaggtgagagtgaagttcacagactcggaccgttttatcatgaggaatgtgaaaggaccggtgagggaaggagacatcctcactcttctcgagtccgagagagaagccagaagactccgttgattctcttatgcaaagtcttctcaggatttacattttgatgctcatttagctttttgttttcgtctgagattgaagcctttgttgttaagacaatgtttgaatctagaaatgaatcttttatgacaaacgttttgtgccaccattgtcattaccgtaaacgttacaacgattaata

SEQ ID NO: 4454 - DNA, 490 bp, Brassica napus
gctctggaaacttttagggtttttgactctttgcttatcgccgctaagctctctagcctccgcgaaccgcggtttctacagtcaagcagaatggattctcagattaagcacgccgtggtggtgaaagtgatgggacgcactgggtcaaggggtcaggtgacgcaggttcgagtgaagttcacagactctgatcgttatattatgagaaacgttaagggacccgtgagagaaggcgatatcctcaccttgctagagtctgagagagaagccaggagacttcgttgattcgcctttttatttttctacaagttggagaaaagaaaacagaacaatgtctacttatttgtctttatggtctctgtgagcggtttagtgattatgctttggtttgttgctatgagacagtggctggattgatatggtgtattttggtattcaaagtctattcttatctgtttgtttcaaatcattactttggttatgttcttaa

SEQ ID NO: 4455 - DNA, 462 bp, Brassica napus
gggaaacttttagggtttttgactctttgcttatcgccgctaagctctctagcctccgcgaaccgcggtttctacagtcaagcagaatggattctcagattaagcacgccgtggtggtgaaagtgatgggacgcactgggtcaaggggtcaggtgacgcaggttcgagtgaagttcacagactctgatcgttatattatgagaaacgttaagggacccgtgagagaaggcgatatcctcaccttgctagagtctgagagagaagccaggagacttcgttgattcgcctttttatttttctacaagttggagaaaagaaaacagaacaatgtctacttatttgtctttatggtctctgtgagcggtttagtgattatgctttggtttgttgctatgagacagtggctggattgatatggtgtattttggtattcaaagtctattcttatctgtttgtttcaaa

SEQ ID NO: 4456 - DNA, 439 bp, Brassica napus
gctctctcatctctggaatattagggttctcgcttcttctctaaccgccgctaagctcccaccatctctacagaatggattctcagattaagcacgccgtggtggtgaaggtgatgggacgtacggggtccaggggtcaggtgactcaggttcgagtcaagttcactgactctgaccgtttcattatgcgaaatgttaagggacccgtgagggaaggagacatcctcaccttgctcgagtccgagagagaagccaggagacttcgttgatccacctgcaagaacacagaacaatgtctgcttagttccctatttttttttcgcttcttgtgtctggattagtgattatgcacttggattgtgtttggttgttgctataagacaattcctggattgatatttgttctgttttttttgggtcttcagagtttattgtttca

SEQ ID NO: 4457 - DNA, 427 bp, Brassica napus
ctggaaaattagggttctcgcttcttctctaaccgccgctaagctcccaccatctctacagaatggattctcagattaagcatgctgtggtggtgaaggtgatgggacgtacggggtcaaggggtcaggtgactcaggttcgagtcaagttcactgactctgaccgtttcattatgcgaaatgttaagggacccgtgagggaaggagacatcctcaccttgctcgagtccgagagagaggccaggagacttcgttgatccacctgcaagaacacagagcaatgtctgcttagctcccttttttctttgcttcttgtgtctggattagtgattatgcacttttggattgtgtttggttgttgctataagacaattcctggattgatatttgttctggttttttgagggtcttcagagtttattgtttc

SEQ ID NO: 4458 - DNA, 431 bp, Brassica napus
atcaacgcagagtacgcggggaggtttttagcaaactcgacgattgttcacgtagcttcttgagcacccgccgcttccgtcaacagaatggattctcagatcaagcacgccgtggttgttaaagtgatggggagaacaggttcgcgtggtcaggtgactcaggtaagagtgaagttcacagactcggaccgttttatcatgaggaatgtgaaaggaccggtgagggaaggagacatcctcactctcctcgagtccgagagagaagccagaagactccgttgattcttatgcaaagtcttctcaagatttaacattttgatggtcatttctctttttgtttttctctaagaaaactgctatgtgttaattagtctttattgttcagacaatgtttgaagaatttttaagactaaacatatgtgccattatta

SEQ ID NO: 4459 - DNA, 424 bp, Brassica napus
ctctagaaattagggtttttgcatcgccgctaagctctctcacctccgcctctccctgagccttcgtcttcagaatggattctcagattaagcacgccgtggtggtgaaagtgatgggtcgtactggatccaggggtcaggtgacccaggtacgagtgaagttcacagactctgatcgttacattatgaggaacgttaagggaccagtgagagaaggtgacatcctcaccttgctcgagtctgagagagaagctaggagacttcgttgattcgccttgttctttgttccttctccactagtagaaacaagaagacagaactatgtcttgctttatctctcttttttctgtattctgtgtctggactagtgattatgctttcgaattgaattttgattttgctataagacatttcatggattgat

SEQ ID NO: 4460 - DNA, 439 bp, Brassica napus
atcgccgctaagctctctcacctccgcctctccctgagccttcgtcttcagaatggattctcagattaagcacgccgtggtggtgaaagtgatgggtcgtactggatccaggggtcaggtgacccaggtacgagtgaagttcacagactctgatcgttacattatgaggaacgttaagggaccagtgagagaaggtgacatcctcaccttgctcgagtctgagagagaagctaggagacttcgttgattcgccttgttctttgttccttctccactagtagaaacaagaagacagaactatgtcttgctttatctctcttttttctgttttctgtgtctggactagtgattatgctttcgaattgaattttgattttgctataagacatttcatggattgatttatgttctggtcttatcatatttttgttttaaactc

SEQ ID NO: 4461 - DNA, 510 bp, Ceratodon purpureus
cttctccttccttgcgcgccttgcttccgcaggccctcctgccaccatggataccgccgtgaagttggctattgtgatgaaggtgatcggacgtaccggatcacgaggacaggtgacgcaagtgcgcgtcaagtttttggacgaccagaaccgtctcatcatgcgcaacgtcaagggcccagtgcgcgaaggagacatcttgactctccttgagtctgagcgcgaagctaggaggttgcggtgaggaaatcagttcctcatggcaggccaaggatgcagtatgaaaagtttagttctgctcatatgtgcatcctgatattcgcttcttagggacttacgttgagcatgattattttgcacacattgtagttcctgaaagacaaatttcgctggagtgtttatctggtctgcgtgacatattccgacgctattatcaattgaggaagttcacctaatttcggattcaattgttgtttgttactactcattctatgtgaatatttccctttt

SEQ ID NO: 4462 - DNA, 698 bp, Ceratodon purpureus
acttcaagcattgttacacaagcactataaatgaattcctctgcctatcgtacgacacctcggtggcagaggatctggagatgctatccaagaagatacccctcagatctccaaataagaagtgtccttccaattcaagcctctataagatttgcctcgcgcctccgctccctctcgccacgccctctgctgcagcacgctctccctcggcccggcatcatggataccgccgtgaagttggctattgttatgaaggtgattggacgtaccgggtcccgaggacaggtgacgcaggtgcgcgtcaagtttttggatgaccagaaccgtctcatcatgcgtaacgtcaagggcccagtccgtgaaggtgacatcttgactctccttgagtctgagcgtgaagcaaggaggttgcggtgaggaacgagagtttttcatggcaggccactggtgcagtattgaatatttagttggggttacatgtgttcgctgatcttgcatcctgagtgcatcaggttgcgcgtggtctaatcccacacactgtagttcctggcgtgcaatatgttgcaaaaagtttttttctggcctacatgatgtagtttagcatttctgtggattgaggattcagtttgggattgtttttgaatgtgcgtgcacggattcgattttctcaaagaaactatttaccagtgaaatttctc

SEQ ID NO: 4463 - DNA, 703 bp, Ceratodon purpureus
cggcctttctcgctcaccaacccttacttgagctctctagttctcgatcactttgtgtttacggtgcgctgccgttgcagttcggaccggagggaacatggattccgccatcaagttggcgatcgtgatgaaggtcatcgggcgtacgggctctagaggccaggtgacgcaggttcgcgtcaagtttctcgacgaccagaaccgtctcatcatgcggaacgtcaagggccccgtccgcgaaggggatattcttacgctgctcgagtccgagcgtgaagcccgccgtctgcgttgatcggtttaccttacatgcgctgagatttggcttcatcggttgagttctttgggtgctttgacatatgatctatatgccgaggagctgcgtcttccaaaatattgagattgttttcgtggaacttgtattacgatagaccacagtgtgttacactgtcatccttcgaagaactgtttataatgtgcacaaatgtataaataaaacagagttttagaacttaacttcacatataacgtcctgaaattgttgcacacgcgtcttgaatgagctatattagtgtacttttacaagtttttgggagttacagttgttttaaatctcacaaccatttgagtttcacatttaaatgaatggggaatggagatcttattataatgccttgtttctgtactttatgtacagagcttg

SEQ ID NO: 4464 - DNA, 524 bp, Cleome gynandra
tcggggtctggaaattagggttttgccttttgttctctcgagccgccgttcgcctttgtttacagctgtttttgttctgaatcagaatggattctcaaattaagcacgcagtggttgtcaaggtgatggggaggactggatcaagaggtcaggtcactcaagtcagagtgaagttcaccgactctgatcgttacattatgaggaatgtcaaaggaccagtcagagaaggtgacatcctcactctgctcgaatccgagagagaagctaggagacttcgttgatgtgctattcactcgtcgtctctttgcttgcatctcaacagccaagtaaaaagtctgatggatcattttgttttcgagttctgagacttggttagtgattaagattgcgattttgttattcggttaagacaattctgtgcgacagttctggtgccatgtcttctatcttctgaatctcttcatcacaaaaagtacatctaatttagttgatgcaagcataagatatatgatcttatttgcaaa

SEQ ID NO: 4465 - DNA, 308 bp, Cleome gynandra
tcggggtcgattgtagggttttggctttctgttctcacgagccgctacgcagagtcgccgttcgtcttcctttacagaatggattctcagattaagcatgccgtggtggtgaaggtgatggggaggactggatccagaggtcaagtcactcaggtcagggttaagttcaccgactctgatcgttacattatgaggaatgtcaaaggaccagtgagagaaggtgacattctcactttgcttgaatctgagagagaagccaggagacttcgttgatgtgttgtttagtggcaatctcactttcgttgatg

SEQ ID NO: 4466 - DNA, 326 bp, Cleome gynandra
cttccaaacttagggttctctgttttctcagaattgtcaaagctcgagcagtgcggccgccgtctccgtttacaggatggattcacaaatcaagcatgccgtggtggtgaaggtgatggggaggactggatcccgtggtcaggtcactcaggttagagtgaagttcactgattcagatcgttacatcatgaggaatgtgaaagggccagtgagagaaggcgacatccttactctcctcgagtctgagagagaagccaggagacttcggtgatgatagttcttcttctcatacccttcactcgaaaccaacagattacgttgcgggc

SEQ ID NO: 4467 - DNA, 424 bp, Medicago truncatula
agggtttcagtgtcttgtcttttcgccgcagagcttgattgagatcttctctttctctgtccaccgcaaccaaagaatggattctcaaatcaagaatgctgttgttgtcaaggtaataggtcgtactggttctagaggacaggtgactcaagttagggtcaagtttaatgatgattcgaaccgtcacatcatgaggaacgtgaagggaccagttagagaaggagacaccctcaccctgcttgagtctgaaagagaagcaagaaggttgcgctagagaaactcagcggtttggtctggtgcaggattcaataaacatttgttttttggggattatttagtagatgtcaaatgttattgtcaaacacttcaattttgcaccttttatttgcttgaatttttaataaaattttacttttatttgata

SEQ ID NO: 4468 - DNA, 710 bp, Mesostigma viride
tctgaacctgctgctgtgacacaaaatggacgccccagttaagctcgctattgtcatgaaggtgatcggtcgcactggatcgcgtggtcaggtcacgcaggtccgtgtcaagttccttgacgaccagaaccgcctcattatgaggaacgtcaagggacctgtccgtgaaggggacatcctcaccttgctcgaatctgagcgtgaggcccgacgacttcggtagacggtggtaacacggattcacttaatgcggggcatatatatgttgatttacacgtcatgaaagggggcagtgaccgagacgtacgaaagctgggatggggcggaaattccagtgcaatctgatgattggcttgccaaaaaatgccaagctcccccttttatgtacagaatatgccaatcgcagtggaaattatcgtggttaccagccggcgtgtcaccatgtagctattttgcaaattgaacgcatgggtgctgaaggggttaagcccatgtgagtaactgtggaagtttgtcagccacggcttctgtttgaactttggcttacctgagtggattgggccatattggccagtcacggcaatattctcgtggtgtccgaccacgcgcagacaccggccaagttttggttgcatggcggcaaatcggacatacgcttttgcgtggacggaaacctgaatatttgtgaaataaagttgcggaagttgctt

SEQ ID NO: 4469 - DNA, 794 bp, Mesostigma viride
gttgattatggcgtcgaccaggatggatcgggttgctctgaacctgctgctgtgacaaaaaatggacgccccagttaagctcgctattgtcatgaaggtgatcggtcgcactggatcgcgtggtcaggtcacgcaggtccgcgtcaagttccttgacgaccagaaccgtctcattatgaggaacgtcaaaggacctgtccgtgaaggggacatcctcaccttgctcgaatctgagcgtgaggcccgacgacttcggtagacgatggtaaaccgaattcatttaatgtggggcatgtgttcatttacacgtcatgaaagggggcagtgaccgagacgtttgaaaactgtgaagggcaatctgatgattggcttgccaaaaaatgccgagctcccccttttatgtacagatatgccaatggcagtggaaattatcgcggttatcagccgtcgtgtcaccacgtagctattttgcaaattgaacgcatgggtgctgaaggggttaagcccatgttgagtaactgtggaactttgtcagccacggcttctgtttgaactttggctttcccgagtatattgggccatattggccagtcacggcaagattctcgtggtctccaaccacgcgcagacaccggccaaatgtgggttgcatggcggcaaatcggaaatacgccttggcgtggactgaaacctgaatattgtgaaataaagttgcggaagttcttccctcgtgccgaattcggcacgagggccaagttttgcctggagccaacctccgtcaaggtgaaggagga

SEQ ID NO: 4470 - DNA, 591 bp, Orobanche aegyptiaca
cgtagtaacttgtcttagggttccgcctcagttgtccattgaacaaattcttcttcagcggctgcttcccctcgttcatttcgtttcgttttgcagagagaatggattctggaagcaagactgcactggtggtgaaggttatgggaaggacagggtctcgtggacaagtgactcaggttagggtgaaatttaacgatgatagtaaccgtttcattatgagaaatgtcaagggacctgtgagggagggtgatatactcacattgatggagtctgaaagagaggctaggaggctccgctgattgatgatgatgatgacgcctcttcgtattatgcccctgcaatcatttttattactagtaatttgatgtcttagactttctctgtggatttttacccttaaagattgtaatggtgcgttttatttctcaatcgacaattgttcttttcatgtttatcatgtttgtttaatttgattctgcagtttgttattgaatcttcaactattagtttgaaatggttctgttattgtttctcaagtatttagcttctatatggttgcagcattttaattttgaggtgaatgcaacatta

SEQ ID NO: 4471 - DNA, 624 bp, Physcomitrella patens
ctctttcgcaatcgagacttgacgcctcgcgccttcggctctctcgcttgctctgcacttgacaacgttgcaggtcttctcgcctccgcttctcatcatggataccgccgtgaagttggctattgtgatgaaggtcattgggcgcactgggtcccgaggacaggtgacgcaggtgcgcgtcaagttcttggatgatcagaaccgtcttatcatgcgcaacgttaaggggccagtgcgtgaaggtgatattttgaccctcctcgagtctgagcgcgaggcaagaaggttgcgatgaagaactcctatctcctatggcaggccactggagcagtactggaagtttagctgtgctcatacgtgtactcctggacttctccacatcttgacaatctcaagttgtgcatagatttattcttaaaagtgttgttcttgatacgaatactgtaattggcctacactgtatgttttggtgttttagtgaatttctacgtctggtcttatatttcatctcttttgtagtacgtcgtgttttcatgagtgtcgaacttcatgcacaatgcatatgtgatgattccaagatagtcagctcctgtgagcagttcgacggattggcttatttaacac

SEQ ID NO: 4472 - DNA, 579 bp, Physcomitrella patens
aggccaagcccggccaagccaagccaagccctagagctagaagaaagagaagctctgttgtggccagatctctttcgccatctttcgtgagtctgcggcttcgcgcctcggcccctttgtttgtcaactcgctctctcgctcgactacattatggataccgccgtgaagttggctattgtgatgaaggtgatcgggcgtactgggtcccgaggtcaggtgacccaggtgcgcgttaagttcttggatgaccagaaccgtctcatcatgcgcaacgtcaagggacccgtgcgtgaaggtgacattctgactctcctcgagtctgagcgtgaagcaagaaggttgcggtaaggaacagtctgcaatggcaattcaatgatgcagtatcggaagttcaatagtggtcatatgtaccattggtcttcacagcttgagtttctcaagttttggctggcctcataccggaaaatgtagctccatacatgaacatgttcacagaaagctccactcagcctacacggcatattctggcatttttatgaattgaggatctattcactttcttcgagagattggtgtca

SEQ ID NO: 4473 - DNA, 763 bp, Pinus taeda
ggggaccccaaaaaacactcaaaatatttttatctacccgaaaaaactagtaaaagtaacacaaaaaaaacgcgtttaatatagaccgttgctttaacggacggttacgattaactagggtttgaagcggcaagatccgaaaacccattaaaccctaatcagggttgcggtttactctcatctctcaagacgcccgatacacacatctccggctattcggtggagttcgcacagagatcggagctttcaacgtgagcaatcgtcttcgaggaagtcatggataccggtgtgaaattggcagttgtggtgaaagtaattggccgtactggatcaagaggtcaagttacacaggtccgagtaaaatttttggatgatcagaatcgacttatcatgaggaatgtaaaaggacctgtcagagagggtgatgtccttactttgctagaatctgaaagggaagcaaggagattgcgctgattatgttgtttagattatcacattggacttaaagtgagacgggaataacttatattgttatgtgttctgtttctgcattatcttgtactgtagtgtttgctattgttttcgatgcaaagggatcaatgagtgaggctataaatgatttgtgatatgtaatccagaattttacaattaaagtatgaagcctgtcatacttgatggggaattggaacagtaactgtttatttttgtatctggaatgaaattcaaattactgtactgaagattttctgtgaaaatgttattt

SEQ ID NO: 4474 - DNA, 634 bp, Populus trichocarpa
ttttgtgaattggtatttttgaacaatttattaaacctaaattcctaattacataaataccccaaactaagcctactcttcttaacacaaccctaactctaggcattcgtattttctgccttccactttgcaagaaccagaaaaccagctacaggcggctgctgcgttcctctcaggatggattctcagattaagcatgcggttgtgatgaaaattatgggtaggactggatcgagggggcaggtgactcaggttagagtcaagtttcttgatgatccaaatcggttcatcatgaggaatgtgaagggacctgtgagagaaggggatgtcctcactttgcttgagtctgaaagagaggcaaggagactccgctgatctgccaatggtgtcatgagctttcttttaattgaaatatagaagtattttctgtgtggttgatgtcaaaagacttgaaagtttggttcttgagttgctccctgatgttttttttcttgcttcagagtcttttctgtttattgttttcaacgcaccgcccttgctgaggaattttgccttgttgtgggatatatgggtccaatgtgcctttgtcgcgctactctgcttgcttgatgcagtaaaaattattgttgcaatt

SEQ ID NO: 4475 - DNA, 727 bp, Pseudotsuga menziesii
ggggccaacaacgaaaaaccattaaaccctaatcagggttgaattttatacttctcttttaagacgcttgatacacatatctcgggcggttcggtggagtttgcacagagatcggagctttgggcgtgagtattcgtctgagaggaagacatggatactggtgtgaaattggcagttgtggtgaaagtaattggccgtactggatcaagaggtcaagttacacaggtccgagtgaagtttttggatgatcaaaatcgattgattatgaggaatgtaaaaggacctgtaagagagggtgacgtccttactctgctagaatctgaaagggaagcaaggagattgcggtgattatagattatggcatggacttataagtgagaattatgtttcctgtttttgcattagatcatagtgttatgtttgctttttatttcaatgcaaagggagcaatgagtgaggctatgagtgagatctgtgataggtatccataattttacatttaaaactttcagcctatcttacttgatggggaattggaacagtatttatttatttatgcttctggaatgaaattcaaactactataataagattttgtgtgaagaatgactcaataattgtatgttttatttagcaaacgtttagtcaaacgtttattgtttttgtctctttttgtcaactaaaagttagtgcgatttgttttctatttggaactatgtttagctta

SEQ ID NO: 4476 - DNA, 478 bp, Raphanus sativus
ggaggttttctagcagaatcgatttcgcctaagctcccgccgcctccttcttcagaatggattctcaaatcaagcacgccgtggtcgttaaggtcatggggagaactggttctcgtggtcaggtgactcaggttagagtcaagttcactgattcggaccgttttatcatgaggaatgtgaaaggaccggtgagagaaggagacatcctaactcttctcgagtccgagagagaagccagaagactccgttgattccatatgcccatttctctctgaaagtgttaccaatatttacattttgatgatgccctcttatgtttattgaccttatggttgtttttttttttgtctaagaaatactctgttttaattactcgagtttgctaagacaatgtttggatctagaaatgaatctttttcaaatacatgaaactgtggcaacatttatcttctatcagtatatgatcactgtttattca

SEQ ID NO: 4477 - DNA, 478 bp, Raphanus sativus
gggagggtttgtgactcttcgcttatcgccgctaagctctctcgtctccttgaaaccgtcgtttcttcagaatggattctcagattaagcacgccgtggtggtgaaagtgatgggccgtactgggtccaggggtcaggtgactcaggttcgagtcaagttcacagactctgatcgttacattatgagaaacgtcaaggggcccgtgagagaaggcgacatcctcaccttgctcgagtctgagagagaagccaggagacttcgttgattggccttttttctaccgctaagtggaaacaagaaaacagaacaatgtcttgtttctcttttttggtttctgtgaccggtttagtttggtttgttgctttaagacagttgctggattgatattgttatttggtattcaaagcctcttctttatctgtttgtttcaaacgtttctctggttatgttcttaatttgatgacatccacactccga

SEQ ID NO: 4478 - DNA, 648 bp, Raphanus sativus
cttttcatttctctcgaatttgtaattagacaactctgctctgtttgttagataatggaacctagtttccgcttcagacagcgattaggaacaaggattgttagtttgtgtttgtcttaattcgtaatcagcacacactagtcacgtgctatgttcttacgattgtgtaacagattcattcatgttgaagcagattgaagatatcctagcaaatgtatttttgcatcgccgctaagctttctcacctccgtctctcaccgagccgtcgtcttcagaatggattctcagattaagcacgccgtggtggtcaaagtgatgggacgtactggatccaggggtcaggtgactcaggttcgagtgaagttcactgactctgatcgttacattatgagaaacgtcaagggacccgtgagagaaggtgacatcctcactttgctcgagtctgagagagaagctaggagacttcgttgattcgtcttgttcctttctccactacagaactatgtctgcttatcttgctctttttttttttgttttctgtgactggattagtgattatgcattcgaactgaattttgtttttgctgtaagacatttcatggattgatttttgttctggtcttatcatattgttgtctgaaccctcca

SEQ ID NO: 4479 - DNA, 467 bp, Raphanus sativus
  misc_feature (114)..(114): n is a, c, g, or t
  misc_feature (437)..(437): n is a, c, g, or t
  misc_feature (443)..(443): n is a, c, g, or t
  misc_feature (457)..(457): n is a, c, g, or t
atctctggaaactagggttcttgcttcttcgcttgccgccgctaagctctcaccttcgtctacagaatggattctcagattaagcatgccgtggtggtgaaagtgatgggacgnacggggtcaaggggtcaggtgactcaggttcgagtgaagttcacagactctgatcgtttcatcatgcgcaatgttaaaggaccagtgagggaaggtgacatcctcacattgctcgagtccgagagagaagccaggagacttcgttgagatcccccttcctcctccacgggtggaagcaagaacacagaaccaaatgtctgcttagttctcttttttttttttttttttgcttcttgttactggattagtgattatgcactcaggttctgtttggttgttgctataagacaattcctggattgatatttgttctgtcttttttnctggtnttcggagttttatntgaaactcat

SEQ ID NO: 4480 - DNA, 335 bp, Raphanus sativus
gggcaagactcgatttcactgtaagcttcttgagcacccgccgcatcaatatccaacagaatggattctcagatcaagcatgctgtggtagtgaaagtgatggggaggactggttcgcgtggtcaggtgactcaggtgagagtgaagttcactgactcagaccgttttatcatgaggaatgtgaaaggacctgtgagggaaggagacatcctcactctcctcgagtccgagagagaagccagaagactccgttgattcttacattttgatggtcatttagtttcttctttttttgtcgaagtatctgctctgttttaattattaagacaatgtct

SEQ ID NO: 4481 - DNA, 931 bp, Picea glauca
agaacagccaagtcccaagaaaccctaaagagggtttacttttactcatttctgggtagaatcctttcctgctgggcgtaatctcagaagggaatcgaattcggagtgctgggcgcaatctcagaagggaatcgaattcggagtgctgggcgctatattctatcttctgggcactttatactctagtctgggcgcatttatcaacatctggaagcgtatttccatagctgggcagatctcttagcataaagatcgaaataaactattgctgcttgaaggtcgagttatttccccaaatctgggcgcatttattctctatttcggaactgtggagcgctgccactatttcctggagtctatttctgggcttggtcaaataccaacactatttctgggcgcattctattggaaatcatggatacaggtgtgaagttggcagttgtggtgaaagttattggccgtactggatcaagaggtcaagttacacaggtccgagtcaagtttttggatgatcagaaccgactcatcatgaggaacgtaaagggacctgtcagagagggtgatgtccttactcttttagaatctgaaagggaagcaagaagattgcggtgatgatattattcagattatagattggagtttctcaatggattagctttagtgtttgcttttcttttcaatgcaaagaggtcacgtgcaaggcactgaatgttctgtgataaacatattttgatttgttttggaggattaagacctatcttaattttgagggtggagttggaacaataattatggattgaaattcaagttaaaacaattattacagattttgtgtgaagaagcgttattatagagtcgtgttttttcacaaacttttgtttttttactcttttacaactaaaattaagtgctttttgttattgggtttgtg

SEQ ID NO: 4482 - DNA, 638 bp, Picea glauca
ttaattaaattaatcccccccccccccgagggtttagttttattcttgtctttcagactctgtacacgtacacgctcgatacacatatcttcggctatttcggtggagttcgcacagagatcagagctctgagcgtgagcattcatcttcgaggaagtcatggatactggtgtgaaattggcagttgtggtgaaagtaattggccgtactggatcaagaggtcaagttacacaggtccgagtgaaatttttggatgatcagaatcgactgatcatgaggaatgtaaaaggacctgtcagggagggtgacgtccttactctgctagaatctgaaagggaagcaaggaggttgcggtgattatattgtttagattatagcatggacttaaagtgagaatggtataacttacattgttgtgttctgtttctggattatctcagagtgttttgttcgctattttttttcaatccaaagggagcaatgagtgaggctatgaatgatctgtgatatgtaatccggaattttacaatcaaaatttaaagcctgtcatacttgacagggaattggaatagtaactatttatttttgcttctggaatgaaattcaaataactatactgaagattttctgtgaaaaaa

SEQ ID NO: 4483 - DNA, 1368 bp, Picea glauca
ggcattcactcatttagaaaatagattcctctttggttaaacccttctttgttcactgtttttggtgttgcaacgatatacccttgatagtccttgatagtgttaggaggaaatcactcagatttcttcagtgtacttcattgctaccgagtttctttagtaggcggtcgattttctttgtgtggcgcctgggattttcattgtgggacgtgtttacgctaccgagtttctttagtaggcggtcgattttctttgtgtggcgcctgggattttcattgtgggacgtgtttacctttggaggacgatttccttatcccattcataccaaggggcttattattttactactgggcgtttttatactgctggacgcattctcccttcatttctgggtcgaaccctctattgctgggcgtaatctcagaagggaatcgaattcggagtgctgggcgctatattctatcttttgggcactttatactctagtctgggcgcatttatctacatctggaagcgtatttcgatagctgggcagatctcttagcataaagatcgaaataatctattgttgcttgaaggccgagttatttccccaaatctgggcgcatttattctctatttcggaattgtggagcgctgccactatttcctggagtctatttctgggcttggtcaaataccaacactatttttggccgcattctattggaaatcatggatacaggtgtgaagttggcagttgtggtgaaagtaattggccgtactggatcaagaggtcaagttacacaggtccgagtcaagtttctggatgatcagaaccggctcatcatgaggaacgtaaagggacctgtcagagagggtgatgtccttactcttttagaatctgaaagggaagcaagaagattgcggtgatgatattatttagattatagattggagtttctcaatggattagctttagtgtttgcttttcttttcaatgcaaagaggtcacgtgcaaggcactgaatgttctgtgataaacgtatttcgatttgttttggaggattaagacctatcttacttttgaggggggagttggaacaataattatggattgaaattcaagttaaaacaattattacagattttgtgtgaagaagcgttataacttattatagagtcatgctttttcacaaacttttgcttttttgctgttttacagctaaaattaagtgctttttgttactgtgtttgtgtaaaattgctgttatctggaacaatgttaacatgttaacgattggaaccttaaactgcaatcataggtcatacttgtttcgttgatgaaactttacctcattgctcttatatttcaatttcaaattttat

SEQ ID NO: 4484 - DNA, 197 bp, Fragaria vesca
gatggattccacggcgaagcatgctgttgtggtgaaagttatgggtcggactggatccagaggacaggtgactcaggttagagtcaggtttctggacgatacgaatcgtcttatcatgaggaatgtcaagggaccagtgagggagggggataccctgaccttgctcgagtctgaaagggaagccaggaggttgcgtt

SEQ ID NO: 4485 - DNA, 408 bp, Thellungiella halophila
gcacgaggtctcactttatcgccgcaaaagctttatcgtcgcatcgttctccgttagccgtcgtctccaggatggattctcagatcaagcacgccgtggtggtcaaagtgatgggtcgtaccggatcaaggggtcaggtgactcaggttcgagtcaagttcacagactctgatcgtttcatcatgcgcaatgtcaaaggaccagtgagagaaggagatatcctcactttgctcgagtccgagagagaagctaggagacttcgttgatgcgcctctacttcttccaatgtctttggttatctctcttttgattcctctcgacttggattagtgatatgatgttgttgcgtttaagacaattgctggattgatatctgttctggtttttctgatattcaaagtctctgtt

SEQ ID NO: 4486 - DNA, 496 bp, Triphysaria pusilla
cttcatcccgccccgtcgttgctacttgtttctttctcagtttctctccaaatcttcagaatggaatcacaaatcaagcacgccattgtggtgaaggttatgggaaggactgggtctcgtggtcaggtgactcaagtgagagtcaagttcatggatgataccaaccgtttcatcatgaggaatgtcaagggaccaatcagggagggtgatgttcttaccctgatggagtctgagagagaggcacgtaggttgcgttgatgggctcaagtcgagtcatcaactctgtgttttggttttggtaaaacaatttattttctgaactttttatcattgtattaggagacaccaatgtgagcttggcctgctattctgttttcttggtttaacgttgaaagacattgttgtttcgattttcgtaatggtagctaaatgtgatttggattattgtttttaatggagcctacttgctctcatgattaaaattgtcttgttattg

SEQ ID NO: 4487 - DNA, 666 bp, Triphysaria pusilla
ccggaaaacttgttcccttgcccgttctgctaatcgccgccgtcggaagtccaatcctttagaaaatggagtcacaaatcaagcatgctattgtggtgaaggtgatgggaagaactgggtcccgtggtcaggtgactcaagtgagagttaaatttatggacgacaccaaccgtttcatcatgaggaatgtcaagggacccatcagggagggcgatgttcttaccttgatggagtccgagagagaggcccgtaggttgcgttgattggcccgagtcgaagatgatcatctctgtgttagagaggcccgtaggttgtgttgattggcccgagtcgaagatgatcatctctgtgtttgttgttggccgactttttttacatcattctataagatagagacatcaaattgatcttggtttgctattttgtttttttggttctgacattgaaaaatattggtgcttcagtttggtaatggtagctgaatttgattcgggttaaaattgttagcttattgcatgttaaaattgttttctttttgctaattctgatcttgatatagtgggtacctctaaaccacttatacgcacttctgatgctgtttagtagtgtacaagaacgagtttgtaatttaggttcatggcatttgcgacaaaaaaaaaaaaaaaa

SEQ ID NO: 4488 - DNA, 458 bp, Brassica napus
ctggaaaattagggttctcgcttcttctctaaccgccgctaagctcccaccatctctacagaatggattctcagattaagcacgccgtggtggtgaaggtgatgggacgtacggggtcaaggggtcaggtgactcaggttcgagtcaagttcactgactctgatcgtttcattatgcgaaatgttaaagggcctgtgagggagggagacatcctcaccttgctcgagtccgagagagaggccaggagacttcgttgattcacctgcaagaacacagagcaatgtctgcttagttcctttttttttttgcttcttgtgtctggattagtgattatgcacttttggattgtgtttggttgttgctataagacaattcctggattgatatttgttctggttttttgagggtcttcagagtttattgtttcatcttcacatcaagaattcgtatattagtat

SEQ ID NO: 4489 - DNA, 491 bp, Sarracenia psittacina
gggatcgtctgcgccaactctcctccctcccccgtcgttgtctctaaagtcaagaatggagtctcagatcaagcatgccattgtggtgaaagttatgggtcgcacaggatcaagggggcaggtgacgcaagtgagagtcaaatttgttgatgatcagaacaggcatatcatgaggaatgttaaggccgtgagggaaggggatgtgctcaccttgctcgagtctgacgtaggaggctagaaggttgcgttgatctctttagtcatcccttcaggttttactaaagtctcttgtgctttgttatctatacgttatatttatgtccgtctgtgtcttgggatgggtattgggacttatccaatgtctataatttttttatctttctttttaccttgtagtaggttgaaaaaacacaatttatttggtcgagttttgtcaaagcgtttgaatagtctatgctttggagacagtactatgatctgagccatgttat

SEQ ID NO: 4490 - DNA, 966 bp, Brassica juncea
agcaagttggttagcggagctgacttctactgtttcaaacacaatatcgaacctaagtgggaggatcctatctgtgctaatggtggcaaatggactatgaacttcccgaaggagaagtctgataagccctggctttacaccttgcttgcgttgattggagaacagtttgaccacggagatgagatatgcggagctgttgtcaacgttagaggaaagcaagagaggatttccatttggaccaaaaatgcttccaacgaagctgctcaggtgagcattgggaaacaatggaaggagtttattgattacaacaacagcattggtttcatcatccatgaggatgccaagaagctggacaggggcgcgaagagcgcttacaccgcttgaaaccccaacaacactctcaaaggtttacaccgtttcaaatacagttttgtatgtgagagatctctatttacattttcaaaacatgacttgacactagtattattaatgtatttgtttggtcgtcataaaaatttaccgtttataaatttaaacttcttgaatttgaaacaaacagataagaatagactttgaataccaaaatacaccatatcaatccagccactgtctcatagcaacaaaccaaagcataatcactaaaccgctcacagagaccataaagacaaataagtagacattgttctgttttcttttctccaacttgtagaaaaataaaaaggcgaatcaacgaagtctcctggcttctctctcagactctagcaaggtgaggatatcgccttctctcacgggtcccttaacgtttctcataatataacgatcagagtctgtgaacttcactcgaacctgcgtcacctgaccccttgacccagtgcgtcccatcactttcaccaccacggcgtgcttaatctgagaatccattctgcttcaatctgaagacgacgcggaggtgagagagcttagcgg

SEQ ID NO: 4491 - DNA, 796 bp, Brassica juncea
gcgtcttctctcccggtcaacgtgcctgactggtcgaagatcctcggggaagagagtccacggaggcagacttcgaacgaggaatacgacggtgacgaagttgctgcatgcggtggagagacacggcgtgtgccgccgcatgagttgcttgcgagtcggaggatggcttcgttttcggttcacgaaggtgctgggaggacgttgaaagggagagatctgagtagggtgcgaaatactattttcaaaattagagggatcgaagattaaatgttttaaaatattggggttgcaaatggaagaaaatgagttttttgaacatgctaatctatgaattcttgatgggaagataatatgagtttcacacaataaactctgaagacccaaaaaaagacagaacaaataccaatccaggaattgtcttataccagcaacaaccaaacacaacctgagtgcataatcactaatccagtcacaagaagcaaaaaaagagagaaacaagcagagacatttggttcagtattcttgcttccacctgtggaggaaggtggatcaacgaagtctcctagcttctctctcggactcgagcaaggtgaggatgtcaccttctctcacaggtcctttaacattgcgcatgatgtaacgatcagagtctgtgaacttgactcgaacctgagtcacctgaccccttgaccccgtacgtcccatcactttcaccaccacagcgtgcttaatctgagaatccattctgttgacgaaggtgagagcttagcggcggcacgcgaagaagcaagaaccc

SEQ ID NO: 4492 - DNA, 455 bp, Brassica oleracea
gaggttttttagcagaatcgatttcacgtaaagctcccgccgcctccttctacagaatggattctcagatcaagcacgccgtggtcgtgaaggttatggggagaactggttctcgtggtcaggtgactcaggttagagtcaagttcacagattcagaccgttttattatgaggaatgttaaaggaccggtgagggaaggagacatcctaactcttctcgagtccgagagagaagccagaagactccgttgattcatatgccattatctatgcaagtgttaccatgttttacagtttgatgactatgcaagtgttaccatgttttacagtttgatgatgccctcttatgtttcttgaccttatggttgtttttttgtctaagaaatactctgttttaatttacttgaattttgttaagactgtttgattcgagaaatgaatcttttttcatacacg

SEQ ID NO: 4493 - DNA, 506 bp, Brassica rapa
gcttctctggaaacttttagggtttttgactctttgcttatcgccgctaagctctctagcctccgcgaaccgcggtttctacaggtcatcaagcagaatggattctcagattaagcacgccgtggtggtgaaagtgatgggacgcactgggtcaaggggtcaggtgacgcaggttcgagtgaagttcacagactctgatcgttatattatgagaaacgttaagggacccgtgagagaaggcgatatcctcaccttgctagagtctgagagagaagccaggagacttcgttgattcgcctttttatttttctacaagttggagaaaagaaaacagaacaatgtctacttatttgtctttatggtctctgtgagcggtttagtgattatgctttggtttgttgctatgagacagtggctggattgatatggtgtattttggtattcaaagtctattcttatctgtttgtttcaaatcattactttggttatgttcttaacttgtttat

SEQ ID NO: 4494 - DNA, 1224 bp, Brassica rapa
ggaaaaggaagagaaaagacgcacaccgaagaaagactactcccatcatctcctccagcttcttcttcttcgtctctgaaactagtttgattcagccatggctaatgcggcgtcaggtatggcagtccatgatgactgcaagctcaagtttctcgaactcaaggctaaaaggactttccgtttcatcgtttacaagatcgaggagcagcagaaacaagtggttgttgagaagctcggcgagcctggtcaatcccatgatgactttgcagcttctcttcctgctgatgaatgccgttacgccgttttcgatttcgatttcgtcactgctgagagttgccagaagagcaagatcttcttcgtcgcatggtctccggacacagcaagagtgagaagcaagatgatctacgcgagctctaaggacaggttcaagagagagcttgacggaattcaagtagagcttcaagctaccgatccaactgagatggatctcgatgttttcaaaagccgagccaactgaggaatacatcctccataaatgaattggttgaatccaaatttctcctactattactgaatgatatatgcttgttctttaagtttgctgtgaaggcaccaccaaaccaaaacagcttcatttcattggtctctgtcttccctatgtcttttatattttttttttggtcctcgcagtgttttgcttaaaacttaagagatttggcttgtgctcttttaccatttgtgtaagaaacccccaaacactttaccaaaagatgaatcttattggcaccgtctttagaatggattctcagatcaagcacgccgtggtggtgaaagtgatgggtcgtactggatccaggggtcaggtgacccaggtacgagtgaagtttacagactctgatcgttacattatgaggaacgttaagggaccagtgagagaaggcgacatcctcaccttgctcgagtctgagagagaagctaggagacttcgttgatgcgtcttgttcttgttccttctccactagtagaaacaagaagacagaaccatgtctgctttttctctcttttttctgttttctgtgtctggattagtgattatgccttcgaattgaattctgttttgctataagacatttcatggattgatttatgttctcgtcttatcatatttttgtttgaaatcatcagtacatcatcaccctccaaaatctcttggattaatcatcc

SEQ ID NO: 4495 - DNA, 422 bp, Brassica rapa
aggtttttttagcagaatcgatttcacgtaaagctcccgccgcctccttctacagaatggattctcagatcaagcacgccgtggtcgtgaaggttatggggagaactggttctcgtggtcaggtgactcaggttagagtcaagttcacagattcggaccgttttatcatgaggaatgttaaaggaccggtgagagaaggagacatcctaactcttctcgagtccgagagagaagctagaagactccgttgattcatatgccattatctatgaaagtgttaccatgatctacagttgccctcttatgtttcttgaccttatgattgtctttttgtctaagaaatactctgttttaattacttgaattttgttaagacaatgtttgaatcgagaaatgaatcttttttcatgcattaaactttt

SEQ ID NO: 4496 - DNA, 424 bp, Phaseolus coccineus
  misc_feature (179)..(179): n is a, c, g, or t
ggactctggttagcaagcatcgcaaacccctagcctactttcttcactcgttttttatttcaggagggactctcaggtgaagcatgctcttgttgtcaaagttatgggtcgtactggatccagagggcaggtgccccaggttagagtgaagtttttggatgatcagaatcgtcccttcntgaggaatgtgaaaggccctgttagagaaggagacattctccccctcctcgattccgagagggaagcaagaagattgcgctagatggtttaaatcgaaccaggggcttgatttttgtggtagttagtggatgccaaaggttatatcaccctatcttgatgtttgggatctatttttattcgaattatggacggaattttgttgtttttagtttaagttttaagattgaagtatgattggcttgat

SEQ ID NO: 4497 - DNA, 425 bp, Phaseolus coccineus
  misc_feature (19)..(19): n is a, c, g, or t
  misc_feature (37)..(37): n is a, c, g, or t
  misc_feature (113)..(113): n is a, c, g, or t
  misc_feature (213)..(213): n is a, c, g, or t
  misc_feature (282)..(282): n is a, c, g, or t
  misc_feature (343)..(343): n is a, c, g, or t
ggattttggttagcaagcntcgcaaaaccctaccctnctttcttcactcgttttttatttcaggagggactctcaggtgaagcatgcttttgttgtcaaagttatgggtcgtnctggatccagagggcaggtgccccaggttagagtgaagtttttggatgatcagaatcgtcccatcatgaggaatgtgaaaggccctgttagagaaggagncattctccccctcctcgaatccgagagggaagcaagaagattgcgctagatggtttaaatcgaaccagnggcttgatttttgtggtagttagtggatgccaaaggttatatcaccctatcttgatgtttnggatctatttttattcgaattatggacggaattttgttgtttttagtttaagttttaagattgaagtatgattggcttgata

SEQ ID NO: 4498 - DNA, 424 bp, Phaseolus coccineus
  misc_feature (66)..(66): n is a, c, g, or t
  misc_feature (87)..(87): n is a, c, g, or t
  misc_feature (134)..(134): n is a, c, g, or t
  misc_feature (196)..(196): n is a, c, g, or t
  misc_feature (348)..(348): n is a, c, g, or t
ggattttggttagcaagcatcgcaaaaccctagcctacttttttcattcgttttttatttcagganggactttcaggtgaagcatgntcttgttgtcaaagttatgggtcgtactggatccagagggcaggtgncccaggttagagtgaagtttttggatgatcagaatcgtcccatcatgaggaatgtgaaaggncctgttagagaaggagacattttccccctccttgaatccgagagggaagcaagaagattgcgctagatggtttaaatcgaaacagtggcttgatttttgtggtagttagtggatgccaaaggttatatcaccctatcttgatgtttgggatntatttttattcgaattatggacggaattttgttgtttttagtctaagttttaagattgaagtatgattggcttgat

SEQ ID NO: 4499 - DNA, 424 bp, Phaseolus coccineus
ggactctggttagcaagcatcgcaaaaccccagcctacttttttcactcgttttgtattccaggagggactctcaggtgaagcatgcttttgttgtcaaagttatgggtcgtactggatccagagggcaggtgccccaggttagagggaagtttttggatgatcagaatcgtcccatcatgaggaatgtgaaaggccctgttagagaaggagccattctccccctcctcgaatccgagagggaagcaagaagattgcgctagatggtttaaatcgaaccaggggctggatttttggggtagttagtggatgccaaaggttatatcaccctatctggatgtttgggatctatttttattcgaattatggacggaattttgtggtttttagtctaagttttaagattgaagtatgattggcttgat

SEQ ID NO: 4500 - DNA, 635 bp, Solanum tuberosum
catacagcagcagatttttctcaccggagatggaatctgtaaccaagcatgcaattgtgattaaagtcatgggtcgtaccggatccagagggcaggtgactcagtcaagtttcttgatgaccagaacaggtttatcatgagaaatgtcaagggaccagtcagagagggtgatattctcacacttttggagtctgagagggaagccaggaggttgcgttgagcccatgattttgattgccaaatcaatattctcttgaatacttgatattggctgggattttgttccctatttaatagtctttggttttgtttgcttagactcttttaagtatggacatgtcgattttggtgcactttatgtttctggaatagttttaatataatattttaccgcctttgtgtcaatgccaacatgtaatggttcttatttcttttcgtctgtgcgggatggacgtccatctatcatgttgaatcttttaccagtgttactaatgtgtgattttggttatattggttcttttattagaattctgaagggtatttaccccaaaaaaagaaaatattgcaatgtcacaaagccttcaaatttaatacttttgatgcataaattcaatattagattatttttattctct

SEQ ID NO: 4501 - DNA, 460 bp, Raphanus sativus
atctctggaaattagggctcttgcttcttcgctttgccgccgctaagctcttcaccttcgtctacagaatggattctcagattaagcatgccgtggtggtgaaagtgatgggacgtacggggtcaaggggtcaggtgactcaggttcgagtgaagttcacagactctgatcgtttcattatgcgcaatgttaaaggacctgtgagggagggagacatcctcaccttgctcgagtccgagagagaagccaggagacttcgttgatcccccttcctcctccactggtggaagcaagaacacagaaccaaatgtttgcttagttctcttcttttttttttccttcttgttactggattagtaattgttctcttgaatcgtgtttggttgttgctataaagacagttcctggattgatatttgttctgtctttttttgggttttcaaagtttattgtgtgaaac

SEQ ID NO: 4502 - DNA, 475 bp, Raphanus sativus
ggagggtttgtgactcttcgcttatcgccgctaagctctgtcgcctccgtgaaaccgtcgtttcttcaggtttgttcctcaatggattctcagattaagcacgccgtggtggtgaaagtgatgggccgtactgggtccaggggtcaggtgactcaggttcgagtcaagttcacagactctgatcgttacattatgagaaacgtcaaggggccagtgagagaaggcgacatcctcaccttgctcgagtctgagagagaagccaggagacttcgttgattggcctttttcttaccgcaagttgggaaacgagaaaacagaacaatgtctacttatttctctttttttggtttctctgaccggtttagtttggtttgttgctttaagacagttgctggattgatatggttatttggtattcaaagcctcttctttatctgtttgtttcaaacgtttctctggttgtgttcttaacttg

SEQ ID NO: 4503 - DNA, 430 bp, Raphanus sativus
ggagggtttgtgactcttcgcttatcgccgctaagctctgtcgcctccgtgaaaccgtcgtttcttcaagtttgttcctcaatggattctcagattaagcacgccgtggtggtgaaagtgatgggtcgtactgggtccaggggtcaggtgactcaggttcgagtcaagttcacagattccgatcgttacattatgagaaacgtcaaggggcccgtgagagaaggcgacatcctcaccttgctcgagtctgagagagaagccaggagacttcgttgattggcctttttcttaccgcaagttgggaaacaagaaaacagaacaatgtcttacttgtttctctttttggtttctctgaccggttcagtttggtttgttgctttaagacagttgctggattgatatggttttttttatattcaaagcctcttct

SEQ ID NO: 4504 - DNA, 537 bp, Raphanus sativus
  misc_feature (334)..(334): n is a, c, g, or t
  misc_feature (483)..(485): n is a, c, g, or t
  misc_feature (491)..(491): n is a, c, g, or t
  misc_feature (493)..(494): n is a, c, g, or t
  misc_feature (496)..(496): n is a, c, g, or t
  misc_feature (500)..(500): n is a, c, g, or t
  misc_feature (506)..(506): n is a, c, g, or t
ggctcatctctggaaattagggttcttgcttcttcgcttgccgccgctaaacactcaccttcgttctacagaatggattctcagattaagcatgctgtggtggtgaaagtgatgggacgcacggggtcaaggggtcaggtgactcaggttcgagtgaagttcacagactctgatcgtttcattatgcgcaatgttaaaggaccagtgagggaaggtgacatcctcaccttgctcgagtcagagagagaagccaggagacttcgttgatcccccttcctcctccacaggtggaagcaagaacacagaaccaaatgtctgcttagttctctttttnttttttttttttgcttcttgttactggattagtgattatgcactcaggttctgtttggttgttgctataagacaattcctggattgatatttgttctgtctttttttctggtcttcggagtttattgtgtgaaactcattactcgagtnnncacatngnnantgtnattacncgagtaagccatggtcagtgttattacatga

SEQ ID NO: 4505 - DNA, 422 bp, Raphanus sativus
  misc_feature (159)..(159): n is a, c, g, or t
  misc_feature (204)..(204): n is a, c, g, or t
  misc_feature (278)..(278): n is a, c, g, or t
ggggcaagactcgatttcacgagtaagcttcttgagcacccacccgccgcatcaatattcaacagaatggattctcagatcaagcatgctgtggtagtgaaagtgatggggaggactggttcgcgtggtcaggtgactcaggtgagagtgaagttcacngattcagaccgttttatcatgaggaatgtgaaaggaccggtgagngaaggagacatcctcactctcctcgagtccgagagagaagccagaagactccgttgattcttacattttgattntcatttagtttcttttttttgtcgaagtatctgctctgttttaattattacgacaatgtctggagtctagaaatgaaatcttgaacacagaacatatgtgcaactttcatcattttaatttctaacgcgtatattcgttggtca

SEQ ID NO: 4506 - DNA, 485 bp, Secale cereale
  misc_feature (168)..(168): n is a, c, g, or t
  misc_feature (328)..(328): n is a, c, g, or t
  misc_feature (468)..(468): n is a, c, g, or t
ccttttgtcctcttctcttgcgcggccctttcgctaccatggcggcggagggggaggacaagaagcagcgatccccatcgccaacagcccaagaaaggcagcatggacacgcaggtgaagcttgcagtggttgtcaaggtgatgggccgcaccgggtccaggggtcangtgacccaggtgagagtcaagttcctggacgaccagaaccgtctcatcatgaggaacgtcaaggggcccgtccgtgagggcgacatcctcaccctgctcgagtctgagcgggaggccaggaggtgcgctaagcactttgtttcttcacctgtcggtcttngaagtaccagtactcctaaaatgctgtgatgttgccttcttgtgctgctacttttgtctttcgcctaggctatggagatgtaatgagtaaacttctgttgtcgaaattaaaatgcacttgatgttattgtgcacacctcngggtaatgtgaaacgac

SEQ ID NO: 4507 - DNA, 627 bp, Picea glauca
  misc_feature (595)..(595): n is a, c, g, or t
  misc_feature (603)..(603): n is a, c, g, or t
ttaattaaattaatccccccccccccccgatatcttacgagcctcggtagtcgctatctggtggagcttggacagagatttggagctcagagcgagagaattcgtctacgagaggaaagcatggatacaggtgtgaagttggcagttgtggtgaaagtaattggccgtactggatcaagaggtcaagttacacaggtccgagtcaagtttttggatgatcagaaccggctcatcatgaggaacgtaaagggacctgtcagagagggtgatgtccttactcttttagaatctgaaagggaagcaagaagattgcggtgatgatattattcagattatagattggagtttctcaatggattagctttagtgtttgcttttcttttcaatgcaaagaggtcacgtgcaaggcactgaatgttctgtgataaacgtatttcgatttgttttgaaggattaagacctatcttacttttgaggggggagttggaacaataattatggattgaaattcaagttaaaacaattattacagattttgtgtgaagaagtgttattatagagttgtgctttttcacgaacttttgcttttttgctnttttacanctaaaattaagtgctttttgttac

SEQ ID NO: 4508 - DNA, 424 bp, Phaseolus coccineus
ggattttggttagcaagcatcgcaaaaccctagcctactttcttcactcgttttttatttcaggaaggactttcaggtgaagcatgcttttgttgtcaaagttaggggtcgtactggatccagagggcaggtgccccaggttagagtgaagtttttggatgatcagaatcgtcccatcatgaggaatgtgaaaggccctgttagagaaggagacattctccccctccttgaatccgagagggaagcaagaagattgcgctagatggtttaaatcgaaccagtggcttgatttttgtggtagttagtggatgccaaaggttatatcaccctatcttgatgttttggatctatttttattcgaattatggacggaattttgttgtttttagtctaagttttaagattgaagtatgattggcttgat

SEQ ID NO: 4509 - DNA, 439 bp, Solanum tuberosum
catacagcagcagatttttctcaccggagatggaatctgtaaccaagcatgcaattgtgattaaagtcatgggtcgtaccggatccagggggcaggtgactcagtcaagtttcttgatgaccagaataggtttatcatgagaaatgtgaagggaccagtcagagagggtgatattctcacgctgttggagtctgagagggaagccaggaggttgcgttgagcccatgattatgattgccaaatcaatattcccttgaatactagatattggctgggattttgttccctctctaatagtctttggttttgtttgcgtagactcttttaagtatggacatgtcgactttggtcatttttgtgcacttcatatttctggaatagttttaatataatattttgctacatttgtgtcaatggcaacatgtaatggttcttattt

SEQ ID NO: 4510 - DNA, 456 bp, Phaseolus coccineus
  misc_feature (122)..(122): n is a, c, g, or t
  misc_feature (138)..(138): n is a, c, g, or t
  misc_feature (140)..(140): n is a, c, g, or t
  misc_feature (205)..(205): n is a, c, g, or t
  misc_feature (211)..(211): n is a, c, g, or t
  misc_feature (251)..(251): n is a, c, g, or t
  misc_feature (298)..(298): n is a, c, g, or t
  misc_feature (401)..(401): n is a, c, g, or t
gactctggttagcaagcatcgcaaaaccctagcctactttcttcactcgtcttctatttcaggatggactctcaggtgaagcatgctcttgttgtcaaagttatgggtcgtactggatccanagggcaggtgacccangntagagtgaagtttttggatgatcagaatcgtcacatcatgaggaatgtgaaaggacctgttaganaagganacattctcaccctcctcgaatccgagagggaagcaagaanattgcgctatatggtttaaatcgaaacagtggcttgatttttgtggnagttagtggatgccaaaggttatatcatcctatcttgatgttttggatctatttttattcgaattatggactgaattttgttgtttttagtctaagttttaanaatgaagtatgattggcttgatatatgcaccacaaacttaaataatggactcttg

SEQ ID NO: 4511 - DNA, 375 bp, Abies balsamea
taccggtgtgaaactggcagttgtggtgaaagtagttggccgtactggatcaagaggtcaagttacacaggtccgagtgaaatttttagatgatcaaaatcgattgatcatgaggaatgtaaaaggacctgtcagagagggtgacgtccttactctgctagaatctgaaagggaagcaaggagattgcggtgattatattgtttagattatagtagggacttcaagtgagaatggaataacttatatttttgtgtttcctgtttctgtattagcttatagtgttaagttttctgtattttttcaactatgaattgtctttgatatctattccagaattttacaattaaaatttaaaggctgtcgtacttgacggg

SEQ ID NO: 4512 - DNA, 218 bp, Malus domestica
ttcaatatattactcatggaatccacgattaagcatgctattgtaatcaaggttataaggcggactggatctcgtgggcaggtgactcaggtgagagtcaaatttttggatgaccagaaccgtttcatcatgaggaatgttaagggaccagtgagagagggggatatccttaccttgctcgagtccaagatggaggcaagaaggttgcggtgatcaat

SEQ ID NO: 4513 - DNA, 223 bp, Malus domestica
ttcaatatattactcatggaatccacgattaagcatgctattgtaatcaaggttataaggcggactggatctcgtgggcaggtgactcaggtgagagtcaaatttttggatgaccagaaccgtttcatcatgaggaatgttaagggaccagtgagagagggggatatccttaccttgctcgagtccaagatggaggcaagaaggttgcggtgatcaatctgat

SEQ ID NO: 4514 - DNA, 500 bp, Chelidonium majus
ctaggaaaacatggactctggagttaagctagcagttgtgatcaaggtgatgggacgcactgggtccaggggtcaggtgacccaagtgagagttaagtttttggatgatcctaaccgtctgatcatgaggaacgtgaagggacccattcgtgagggtgactatctcactcttcttgagtctgaaagagaggctaggaggctcagatgattttgcttattcaacttggtagtttttgttcaagatatttctaggttttgagactatggtttgtaaccctttattagcatactggagatattactgagtcttgttgtggatcattatgcgattttgttggctctgtttgcttaatattttcgacatgcacacttttttgtttgaattgaagttgaagtttgatataagtagttgagttatagttgattagagtggttttgatgtctgtgttttcttaagattctctgctatgatataagcctgttgaactgcctatggttac

SEQ ID NO: 4515 - DNA, 419 bp, Primula obconica
gtaacaggatggaatcccagatcaagcacgcagttgtggagaagattatgggacgtaccggttcaaggggacaagtgactcaagtgagagtcaagtttatggatgacacgaaccgattcatcatgaggaatgtgaagggaccagtgagagagggagatattttcaccctcttcgagtctgagagggaagctagaaggctgcgttgattcgccaagtcatcaccttcttcaggtttttgtcacttgggagatcatgtcgcacttcctttttgagatgtagttttgcaatatttatcttaagacttcgtatggaagcatgatctatttattttgtctgttttgttttcgttgaaagacaaatgagatgttgactgctgccttgacaggcactagaatggtttaagatgattttgtttgtgt

SEQ ID NO: 4516 - DNA, 720 bp, Primula obconica
ctctctctctccgccgcaggttgttttttgtttgtaataaggatggattctcagattaagcatgcagttgttgtgaagatcatgggccgcacagggtcaaggggacaggtgactcaagtgagggtccagttttcggatgatcatagtcggttcattatgagaaatgtgaagggccctgttagggaaggtgatattctcacccttctcgagtctgagagggaggcaaggaggcttcgttgagaccatttcatctgccttttacttcctacccttggcgtagttttctggtttcatggaacagtttatttaaaactgagttcttgtttttgtgtttggaagtgagtgttatttggagactggtttatgtccttgtaagactattttgattgagaaagacaatttgtgttggttgctattctaattaaaacccatattgttttccatttatttgactatagccattgattggaagcaatccttttctagcaaattgtggcgagtaggctgtgacccaaattttgctacagagtcatgacatgtttaaaatcactgctgcttgtaactttgaaaatgcaactatcttcagttttcttgtattctttagccatgtgatccttgattgtttttgttttagtcttatgttgtatcttcggtagaaatgtgaaaatgtattcgtgaactttgctatataatgtgtggtattcgaataccaggtgtcat

SEQ ID NO: 4517 - DNA, 478 bp, Silene vulgaris
acgattgaataaactcttgaggcgccgttctccttctttcttttctccaattcgcctctcttcaatcccagcatggataccgcaataaagcacgcagtcgtcattaaaatcatgggacgcacaggatcaaggggtcaggtgacccaagtcagggttaagttcattgatgaccaaaaccgttttatcatgaggaatgtcaagggacccgtcagggaaggagacattctcaccctccttgagtccgagcgagaggctaggagacttcgttgaatggcctatgcttgttcgtgtgctgtggttgaattttgtattagttttcatgctatttgtgtttctgttggccttttaaattgaactgtgtcaagacttgtgtcatttgtgctgttgtaacagagttgtaacattgtgtgttccagtccctagtattttgaggactttgtaaggatttattggtttatgaatatgtgcggtttgttct

SEQ ID NO: 4518 - DNA, 591 bp, Silene vulgaris
tttctgctggagcacatacacagcatagcaagatggatcagccagctaagcttgctattgtgatgaaggtcattggccgcactggctctcgtggtcaggtgacccaggtgcgcgtgaagttcctggacgatcaaaaccgcctgatcatgcgcaatgtgaagggcccagtgcgcgagggtgatatcctgaccctgctggagtctgagcgcgaggccaggcgcctcaggtaaagaccaccaaagtttaaatcagtgtttgccgatctgaagccttgtggtcttaccgcagctaaccacagcagcagctgctgggctgagaccctcggaggcatatgcaatgagggactactgtcagcagcgccgtcagcggcagcagcagtattagcccttgttgcagtagcagcagcaggcagctggttaagcgcaccagccttgggaagagcgtcactggacgggtcggcattgtggcatgtgaacagacagatgcgcccagtcctcttactagcaaggtagcagcttggcagcaacgatctgaatgagttattttgcatgggctgatgagccacagtattggctgcatgaatgtaacaaa

SEQ ID NO: 4519 - DNA, 195 bp, Eutrema parvulum
atggattctcagattaagcacgccgtggtggtcaaagtgatgggtcggaccgggtccagaggtcaggtgactcaagttcgagtgaagtttacagactctgaccgttttattatgagaaacgttaaaggacccattagagaaggcgacatacttaccttgctcgagtccgagagagaagccaggagacttcgttga

SEQ ID NO: 4520 - DNA, 450 bp, Arabidopsis thaliana
ttttccgattctagggtttttctttggcaaactcgatttcgcctagcttcttctgagcatccgccgcttccgtctacagaatggattctcaaatcaaacacgccgtggtcgtgaaggtcatgggtaggactggttctcgtggtcaggtcactcaggttagagtcaaattcactgattcagaccgtttcatcatgaggaacgtgaaaggacccgtcagagaaggagatgtcctcactctcctcgagtccgagagagaagctagaagactccgttgattccaccatatcccaattctctttcaaaagtcttaccaagatttacattttgatggtctcttgtttcttggcattgtagtcaagttctcttttctttttctactgctttgttttaattacttgaggttttgttaagacaatggttgaaatctaggaatgaatcttttatgacgca

SEQ ID NO: 4521 - DNA, 461 bp, Artemisia annua
tttgcaaatagcagcacagcagcagccgttcaatcaatctctcatttactagtgaaagatggagtcccagattaagcatgcagtcgttgttaaggtgatgggaagaactggatcaagagggcaagtgacccaacttgatgaccagaaccgtttcatcatgaggaacgtcaagggaccagtcagagaaggtgatgtccttaccttgctcgagtctgagagggaagccaggaggttgcgttgaatatgttttggtggttgttacctttctattttgtgagacttggttgagtgcaagaattggtaattttaaatgtttggtatttgaatctagaagcaaacttttgatctgttcttgttagcagaaggtttttctatcagtttagtaacttgttttgtcagattttgaatggatcaaatgcttaatcattcaagtttatgctgatatatgttttttgaaagca

SEQ ID NO: 4522 - DNA, 278 bp, Brassica juncea
ttttgcatcgccgctaagctctctcaccttcgcgtcttcttcagattgaatcagaatggattctcagattaagcacgccgtggtggtgcaagtgatgggacgtactggatccaggggtcaggtgactcaggttcgagtcaagttcacagactccgatcgttacattatgagaaacgtcaagggacccgtgagagaaggcgatatcctcaccttgctcgagtctgagagagaagctaggagacttcgttgattcgccttttgttcttgttccttctccg

SEQ ID NO: 4523 - DNA, 878 bp, Chlamydomonas reinhardtii
gtgctttcaaggcagctgaaagatggacgccccggccaagctcgctattgtcatgaaggtcatcggccgcactggctcgcgtggccaggtgacccaggtgcgcgtcaagttcctggacgaccagaaccgcctgatcatgcgcaacgtgaagggccccgtccgcgagggcgacatcctgactctgctggagtctgagcgtgaggcccgccgcctgcggtaaatgcagcagcttcagaggttgctgccttttagcaggagatagagtgtaaccgtggcgtataacactttggactcgctgtctctctgtccgtctctgccgtaagctgtacagcagcactggccagtacctgcagcatcagcgaagctctagctgcctacagtcaggcagcttctgcgagcagctcaggcaggcagtgcgcgattcgctctggcgcttgtgttcaggagcagcagtgggaaatgatgcagctgtggctacacagcagccaggtacaatgtggcgagtggggtgtggagcgccgaatcggacgggcatggctggtgagcggataggcgtggatcgggtcatggctgtcgggttgcccttcgggtagttggcgttgtgcgggggggcgcgatcaggcaatgcacgggcgtcagcacggcgttgccggaggcttcaggagctgcagctggcgctgctgcgggcgtgcgcctcttaaagagcgccgcagctgtgggcgctgctcactggaacagccgcggggggggggggcgccgagcgtgatgggccagcggtatgacgtgcaaagcgggtgcgcgggcaagctatgtcgcacttgaccgcattgatgctggcctcgttgtgggcatggacatgatttggcagtgccgtccat

SEQ ID NO: 4524 - DNA, 560 bp, Cleome spinosa
tcaaagttagggtttttgtccttttgctctctcgagccgctgagttcttccgatccttagagccgccattcgcctttgttaacagaatggatagtcagattaagcatgcggtggtggtgaaggtgatgggaaggaccggatcacgaggtcaggtcactcaggtcagagtgaagttcaccgactccgaccgttacattatgaggaatgtcaaaggacccgtcagggagggagacgtcctgactctgctcgagtccgagagagaagccaggagacttcgttgatgtttgctcatctctcacttgatggatcggtctgttctggtacttggttagtgactatgagtgcgattttgttcttctcattttaagacaagcgtgtgtgcgacaacaattctggttcgacattcgggttctatatgatcctatttgcaaagggtttttcatgccccatttttgttttgtgcgatgaattgcttattagattagaacccgaccaaaaccaaatcgaattacgaattttttttatcagaagaacagataagtaatcgtgtgtcaatttgc

SEQ ID NO: 4525 - DNA, 425 bp, Cleome spinosa
aaggaagtcttgccatccaaagttagggttttatctgttaactcagtttgccccagagctcccagggcggccgccgtctccgtttcaggaaggatggattcacagataaagcatgcagtggtggtgaaggtgatggggaggacgggatcgcgtggtcaggtcactcaggtcagagtgaagttcactgattcggatcgttacatcatgaggaacgtcaaaggccctgtccgagagggcgacgtcctcaccctcctcgagtccgagcgcgaagccaggaggctccgttgatcttttttaccaaaagttttagtccttcagtatcaatctctgcttgtcttcttcttagttttgttttcattttctagacatgttcatggagacgatggatctatgaatcttatgatgtgcctttggaatatcaattc

SEQ ID NO: 4526 - DNA, 477 bp, Cleome spinosa
tttcctgttatttcagggttgccaacgctcgcagtgctctcgccgtctccgtcatcgttcacaggatggattctcagatcaagcacgcagtggtggtgaaggtgatgggaaggactggatcacgtggtcaggtcactcaggtcagagtgaagttcactgactctgaccgttacatcatgaggaacgtgaaaggacccgtcagagagggcgatgtcctgactctcctcgagtccgagagagaagccaggagactccgctgatgtttcgtctctcggcccttttacacacgtcggactgccatgtcgcgggcgagttttgtctcggtatctactgtgttgctttgtcgactagatttttcagacatgttcttgaaggatgaatcttattacttggtgtgcctactctactgccttctgatatacaaaaggcccatttggtcgtagaaattagtcatgggtgcacaagtatctgattttc

SEQ ID NO: 4527 - DNA, 489 bp, Cleome spinosa
tctacagccgctaagttctttccatcgcagagccgccgcccttcgtcttcgttaacagaatggacagtcagattaagcacgcagtggtggtgaaggtgatgggaaggaccgggtctcgaggtcaggtcactcaggtcagagtgaagttcaccgactctgatcgttacattatgaggaatgtcaaaggacccgttagagagggcgatgtcctcactcttctggagtccgaaagagaggccaggagacttcggtgatgtgccctctcacttggtttcgtctcaccagcaagtaaaagttgatggatcgtttttatttattttgtttcgagacttgattagtgattgtgattgcgattttgttgtttgttcaagacgattttgcttgaaagttctggtcctgaattctagtctccatcttctaaatcgctaaaacctcaaaggcatgttgaactattggatgcattatactattaatgatcgtttctgctta

SEQ ID NO: 4528 - DNA, 510 bp, Cryptomeria japonica
gccctgaatattttggcgatccgattgaggcgcggctgagctcgctaggtctgcagaaaaaggctattttcaggaaaccatggatacaggagttaagctggcagttgtggtcaaggtcattggccgtactggatcaaggggtcaagttacacaggttcgagtgaagtttatagatgatcagaatcgtcttattatgcgaaatgtgaaaggacctgtcagagaaggtgacgtccttactctgctggaatctgaaagagaagcaaggagactgcggtgatcatgtttcacttactaaaattcttgggtttggattgcggtggaatattttcgtagatttttgaatgagcagagatcatggagtatagccttttaatgttttagacatttattggaaattgttttctttgattgcctgataggcaatgcttaatttgttttattaaacaagacttgttattatcaactactcttcttgatttgaatctaatctataatcatatggtttctagg

SEQ ID NO: 4529 - DNA, 509 bp, Orobanche aegyptiaca
ttaacttaaatttccttttcttttctagtcggtcttgtctttcccttcatttcgtgttgcagagagaatggattctggaatcaagactgcagtggtggtgaaggttatgggtaggacagggtctcgtggacaagtgactcaggttagggtgaaatttaacgatgatagtaaccgtttcattatgagaaatgtcaagggacctgtgagggagggtgatatactcacattgatggagtctgaaagagaggctaggaggctccgctgatcggcgatgatgatgatgatgcctcttcgtattatgcccctgcaatcatttttattactagtaatttgatgtcttagactttctgtggatttttacccttgaagattgtatgggggcgtttggggcgttttgtttctcaatcgacaattgttcttttcatgtttatcatgtttgtttaatttgattttgcagtttgttattgaatcttcaactattagtttgaaatggttgtgttattgtttct

SEQ ID NO: 4530 - DNA, 556 bp, Orobanche aegyptiaca
gaaaatggattctggaatcaagactgcagtggtggtgaaggttatgggtagaacagggtcccgtggacaagtgactcaggttagggtgaaatttaacgatgatagtaaccgtttcattatgagaaatgtcaagggacctgtgagggaaggtgatatactcacattgatggagtctgaaagagaggctagaaggctccgctaattggtggtggtgatgatgatgatgctgatgatgcctcttcgtattatgccctgctatcatttttattactagtaatttgatgtcttagactttttatgtgcatttttacccttaaagattgtatgggggcattttgtttctcaatcgacaatcgttcttttcatgtttatcatgtttgcttaatgtgattttgcagtttgttattgaatcttcaactgttagtttgaaatggttctgttattttttctcaagtatttagcttttatatggttgcagcattttaattttgaggtgaatgcaacatattatttgtaggcggttggcatcttgatatttgtgttttaagtttttgtg

SEQ ID NO: 4531 - DNA, 491 bp, Orobanche aegyptiaca
ttcttcagcggctgcttcccctcgttcatttcgttttgcagagaaaatggattctggaatcaagactgcagtggtggtgaaggttatgggtagaacagggtcccgtggacaagtgactcaggttagggtgaaatttaacgatgatagtaaccgtttcattatgagaaatgtcaagggacctgtgagggaaggtgatatactcacattgatggagtctgaaagagaggctaggaggctccgctgattggtggtggtgatgatgatgatgatgatgcgcttcgtattgtgcccctgcaatcatttttattactagtaatttgatgtcttagactttctctgtggatttttacccttaaagattgtatgggggcgttttgtttctcaatcgacaattgttcttttcatgtttatcatgtttgtttaatgtgattttgcagtttgttattgaatcttcaactattagtttgaaatggttgtgttattgtttctcc

SEQ ID NO: 4532 - DNA, 694 bp, Pinus taeda
aggcttatccggtggagcttggacagagatttggagctccgaacgtgagaactggtctgcgaggaaatcatggatacaggaattaagttggcggttgtggtgaaagtaattggccgtactggatcaagaggtcaagttacacaggtccgagtgaagtttttggatgatcagaaccggctgatcatgaggaatgtgaaaggacctgtcagagagggtgatgtccttacccttctagaatccgaaagggaagcaagaagattgcggtgatcatattattccagattatagattggacttgagtgatcatattattaagattttagatttgagtttttcaatggattagttttctagcgtttgcttttattttcaatgcaaaaagaccacatgcaaggcactaaacggtttgtgataatgtttcaatttgttttggaggattaagacctatcttatttttgaggggggagttggaaccatatttatggattgaaattcaagttaatacagttacagattttttgtgaagaagcattattatagagctgtgcttgtttccgcaaacttttgcatttctattctttcacaactaaaactaaatcattccgttacagggtttgagtaaaattgctattgtctggaacaataaccttgaactgcaacaattgattatacttgtttccttaatgaaaccttt

SEQ ID NO: 4533 - DNA, 322 bp, Selaginella moellendorffii
gggttcttgagagccgccgggaactagcaagcgccgcgccatggatcagccggtgaagctcgcaattgtgaccaaggtgatcggcaggacgggatctcgcgggcaagtgacccaagtccgggtgaagttcctggacgaccagaatcgtctcatcatgcgcaatgtcaaggggccgatccgcgaaggtgacatcctcacgctgctcgagtccgaaagagaagctagaaggctgagatgaagagaccctggcgaaattttgggattgggatttctatgtagccttctcgatcgatgaaattctaatagaaagagtcttgtgttt

SEQ ID NO: 4534 - DNA, 349 bp, Selaginella moellendorffii
aaagccctagctaaagagttttagggttcttgagagccgccggaaacagcaagcgccgcgccatggatcagccagtgaagctcgcaattgtgaccaaggtgatcggcaggacgggatctcgcgggcaagtgacccaagtccgggtgaagttcctggacgaccagaatcgtctcatcatgcgcaatgtcaaggggccgatccgcgaaggtgacatcctcacgctgctcgagtccgaaagagaagctagaaggctgagatgaagagaccctggcgaaattttgggattgggatttctatgtagccttctcgatcgatgaaattctaatagaaagagtcttgtgtttaaaat

SEQ ID NO: 4535 - DNA, 443 bp, Triphysaria pusilla
ttttgcttttggtttctgtgctctcagtttttctccaagtcttcagagaatggaatcacaaattaagcacgccattgttgtgaaggttatcggaaggactggttctcgtgggcaggttacccaggtgagagttaagtttatggatgacacaaaccgtttcatcatgagaaatgtgaagggaccaatcagggagggtgatgttcttaccctcatggagtctgagagagaggcccgtaggttgcggtgattggctctggctcgagtaggctcatcaaatatgtgtcgtgtttttggccttataattgttctaaactatttatcattgtattaggagacatcaatttgagcaatgagcttagcttgctattttattttcttggtttgacattgaaagacattgttgttttgcttttgataatgctatctaaatgtgatttgggtta

SEQ ID NO: 4536 - DNA, 447 bp, Triphysaria pusilla
ttttgcttttggtttctgtgctctcagtttttctcgaagtcttcagagaatggaatcacaaatcaagcacgcgattgttgtgaaggttatcggaaggactggttctcgtgggcaggtgactcaggtgagagtcaagtttatggatgacacaaaccgtttcatcatgagaaatgtgaagggaccaatcagggagggtgatgttcttaccctcatggagtctgagagagaggcccgtaggttgcgttgattggctctggctcgggctcgagttgagtcatcaaatctttgtcgcgtttttggccttataattgctctaaactttttatcattgtattaggagacaccaatttgagcaatgagcttagcttgctattttattttcttggtttgacattgaaagacagttgttttgcttttgttattggtatctaaatgtgatttgggtta

SEQ ID NO: 4537 - DNA, 815 bp, Volvox carteri
cacccgagcttaaagcagcgcaaaaatggacgccccggctaagctcgccatcgtcatgaaggttattgggcgcactggctcgcgtggccaggtgacccaggtgcgcgtgaagttcctggacgatcagaaccgtctgatcatgcgcaacgtgaagggccccgtccgtgagggcgatatcttgaccctactggagtctgagcgtgaggcccgtcgtctgcggtaaagctcaacaggcgcagactgctttgttagctgctgttggatgagtgaaagagtgtaaccgtggcgctgctcgtttcccgttcctacggcacttggcagcggtttggcaagggtctttgaccggccagcagagtaccgaatgtccatgaagtgccagagcttgccaggggacctgcagcatgcttgcaaaaggctccgatatgtgcgtatccctggtggactcccgtgtactccacagcgaccgccctcgccaaagaatttggatttgcagcggaaacgggcagacgcgcttttgcatctcgatgtccgagcagacgttcagattagagggggtgcaggcgcctgtgagagggcagccagatggcgcgcttttccagggaaggatcacttttgaggagggtgaatggaatatatgtcggcgaggcgtcctccagaagaacctctccatcagctgtagctggggctcattcaaacgtatcgatggttgctcgtttatgcccttcaatgacgagggtttaatgtatgcaaaaagcatctgacgatgtgcagctggggtgagctgaggagtaggtatgattaaatgacagccgggt

SEQ ID NO: 4538 - DNA, 424 bp, Phaseolus coccineus
  misc_feature (19)..(19): n is a, c, g, or t
  misc_feature (47)..(47): n is a, c, g, or t
  misc_feature (89)..(89): n is a, c, g, or t
  misc_feature (174)..(174): n is a, c, g, or t
  misc_feature (176)..(176): n is a, c, g, or t
  misc_feature (218)..(218): n is a, c, g, or t
ggactttggttagcaagcntcgcaaaaccctagcctactttcttcantcgttttttatttcaggagggactttcaggtgaagcatgctnttgttgtcaaagttatgggtcgtactggatccagagggcaggtgccccaggttagagtgaagtttttggatgatcagaatcgtcncntcatgaggaatgtgaaaggccctgttagagaaggagacattntccccctcctcgaatccgagagggaagcaagaagattgcgctagatggtttaaatcgaaacagtggcttgatttttgtggtagttagtggatgccaaaggttatatcagcctatcttgatgtttgggatctatttttattcgaattatggacggaattttgttgtttttagtttaagttttaagattgaagtatgattggcttgat

SEQ ID NO: 4539 - DNA, 424 bp, Phaseolus coccineus
  misc_feature (55)..(55): n is a, c, g, or t
  misc_feature (62)..(62): n is a, c, g, or t
  misc_feature (66)..(66): n is a, c, g, or t
  misc_feature (78)..(78): n is a, c, g, or t
  misc_feature (113)..(113): n is a, c, g, or t
  misc_feature (168)..(168): n is a, c, g, or t
  misc_feature (229)..(229): n is a, c, g, or t
  misc_feature (371)..(371): n is a, c, g, or t
ggactttggttagcaagcatcgcaaaaccctagcctacttttttcactcgttttntatttcngganggactttcaggngaagcatgctcttgttgtcaaagttatgggtcgtnctggatccagagggcaggtgccccaggttagagtgaagtttttggatgatcagantcgtcccatcatgaggaatgtgaaaggccctgttagagaaggagacattctccccctcctngaatccgagagggaagcaagaagattgcgctagatggtttaaatcgaaccagtggcttgatttttgtggtagttagtggatgccaaaggttatatcaccctatcttgatgttttggatctatttttattcgaattatggacngaattttgttgtttttagtttaagttttaagattgaagtatgattggcttgat

SEQ ID NO: 4540 - DNA, 459 bp, Phaseolus coccineus
ggggattttggttagcaagcatcgcaaacccctcccctactttcttcactcgttttttatttcaggagggactctcaggtgaagcatgctcttgttgtcaaagttaggggtcgttcgggatccagagggcaggtgccccaggttagagtgaagtttttggatgatcagaatcgtcccctcatgaggaatgtgaaaggccctgttagagaaggagacattctccccctcctcgattccgagagggaagcaagaagattgcgctagatggtttaaatcgaaccaggggcttgatttttgtggtagttagtggatgccaaaggttatatcaccctatcttgatgtttgggatctatttttattcgaattatggacggaattttgttgtttttagtctaagttttaagattgaagtatgattggctttgtattattatgtatcatggtttgaattttggatac

SEQ ID NO: 4541 - DNA, 559 bp, Solanum tuberosum
cccgtttttttagaggttttaatcattctccattctttgatacacagcagcagcatacagcagcagatttttctcaccggaaatggaatctgtaaccaagcatgcaattgtgattaaaatcatgggtcgtactggatccagggggcaggtgactcagtcaagtttcttgacgaccagaacaggtttatcatgagaaatgtcaagggaccagtcagagagggtgatattctcacattgttggagtctgagagggaggccaggagattgcgctgagcccataattttgattgccatatcgaaatttccttgagtacttgattattgactgggatttattccctagttaatagtctttggttttgtttgcttagactctttaagtttggatatgttgattttggtgcacttcatgtttctggaattgtttttatgttaaaattttgctagcattgcgtcaatggcaacgagtaatggttcttatttgttttcgtgtttgctggatggacgtccatctatcatgttgaatctttttccagtgttccttatgtgtgatattggt

SEQ ID NO: 4542 - DNA, 424 bp, Phaseolus coccineus
ggactttggttagcaagcatggcaaaaccctagcctcctttcttcactcgtcttctatttcaggagggactttcaggtgaagcatgctcttgttgtcaaagttatgggtcgttctggatccagagggcaggtgccccaggttagagtgaagtttttggatgatcagaatcgtcccttcatgaggaatgtgaaaggccctgttagagaaggagacattttccccctccttgaatccgggagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtttaagttttaagattgaagtatgattggcttgat

SEQ ID NO: 4543 - DNA, 336 bp, Allium cepa
aatcagtcgaagagaattatttgacatggacaatcaagtgaagctggcagtggtggagcaagtgatgggccgaaccgggtcaagaggacaggtgacccaagtccgagtcaagttcttggatgatgagaacaggcgcatcatgaggaacgtgaagggcccggtcagagttggtgacttcctcactcttcttgagtccgaaagagaagccaggaggcttcgctgaacaatgcaccatcaccttctccatcttcgaaatgacttttatatccctactattgctatgtttttaatgttggtattacgccctttattgtgattgagatgatttcggttagt

SEQ ID NO: 4544 - DNA, 425 bp, Raphanus sativus
  misc_feature (27)..(27): n is a, c, g, or t
  misc_feature (62)..(62): n is a, c, g, or t
  misc_feature (76)..(76): n is a, c, g, or t
  misc_feature (321)..(321): n is a, c, g, or t
atctctggaaattagggctcttgcttnttcgctttgccgccgctaagctcttcaccttcgtntacagaatgtattntcagattaagcatgccgtggcggtgaaagtgatgggacgtacggggtcaaggggtcaggtgactcaggtgcgagtgaagttcacagactctgatcgtttcattatgcgcaatgttaaaggacctgtgagggagggagacatcctcaccttgctcgagtccgagagagaagccaggagacttcgttgatccccttcctcctccactggtggaagcaagaacacagaaccaaatgtccgcttagttntcttttttttttttttttgttcttgttattggattagtgattatgcactcggttgtgtttggttgttgctataagacaattcttggattgatatttgttccgtc

SEQ ID NO: 4545 - DNA, 399 bp, Triticum aestivum
gagcaccttgcgccgccgcctccgtcgtctcagcagaagcaccgatccccatccccaacaaccaaagaaagcatggatacgcaggtgcaacctcccactggtggtcaaggtgatgggccgcaccgggtccagggggtcaggtgacccacgtgacagtcaagttcctggacgaccaacaaccgtctcatcatgaggaacgtcaaggggcctgtccgggagggcgacatcctcaccctgctcgagtctgaagcgggacgccaggaggctcccctaagcactttctttcttcaccctgtctgtcttcggaagtactcctgaaattgtgtgctgttgccttcttaatctactgcttccgtcttttgccttggctatggagatgtaatgagtttccttctgttg

SEQ ID NO: 4546 - DNA, 424 bp, Phaseolus coccineus
  misc_feature (37)..(37): n is a, c, g, or t
  misc_feature (70)..(70): n is a, c, g, or t
  misc_feature (89)..(89): n is a, c, g, or t
  misc_feature (115)..(115): n is a, c, g, or t
  misc_feature (174)..(174): n is a, c, g, or t
  misc_feature (176)..(176): n is a, c, g, or t
  misc_feature (306)..(306): n is a, c, g, or t
  misc_feature (356)..(356): n is a, c, g, or t
ggactttggttagcaagcatcgcaaaaccctagcctnctttcttcactcgttttttatttcaggagggantttcaggtgaagcatgctnttgttgtcaaagttaggggtcgttcnggatccagagggcaggtgccccaggttagagtgaagtttttggatgatcagaatcgtcncntcatgaggaatgtgaaaggccctgttagagaaggagacattctccccctcctcgaatccgagagggaagcaagaagattgcgctagatggtttaaatcgaaccagtggcttgatttttgtggtagttagnggatgccaaaggttatatcaccctatcttgatgtttgggatctatttttnttcgaattatggacggaattttgttgtttttagtttaagttttaagattgaagtatgattggcttgat

SEQ ID NO: 4547 - DNA, 424 bp, Phaseolus coccineus
  misc_feature (4)..(4): n is a, c, g, or t
  misc_feature (19)..(19): n is a, c, g, or t
  misc_feature (70)..(70): n is a, c, g, or t
  misc_feature (87)..(87): n is a, c, g, or t
  misc_feature (110)..(110): n is a, c, g, or t
  misc_feature (113)..(113): n is a, c, g, or t
  misc_feature (282)..(282): n is a, c, g, or t
  misc_feature (331)..(331): n is a, c, g, or t
ggantttggttagcaagcntcgcaaacccctaccctccttttttcattcgttttttatttcaggagggantctcaggtgaagcatgntcttgttgtcaaagttaggggtngtnctggatccagagggcaggtgccccaggttagagtgaagtttttggatgatcagaatcgtcccttcatgaggaatgtgaaaggccctgttagagaaggagacattctccccctcctcgaatccgagagggaagcaagaagattgcgctagatggtttaaatcgaaccagnggcttgatttttgtggtagttagtggatgccaaaggttatatcaccctntcttgatgtttgggatctatttttattcgaattatggacggaattttgttgtttttagtctaagttttaagattgaagtatgattggcttgat

SEQ ID NO: 4548 - DNA, 412 bp, Solanum tuberosum
catacagcagcagatttttctcaccggagatggaatctgtaaccaagcatgcaattgtgattaaagtcatgggtcgtaccggatccagggggcaagtgactcagtcaagtttcttgatgaccagcacaggtttatcatgagaaatgtcaagggaccagtcagagagggcgatgttctcacactgttggagtctgagagggaagccaggaggttgcgttgagcccatgattatgattgccaaatcaatattcccttgaatactcgatattggctgggattttgttccctatttaatagtctttggttttgtttgcttagactcttttaagtatggacatgttgattttggtcatttttgtgcacttcatgtttctggaatagttttaatataatattttgctacatttgtgtc

SEQ ID NO: 4549 - DNA, 739 bp, Aristolochia fimbriata
tagtgactaggtttagggttttggctccacgcaaaagagtctctgttctcccgtctacacctgcatttcacagcggggaagaaagcgaatatggattcccaggtgaagctcgcccaagtcgtcaaagtgattggccgaactggctccagagggcaggtgacacaggtcagagtgaagtttatcgacgacccaaaccgtctcattatgaggaatgtgaaggggcccatccgcgaaggtgattgcctcaccttgatggagtcagaacgcgaggccagaaggcttcgctgatgtgctctttcgttgctctcatttctcctcttccgtaatggatgttatacttcgtgtcgggttctgaagatttttatttttatttttatgggcggattttgtcttctggtgaccataagatctagtatggggtttacataatattgctcttgttctacacattttgacaacgttttgtagtaagtaaggtttctttcagtttatctgtttttgtgttttactattattttagaaatctgcttcctagttatgattcttgaggatgctagattctaaacaaatcaaggcagtaaagcctgatatctctacaactctgtttctctcttaaatctcaaaaactgacaattattcacgagaccaaattattcgccggatttgttggatttattagaggatcaaaaggataacttaatcaagaattgtttagtttatctacaatttctttctttca

SEQ ID NO: 4550 - DNA, 457 bp, Ocimum basilicum
gcacgaggatacacagcagtagcagcaacagcaacaacaacaacaacctacagctgcagatttttctcaccggaagaatggaatctgtaaccaagcatgcaattgtgattaaaatcatgggtcgtactggatccagggggcaggtgactcatgtgagagtcaagtttcttgacgaccggaacatgtttatcatgacaaatgtcaagggaccagtcagagagggtgatattctcacattgttggagtctgagagggaggcaaggagattgcgctgagcccataattatgattgccatatcgagtacttgattattggctgggatttattcctatttaatagtctttgattttgtttgcttagactctataattttgaatatgttgattttgttgcactttatgtttctggaatagtttcatgttaaaattttgctagcattgcgtcaatggcaacaag

SEQ ID NO: 4551 - DNA, 576 bp, Tropaeolum majus
cggccggggaaaccctaattgcttcatatcttcccctataaaacataaacataattttgaaaattctcctatatcgacagtaatcacaacactaagcagaatggattctcaaattaagcatgctattgtgactaagatcattggtagaacaggatcgagaggtcaagttactcaggttagggtgaagtttatcgatgatccgaaccgagtcatcatgaggaatgtaaagggcccggttagagaaggggattacctaactctgctcgagtccgagagggaggctaggaggttgcggtgaatgtcatccgttgctatggcggctcttattcagcttgcaagttatgttaaagtatgtttggtagtgccctttatatcatgttaaagtttatatcaaaaagtatggtatgattaagatctcagtttatgaatagactagattctttgtatctgtttattcgatctcatgtttcctcccaaacaaatttttaattattttgtcttttctatgggctgccaattgatgtctcgatgatgaatgattcagtagattcagtggattttgtatctgtttattcg

SEQ ID NO: 4552 - DNA, 481 bp, Quercus alba
attatttgcgtttttaatttctcttaaacaaggagcatttttatttaactagcgtgagtgatctcttggcaatcagctgtgcaaaatgaacactgacgtgaagcatgcgattgtgacgaaagttgttggtaggacaggatcaagagggcaggttactcaggtgagagtgaggtttacagacgatgcaaaccgccaaattatgaggaatgtcaagggacccgttagagaaggtgatatcctcactcttcttgagtcagaaagggaagcaagaaggttgcgttgatggtgttttttttttttttcctatggttcaaatttagatatatgactgagttttagtatctatgaacattttgtgaaaatggatactttgtttgggatgctatggcagattttattttagaataaatgctatgtagttggtttaaacaagcatgttttgttttttgctgtagtaaaccatttatatctggattttgat

SEQ ID NO: 4553 - DNA, 498 bp, Quercus alba
attatttgcttttaatttctcttaaacaaggagcatttttttttttttaaccagcgtgagtgatttcttggtaatcagctgtgcaaaatgaacactgacgtgaagcatgcgattgtgacgaaagttgttggtaggacaggatcaagagggcaagttactcaggtgagagtgaggtttacggacgatgcaaaccgccaaattatgaggaatgtcaagggacctgttagagaaggtgatatccttactcttcttgagtcagaaagggaagcaagaaggttgcgttgatggtttttttttttttaattttttttatctatggttcaaattcagatatatgactgagttttagtatctatgaacattttgtgagaatggatactttgtttgggatgctatggcagattttattttagaataaatgctatgtagttggtttaaagtttaaacaagcatgttttgatttttgctgtagtaaaccatttatatcttcattttgat

SEQ ID NO: 4554 - DNA, 516 bp, Sequoia sempervirens
tggcgatccattgaggcgcggctgagctcgctaggtctgcagaaatacactattttcagacaaccatggatactggggtaaagatggcagttgtgatcaaggtcattggccgcactggatcaagaggtcaggttacacaggttcgtgtgaagtttatagatgatcaaaatcgtcttattatgcggaatgtgaaaggtcctgtcagagaaggtgatgtccttactctgctggaatctgaaagagaagcaaggagactgcggtgatcatgtttttacttattaaaattcttaggtttggactgtgggtggattattttcctggatttttggttgagaagtgatcaaggagtatggccttttaatttttacaaatgcttgcacatttattggaaaatttgatagcctgataggcagtgcctaagttggtttattaaactacatttattattattatcaactacttttttgatttgaatctatgattattttgaatctaatctataatcatacagtttgc

SEQ ID NO: 4555 - DNA, 501 bp, Triticum aestivum
  misc_feature (77)..(77): n is a, c, g, or t
  misc_feature (80)..(80): n is a, c, g, or t
  misc_feature (150)..(150): n is a, c, g, or t
  misc_feature (210)..(210): n is a, c, g, or t
  misc_feature (240)..(240): n is a, c, g, or t
  misc_feature (248)..(248): n is a, c, g, or t
  misc_feature (258)..(258): n is a, c, g, or t
  misc_feature (283)..(283): n is a, c, g, or t
  misc_feature (307)..(307): n is a, c, g, or t
  misc_feature (358)..(358): n is a, c, g, or t
  misc_feature (364)..(364): n is a, c, g, or t
  misc_feature (415)..(415): n is a, c, g, or t
  misc_feature (427)..(427): n is a, c, g, or t
  misc_feature (436)..(436): n is a, c, g, or t
  misc_feature (481)..(481): n is a, c, g, or t
cctgaattatttcctccctctccgcgccgccgcctccgtttgttgtagcagaagcagcttgcgccgccgcctccgtngtntcagaagcagccggagaaagcatggatacgcaggtgaagctcgcggtggtggtcaaggtgatgggccgcnccgggtcgaggggtcaggtgacccaggtgagagtcaagttcctggatgaccagaaccgtntcatcatgaggaacgtcaagggccctgttngtgagggngacatcctcnccctgctcgagtttgagcgggaggntaggaggctgcgctaaaaaatttnttcctttatacctgtctgtcttgggaagaagaatgctgtactgttgccttnttagtntactgctttccttctttgcctagctatgtggaggtgtaatgagttttgttntgttgcctaaantaaagtgcncttgatgttgtgagacttgatcatttttgcgcacctcttggtaangtgaatcggaatcgtctata

SEQ ID NO: 4556 - DNA, 665 bp, Trigonella foenum-graecum
aaagggtttttggcacttgtaaccgcagctgcgaaattagggttctttgtctcccttcatcaagatggaatcgcagactaagaacgttactgttgagaaagttatcggtcgtactggatccagaggacaggtcactcaggttagagtcaagtttatggatgatcctagtcgccacatcatgaggaatgtgaaaggtcctgttagagtaggagacgttctcaccctacttgagtccgagagagaagctagaagactccgatagaagagtagctttctcaatggtttggtgcaagatataatgaagcaatgctggttgtcgtagttaccttatgaaaaatgtttttgtattcacttttacattttgcacctatgacctattacttgagcttttatttgggtgagttttgactaaaattgtgctttgactatatattatgtttttcatgcttaattggctgtattcaaatgcagttcttggttactttgatataattatgcaaatgcttatgatttgaagcatgtgtattagcttttagatctataataattttgtgcttagccactcaatatgttagctaagattgtcacgcttatgtgatagaatatcaaagtggctcaaaatgttaatatctctttggtggtggtttgttaaagagttgcaacct

SEQ ID NO: 4557 - DNA, 489 bp, Cicer arietinum
acgcggggagggtttctgtattttctcgcagcttgtttcgggtgctctctttcgtcaatcaacagcaaaatggattctcaagtcaagtatgcttctgtcgtcaaagttattggccgtaccggttctagaggacaggtgactcaagttagggtgaggtttaatgatgatcatacccgtctcatcacgaggaacgtgaaaggaccagtcagagaaggagatgtcctcactctactcgagtctgaaagagaagcaaggaggttgagatagagttttaaaaagaagtgtcaagtttgcgataatgaaaccttcaatgttttgtgtttttggtggtatttgacagttgtttgtgataatgaaaccttcaatattttgtgttttgggtgttatttagcagatgtgaactgttattatttaaattttaattattaaccacctattttgactttatattttattttgggtgttttgaataaatttttgtgttgacta

SEQ ID NO: 4558 - DNA, 422 bp, Ipomoea batatas
  misc_feature (47)..(47): n is a, c, g, or t
ggcacaaggatagttcagaacggccgtagcctccatcctctcctttngatttttgaagaatggagtctcagatcaagcatgctattgtggtgaaggttatgggtcgtactggatccaaagggcaagtgactcaggtgcgagtcaagtttattgatgaccaaaacaggtttatcatgaggaatgtcaagggaccagtcagaaagggttatgtgctcactctgctggagtcccaaaaggaagccaagaggttgcgttgacccccccaaaaaaaatctcaattgcatataaaagggcgttaaatacgcgaaatctatttatcagttttgctgtactacttaatagctttcttggattatgacagtttgttaaatttggacaaatgcatcacttcatttaatggatttgatatgattgtgtccctg

SEQ ID NO: 4559 - DNA, 411 bp, Rosa hybrid cultivar
tttctctcgaaaactttggagcatcggagtcgcagcctcttcaggatcggagaatggaatccacagtgaagcatgctcttgtggcgcaaggtcatgggccggactgggtctaggggacaggttactcaagtgagagtcaagtttttggatgatcagaatcggttcatcatgaggaatgtcaagggaccagtgagggagggtgatatccttaccttgctcgagtctgagagggaagcaagaaggttgcggtgattttctgttggctcctaccgcagttttgctaagatgctttcgactgttatctctgttggtcaatggcagttgtgttgccgatgtatgctgtttcttttcaatgtttcgtgttgttagtagtaacttccccgactttatttttgtgatggaatttctagt

SEQ ID NO: 4560 - DNA, 199 bp, Helianthus annuus
ccccgtcaagctcgccattgtggtgaaggtgctcggccgcaccggaagccgtggtcaggtgacccaggtccgcgtcaagttcctgtacgaccaggagcgccagatcatgcgcaacgtcaagggccccgtccgcgagggcgatgtgctgaccctgctggagtctgagcgcgaggcccgccgcctgcggtgaagagcgcgc

SEQ ID NO: 4561 - DNA, 396 bp, Sarracenia psittacina
  misc_feature (318)..(318): n is a, c, g, or t
gctcttcctggctgttttcgcgaggcgcaaggggcatccgtgagactcatcatggatactcaagtgaagcttgccatcgtggtcaaggttatcggtcgcacaggatcaagaggacaggtgacgcaagtgcgtgtgaagttcctggatgcagagcggctcattatgaggaacgtcaaggggcctgtccgcgagggtgacatttctcgaccctcatggagtccgagcgtgaggccaggaggctgagataaatgcaagggacggtggaggtgtgagaggcgaacgacagttggggctcctctgtgtgttctggagaagggngacagatcagtcttgccaatgtcattaggaaaagacaggcctcgtggagcttagtatgtttcgtggtcgtggacgagg

SEQ ID NO: 4562 - DNA, 520 bp, Camellia sinensis
atctagcgccgactgttctacatccctgcgccaagtctctcccaccgcacctcttctcccctgtcataatggagtctcagatcaagcatgccatcgtggtgaaagttatgggaatggaggatcaaggggacatgtgacccaggtgagggtcaaatttattgatgatatcaaccggtttatcatgaggaatgtcaagggaccggtgagggaaggggatgtgcttccctgctcgagtctgagagggaagcgaaaggttgcgatgatctcttttgccttgttctaaccaccaagttttaattgcttgttaatcccctccattcttactccatatgcattatgttatgatatgttatttaacactactttcttcatatctgaggattgagattgatgatttgcctttctttttttttgttggtgtttgataattactgattaatatggattattgcttgagatgatggagtaaaatgctttaatcatttatgcttgaaatgaaacatgacggccgcctcggcct

SEQ ID NO: 4563 - DNA, 268 bp, Flaveria ramosissima
cacgcagttgcggtgaagataatggggcgaaccggatcccgagggcaagttacacaggttcgagtgaagtttctcgatgatcagaaccggttcatcatgagaaacgttaaaggaccggtgagagaaggtgatgttcttacgttgcttgaatcggagagagaggctagaagattgcgttgattacgtgatgattttggcatcggaaattcactggttcgatttttaatctatttgtttttgttttgtatttgattttgacttttgtttt

SEQ ID NO: 4564 - DNA, 414 bp, Fraxinus spp
catgccatcgtggtgaagattatgggcaggaccgggtctcgtggtcaagtcactcaggtgagagtgaaatttatcgatgaccagaaccgtttcattatgaggaatgtcaagggaccagtcagggaaggtgatgttctcaccctgctggagtctgagagagaggccaggagattgcgctgatggctttacttgcagtctttttctctgctcgagtttttagctatttaaaaattactctatgtaggattattcctttatgggaattcagacaaggcatcgaggtgctcgtgactgcactggatgcttcattttcatgtttgtgatgtgaaggtagatgaacagatttgagtgcatttcacgagggattttgcaattataatctgatatcactttcatactcttcgggctttacta

SEQ ID NO: 4565 - DNA, 497 bp, Ocimum basilicum
tgctagggttcctccgcggcccctctttctccctttgtttttcagcacgcagtcgtggtgaaggtcattggtaggacgggttctcgcggccaagtcacacaagttagggtcaagtttatcgatgatcagaatcgatttattatgaggaatgtgaagggccctgttagggagggcgacattctcaccttgttggagtctgaaagagacgcgaggaggctgcgttgattgcgtcgacattgcatctcatcgtccttgactacacttcatggaagctttgcaatttgatggggcctctatgtggtattcttctttgcatgacagggatttcaaaacaagctttttgatttaggctttttctggatctgttgcgatgtgtactgcttcttcaaccttaatttttgtgtgattttgtatggattgtaaggtagttgtagggtttattaaggaaattcacattttgtagcggtttagtaatggtattatgacatttagcatct

SEQ ID NO: 4566 - DNA, 407 bp, Fraxinus spp
acatctaatcgtcgagctccatttgtgtattctagttttctctcagccgtcgctttcattcattcttcagaattggatttctacaaattctaagtctattgtccattttgtcgtgaagatcatgggcaggactggttctcgaggtcaagtgacccaagtgagagtgaaatttattgatgaccagaatcggttcatcatgagaaatgtcaagggacctgtcagggagggtgatgtactgaccctgcttgaatctgagagagaggcaaggaggcttcgctgatggcttcatttctgcttgagtttttgtagttttgatataataatctaatgtaagcttttgcgtggtttatgcttttttgggacttcatagtagacttggtgccactgtgggacacttgtttgtttcc

SEQ ID NO: 4567 - DNA, 439 bp, Phaseolus coccineus
ggattctggttagcaagcatcgcaaacccctagcctcctttcttcactcgttttctatttcaggagggactctcaggtgaagcatgcttttgttgtcaaagttatgggtcgtactggatccagagggcaggtgacccaggttagagtgaagtttttggatgatcagattcgtcccatcatgaggaatgtgaaaggcccttttagagaaggagcctttttccccctcctggattccgagagggaaccaagaagattgcgctagatggtttaaatcgaaccaggggcttgatttttgtggtagttagtggatgccaaaggttatttcaccctttctggatgtttgggatttatttttattggaattagggacggaattttgttgtttttagtttaagttttaagattgaagtatgattggcttgatatatgtatcatggtt

SEQ ID NO: 4568 - DNA, 420 bp, Phaseolus coccineus
  misc_feature (38)..(38): n is a, c, g, or t
  misc_feature (58)..(58): n is a, c, g, or t
  misc_feature (66)..(66): n is a, c, g, or t
  misc_feature (68)..(68): n is a, c, g, or t
  misc_feature (83)..(83): n is a, c, g, or t
  misc_feature (109)..(109): n is a, c, g, or t
  misc_feature (172)..(172): n is a, c, g, or t
  misc_feature (209)..(209): n is a, c, g, or t
  misc_feature (387)..(387): n is a, c, g, or t
  misc_feature (401)..(401): n is a, c, g, or t
tctggttagcaagcatcgcaaaaccctagccaactttnttcattcgttttttatttcnggagggantntcaggtgaagcatgnttttgttgtcaaagttatgggtggtnctggatccagagggcaggtgccccaggttagagtgaagtttttggatgatcagaatcgtcccntcatgaggaatgtgaaaggccctgttagagaaggagncattctccccctcctcgaatccgagagggaagcaagaagattgcgctagatggtttaaatcgaaccagtggcttgatttttgtggtagttagtggatgccaaaggttatatcaccctatcttgatgtttgggatctatttttattcgaattatggacggaattttgttgtttttagtntaagttttaagatngaagtatgattggcttgat

SEQ ID NO: 4569 - DNA, 363 bp, Brassica napus
ctaagttctctctccgccgcctctccctgagccgtcgtctttagattaagcacgccgtggtggtgaaagtgatgggtcgtactggatccaggggtcaggtgacccaggtacgagtgaagtttacgagactctagatcgttacattatgaggaacgttaagggaccagtgagagaaggcgatatcctcaccttggctcgagtctgagaggagaagctaggagacttcgttgattcgttgtctgtctctccagtgaacagagacagaaccatggtctgctttatctctctttttctgtttctcgtagtctggattagtggattagtgcctttcggaattgaattttggtttactataagacattt

SEQ ID NO: 4570 - DNA, 330 bp, Pisum sativum
aagttatgggacgtactggatcaagaggacaggtgactcaggttagagtgaagtttttggatgatcagaatcgtcacattatgaggaatgtgaaaggaccagttagggagggagatattctcaccctgcttgaatctgagagagaagcaagaagactcagatagatgagtagtattgttatcttaatgttttgttgcaagttttaatgaaccattactatttttggtagttagtttatgccaattgtttgtgtttaagttaagttaaagatgttctgtttggtttatgtctttgggtaaaactgtctcacgacattgtgtccttttctaa

SEQ ID NO: 4571 - DNA, 369 bp, Primula obconica
aggatggacactcagataaagcatgcatttgttgtgaagatcatgggtcgcacaggctcaaggggacaggtgactcaagtgagggtccagtttgcggatgatgctactcggttcattatgagaaatgtgaagggccctgttagggtaggtgatgttctcacccttctcgagtctgagagggaggcaaggaggcttcgttgagtccatttcatctgcttttacttcctatcattcacgtagttttctggtttcatggaacggtttatttaaactttagttcttgttgtgtttggaagtgagtgttgtttggagactggtttatgttcttgtaagactattttgattgagaaagacgatttgtgttggttg

SEQ ID NO: 4572 - DNA, 217 bp, Aquilegia formosa
caatggattctggagcaaagaacgcacaagtgattaaggtgattgggcgaacaggttcgagaggacaggtgactcaggttagagtcaagtttctggatgacacaaaccgaattatcatgaggaatgtcaaaggacctgttagagaaggggatgttctttgccttctcgagactgaacgagaagctagaaggttgcgttgatttattaatttttccat

SEQ ID NO: 4573 - DNA, 178 bp, Ostreococcus lucimarinus
agcaatcgtgatgaaggtcatcggtcgtacgggctctcgtggccaggtgacacaggttcgtgttaaattcttagacgaccaaaatagacagattatgcgaaatgtgaagggcccggtgcgagaaggcgacatattgacgttgatggaatctgagcgtgaggctcgacggttaagataa

SEQ ID NO: 4574 - DNA, 357 bp, Salvia sclarea
ctactagaccttggctgtcactcagcagattatcacctacggcggcgatctgtccggttcagaaacctgcaattctctgcggtttgtgtgcgtaaacttcttcaagcataaatggagtctcagatcaagtacgcgtctgtggataaggttgtagggcgaactgggtcgagggggcaagtgacccaagtccgggtgaagttccatgacgacccgagccgtctgatcatgaggaacatcaagggcccggttaaggaaggggacatcatcacgctcctcgagtcggagcgtgaggccaggaggctgcgatgattgattttgcattatcgtttctttcgagatctagcctcgttggttcta

SEQ ID NO: 4575 - DNA, 545 bp, Pinus taeda
gtggagttcgcacagagatcggagctttcaacgtgagcaatcgtcttcgagttttgcatacattgcgctgtgggcaaggagctaagggtgtggagtgtttggcaaggagatttaagattcaagcaccaggaagtcatggataccggtgtgaaattggcagttgtggtgaaagtaattggccgtactggatcaagaggtcaagttacacaggtccgagtaaaatttttggatgatcagaatcgacttatcatgaggaatgtaaaaggacctgtcagagagggtgatgtccttactttgctagaatctgaaagggaaggacatcaccctctctgacaggtccttactttgctagaatctgaaagggaagcaaggagattgcgctgattatgttgtttagattatcacattggacttaaagtgagacgggaataacttatattgttatgtgttctgtttctgtcattatcttgtactgtagtgtttgctattgttttcgatgcaaagggatcaatgagtgaggctataaatgatttgtgatatgtaat

SEQ ID NO: 4576 - DNA, 537 bp, Arabidopsis lyrata
  misc_feature (334)..(334): n is a, c, g, or t
  misc_feature (483)..(485): n is a, c, g, or t
  misc_feature (491)..(491): n is a, c, g, or t
  misc_feature (493)..(494): n is a, c, g, or t
  misc_feature (496)..(496): n is a, c, g, or t
  misc_feature (500)..(500): n is a, c, g, or t
  misc_feature (506)..(506): n is a, c, g, or t
ggctcatctctggaaattagggttcttgcttcttcgcttgccgccgctaaacactcaccttcgttctacagaatggattctcagattaagcatgctgtggtggtgaaagtgatgggacgcacggggtcaaggggtcaggtgactcaggttcgagtgaagttcacagactctgatcgtttaattgtgtttaatgttaaaggaccagtgagggaaggtgatatcctcaccttgctcgattttgagagagaagccataagacttcgttgatcccccttcctcctccacaggtggaagcaagaacacagaaccaaatgtctgcttagttctctttttnttttttttttttgcttcttgttactggattagtgattatgcactcaggttctgtttggttgttgctataagacaattcctggattgatatttgttctgtctttttttctggtcttcggagtttattgtgtgaaactcattactcgagtnnncacatngnnantgtnattacncgagtaagccatggtcagtgttattacatga

SEQ ID NO: 4577 - DNA, 655 bp, Theobroma cacao
cttctcctctcacgccaatccaaaaccaaaaaggtaatttgtgtttcgatttggatcgtgaagtgttgagaatggaatctggggtgaagaatgcgacagtgacgaaggtgataggcaggacagggtcacgagggcaagtaacccaggtgagagtgcgtttcataaatgatagcagggagatcacaaggaatgtgaagggacccgtccgggttggggacattctcacccttcttgagtctgagagggaagcaaggaggctacgctgatgcctcatctgtctctgatcatgtgtttggttaggttgatacactttcctctacttgcttaccgcttttgcgttaataatttgtaggttgaacaaaattttaatcttttcccagcaattgcagacaatatcattggggtgttccattgtgtaaaccaatagagcttcaactcaacacttttgccaggttattacttttgttgctgtcctcctctctgatgttgttagaatagctatgcaaatgcaacgccgtcttgtttatgatcaccttggtgcataagtctaaaggacttaaagtggttggagagaatgaaatagtcattccttttctttcttattctcattttagagataaaactgtatttagttgaatgaaatagttatttttca

SEQ ID NO: 4578 - DNA, 394 bp, Medicago truncatula
atgcaatgtttccatcaattgaagatggaatcacagattaagcacgctcaagttgagaaagttatgggtcgtactggatccagaggacaggtcactcaggttagagtcaagattctgcatgagaatcgctatatcatgaggaatgtgaaggggcccattagaaaaggagatgtcattgccctacttgagtctgagagagaagcaagaagactccgatagaagagtagcttttctcaatggtttggtgcaagatataataaagcaatgctggttttgtggttgctagcttatgaaaattgtttctgtattgactttcattttgcacctatgacctatttattattactagaccttttatttggctgagttttgagtaaagattttggtttgactt

SEQ ID NO: 4579 - DNA, 461 bp, Euphorbia esula
  misc_feature (262)..(262): n is a, c, g, or t
cgttttccacctatcttcttcgttctcaagatggattccacaatcaagcatgctttggtggtgaaagtgatgggtcgtaccggatccagggggcaggtgactcaagttagagtcaagtttcttgatgaccagaaccggttcatcatgaggaacgtgaagggaccagttagagaaggtgatgtgcttacccttcttgagtctgagagagaagccaggaggctccgttgatcggtctatgccttgttttgatttcatggacttnagtgaaaattgaaaaaatgtttgtgttgtttatgttttctttgatgcaagtaagacttgattagggattatgttgcttgtagtgcttgaaaattttggagtatgaaagacctaaatttgacttaatatattgatcttgattgttgaaatacttgtattatcatcaagctatttgggatgttacatggttgagttcatgc

SEQ ID NO: 4580 - DNA, 448 bp, Triticum aestivum
  misc_feature (88)..(88): n is a, c, g, or t
  misc_feature (192)..(192): n is a, c, g, or t
  misc_feature (291)..(291): n is a, c, g, or t
  misc_feature (297)..(297): n is a, c, g, or t
  misc_feature (320)..(320): n is a, c, g, or t
  misc_feature (344)..(344): n is a, c, g, or t
  misc_feature (429)..(429): n is a, c, g, or t
cgctctagaatatggatccccgggctgcaggaatcggacgaggcctattgcgcctgcgccgccgcctccgtcgttgtagcaaaagcancgatcccccgtcacaacagccgaagaaagatggatacccaagtcaagctcgcagtcgtggtgaaggtgatgggccgcaccggctccaagggtcaggtgacccangtcagggtgaagttcctggatgaccagaaccgtctcatcatgaggaacgtcaagggccctgttcgtgagggcgacatcctcaacctgctccagtctgancggganggcaagaggctgcgctgaacggntgcttttcctgtcttcgggaagtnaactctactgcattaaatcaacttcctgaacgctggcttgtcttttgcctccgctatgggaatgtaagcagtacttaatatgttnagttttcttctgttgcctg

SEQ ID NO: 4581 - DNA, 242 bp, Cleome gynandra
gggttttttctgttatcggccgacgtttccttttacaggcaaaaaaaaaagacattgaagcaaaataggaatctcaaataaagcacgcggtggtggtgaaggtgatggggaggacaggatcacgtggtcaggtcactcaggttagagtcaaattcaccgactcagatcgttacatcatgaggaacgttaaaggacccgtgcgagaaggtgatatcctcactctcctcgagtccgagagagaa

SEQ ID NO: 4582 - DNA, 782 bp, Glycine max
gagcatgcttacggttctggaatccatcgtataaaagctcaaatccaaaccctaaaataccaccgccgttctcatctctcttcccagccctcacctcaacgctgcatcttcacgtcgtctcacgaggtgcatatagtagagagggaaaatgagtcgaggaggcgcagtagcagcagcgaagggaaagaagaagggtgctacattcaccattgactgtgcaaagccagtggaagataagatcatggacattgcttctctcgaaaagtttcttcaagagaggatcaaggttggtggcaaagctggtgctcttggtgacagtatcactgttacccgcgagaagaccaagatcattgtcacctctgacagtaacttttccaaacggtatttgaagtacttgacgaagaagtacttgaagaaacacaatgtgcgagactggctcagagtgattgcttcaaacaaggatagaagtgtttacgaactgaggtacttcaacattgccgagaatgagggagaggaagaagattagttgtctgataatcttatttgcttgtgttttgtttacccttttcctatacctagctttctttttggcaaatattgcttgagatacgatgctttgtttttatcagttgcaatttaacggttttgatcatttaagaattgcggtactatcggtgttgaattgggaacagagtttacatattattcattgctgtttcagtctttaaaattgtattatgtttctttcaacaatctcgaataatttacctttgcctacctcc

SEQ ID NO: 4583 - DNA, 692 bp, Vigna unguiculata
ggaccctggttctcatctcttcccaatcccgacctcacagccgcatcttcacgtctctcatacgaggtgcgtataatataacaggaaggaaaaatgagtcgaggaagtgcagcaggagcgaaggggaagaagaagggggcgacattcaccattgactgtgcaaagcctgtggaagacaagatcatggacattgcctctctcgagaagtttcttcaagagaggatcaaggtcggtggcaaagctggtgctcttggtgactctgttactgttacccgcgagaagaccaagattattgtcacctctgacagtaacttctccaaacggtatctgaagtacttgactaagaagtacttgaagaaacacaatgtgcgtgactggctcagagtgattgcttcaaacaaggatagaaatgtttatgaactgaggtacttcaacattgctgagaatgagggtgaggaggaagattagttgtctgagtcccttattctctgagtgttttgtttacacttttcttatagctagcttcgtttttggcaaggattgcttgatataacggtgctttgttttgatcagttgcaatttaacattttttatcatttaagaatttttgtacttttaatgttagatgggaatggagtttgcatattattctattttgtctgagtctttaatatggttaaattgcattatgt

SEQ ID NO: 4584 - DNA, 853 bp, Cajanus cajan
ttgggggggtaaaccaaaacgcgcgtttcatattagactataaaatgagacgcaaatccaaaccctaatttcttaccctacttcaccgccgctcgcttcttcacactctggtgtgctctttcggtgtagcttaagaggttcgcgatagtaattgagaaaaatgagtcgaggaggtgcagctagtgccaagggaaagaagaaaggggcgacattcaccatcgattgcgcgaagcctgtggaggacaagatcatggacattgcgtctctcgagaagtttcttcaagagaggattaaggtcggtggcaaggccggcgctctcggcgacaccgtcaccgtcgcacgtgagaagaccaaaatcatcgttacttccgatagcaacttctccaaacggtacctcaagtacttgactaagaagtacttgaagaagcacaatgttcgggattggctcagagtgattgcttctaacaaagatagaagcgtttatgaactgaggtacttcaacattgctgagaatgaaggagaggaagaagattaatcttgttatcggttttattcatttaagaaccttgtttaccaattttctcagtgttagcttctcttttagcttgtgctatgttgcttcgtttacattagttgcgattaaacagttttgttttttcaagagtttgaattcagaacagagttcacatattatattttcaacttttgcctttgatacggttccattgcgttattaaacaaattgttagatcaccttaattccccgatccatagtcctttattatttgtttcaaaatgttgattaaatgatcagttaattgctttaaagcagcaatgtagaattttgtttgac

SEQ ID NO: 4585 - DNA, 706 bp, Phaseolus coccineus
gatccaccgccgttatcatctccttcccaatcctaacctcaccgccgcatcttcacgtcgctcaaacgaggtgagtataatataacagaggaggaaaatgagtcgaggaagtgcagccggagctaaggggaagaagaagggggcgacattcaccattgactgtgcgaagccagtggaagacaagatcatggacattgcctctctcgagaagtttcttcaagagaggatcaaggttggtggcaaagctggtgctcttggtgactctgttactgttacccgcgagaagaccaagatcattgtcacctctgacagtaacttttccaaacggtatctgaagtacttgactaagaagtacttgaagaaacacaatgtgcgtgactggctccgagtgattgcttcaaacaaggatagaaatatttatgaactgaggtacttcaacattgctgagaatgagggcgaggaagaagattagttgtctgataacaccttatccgccgagtgttttgtttacacttttcttatagctagcttcctttttggcaaggactgcttgatatgacagtgctgtgttttgatcagttgcagtttaacaattttgatcatttaagaatttttatgttagttggaacagagtttgcatattattatgtgttgtctcagtctttaatacggttaaattgcattatgtttcgttccagaatctcat

SEQ ID NO: 4586 - DNA, 687 bp, Glycyrrhiza uralensis
acctaccgctgtttctcacctctctcccagtcctcgccgcttcacgcctttctatcgtgtttgagaaaaaacagagaggagaaatgagtcgaggaggtgcagctggagccaagggaaagaagaagggtgcgacgttcaccattgactgtgccaagccagtggaggacaagatcatggacattgcctctctcgagaagtttctccaagagaggatcaaggttggtggcaaagccggtgcccttggtgactctgtcactgttacccgtgacaagaccaaaatcactgttacctctgacagtaacttctccaaaaggtatttgaagtatttgactaagaagtacttgaagaaacacaacgtgcgtgactggctcagagtgattgcttcaaacaaggatagaagtatttatgaactgaggtacttcaacattgccgagaacgagggagaggaagaagattaattgtaccatcagcttatttactcaggaactttgattaccctttttcctagagctagctttccttttggcaaatattgcttgagatatgatgcgttgtttagacccgttgcaattaacagttttgtttgtttaagaattgtgatgccattgttgaattgggaatagagtttgcgtattattctgtgttctttccagctttaatacggttgtagtgcattatgtttctttc

SEQ ID NO: 4587 - DNA, 674 bp, Cajanus cajan
ccgttctcatctctcttccgctgctattcttcacgtctctctaacgaggtccatatattgaagaggaaaaatgagtcgaggaggcgcagcaggagcgaaggggaagaagaagggagcaacattcaccattgactgtgcaaagccagtggaagacaagatcatggacattgcctctctcgagaagtttcttcaagagaggatcaaggttgctggtaaagctggtgctctcggtgacactgttaacgttacccgtgagaagaccaagatcaccgtcacctccgacagtaacttctccaaacggtatttgaagtacttgactaagaagtacttgaagaaacacaatgtgcgtgactggctcagagtgattgcttcaaacaaggatagaagtgtttatgaactgaggtacttcaacatagctgagaatgagggtgaggaagaagattagttatctgataacctaattcgcataagggtttaattttacccttttcctgtagctagcttcctttttggcaagtattggttgagataacactgctttttttgatctgttgcaatttaattggttttgataatttaagagttttgatgttgaattgggaacagagtttacatattattctgcgttgtttcagtatttaatatggttaaattgcattatctttctttccgac

SEQ ID NO: 4588 - DNA, 752 bp, Glycine max
gccattatgttagcgtataaaatgagagccaaatccaaaccctaatttcctaccacaccgcacttcaccgcccctcgtttcttcacactctgccgtgctctttcggcgcaggtcaagagattcgcaatagaaagtgagaaaaaaaaatgagtcgaggaagtgcaactgctgcgaagggcaagaagaagggtgcgacattcaccattgattgcgcgaagccggtggaggacaagatcatggacattgcgtctctcgagaagttccttcaagagaggattaaggttggtggcaaggccggtgctctcggcgactccatcaccgtcgtacgtgagaagaccaaaatcattgttacttccgacagcaacttctccaaacggtacctcaagtacttgactaagaagtacctgaagaagcacaatgtgcgggactggctcagagtgattgcttctaacaaagatagaagcatttatgaattgaggtacttcaacattgctgagaatgaaggagaggaagaagattaatttacccattttgagagaaccttgtttacccattttcccagtgttagcttctcttttggattgagctatgttgctttgtttacattagttgcaatttaacagttttgcttatttatgagttgtggtgccattttccattgaattcagaatagagttcatttattacatggttaacttttgcgtttgatacagttcgattgctttactaaacgaattcttagatcatatctc

SEQ ID NO: 4589 - DNA, 1060 bp, Citrus clementina
ggtccaatgctgaaaccctagttagcccacatagctaaccctcctttttatacgttcgttcttgagacagctccaagctgcagtgctcttctcctgtaaattgtacaattcgtagtgcggcggagcagagacgggaaaatgagtcgcggagcagcagcagcaggggtgaaggggaagaaaaagggagcgaccttcgtgatagactgcgggaagcctgtggaggacaaaatcatggacattgcgtccttggaaaagttcctccaggagcggatcaaggtcggcggcaaggctggtgcccttggggattcagttaccgtcacccgtgagaagaccaagatcaccgtcacttctgacagcaacttctctaagaggtatcttaaatatttgaccaagaagtacttgaagaaacacaatgtaagagattggctccgagtgattgcttcaaacaaggaccgaagtgtctatgagctgcgatacttcaacattgctgagaatgagggagaggaggaagactgaagatccatttcagtatttcctcatattatatctattctgattacttgttctagctcttttttctttttttctcctgcgatcaaatctgtggacttgtttgaattgtttatgagatcattcttagtttatgttctgttgaaattttgtttactttttagatatatgttttttttttttgggttgtataagatgctttaatactatgccagttttttctcaagtggttggttatttagtggtggatattgttattcactcgtaactttgtatgatcaagcccacctgtggttgggactctcagtcattttgagctagtaaggcattgtttgtgctgcttttcccacaaatttagttaatagcttgttgctcagctgcaagaacagcacttgtggtgattggtgattgttaaactcatttccgtttctcagtgaaatgggagaattaatgtcagaagtaccatgctgtaatgtattatatagttgttagctggacattggcgttgtcttcagagtcaaatcttgtgggggatttgaattggattgat

SEQ ID NO: 4590 - DNA, 1059 bp, Citrus sinensis
ggtccaatgctgaaaccctagttagcccacatagctaaccctcctttttatacgttcgttcttgagacagctccaagctgcagtgctcttctcctgtaaattgtacaattcgtagtgcggcggagcagagacgggaaaatgagtcgcggagcagcagcagcaggggtgaaggggaagaaaaagggagcgaccttcgtgatagactgcgggaagcctgtggaggacaaaatcatggacattgcgtccttggaaaagttcctccaggagcggatcaaggtcggcggcaaggctggtgcccttggggattcagttaccgtcacccgtgagaagaccaagatcaccgtcacttctgacagcaacttctctaagaggtatcttaaatatttgaccaagaagtacttgaagaaacacaatgtaagagattggctccgagtaattgcttcaaacaaggaccgaagtgtctatgagctgcgatacttcaacattgctgagaatgagggagaggaggaagactgaagatccatttcagtatttcctcatattatatctattctgattacttgttctagctcttttttctttttttctcctgcgatcaaatctgtggacttgtttgaattgtttatgagatcattcttagtttatgttctgttgaaattttgtttactttttagatatatgtttttttttttgggttgtataagatgctttaatactatgccagttttttctcaagtggttggttatttagtggtggatattgttattcactcgtaactttgtatgatcaagcccacctgtggttgggactctcagtcattttgagctagtaaggcattgtttgtgctgcttttcccacaaatttagttaatagcttgttgctcagctgcaagaacagcacttgtggtgattggtgattgttaaactcatttccgtttctcagtgaaatgggagaattaatgtcagaagtaccatgctgtaatgtattatatagttgttagctggacattggcgttgtcttcagagtcaaatcttgtgggggatttgaattggattgat

SEQ ID NO: 4591 - DNA, 801 bp, Citrus sinensis
gagacagctccaagctgcagtgctcttctcctgtaaattgtacaattcgtagtgcggcggagcagagacgggaaaatgagtcgcggagcagcagcagcaggggtgaaggggaagaaaaagggagcgaccttcgtgatagactgcgggaagcctgtggaggacaaaatcatggacattgcgtccttggaaaagttcctccaggagcggatcaaggtcggcggcaaggctggtgcccttggggattcagttaccgtcacccgtgagaagaccaagatcaccgtcacttctgacagcaacttctctaagaggtatcttaaatatttgaccaagaagtacttgaagaaacacaatgtaagagattggctccgagtgattgcttcaaacaaggaccgaagtgtctatgagctgcgatacttcaacattgctgagaatgagggagaggaggaagactgaagatccatttcagtatttcctcatattatatctattctgattacttgttctagctcttttttctttttttctcctgcgatcaaatctgtggacttgtttgaattgtttatgagatcattcttagtttatgttctgttgaaattttgtttactttttagatatatgttttttttttttgggttgtataagatgctttaatactatgccagttttttctcaagtggttggttatttagtggtggatattgttattcactcgtaactttgtatgatcaagcccacctgtggttgggactctcagtcattttgagctagtaaggcatttgtttgtgcgtgcttttcccgcca

SEQ ID NO: 4592 - DNA, 966 bp, Cannabis sativa
gacgcgcagctccaccatcttttacatctctctctcagcctctaattctgtggccaccgaacaagcaaatatgagtcgaggaagtgcagcagctcccaaggggaagaagaagggagcaacatttacaattgattgtgctaaaccggtggaggacaaaatcatggatattgcatccctcgagaagtttctccaggagaggattaaggttggtggcaaggcaggcgctctcggtgactcagtaactgttacccgtgagaagagcaagattactgttacatctgacagtaatttctccaagaggtatttgaaatacttgaccaagaagtatttgaagaagcacaatgttcgcgattggctccgtgtaatctcatccaacaaagatcgtaatgtttatgaattgaggtatttcaacattgccgagaatgagggtgaggaggaagattaaacctctgtaatattttatttgttagaagaacttaatttcctgttgccagactttcctttgttttagtttttccaatgtgatggtgttttcactgaaaattattatggttcacaattttgttcagtaaaagctacgagattttaaattattactgctgtttgttgaccgatgagaatatattagcatatgttttgatcacggatttgatctgtagtgatgcttctatgtttctatagtttcttgtatcaagtgatgtcgttaatttggtttgccgaatcaagatgtcttattttgttacttgttcatgtaaagcagtgcccatattaccgaaggaaaacatgattttgttctttttcatttttgagctagatgacacattggtatttatctgcctgtgtatgcgagcaagcatgaatgaagtttagccctttccaaaaaataaaaagaaaacatcaattttagtctatcttaatatctacaccgtttcaaacgttaacggagcgtgactgtgtgatcctcct

SEQ ID NO: 4593 - DNA, 912 bp, Cannabis sativa
cgaaaataaaggcccagtccaatattgaaaccctagccctaactcagctctctccttaacttctctctctcctctcaaactcattcattttcatcagaacggacggagagaagagtgtagccgccgtgacagtttcactgctctgaaactccatttcctctcccgcacgccgcctctatcagagaagaagtaaatatgagtcgaggaagtgcagcagctcccaaagggaagaaaaagggagcaacatttacaattgattgtgctaagccagtggaggataagatcatggacattgcatctcttgaaaagtttcttcaggagaggattaaggtcggtggcaaggctggtgctctcggtgactcagtcactgttacccgcgagaagagcaagattactgttacatctgacagtaatttctccaagaggtatttgaaatacttgactaagaagtatttgaaaaagcacaatgttcgtgattggcttcgcgtgatctcatcgaacaaggatcgcaacgtttatgaacttaggtactttaacattgctgagaacgagggtgaggaggaagattaaatttaatttgtcagaacaagttaattttcttgttgcctgaatttccttttagtttttccaatccaattttatgtatgccttacaattttgtttgttatagctagagatttttaaacatttcttctgtttgatgagaatatattagcatgtttggaattttagttctcagatttgatctatatattttttttttctcttattatgcttcaatcatgttaataatttttattacaatttcccttgttaatgcttcaattgataaggctattagggtttgtgtattgttaagagaaattgagaatcattttctgtttcatcggatttgggaaacaatatctaaag

SEQ ID NO: 4594 - DNA, 837 bp, Cannabis sativa
ttggtctgctggaagtttaaaaaccaaaaccctagcttctatttcctctcagacgacgcgcagctccaccatcttttacatctctctctcagcttctaattctgtggccaccgaacaagcaaatatgagtcgaggaagtgcagcagctcccaaggggaagaagaagggagcaacatttacaattgattgtgctaaaccggtggaggacaaaatcatggatattgcatccctcgagaagtttctccaggagaggattaaggttggtggcaaggcaggcgctctcggtgactcagtcactgttacccgtgagaagagcaagattactgttacatctgacagtaatttctccaagaggtatttgaaatacttgaccaagaagtatttgaagaagcacaatgttcgcgattggctccgtgtaatctcatccaacaaggatcgtaatgtttatgaattgaggtatttcaacattgctgagaatgagggtgaggaggaagattaaacttctgtaatattttatttgttagaagaacttaatttcctgttgctagactttcctttgttttagtttttccaatgtggtgttttcactgaaaattattatggttcacaattttgttcagtaaaagctacgcgattttaaattattactgctgtttgttgactgatgagaatatattagcatgttttgatcacagatttgatctgtagttatcttttaatgcttctatgtttctatagtgctttgtaagtgatgtcgttaatttggtttgccgaaacaacatgtcttattttgttacttgttcatgtaaagcagtgcccatattaccaaagaaaaac

SEQ ID NO: 4595 - DNA, 734 bp, Gossypium hirsutum
atctattgagcgttttagcccaaaatttacacacttgaataagaatccttgaaaaccctagactcgtgaatcaatatatagactccgccataagcattcgtaacttcgccgccgttgattattatcttcaaaaatacgctgcggcaactaagtgagttggtgcgaagatgagtcgtggtacagcagcgggacccaaggggaagaagaaaggagcgacctttaccatcgactgtgctaagccggttgaagataagatcatggacattgcctcactcgaaaagttcctccaggaacggatcaaggtaggcggcaaagccggtgctcttggcgactccgtcaccgtcacccgcgacaagaccaaaatcaccgtcacgtccgattccaacttctccaagcgttatcttaagtacttgaccaagaagtacttgaagaagcacaatgtccgggattggcttcgagtgattgcttccaacaaggacagatctgtttatgaactccgctacttcaatattgccgagaatgaaggggaggaggaagaatgaagaatcagttccacatttttttttctagtttactgctttattatttcttaggaacctctttttatctatttaaggtgtcatgttctgcttttttccttcagaccttactctaatttgcaatgaaattttgattgctgatagtaaaatttgctataaaaagaaaaagtaccgactgcgactctgcgttgatac

SEQ ID NO: 4596 - DNA, 858 bp, Medicago truncatula
aaagctgctcccatatcttgcaaccctcgccgctggtctctcttcaaaccttcgaacgattcacaaaaggtaagaaaaaatgagtcgtggtagtgcagctggtgccaagggaaagaagaagggtgcaaccttcaccattgactgtgctaagccagtggaagacaagatcatggacattgcttctcttgagaagtttcttcaagagaggatcaaggtcggtggaaaagctggtgctctcggtgattctgtctccgttacccgtgagaagagcaagatcactgttacctctgacagtaacttttccaagcgatacttgaagtatttgacaaagaagtacttgaagaaacacaatgtaagagactggctcagagtgattgcttcaaacaaagatagaagtatctatgagctcaggtacttcaacattgctgagaacgagggagaggaagaagattgattgtatggtcatcttatttacctgaaaactttgtatgccctttatcactagagctagctttcgttttggccaagtattgcttgagataatgatgcgttgtttagactgtgttgcaatttaacagttttgattatttaatagttgcattggcatttatgaattcagaatacagttttgagttttcatttactcttatgttttttcctccagctgttaaacagttgcattgagctgtttccaccaaaattcagcatcaagtattcaagttcattagcttcaaacatttgtatttttctttatattttttattttaaaaaattcaatgatattaggcgtaataactccattttgaacatgaacatttaaaaaaattcaatgatagtaagagtaacaactccttttcg

SEQ ID NO: 4597 - DNA, 714 bp, Glycine max
ataacctatttctctctaaacgcgcgtttcatgttagcgtataaaatgagagccaaatccaaaccctaattttctaccacaccgccgctcgttattcacactgtgctgtgcttatttggcgtagcttaagagattcgcaatagaaagtgaaagaaaatgagtcgaggaagtgcaactgctgcgaagggcaagaagaagggtgcgacattcaccattgactgcgccaagccagtggaggacaagatcatggacatcgcgtctctcgagaagttccttcaagagaggattaaggttggtggcaaggccggtgctctcgccgacaccatcaccgtcacacgtgagaagaccaaaatcatagttacttcagacagcaacttctccaaacggtatctcaagtacttaactaagaagtacttgaagaagcacaatgtgcgggactggctcagagtgattgcttctaacaaagatagaagcatttatgaattgaggtacttcaacattgctgagaatgaaggagaggaagaagattaatttacccattttgagaaaccttctttacccattttcccagtgttagcttctcttttggattgagctatgttgctttgtttacattagttgcaatttaacagttttgtttatttatgagttgcagtgccatttctgttgaatttagaatagagttcacataatatattgtcagcttttgccttt

SEQ ID NO: 4598 - DNA, 765 bp, Cannabis sativa
ggaaagttagggtcttatagaaactttaaaaaccaaaaccaaaaccaaaaccctaaccctatcttcttctacttcctctcggactcaaaccctagctgcggccaccgagaagaagcaaatatgagtcgaggaagtgcagcagctccgaaaggggggaagaagaagggagcaacatttacaattgattgtgctaagcctgtggaagacaagattatggatattgcatcccttgagaagtttctccaagagaggattaaggtcggtggcaaggcaggggctctcggtgactctgtcactgttacccgcgaaaagagcaagattactgttacatctgacagtaatttttccaagaggtatttgaaatacttgaccaagaagtatttgaagaagcacaatgttcgtgattggctccgtgtaatctcatcaaacaaggaccgcaatgtttatgaattgaggtatttcaatattgcagagaacgagggtgaggaggaagattaaacaaacctctgtaatattttatttgtaagaacgaacttaatttccagttgccagattttcctttctttgagatttcactgaaaattattttggttcacaattttgttgatgactgatgagaatataattgcatgttttcgatctattgctatcttttaattcttctatgtttctatagtgctttatatcaacatgtttaatttgttatttgttcatgtaaaagcactgcccatattaccaatgaaaagcaggactattctttttcta

SEQ ID NO: 4599 - DNA, 903 bp, Cannabis sativa
tcttcttctacttcctctcggactcaaaccctagctgcggccacgagaagaagcaaatatgagtcgaggaagtgcagcagctccgaaaggggggaagaagaagggagcaacatttacaattgattgtgctaagcctgtggaagacaagattatggatattgcatcccttgagaagtttctccaagagaggattaaggtcggtggcaaggcaggggctctcggtgactctgtcactgttacccgcgaaaagagcaagattactgttacatctgacagtaatttttccaagaggtatttgaaatacttgaccaagaagtatttgaagaagcacaatgttcgcgattggctccgtgtaatctcatcaaacaaggaccgcaatgtttatgaattgaggtatttcaatattgccgagaacgagggtgaggaggaagattaaacaaacctctgtaatattttatttgtacgaacgaacttaatttccagctgccagattttcctttctttgagatttcactgaaaattattttggttcacaattttgttgatgactgatgagaatataattgcatgttttcgatctatttctatcttttaattcttctatgtgtctatagtgctttatcaacatgtttaatttgttatttgttcatgtaaaaacactgcccatattaccaatgaaaagcaggactattctttttctatttttgaactagatgatagagttttggttagagcattactattattgggcacaagtggtacctagcactacttaaagctggtgtcttacacgattagatagcgatattttttaaatcttattgtataagatctgatacttaattgtactaatagtgatatgacatcatgaaaggtggtaggctatgtgtttgattgttaatg

SEQ ID NO: 4600 - DNA, 616 bp, Humulus lupulus
ctctctttcacgccggctgtgtctcataccagaacaagcaaatatgagtcgaggaagtgcagcagctcccaaggggaagaagaagggagcaacatttacaattgactgcggtaagccagtggaggacaagatcatggatattgcatctcttgagaagtttcttcaggagaggattaaggtcggtggcaaggccggcgccctcggtgactcagtcactgttacccgtgagaagagcaagattactgttacatctgacagtaatttctccaagaggtatttgaaatacttgactaagaagtatttgaaaaagcacaatgttcgtgatttggctccgtgtgatctcatccaacaaggatcgtaatgtttatgaactgaggtacttcaacattgccgagaacgagggtgaggaggaagattaaacctctgtaatatttaatttgtcagaacttaatattcttgttgccagaatttccttttgatgtttttactgaaaaccaattattcttcacaattttgtttattgaagctagagattttgaaatatttctgctgttttatgagaatatattagcatgtttggatctcggatttgatctatagttatctcgtaattttt

SEQ ID NO: 4601 - DNA, 587 bp, Euphorbia peplus
gttacggacccgacgccgcgcatctcttcctctttcaccatcttgaatctctggtttctcagaaggtaaatcgaagatgagtcgaggcgctgcagcagtaactaaagggaagaagaaaggagcaacatttacgatcgattgtgcaaagccagtggaggataagattatggacattgcctcgctcgagaaattcctacaggagagaatcaaggttggaggcaaggcaggtgctcttggtgattctgtcaccgtctcccgtgacaagagcaagatcactgtcacctctgatagcaatttctccaagaggtatctcaagtacttaactaagaagtatttgaagaaacacaatgtgagggattggctaagagtgatcgcatccaacaaagatcgaagcgtatatgaattgaggtacttcaacattgctgagaacgaaggagaggaggaagattaagctcttggatcaaatcatctcgttcttcctgtagtcaattctgaacttcttgtttattgtttggtttgatgctctgccataatgattgacacaatgttgtttatcatttgctcatcaaaattaatgattttgtgat

SEQ ID NO: 4602 - DNA, 674 bp, Humulus lupulus
ggacacaatagcttagctgccgtaagagtatcactgctcttctctctttcacgccggctgtgtctcataccagaacaagcaaatatgagtcgaggaagtgcagcagctcccaaggggaagaagaagggagcaacatttacaattgactgcggtaagccagtggaggacaagatcatggatattgcatctcttgagaagtttcttcaggagaggattaaggtcggtggcaaggccggcgccctcggtgactcagtcactgttacccgtgagaagagcaagattactgttacatctgacagtaatttctccaagaggtatttgaaatacttgactaagaagtatttgaaaaagcacaatgtccgtgattggctccgtgtgatctcatccaacaaggatcgtaatgtttatgaactgaggtacttcaacattgccgagaacgagggtgaggaggaagattaaacctctgtaatatttaatttgtcggaagaacttaattttcttgttgccagaatttcctttttagttccaatatggtggtgtttttactgaaaactaattatgcttcacaattttgtttattaaagctagagattttgaaatatttctgctgttttatgagaatatattagcatgtttggatctcggatttgatctatagttatctcttaaatttt

SEQ ID NO: 4603 - DNA, 758 bp, Humulus lupulus
aatagcctagccgccgtgagagtctcactgcttccctctttcaactctcccctcgcgccggctctgtcatacaccagaacaagcaaatatgagtcgaggaagtgcagcagctcccaaggggaagaagaagggagcaacatttacaattgactgcggtaagccagtggaggacaagatcatggatattgcatctcttgagaagtttcttcaggagaggattaaggtcggtggcaaggccggtgccctcggtgactcagtcactgttacccgtgagaagagcaagattactgttacatctgacagtaatttctccaagaggtatttgaaatacttgactaagaagtatttgaaaaagcacaatgttcgtgattggctccgtgtgatctcatccaacaaggatcgtaatgtttatgaactgaggtacttcaacattgccgagaacgagggtgaggaggaagattaaacctctgtaatatttaatttgtcagaacttaatattcttgttgccagaatttccttttgatgtttttactgaaaaccaattattcttcacaattttgtttattgaagctagagattttgaaatatttctgctgttttatgagaatatattagcatgtttggatctcggatttgatctatagttatctcgtaatttttcaatgtttctatggtgctttatatcaagtgatgcccccgaatgtggcttgccgaaataaataatggggcttatatttgcgcacccaaaaagtacaaag

SEQ ID NO: 4604 - DNA, 678 bp, Trigonella foenum-graecum
catctcttgcaaccgtcgccgcagagattcacaaaaggtaagaaaaaatgagtcgaggaagtgcagctggtgccaagggtaagaagaagggagcaaccttcaccattgactgtgccaagccagtggaagataagattatggacattgcttctctcgagaagtttcttcaagagaggatcaaggtcggtggcaaagctggtgctctcggtgattctgtcaccgttacccgtgacaagtccaagatcactgttacctctgacagtaacttttccaagcgatacttgaagtatttgacaaagaagtacttgaagaaacacaatgtaagagactggctcagagtgattgcatcaaacaaagagagaagtatctatgagctcaggtacttcaacattgctgagaatgaaggagaggaagaagattaattgtatgattgacttatttgcttccaaactttgtatgcccttttttcctagagttacatttccatttggcaagtattgcttgagatatgatgcgttgtttagacttcgttgcattttaacaattttgattatttaatagttgtgttgccatttatgaattcaaaatacagctttcgtttattttatgctgtttcctcctactgttagacagttgcactgagttgtgtttcttttggtggatcaaaatacctagata

SEQ ID NO: 4605 - DNA, 805 bp, Vigna unguiculata
  misc_feature (38)..(38): n is a, c, g, or t
  misc_feature (40)..(40): n is a, c, g, or t
  misc_feature (43)..(44): n is a, c, g, or t
  misc_feature (48)..(48): n is a, c, g, or t
  misc_feature (50)..(50): n is a, c, g, or t
  misc_feature (52)..(54): n is a, c, g, or t
ggaatatataaaactaaagtccaatccaaaccctaatnanctnncacncntnnncgccgcccacctcttcacaacactgtgttgtggtattccggtgtaacttcagagtttcacaacagaaagtgaaaagaatgagtcgaggaggtgtaactgctgcgaagggcaagaagaagggggtgacattcaccattgactgtgcaaagccagtggaggacaagatcatggacattgcgtctctcgagaagttccttcaagagaggattaaggttgctggcaaggccggtgctctcggtgacacagtcgccgtcgcacgcgagaagaccaaaatcattgttacttccgacagcaacttctctaaacggtacctcaagtacttgactaagaagtatttgaagaagcacaatgtgcgtgactggctcagagtgattgcttctaacaaagatagaagcgtttatgaactgaggtacttcaatatcgctgagaatgaaggagaggaagaagattagtcatgtcggtttattcatttgagaacctttttacccttcttctgaatggttgattatcttttggcttgagctctgtttacattagttgcaatttaacagttttgtttatttgagagttgtgattcggaatagagttcacatattatatttttattaaactgatattgagatcatctcaaagcccatccctagtatcttattatttgttcttatgtcttgcaattgaaaaatgtttcatcagagcatcggttacttgcttctggaaaagcaatatagaatttggtttgcttattgactta

SEQ ID NO: 4606 - DNA, 689 bp, Arachis hypogaea
gccgaatccaaaccctaaatctgcagcgccgttgtcatccctgtcctctcactcgcacctgctttgtttccatcgggttgtgtaaaagaagaagggaaaaatgagtcgagggggtgcagttggagctaagggaaaaaagaagggtgcaacattcaccattgactgcacaaaaccagtggaggacaagattatggacattgcttctcttgagaagttccttcaagagaggattaaggttggtggcaaagctggtgctcttggtgattctgtcactgtctcccgtgagaagaacaagatcactgtcacctctgacagtaacttctccaagcggtacttgaagtatttgacaaagaagtacttgaagaaacacaatgtgcgtgattggctccgggtgattgcttctaacaaagataggaatgtctatgaactgaggtacttcaacattgctgagaatgaaggagaggaagaagattaaatgtctgatcgattttattctgttaagaacttgttttagcatttttcttagatctagcttccctttttgccagtgttgcttgagatatgatggtttgtctacatcggttgcaattaaacaattttgattatctaagtgttgtgccattgttattgaatttggaatagttaaatacaaatttgcaagcattatctattcacaaatcaagaataac

SEQ ID NO: 4607 - DNA, 638 bp, Ricinus communis
aacctaaaaacctaatctctctcacatttgtccctgtaacgccacgccgctaattcttttttttagctttcaactggtacgatttttggttattcagataccgttaaaaaaaagaatgagtcgagggtctgcggcggcgggagtcaaaggaaagaagaaaggagcaacctttacaatagattgcgcaaagccagtggaagataagataatggacattgcttcgcttgagaagtttcttcaagagagaattaaggttggaggcaaagctggcgctcttggcgattctgttactgtcactcgtgggaaaagcaagatcactgtcgcttctgacagtaacttctccaaaagatatctcaagtacttgactaagaagtacttgaagaaacacaatgtgagagattggctccgagtgattgcatccaacaaggaccgaggcgtatatgaattgaggtacttcaacattgccgagaatgagggggaagaggaagactgagaccgagtatttgtacctttatagccttcttttcctttttgccaaatcttgaacttctactggtttagtatatctggtttaatggagctacattttattcccaatatgttgttttataattctgtttatcaaattaatgattttg

SEQ ID NO: 4608 - DNA, 3085 bp, Ricinus communis
ggtctgacatttatttaaaatagaaaatcttaatttaaaatttaccagttaaaattatttattactaaataatagcgaactgagttatgattggtattgggatatgattagtctttatattaatcttggaagttttatatttagcattcagataataataataataatatatgaaaaaaataataattacctcagcaagtagtttatgtaaacttttccaatataatttagctataattacctaaattatagcccacgacatgtcgtctacacagcactcggaccatagactggtctgggtctcagaaaaaaaaaagaaaaaagaagaattataacaatttccagttccctttcccttataacctaaaaacctaatctctctcacatttgtccctgtaacgccacgccgctaattcttttttttagctttcaactggtacgatttttggttattcagataccgttaaaaaaaagaatgagtcgagggtctgcggcggcgggagtcaaaggaaagaagaaaggagcaacctttacaatagattgcgcaaagccagtggaagataagataatggacattgcttcgcttgagaagtttcttcaagagagaattaaggttggaggcaaagctggcgctcttggcgattctgttactgtcactcgtgggaaaagcaagatcactgtcgcttctgacagtaacttctccaaaagatatctcaagtacttgactaagaagtacttgaagaaacacaatgtgagagattggctccgagtgattgcatccaacaaggaccgaggcgtatatgaattgaggtacttcaacattgccgagaatgagggggaagaggaagactgagaccgagtatttgtacctttatagccttcttttcctttttgccaaatcttgaacttctactggtttagtatatctggtttaatggagctacattttattcccaatatgttgttttataattctgtttatcaaattaatgattttgctatgctgagattgagaattaaaatctgccatttagaaatcatgggaattgtcagttgtgttgtgtctctgtgtttgcttctgtattctatgcacccaattctctatgcagcctcaaaagtgttaatgggatcttgcagagggagttataaaggcttcatattcgttcattgctccaagttaacttcaccttaataatgacaaactccattaaggcatgggctcatgttgacaactgtggaattggtcctaaataactccttaaattgttctttcatttaccagtaacaggtccaattggatgtgggctatacgaacctaagactttatctcctgcttgggacaacgatcaacttacattctctaatgcattcttaatttccacaaagtgccaatataaatcacaaactaaaagagggaacatgtaaataataattacttattttaaatttgcatattctccaccacttaattatcctaatatacaggagtcaaatgcgaagaacatatctaaacttcatatttgttttaaagtgacaaggtcaccgtgtacaagttgtttctatcattagcatatttgtcagcaaacttcagaacaaaatacgaaaatagaaataacaactatcatcaacaaactcaatcggatgcattagtccagatttagcctcacaatatgtggcttacagtcgtgttagaaacacagaaaagtactataaatatgctagaataattcataagcaaatcacctcccctgttctttttctcagtttctgttcttttctcagttctaaagaaaagaaatacaggaactgagaaaagaacttggggggtgaaattattaattctaacaggacaggcattaataactttcatactgcaacattactccctcttcagccatgagtatcaacgtatctttcttccttgttcttatgatgggctcattgtttctcctttcttgcgaggcacaagatcttaaggcttgcaagtttgacgcaatatatcaactgggtgattcaatctcggatacaggaaattccatagtggaaattcctccagcttttcacagtcgcttgccttacggcgaaacgattggtaaagcaacgggtagaccatcagatggatatctaatgatcgattttatagcacaatctgctggtcttccatttcttgaaccttatgaaaatccgaattcgaaattcactcacggagcagatttttcagtcgctggtgccagagctatgtctgcggaagatctattgaaattaaatcttgatgttggattcactaacagttctcttagtgtacaacttggatggcttaaaaaggttctatcaactgtctgcaacggccctaaagattgtcaggagaaactcaaatcatccctctttatggtcgggcttattggaccaaatgatcttatggctggactgtttaaaggtgacggcattgagaaagtaaagacaactgtgctacctgcagttctgcaaaccgttatagatggtgtccaaactgttataagctatggtgctagccgagtcgtcgtccctggagcctacccattaggttgtacgccaagcttactaacaacatattcagtaaacaagtctgctgcgtacgattcactcggttgcttaaaggattataatgactttttcgcgtattataatacccagctccaaatagctcttgagaattcaagaaaagcaaatccaaatgtaatcattatttacagtgacttttacagtgcgacccagtcgattttggataatctttcaactcttggatttaaagcatttagaaaggcttgttgcgggattggaggtgagtttaatttcacccctacaatgcaaaagacatgcggagctaaaggtgtaccagtttgtccaaatcctaaggaacatgtgttttgggatggaggacacttcagtcatcatgcaaacatggtattagcagagtggctgattaaggaaatgttgcctcaacttcattgtagtgcttgacaaattatggcatatgttatccttctaatgtaacatatctgtaattcatcaatatatatatatatatttttatcattctggtgcc

SEQ ID NO: 4609 - DNA, 752 bp, Humulus lupulus
tttgaacggacacaatagcctagctgccgtaagagtatcactgctcttctctctttcacgccggctctgtcttataccagaacaagcaaatatgagtcgaggaagtgtagcagctcccaaggggaagaagaagggagcaacatttacaattgactgcggtaagccagtggaggacaagatcatggatattgcatctcttgagaagtttcttcaggagaggattaaggtcggtggcaaggccggcgcccttggtgactcagtcactgttacccgtgagaagagtaagattactgttacatctgacagtaatttctccaagaggtatttgaaatacttgactaagaagtatttgaaaaagcacaatgtccgtgattggctccgtgtgatctcatccaacaaggatcgtaatgtttatgaactgaggtacttcaacattgccgagaacgagggtgaggaggaagattaaacctctgcaatatttaatttgtcagaagaacttaattttcttgttaccagaatttcctttttagtttttccaatatggtggtgtttttactaaaaactaattatgcttcacaattttgtttattaaagctagagattttgaaatatttctgctgttttatgagaatatattagcatgtttggatctcggatttgatctatagttatctcttaaattttctatgtttctgtagtgctttatatcaagtgatgcccctaatttggcctgccgaatcggcatattttat

SEQ ID NO: 4610 - DNA, 661 bp, Platanus occidentalis
gcgccttctctcctcctcctgccgcgacgaaactttcgatccgaccaccgaggagatatagaggcgaagatgagtcgggggagcgcagcggggactaaagggaagaagaagggatcgaccttcaccatcgattgtgctaagccggttgaggacaagatcatggacatcgcttcgctggagaagttcctccaggagaggatcaaggtcggcggcaaggccggcgctctcggtgactccgttacggtcgctcgtgaaaagaacaagataaccgttacctctgacagcaatttctctaagaggtatttgaagtatttgacgaagaaatacttgaagaagcacaatgtgcgtgattggctccgggtgattgcttccaacaaagatcggaatgtttatgaactgcggtacttcaacattgccgaaaatgagggggaggaggaagactaaagatctatatcagtatttcctttattacccgttttttgttcttttatccgtcttagtatctcctttttatgctttttagctaaattatgcccttgtttaaggttgtctgtgattcttatctattgaacttgattttgttttggaattttgtttactggtaactagatggtttcctcattatgcagttggtagataaaacaatacaagtttctttaca

SEQ ID NO: 4611 - DNA, 691 bp, Tripterygium wilfordii
aaaaacactctcccttctcttctcagccgctcgtaggaaaggaacccgaaactctcagttcaatctttgctgcaattaacgagcataatcgaagatgagtcgaggaagtgcggcggttgccaaggggaaaaagaagggagcgacgttcacgatcgactgcgggaagcctgtggaggataagatcatggacattgcatcactggagaaatttttgcaggagaggatcaaggtcggaggcaaggctggtgcacttggtgattccatcaccgtaaccagagagaagagtaagattacggttacctctgacagcaacttctccaagcggtatcttaagtatttgacaaagaagtacttgaagaagcacaatgtgagggattggctccgggtgattgcatccaacaaagatcgcaatgtttatgagctgaggtacttcaacatcgctgagaatgaggccgaggaagaagattgaaacaatttctttttctaaggaccttgttttgctagtcagaatattccaattttctttacactctgcagtcattgtctgtgtttacaattttgttcatttgccaagacatttgatgttgctgttgttgaatttggaagacaaaggctttaagttttaacgatgatgattggatttgatttagtgcgaaccttaaggagtctgttttttgtgtaccttataaag

SEQ ID NO: 4612 - DNA, 678 bp, Manihot esculenta
atcatatatttttctcacacggcgctgccacttcttctcaaagctctgttctccttatctaatccatattgtgagtagcggagcagaaacggcaagatgagtcgcggggcggcagctggagctaaggggaagaagaagggagcttccttcgtgatcgactgcgcgaagccagtggaggataaaatcatggacatcgcttcactggaaaagttcctgcaggagaggatcaaggttggtggcaaggccggtgctctcggtgacaccgtcaccgttactcgtgacaagactaagatcaccgttacctctgacagcaacttctctaaaaggtaccttaagtacttgacaaaaaagtacttgaagaaacacaatgtccgggattggcttcgggtgattgcttccaacaaagacaggaatgtctatgaacttcggtacttcaacattgccgagaatgagggagaggaggaagattgaacacccaattcagtatttcatatgttttagtttgtctttcttagagcctcattatctatttcagctgttggatctttaagacctgttgggattgtttttcatcctttctgaatttgttgagatttttgctacttataattagataccttcttttcatgtattcgatgctattaatacaatgcagatttcgtgctccagtttggtggt

SEQ ID NO: 4613 - DNA, 1131 bp, Gossypium hirsutum
gaaaccttagccaagctaaaaagcccaactcttacactccaaaactgaaaaaccctagtgtggaatccatatattctttaccctctgcaccaagcatttgtgacatcgccgtcttcaataccgaagatacagagctaagtgagttggtgtgaggatgagtcgtggtgcagcagctggagctaagggaaagaagaagggagcctccttcaccatcgactgtgcgaagccggttgaggataagatcatggacatcgcttctttggagaagttccttcaggaaaggatcaaggttggtggcaaagctggtgctctaggtgactccgtcactgtcacccgcgacaagacccgtatcaccgttacctctgactccaacttctctaagcggtaccttaaatacttgactaagaagtacttgaagaagcacaacgtccgggattggcttcgggtgattgcttccaacaaggaccgtaatgtttatgaactccgctacttcaatattgctgagaatgaaggggaagaggaagaatgagcaatcagttcagttacttttctctgttacctatctggtttattagttctgaggaaacttgtttgtgtcaaatcgttggacttgtttgggtttgctttttgacccttggctttattttcaatgaagttttggttgctgatagttaaattttttgtttatgtattaatatattagattctataaaagaaggatgcacatttcttttcatgagttgattgtttagagctctcaattcactgatgctcatggctgccagtgccattttctataaagtattctcagtggtgatatacttgcatatgcaatccattcatggatgattatgcatggtagagattggtggcaagatcaaagccttggaatatgtaaccaaattgaatgattatgttgtgtgtaaatatattgtggataattttatccatgatgtgcatgcaaattcaaagcaattcatggatgagttgccaatgatgaattctacggtaacttgtgcatgacagagaattgggtgtatgtatgtgttgtttagtgaaatgattgccaggcagataatcattaatcagtgggagtgatgtaagtagtatcaattgtggttgaaatggtga

SEQ ID NO: 4614 - DNA, 690 bp, Vitis vinifera
cagattcccaattgctcccaacgccgcttcatcctcacttacacctgccatatcataatcgagtacagccaaagatgagtcggggaagcgcagcgggagcgaaggggaagaagaagggagcgaccttcacgatcgactgcgggaagccggtggaggataagatcatggacattgcttcgctggagaagtttctccaggagaggattaaagtaggcggcaaggccggtgctcttggtgacaccgttaccgtcacccgtgagaaaagcaagatcaccgtcacttctgagagcaacttctccaagaggtatttgaagtatttgacaaaaaaatacttgaagaaacacaacgtccgcgactggcttcgtgtaattgcatccaacaaggaccgaaatgtttatgagcttaggtacttcaacattgcagagaatgagggggaggaggaggattaaacatttgatctacattattcatctataaacaccttctttcaccttgcttccttggatgtctcttcgtttgttggatttttatgcagtttaacaattttgttcaccgagatgatcttgttgaatttggatagctataagactctaccatttaaaaaatagtttattatcattttgtgtgttttttatgacaatctttcgaatttatctgaggttctaaattatgctttttgtgctgcccaaa

SEQ ID NO: 4615 - DNA, 626 bp, Vitis vinifera
gctcccaacgccgcttcatcctcacttacacctgccatatcataatcgagtacagccaaagatgagtcggggaagcgcagcgggagcgaaggggaagaagaagggagcgaccttcacgatcgactgcgggaagccggtggaggataagatcatggacattgcttcgctggagaagtttctccaggagaggattaaagtaggcggcaaggccggtgctcttggtgacaccgttaccgtcacccgtgagaaaagcaagatcaccgtcacttctgagagcaacttctccaagaggtatttgaagtatttgacaaaaaaatacttgaagaaacacaacgtccgcgactggcttcgtgtaattgcatccaacaaggaccgaaatgtttatgagcttaggtacttcaacattgcagagaatgagggggaggaggaggattaaacatttgatctacattattcatctataaacaccttctttcaccttgcttccttggatgtctcttcgtttgttggatttttatgcagtttaacaattttgttcaccgagatgatcttgttgaatttggatagctataagactctaccatttaaaaaatagtttattatcattttgtgggtctttattatca

SEQ ID NO: 4616 - DNA, 879 bp, Vitis vinifera
ctgcatcgaaccggtttacatgggcttggaccgggtttgccccgtaaaccaggcccgaatgggaaatccagaaagaagggtgaaaaaccctaaccccaattgccccaactccgcttcttctttcacttccacctgccataccatctctccggtcacagtaaagccaaagatgagtcgggtaagcgcagcgggagcgaaggggaagaagaagggagcgaccttcacaatagactgtgggaagccggtagaggataagatcatggacattgcttccctggagaagtttctacaggagaggatcaaggtaggcggcaaagccggtgctctcggtgactccgtcaccgtcactcgtgagaaaagcaagattatggtcacctctgagaacaacttctctaagaggtatttgaagtatttgacaaaaaaatacttgaagaaacacaatgtccgtgactggcttcgcgtaattgcatccaacaaggaccgaaatgtttatgagcttaggtacttcaacattgcagagaatgagggtgaggaggaggattaaaaatgtggatttgcattatctatacacacctcctttcatctgcttcctcgaatgtctactattgcatgtttgattcttcttttgttggatttttatgcagtttagcaattttgtttaccaaattagagattttaaattgatcttcttgttgatttgggtagactcaagactcttctccatttcacaaatagtttgttgtcattttgctgtccaaaagttggtgtatgtgttttttatgacagttaaggttctgaattatgctttatgtgctgcccaattctcttgaatgtgatgtccatccacaagggatgttataaattgtggaccggcttaat

SEQ ID NO: 4617 - DNA, 599 bp, Vitis vinifera
agccaaagatgagtcgggtaagcgcagcgggagcgaaggggaagaagaagggagcgaccttcacaatagactgtgggaagccggtagaggataagatcatggacattgcttccctggagaagtttctacaggagaggatcaaggtaggcggcaaagccggtgctctcggtgactccgtcaccgtcactcgtgagaaaagcaagattatggtcacctctgagaacaacttctctaagaggtatttgaagtatttgacaaaaaaatacttgaagaaacacaatgtccgtgactggcttcgcgtaattgcatccaacaaggaccgaaatgtttatgagcttaggtacttcaacattgcagagaatgagggtgaggaggaggattaaaaatgtggatttgcattatctatacacacctcctttcatttgcttcctcgaatgtctactattgcatgtttgattcttcttttgttggatttttatgcagtttagcaattttgtttaccaaattagagattttaaattgatcttcttgttgatttgggtagactcaagactcttctccatttcacaaatagtttgttgtcattttgctgtccaaaa

SEQ ID NO: 4618 - DNA, 698 bp, Populus trichocarpa
aagaaaaaccctagatcccttttccatctcgtcccaatatattcagtctctgtctcacccacacggcgctcttttatcagctgacggagggaaagagggctcagtttttacctgtgtattagagagcaaaaatgagtcgggcagcagcagcaaagggaaagaagaagggagcgtccttcgtcattgattgcgctaagccggtggaggataagatcatggatatcgcctctctcgagaagttcctccaggagaggatcaaggttggtggaaaggccggtgctcttggtgactctgttaccgttactcgtgagaagaacaagatcaccgttacctccgacagcaacttctctaagcggtatttaaagtacttgaccaaaaagtacttgaagaaacacaatgtgagggactggcttcgagttatttcttccaacaaagacaggaatgtttacgaattgcgctactttaacattgccgagaatgagggagaggaggaagactgaggactggactcggttcagtatttcttctgattacctgttctgtttacccattttagggcctccattatcgatatcagcggttgggttttcctcgcttgttctttgaaattttggctactgataagtggatttctattttcaattttcatgtattagatgctattaatacaatccgaatttctttctagggtttggcta

SEQ ID NO: 4619 - DNA, 596 bp, Euphorbia esula
ctggaatctctctggtaaatcgaagaagatgagtcgaggggctgcggcaggaactaaaggcaagaagaagggagcaaccttcactatcgactgtgcaaagccggtggaggataagattatggacatcgcctcgctcgagaaattccttcaagagagaatcaaagttggaggaaaggctggtgctcttggtgattccgtcactgtctcccgtgataaaaacaagatcaccgtcacttctgatagcaatttctccaagaggtatctcaagtacttaacaaagaagtatttgaagaaacacaatgtgagggattggctaagagtgattgcagccaacaaagatagaagtgtatacgagttgaggtacttcaatattgctgagaacgagggagaagaggaagattaactttcaacttcttttccatcgaatttagtgggttttgaactagttgtttattgtttggctttgatgctttgctacaatttttgactcatcttgtctatcattttgcttatcaaaattgaatattttgcttatcaaccaatgttgtctatcattttgcatatatgttaattgtgctgtcttgggctgaaaaaaa

SEQ ID NO: 4620 - DNA, 678 bp, Juglans hindsii x Juglans regia
gcctcattttcatttcaagtagggttttttcattcgtcactagcagtcgccgcgtgctccctcgagcagtcccctctgaacgctgactgcagagtttaatcaaagatgagtcgagcgaatgcaccaggtcccaaggggaagaagaagggagcgacatttaccattgactgtgcaaagccagtggaggacaagatcatggacattgcgtcgctggagaagttcctccaagagaggatcaaggttggaggcaaagctggtgctcttggtgacactgtgactgtcactcgtgagaagagcaagataacagttacttctgacagtaacttctcgaagaggtatctgaagtatcttactaagaagtacctgaagaaacacaatgtgcgggattggctccgtgtgatagcttccaacaaagatagaagtgtgtatgaacttaggtacttcaacattgcggaaaacgagggggaggaggaagattaagagtctagattggcctagtcattaagaacttccttactttgtttccatttgtagcttttcatttttcggtttaccatgctttttgtttaaacgtatggtttttgacaatctcgttgcttaaattagaggttttgaaacattccaacatttggatcggtggtataggaaccctgctttgtttggtgcttggccccatgg

SEQ ID NO: 4621 - DNA, 707 bp, Linum usitatissimum
agtgtttctgcggcgctgcaatctctgccaatctctccggaagttggacgacaagttaatacaaaatgagccgaggagcagctggaggtgccgccggcgccaagggaaagaagaagggagtgaccttcaccatcgactgcggtaagccagttgaggataagatcatggatatcgcatcactcgagaagtttctccaggagcggatcaaggttggcggcaaggctggagctctcggcgactccgtcaccatcactcgtgagaagaacaagatcaccgtcacctctgactccaacttctctaagcgttacctcaagtacttgacgaagaagtacttgaagaagcacaacgtcagggattggcttcgcgtgattgcgtccaacaaggaccgctctgtctacgagcttagatacttcaacattgctgaaaatgaaggcgaggaggaagattaattatctgtaatggtttctttttcccttgttctcctccagagctttaatgttgcttttataatttaggatgatatttagtctccaacttgggattgtgatcagcggtacaattatgtagttgaaattttgtgttgagacctttgatttcttcaaattagtcttctagttctcccgtttgctgcggatgtttctctcatttcatctgctaatcgatgcactgtgatttcagtctctcaaatagatgttatattttgtagt

SEQ ID NO: 4622 - DNA, 572 bp, Malus domestica
agaaactaaagatgagtcgtggggcggcagcagggacgaagggagggaagaagaagggagcttcgttcacgatagactgcgcgaagccggtggaggataagatcatggacatcgcctcactggagaagttcctccaggagcgcatcaaggtcggcggcaaggccggtgctctcggtgactccgtcaccgtctcccgcgagaagaacaagatcaccgtcacctccgactccaacttttccaaaaggtatcttaaatacttgacgaagaagtacttgaagaagcacaacgtgagggattggcttcgcgtgattgcatccaacaaggaccgcaatgtttatgaattgagatacttcaacattgctgagaacgagggtgaggaggaagactaagcactttgtctcctgttttgtggcattaccggttggtcttagttgttctttagaccgtcttttgttttttaacctgtcttatctatcaacttctgttttagcttgtttcatgattgatacttcctatgaaattaagcttcttctaaaataaaaaaaaaaaataaaaaaaaataaaaaaaaaaa

SEQ ID NO: 4623 - DNA, 712 bp, Malus domestica
cacacgcagagagagagagagagagagagagggagagagagagaagcaaagatgagtcgtggggcggcagcagggacgaagggagggaagaagaagggagcttcgttcacgatagactgcgcgaagccggtggaggataagatcatggacatcgcctcactggagaagttcctccaggagcgcatcaaggtcggcggcaaggcaggtgctctcggtgactccgtcaccgtctcccgcgagaagaacaagatcaccgtcacctccgactccaacttttccaaaaggtatcttaaatacttgacgaagaagtacttgaagaagcacaacgtgagggattggcttcgcgtgattgcatccaacaaggaccgcaatgtttatgaattgagatacttcaacattgctgagaacgagggtgaggaggaagactaagcactttgtctcctgttttgtggcattaccggttggtcttagttgttctttagaccgtcttttgttttttaacctgtcttatctatcaacttctgttttagcttgtttcatgattgatacttcctatgaaattaagcttcttctaagactttgttttgaaatttagaatctggttattacattatctatgtgcctggtgcaatacatatttcctcgaggaatttggttatggcggattgaatttttctacggtgttttatgtacaagatctgtgaaaactttc

SEQ ID NO: 4624 - DNA, 559 bp, Manihot esculenta
gctggtctatctaatctcgagtcgcgaagcagaaacggcaagatgagtcgcggggcggtagctggagctaaggggaagaagaagggagcggcttttgtaattgactgtgcgaagccagtggaagataagatcatggacatcgcttccctggaaaagttcctgcaggagaggatcaaggttggtggcaaggccggtgcccttggtgacactgtcaccgtcactcgggacaagactaagatcaccgttacctctgacagcaacttctctaaaaggtatcttaagtacttgaccaagaaatatttgaagaaacacaatgtgcgggattggcttcgggtgattgcttccaacaaggacaggaacgtttatgaacttcggtacttcaacattgctgagaatgagggagaagaggaagattgagtaccccaatcaagtatttcatatgttttaatttgcttatcttagagcctcattatctatatcatctgttggatctgtacttgttggagtggttttgttgaaattttggctacttataattgagtatctcctttttatgttg

SEQ ID NO: 4625 - DNA, 672 bp, Castanea mollissima
  misc_feature (646)..(646): n is a, c, g, or t
ttgcatagtgggtttagtccttagggaagcgaaaatgagccgaggggcagctggagcgaaggggaagaagaagggggccacattcgtgatcgactgcgcaaagccggtggaggataagatcatggacatcgcctccctcgagaagttcctccaggaacgcatcaaggtcggcggcaaggcgggcgctctcggcgactccgtcaccctctcccgcgagaagaacaagatctccgtcacctccgactccaacttctccaaacggtatcttaaatacttgactaagaagtacttgaagaagcacaacgtgagggattggcttcgggtgatttcttccaacaaggacaggaatgtttatgaattgagatatttcaacattgctgagaatgagggcgaggaggaagattgaagttatagtattctatatcgaggcatcatccattagaggactttctttattttttgaggaacatccattagaggacttagttgttctagagcgtcatttttatattttccagcactgttttgatctatccgctagacgggattgttttctgattttcaaagtttattttctcttaaaaattttgtactgttaattctggttatcacattgttagttgtggttgatgcaatagttgtttcncctctctctggagtcgtattgtggta

SEQ ID NO: 4626 - DNA, 737 bp, Lotus japonicus
ccttcaattccaccgccgtcgatcgtgccgtgctctctctctctctctctctctctctccgtctggttcaagggattcgtagtagaatctgcagagtgaaaatgagtcgaggaggtgtagctggtgctaaggggaagaagaagagcgtgtcgttcaccatcgactgtgcgaagccggtggaggacaagatcatggacattgcatctctcgagaagttccttcaggagaggattaaggttggtggcaaggctggtgctctcggcgatgctgttacggttgctcgtgagaaatctaagatcactgttacttctgatagcaacttctccaagaggtacctcaagtacttgacaaagaagtacttgaagaaacacaatgtgagggactggctcagggtgattgcttctaacaaagatagaagtgtatatgaactgaggtacttcaacattgcagagaatgaaggagaggaagaagattagtcacttgatcagcttaatcatctgtgaaccttgtttacccttgttcactgtgttagcttttctcactagacaagtattgcttgagatatattgctttgattacattagttgcaatttaacagttttgtttatctaaattgcggtgccttttaagttggattgggagtatttcatctactatactgtcaagtgtcaagtaatcaagttctacctttgatacaattgcattgccatatcatacttcccataaatctttatttt

SEQ ID NO: 4627 - DNA, 723 bp, Linum usitatissimum
ggtcttcctcctcagtgtttctgcggcgctgcaaatctctgccagtctctccggaagttggacgacaagttaaaacaaaatgagccgaggagcagctggaggtgccgctggcgccaagggaaagaagaagggagtaaccttcaccattgactgcggtaagccagttgaggacaagatcatggatatcgcatccctcgaaaagttcctccaggagcgcatcaaggttggcggcaaggctggagctcttggcgattccgtcaccatatctcgtgagaagaacaagatcacggtcacctctgactccaacttctccaagcgttacctcaagtacctcacgaagaagtacttgaagaagcacaacgtcagggattggcttcgcgtgattgcgtccaacaaggaccgctctgtctacgagcttagatacttcaacattgctgaaaatgaaggcgaggaggaagattaaaaatctgtaatggtttctgtttccttgtacccctccagaggattactgttggtttttacagtttaggatgatatgtagttgaaattttgtgttgagacgttggatttctcgagtcttcttgtccttccatttgatgctgatgtttctctcatttcatctgctaatcgatagtatgatttcaatgtcttaaaaagatggtatagttttgttgaatccttgtgcaagatattgtctttctacgatgatgaaatagtttgttg

SEQ ID NO: 4628 - DNA, 793 bp, Citrus sinensis
  misc_feature (273)..(273): n is a, c, g, or t
  misc_feature (319)..(320): n is a, c, g, or t
ttcatgggatggcattacggccggggcttcccattacagcggcgcaccaaaaccccaatcatccacgcacgcaggaaccatcaatcaagtgaagaaagaacaatgagcagaggaagcggaggagcggccggtggtggagccaagggaaagaagaagggtgcaactttcaccatcgactgtgcgaagcctgtcgaggacaagattatggacattgcttccctcgaaaagttcctccaagagcgcatcaaagttggcggcaaagccggcgccctnggtgacactgttaccgtcactcgtgacaagactaagatcaccgttnnctccgactccaacttctccaaaaggtacttaaagtacttgacaaagaagtatttgaagaagcacaatgtgcgtgattggcttcgtgtgattgcatctaacaaggaccggaatgtttatgaattgagatacttcaatattgccgagaatgagggtgaggaggaagattagaacttgggttttgagcacttgtttttgtctcatttgttataatagaaaccatgtggtgggattttcatcatctttatttttattaggttctcccttttttgtaccttctgcaagttgactatatgaaatttttgcgtcttgaatgcctttgtttacttttgccttattacaatgttaagttggatattgaacttcatttattagttagtctttatccatggaaggaggatgttgtcatttaatatgttgttcatttgtggtttgggttgattatataatgctgtaacagctcgagttgagcaaa

SEQ ID NO: 4629 - DNA, 559 bp, Scabiosa columbaria
tactcagttgcattgccgcatcgccatttttctcttcagcaacaaacagaacgaagctttgtgattaatcgacgaatatgagtcgaggaggagctgccggtggtgccaaaggcgggaagaagaagggatcgacgttcacgatcgattgtggaaagcctgtagaggataagattatggagattgcttcactcgagaagtttctacaggagaggattaaggtcggcggcaaagccggtgctctcggtgactccgttaccgttactcgtgagaagagcaagattactgttacctccgacagtaacttctctaaacggtacttgaaatacttgaccaagaagtatctgaagaagaacaatgttcgtgattggcttcgtgtgatagcctccaacaaggatcgtaatgtttatgagctcaggtatttcaatatagctgagaacgagggcgaagaggaggattgaatgattgattgatacttgcagttcattgtagtattttatctagctgttcttgcttgcttttgtttcttaggttcttaaaaccctccaactcttgatatttg

SEQ ID NO: 4630 - DNA, 700 bp, Ricinus communis
tctctcacacggcgcaaccttacgcttcttaaatgctctgtcacactggtctttctatcaatattgaatccagccagtagcggaccagaaacgggaaagatgagtcgcggggcggcagctggaggagcaaagggtgggaagaagaggggagcgaccttcactattgactgcgcaaagccagtggaggataagatcatggacattgcctctctggagaaatttctccaagaaaggattaaggttggcggcaaggccggtgctcttggcgacaccgtttccgtctctcgtgagaagaccaagattaccgttacctctgacagtaacttctctaaaaggtatcttaagtacttgaccaagaaatacttgaagaaacacaatgtgcgagattggcttcgtgtgattgcttccaacaaagataggaatgtttatgaactccgttacttcaacattgctgagaatgagggagaggaggaggattgaagatctggttcagtttatcttcaaattatatatgcttttagagtcttgtttttcttttgagctgttagatctgtaatacttgttgggggtgttttgtgatccttctgagtttgttgaaattttggctatttatcaactagatatctactttttttaaaaaaaaatgtattagatgcttttaatacaatgctgatttcttgctccactttggttatgctga

SEQ ID NO: 4631 - DNA, 742 bp, Ricinus communis
cctagatagtctcatgacaatacgatatattctctcacacggcgcaaccttacgcttcttaaatgctctgtcacactggtctttctatcaatattgaatccagccagtagcggaccagaaacgggaaagatgagtcgcggggcggcagctggaggagcaaagggtgggaagaagaggggagcgaccttcactattgactgcgcaaagccagtggaggataagatcatggacattgcctctctggagaaatttctccaagaaaggattaaggttggcggcaaggccggtgctcttggcgacaccgtttccgtctctcgtgagaagaccaagattaccgttacctctgacagtaacttctctaaaaggtatcttaagtacttgaccaagaaatacttgaagaaacacaatgtgcgagattggcttcgtgtgattgcttccaacaaagataggaatgtttatgaactccgttacttcaacattgctgagaatgagggagaggaggaggattgaagatctggttcagtttatcttcaaattatatatgcttttagagtcttgtttttcttttgagctgttagatctgtaatacttgttgggggtgttttgtgatccttctgagtttgttgaaattttggctatttatcaactagatatctactttttttaaaaaaaaatgtattagatgcttttaatacaatgctgatttcttgctccactttggttatgctgatccctgtctgga

SEQ ID NO: 4632 - DNA, 593 bp, Beta vulgaris
  misc_feature (11)..(11): n is a, c, g, or t
  misc_feature (61)..(61): n is a, c, g, or t
  misc_feature (98)..(98): n is a, c, g, or t
  misc_feature (242)..(242): n is a, c, g, or t
  misc_feature (475)..(475): n is a, c, g, or t
ttcctctctcnttttcgccgctctgatcaaagaagaatcagaagaagcacaaataaaaaancgtgaaaatgagccgaggatcagccgtaggtggtgcnaagggcaaaaagaagggtgcttccttcaccattgattgcgcgaagcctgtcgaagacaaaatcatggatattgcatcactcgaaaagtttcttcaggagagaattaaggtcggcggtaaagctggtgccctcggtgattctgtnactgttactcgtgaaaagaacaagatcactgttaactctgacagcaatttctccaagaggtacttgaaatacttgacaaagaagtacttgaagaagcacaatgttcgtgactggcttcgtgttattgcttccaacaaggatcgtaatgtgtacgagttgaggtacttcaacattgctgagaatgaggctgaggaggaagattagatctttattttggggatttaagccatgtngcattttgtttagtgatatgtgtatctttttggttcgatttagattgtaactgtttgccatcttatcgcttgagagattttgccaagaagcattttggttattgtttaaaaaaaaaaa

SEQ ID NO: 4633 - DNA, 530 bp, Bruguiera gymnorhiza
  misc_feature (149)..(149): n is a, c, g, or t
  misc_feature (194)..(194): n is a, c, g, or t
  misc_feature (197)..(197): n is a, c, g, or t
  misc_feature (227)..(227): n is a, c, g, or t
  misc_feature (440)..(440): n is a, c, g, or t
gattcattctccttccatttcagcggcgggcggcgttgctccagagcacttgcgctcagctgagatagttaatcgaaacattcagaaaaatgagcaaaggaggagcagcgggtggggccaaggccaagaagaagggagcgacgttcacnatcgactgctccaagccggtggaggacaagatcatggacatcgcntcnctcgagaagttcctccaggaacgcatcaangtcggcggcaaagccggagctctcggcgattccgtcaccgtcgtccgcgagaagtcaaagattatcgtcacttctgattcccacttctccaaacgatatcttaagtacttgacaaagaagtacttgaagaagcacaatgtgcgagactggcttcgggtgattgcggccaacaaggaccgtaatgtttatgaactgagatactttaacattgcngagaatgaaggcgaggaagaagactaaactctccccatgttttcactttttctcttgttagaatcttctccagatgtatctctttgtccg

SEQ ID NO: 4634 - DNA, 662 bp, Euonymus alatus
agcgactcacacactcttctttctcttctcggacagccgctcgtaagactcttcaatctttgctgcaatcaacgctgaggataatcgaagatgagtcgaggaagtgcggcggttgccaaggggaagaagaagggagcaacgttcacgatcgactgcgggaagcctgtggaggataagatcatggacattgcatcactggagaaatttttgaaggagaggatcaaggtcggaggcaaggctggtgcacttggtgattccatcactgtaaccagagagaagtctaagatcacggttacctctgacagcaacttctccaaacggtatctcaagtatttgacaaagaagtacttgaagaagcataatgtcagggattggctccgagtgatctcatccaataaagatcgcaatgtttatgagctgaggtacttcaacattgctgagaatgaggccgaggaagaagattgaaacaatttctttatctaaggaccttgtttactagtcagaatattccaattttctttatacactgctgtcattgtatgtgtttgcaattttgtttattggcctagacattcggtattgctgttgttgaatttgaaagacgaggagtctgttgtatgcgtaccttattggcactagtcttgcatctcacttttggggtt

SEQ ID NO: 4635 - DNA, 774 bp, Platanus occidentalis
acaaacattttcagaaacgaaaaccctataaaaaccctaaccctaattttcatctcctcttctccattactgcggcgctttctcctttctaacttcagttgatcgcagcgagattgggagagccgaagatgagtcgaggaagtgcagcggggcccaaggggaagaagaagggatccaccttcacgatcgactgcgctaaaccagtcgaagataagatcatggacattgcatcgctggagaagttcctccaggagaggattaaggtcggcggtaaggctggtgcgcttggtgacgtcgttaccgtagcccgtgacaagaacaagatcaccgttacctctgacagcaatttctctaagcggtatttgaagtacttgacgaagaaatacttgaagaagcacaatgtgcgtgattggcttagggtgattgcctcaaacaaagataggaatgtttatgaattgcgatacttcaacattgctgagaacgagggggaggaggaagactgaagatccagattagtattacctttatgatccctatttgttcattgatctttatcttagggtctcccttttcctttttagcccagttgcctccttgtttaaggttgtctgtttgattctccattttgagcttgatgttgttttggaattttgtttactggaacttggatggttttccattatgcggttggtagttacttacagtgcttttccaagggaaagaaattcttagcttattggtgtatttaacttaagggcttattaggcctgatca

SEQ ID NO: 4636 - DNA, 674 bp, Cucumis sativus
attgggcggccgtcgatatctgaatcctcaacttctcttcactaacttagttttctttaatcgaaaatgagtcgaggaggtgcagccggtcccaaggggaagaagaagggagtaaccttcacaatcgactgttctaagccagtggaagataagattatggacattgcttcgttggagaagtttcttctcgagaggattaaagttggaggcaaggctggagctcttggggattccgtctctgttactcgcgagaagagtaaaattaccgtcacttctgacagcaacttctccaagaggtatttgaagtacttgactaagaagtacctgaagaaacacaatgtgcgagattggctacgagtgattgctgccaacaaagataggaatgtgtacgaactcaggtactttaacattgccgaaaatgagggagaggaagaggattaaatttaccaatttagacattgtattcaaggaacaagtgcgtctatacgtcgctggaatctctcactgtttttgttactagtgttgcctgtgtgatgctctctatttttatttgaactaatgcagtttagcaattttgttttcttcgacagacctagattgctggtattttttgtgtcatatttgagtaagatcaacaatttttcactttaaattacccatgcttttcacatgtc

SEQ ID NO: 4637 - DNA, 612 bp, Cyamopsis tetragonoloba
gttctcttcagctgttactcaagaggcttgtagcaggaagcgaaggaggaaaatgggtcgaggaagtgcagctggtgcgaagggaaagaagaagagtgtgacttttaccattgactgtgcaaagccagtggaagataagatcatggacattgcttctcttgagaaattccttcaagagaggattaaggttggtggcaaagccggtgctctcggtgataccgtctctgttacccgcgagaagactaagatcatcgttacttctgacagcgacttctccaaacggtacctcaagtacttgacaaagaagtacttgaagaagcacaacgttcgggactggcttagagtgattgctgccaacaaagatagaaacgtttatgagctgaggtacttcaacattgctgagaatgaaggcgaggaagaagattgaacatgtgatttcttgttcatttgagaaccttatctgtctttttattatgtattagctctcttttggcaagtactgcttgagataagtttcttggtttacactagttgcagtttaaacaattttgcttatttaagagttgtggtgcccatttttttggaaacagagttcacatactattctctcaa

SEQ ID NO: 4638 - DNA, 635 bp, Cucumis melo
actgggcggccgtcgatatctgaatcctcaacttcccttcactaacttagatttctttaatcgaaaatgagtcgaggaggtgcagccggtcccaaggggaagaagaagggagtaaccttcacaatcgactgttctaagccagtggaagataagattatggacattgcttcgttggagaagtttcttctcgagaggattaaagttggaggcaaggctggagctcttggggattccgtctctgttactcgcgagaagagtaaaattaccgtaacttctgacagcaacttctccaagaggtatttgaagtacttgactaagaagtacctgaagaaacacaatgtgcgagattggctacgagtgattgctgccaacaaagataggaacgtttacgaactcaggtacttcaacattgccgaaaatgagggagaggaagaggattaaatttaccaatttagacattgtattcaaggaacaagtgcgtctatacgatgcaggaatctatcactgtttttgttactagtgttgcatgtgtgatgctctctatttttattcgaactaaatgcagtttagcaattttgttttctttgacagacctagattgctgttattttttgtgtcatatttgagtaagatca

SEQ ID NO: 4639 - DNA, 814 bp, Populus trichocarpa
gaaagccacccttataaaccaaaccctagtctcaccctctctttttctagtagacggccgctccatctctctcgcctgcagtctccaccgggagtaatcgaagatgagtaaggcaacagcaccaggacccaaagggaagaagaagggtgcgaccttcacaatagattgtgcaaagccagtggaggataagattatggacattgcttcattggaaaagtttcttcaagagaggatcaaagttggaggcaaagctggtgctcttggtgatgctgttactgttactcgtgagaagaacaagattactgttacttctgatagtaacttctccaaaaggtatctcaagtacttgacaaagaagtatttgaagaaacacaatgtcagggattggctacgagtgattgcatccaacaaagatcgcaatgtgtacgagttgagatacttcaacattgctgagaacgagggagaggaggaagattgaaatttaggtctcatagcctcgatcatgttgtttcctcaatcgaaccccctccattttttttgtttgatcaagtgatctgtaaaacatttaccgagttaatgttttataattttattaccaagttggttcttttgcaatattgcagccgctaaattgagaacctacctgccatttagcatatctggaatttgctcaagttgtcttttactatgttcttcaactttgattagttatggccttcgaaatccgagtgctctagtgatttgatctgaataccaatcattgaaatttattcaggacttggtggtttctggctttgtattagtttacttttca

SEQ ID NO: 4640 - DNA, 690 bp, Prunus persica
ctaatctcagtaacagacgcagctcacacacagacgcagagagagagagagagaagcgaagatgagtcgtggggcggcagctgggacgaaggggaagaagaagggggcttcctttgtgatagactgcgcgaagccagtggaggataagatcatggacatcgcctcactggaaaagttcctccaggagcgcatcaaggtcggcggcaaggccggtgctctcggtgacgccgtcactgtctcacgtgagaagaacaagatcaccgtcacctctgactccaacttctctaagaggtatcttaaatacttgaccaagaagtacttgaagaagcacaatgtgagggattggcttcgcgtaattgcttccaacaaggaccgcggtgtttatgagttgagatacttcaacattgctgagaacgagggagaggaggaagactgaaaacctagtctccttttttgtggcattaccctttgagcttagtagttctagaggacaatcttttgtttttcacctgcttatctatcgactttattttggcttgtttcatgattgatacccactatgaaattaagcttcttttgagtattcggtctgaaatttagaatctcgttcacattgtctatgtgggtgatacaatacatttttcattcaggtacttgattatggtggattgataattttttgatggtgtt

SEQ ID NO: 4641 - DNA, 633 bp, Prunus persica
tcttcttggccgtcttcttcattgtgtaacagaactcatcacctctctctctctttctcgctccactctcgaagataatcgacaatgagtcgaggagctgcagcaggtcccaaggggaaaaagaagggagtgactttcaccattgattgtggaaagccagtggaggacaagatcatggacattgcatccctggagaagtttcttcaggagaggatcaaggttggaggcaaggccggtgcacttggtgacgcggtcagtgtgacccgggagaagagcaagatcactgtcacttctgacagtaacttctctaagaggtatctgaagtacttgacaaagaagtatcttaagaagcacaatgtgcgagattggcttagagtgattgcttccaacaaggatcggaatgtttatgaactaaggtacttcaacattgccgagaatgaaggggaggaggaagattgagatgctggatgattttagtcatcgaaggaccgtgtttacttgtttactgttttttgtgtggtactttgctgaaattaatgctgttttgaagttttgttcttttaatttcatgattgtcgaattttgctattagtacatcagaatatagaagatctggatttttaggaagtctta

SEQ ID NO: 4642 - DNA, 706 bp, Ricinus communis
gccgatccatcgtggaaacctgtgagcttagagctgcacattcgctcgcaataaaaccctaaccatagccctctcttctctttctcttcccatttctgcggcgctccaaaaccctaatctttcagtctgatagagcaatcgaggtaaaggaaaatgagcaaaggcggagcagctggtggcggtggagccaaggggaagaagaagggagcaacatttacaattgattgcgcgaagccagtagaggataagatcatggacatcgcctcactcgagaaattcctccaagagcgaatcaaagtcggcggcaaggcaggcgctctcggtgattctgtcactgtcactcgcgaaaagtctaaaatcaccgtcacctccgactctaacttctccaaacgatatctgaagtatttgacaaagaagtacctgaagaagcacaatgtgagggactggcttcgtgttattgcttcgaacaaggaccgtaatgtttatgagctgagatactttaacattgctgagaatgaaggcgacgatgaagagtaaattgtgttgcattcatgtctcaatttatttcgcttcaaagaaactttgtaggctttctttgttattttggaattagaaaaatgaactttttgctagagcaacctgttatcctcaatgtttgggtgattgagatttttaattttttaatccagaaatgtttgtcccaatc

SEQ ID NO: 4643 - DNA, 3015 bp, Ricinus communis
ggccaagctgacaactggtggatgccgatccatcgtggaaacctgtgagcttagagctgcacattcgctcgcaataaaaccctaaccatagccctctcttctctttctcttcccatttctgcggcgctccaaaaccctaatctttcagtctgatagagcaatcgaggtaaaggaaaatgagcaaaggcggagcagctggtggcggtggagccaaggggaagaagaagggagcaacatttacaattgattgcgcgaagccagtagaggataagatcatggacatcgcctcactcgagaaattcctccaagagcgaatcaaagtcggcggcaaggcaggcgctctcggtgattctgtcactgtcactcgcgaaaagtctaaaatcaccgtcacctccgactctaacttctccaaacgatatctgaagtatttgacaaagaagtacctgaagaagcacaatgtgagggactggcttcgtgttattgcttcgaacaaggaccgtaatgtttatgagctgagatactttaacattgctgagaatgaaggcgacgatgaagagtaaattgtgttgcattcatgtctcaatttatttcgcttcaaagaaactttgtaggctttctttgttattttggaattagaaaaatgaactttttgctagagcaacctgttatcctcaatgtttgggtgattgagatttttaattttttaatccagaaatgtttgtcccaatcatatcagcctattcatgccttaattctgagattatttgagctgcatttgatcttgtatcatttgcatatatactgcttttatgcatgacgcatcaatgtattttgataagtcgtattcttgctaagaattggaagtattcattagtctttttatagtagaaattacaatcaagatatagggtgaatacaagcagccaattcacattacaccaacttcaattcattgtagcaatgtttggtatttctactggatatttattaatctcatctgctggccatgcatttgcttcttcattccttgcattgtaaatgcatttccacactgcactattgcatttgaacccactcccaaaagcaatttgccaaaccctatcaccccttttcatccttcctttggcttctatatatgaaagttcataccatatagaagaagatgaggtatttccatatctatagagagtcatcttagaaggctcgacatcttctttcttcaacactaggtttctttcaattgcttggatgacagattttcctccagcatgtatgcagaaatgttcgaaagctcttcgaaaatttggtatgtagaagtttcttgtgcttaaaatccttgtctttctgcgagttattgaaagcacataccttaattgctctgagaatggcaaaaccaggggccctagtgttgaaatattcgcctttaatgcatccgctgccacatggagtgtgtcttttgatattgatactcctagcatgttttcagagtctaagtcctgatagacacagttgtaagagcgatcatcatgtgccttgtttgttcgaataaggtgttgtagctcatactttgcctttttcttgtcttgacaacggctggacatcagtatggccgctcccccagttctgaaaagacaattggttaacaacattgaagtctccttgccagtataccagttacaattaagcatctctgtgcttacaatgagagccaatgagttttgatgtacccttaacaaatcttttgccaggccaatggatgttatgccagcactgcaccccatgcctgataggttaaaactcatgatattgctccgcatattgaatttattcacaaccatagcagtaagggatggtgtaggggcaaacatgctgctattagatatgagtatgtcaatagcttttgggttgatgttgtttttctgcagcaagtctgtcacgatagaaaatattgttgtctgagcctcctccattgcagaagatagtttatttcttattggtgtctcagcaaaagcacaaggaacgcaagtttcgtgactaaagcctgatttctctaggatcttaatttggaattcaacactactgggatggaatctgctatcaagatggatatgctcttggaacagagacatgggtactctagtagaataaggtggcctgtagcaagtgaaatctagtaaacagatagtgactctttttctgaatgcaagatatagaaccagtgccagtggggctgctatgcatagtacggtgaattggtaggaagtgaagagcagcagcattgtgagttcagatatgtgtgcttggatcattgttaaggagtagaagttcatacttctctgtaaatggacatcgcacaaatatgatgtatatatattggttcgaactgtggagatgatgaggttgcctaagtgtgctcacaagggtatgaacgaggaaagaaagtccctttgggaaagttaaagagggaaaaatgttattataatatcacacgagtttagtgctttgtgggtggaaatttggacgcaactcttttcttctcagcaggtccactgtagagattcgatgaaatggacaatctcatgcgtatgataagcccaattattgtcatagccgtggtggtatgggcttagatggtgtgatagttaaatagaaaaaaagttccaagaatgcatgttgcaggatccaattctgtacaagtattgcttctcgttcctaccatgtcaaagtatgtttagtgcaaagctctaaaggattgattagaagggtagaaattgaatcacagcagtcacatgcatgcaataataaaaccgttttggcgtgtaggtgaggaaaacaaacaaccaaggacaatgacacgagtggctgctttatgccattacctaattttaatagctgcatcctggtttcagactggttttgaggtgtaattagaattattaacaaagatgtgcaattagaattgctgatactgatatggctataaaatccaagcatgtcacaatctttacattcttt

SEQ ID NO: 4644 - DNA, 637 bp, Valeriana officinalis
tctccacttccacctccctcaatccttcacaggtactgtaatcaacccgagaaaatgagccgcggcggtgcaactggtggcgctaagggcgggaagaagaagggatcgacgttcacgatcgactgcgggaagcctgttgaggataagattatggagattgcttcacttgagaagtttcttcaggagaggattaaggtcggcggcaaggctggtgctctcggagattctgttaccgttactcgtgagaagagcaagataactgtcacttctgatagcaacttctctaaaaggtacttgaagtacttgacaaagaagtatctaaagaagaacaatgtgagggactggcttagggtgattgcttcaaacaaggacaggaatgtttatgaactgcgatacttcaatatcgctgagaatgaaggcgaggaagaagattgataatatcaaatcggtatcattattatctcttttttgtttatcttaagctgctgtaatagcattagttttacagaagtttgattccaaattttacgtacaatgcgtttttggtactgttttcggatttaagaactgttgcagtgttgttcagattgagatgatttttgacatgatttgcttggcttggttcatacgagtaaca

SEQ ID NO: 4645 - DNA, 745 bp, Vinca minor
agttccagttccagttccagtctctcttcatacccaccttcaatcagagtcggccgcggcggagtagtatagacctagagaaaatgagtcgaggaggagcagctggagccaagggcgggaagaagaagggagcaaccttcgtgatcgattgtgctaagccggtggaagataagatcatggaaattgcatcgctggagaagtttttgcaagagagaatcaaagttggtggtaaagctggtgctcttggagattccgttactgttacacgtgacaagagcaagatcaccgtcacctccgattctactttctccaagaggtatctcaagtaccttacaaagaaatacttgaagaagcacaatgtcagagattggcttcgtgtgatttcatcaaacaaagacagaaatgtttatgaactccggtactttaacattgccgagggtgaaggcgaagaagaagattaaagctacaattgatgtggcttttgtgcttctgttagctgttgtttcagaaacatcattttgcttatttcactcattatcaacctcctggagttattttgaagttttgtctatcttatgatttttgtttacttgcaaatgaacatgtagtggaatagcatatccttgttatgggggtaccaagtatgaagagtaatgattattgcagtcttaatgtggtttgtttctacttgatattttggatctgttgcatttggaatcagctgcatatagtcaccatctctgga

SEQ ID NO: 4646 - DNA, 656 bp, Malus domestica
gagagctaatcctaacagacgcagctcccacacacccacgcagaagcgggcagcgagagagagagagagagagagagagagagagagagcgagagagagagaggcgaagatgagtcgtggggcggcagctgggacgaagggagggaagaagaagggggcttcattcgtgatagactgcgcgaagccggtggaggataagatcatggacatcgcctcactggagaagttcctccaggagcgcatcaaggtcggcggcaaggccggtgctctcggcgaatccgtcaccgtctctcgtgagaagaacaagataaccgtcacctccgactccaacttctccaaaaggtatcttaagtacttgacgaagaagtacttgaagaagcacaacgtgagggattggcttcgcgtgattgcatccaacaaggaccgcaatgtttatgaattgagatacttcaacattgccgagaacgagggtgaggaggaagactaaaagctttgtctcctgttttgtggcattaccggttgagcttagttgtggcattatctatcaacttctgtttcagcttttttcgtgattgatacctcctatggaaattaaagcttcttttgagacatcggtttggaatttagaatctggttatcatgttatctaaaaaaaa

SEQ ID NO: 4647 - DNA, 684 bp, Malus domestica
ctttaaccttcttggtcgtcttctgttatctctcattttccaacagaacccatcaccccgttccctctcaactcccgcaggagataatcgacaatgagtcgaggaactgcagcagcaggtcccaaggggaaaaaaaagggtgtgacttttaccattgactgtggaaagcctgtggaggacaagatcatggacattgcatccctggagaagtttcttcaggagaggatcaaggtcggaggcaaggctggtgcacttggcgatgctgtcagtgtgacccgtgagaagagcaagatcactgtcacctctgacagcaacttctcaaagaggtatctgaagtacttgacaaagaagtatctaaagaagcacaacgtgcgagattggctacgagtgattgcttccaacaaggatagaaacgtctacgaactgaggtacttcaacattgccgacaatgaaggggaggaggaagattaagatgccgggtcatctaagaaccttgttcacttattcagttttacgcgtggtactgttaaaattaatgatgttttgaaattttgtttttctttctaatgagatatttgctatcagtggatgagaatacagatctggattgtaggaagttgaactagttatgttttaacgaattcaccaggtgatattctcaaagttttcagcacagccctcgtg

SEQ ID NO: 4648 - DNA, 1264 bp, Theobroma cacao
tgtctaggcctctcaccatttctgcggcgctcgaaaaccctaaaatcaatcaagcaaccaaaagaggtaaaaatgagcagaggagcagcggctggcggagccaagggaaagaagaagggagcaaccttcacgatcgactgcgggaagccggtggaggataagatcatggacattgcctcactggaaaaattccttcaggaacgcatcaaagttggcggcaaagctggtaacctcggagactccgtcaccatcacccgcgagaagtccaaaatcaccgtcacctccgactccgccttctccaaaaggtatctgaagtacttgacaaagaagtacttgaagaaacacaatgtgagggattggctccgagtgattgcttccaacaaggatcggaatgtttatgaattgagatacttcaacattgctgagaatgaagcagaggaagaagattaagtattttctttctgttttgtgtctgttgtttgaagaagaactcattacaccctttccctcttgtgtttaggattgcttatgtagtttttttctttggagattgttgacagtaccaagttttgtttttaagagattattcaactactttaccctctgctttttctggtttgttgttgtggatgagctaaggggttttttcttttttttgtttaccttattactctgttcatggtttggcttctttgattcgccagtgaaattgtggattccaattgaattgtagttgtgaacttgggtgggttttcatggtagctgccatctatatgcctggattttctataacccactgtagaagctaggttggcagactttatgagccccttttatcctccttcttctctactgtaaccaatggaagaaggatgtgtttccaaatctataatcatcttacaggttctgtatgaaatctggtgtacaagcctttcaattggtcttgctctccgttagacattcccaactcctccctcatcaggctgtcattttagattttccagttgcatgcagaggatagtttggagatcattggggttacatcagcaagtttgcatatataacatggaaaggttgcagagcaaggctaggaggagagagtatctgggtaaatttagcaaaaatatcatagaattacaaggcattgaatgttcattttgtgctagatattttaatattttagagttgagagttgaggtgaaagtgggagaaatttgcaaataaagctacaagagcatggaaataagaaactataattttagat

SEQ ID NO: 4649 - DNA, 665 bp, Juglans hindsii x Juglans regia
  misc_feature (493)..(493): n is a, c, g, or t
  misc_feature (508)..(508): n is a, c, g, or t
  misc_feature (604)..(604): n is a, c, g, or t
ggggataggattatagaagtatcaatcatttcacggcgaggcttccttctttatctctcgtgtcatgtggagtgaagaatcacagcgaaaatgagccgcggggcagcagcggtgggaccgaaggggaagaagaagggagccacgttcgtgattgactgcgcgaagccggttgaggataagatcatggacatcgcctcacttgagaagttcctccaggagaggatcaaggtcggaggcaaggccggcgctctcggtgaatccatcaccgtcgtccgcgaaaagagcaaaatctccgtcacctctgacagcaacttctctaaaaggtatctcaagtacttgactaagaagtacttgaagaagcacaatgtgagggactggcttcgggtgattgcttccaacaaggacaggaatgtttatgaattgagatacttcaacattgctgagaatgagggcgaggaggaagactgaatatctagtattcttgtgtcgaggnaacattttctagtcncttggttgttccagtggatgggattgtttttttatgtttcaagttctgttttgctagccgtggttatcacattattagatccgctcaacgcattanatgtttgatgtttctttctggagtttgattatgatagagtaatgattattatgtgcttctg

SEQ ID NO: 4650 - DNA, 549 bp, Chelidonium majus
aggcaaagaagaagaagatgagtcgaggaacagcagctggtcccaaggggaagaagaaggtctcaaccttcacaatcgactgtgctaagccagtggaagataagatcatggatatcgcttctttggagaagttccttcaggagaggatcaaggtcggtggcaaagccggagctcttggtgatgccgtcaccatcgccagagagaagaacaagatcactgttacttctgacagcaacttctccaagaggtatttgaagtatttgacaaagaaatacttgaagaagcacaacgtccgtgattggctccgggtgattgcttccaacaaggacagaaatgtctatgagctccgatacttcaacattgctgagaatgagggagaggaggaagattgaagaccctgcctctcattatatattatccttttttagtattcgaatttttagccaagttgaagcattttcttatttaggttcatctgtgttcctttcttactggatttgatgttgtcatgaaattttgttgcttacaactaggaggatattggttttt

SEQ ID NO: 4651 - DNA, 653 bp, Cucurbita pepo
tcctcagcaactgtttttgttatcgaaaatgagtcgaggaggtgcagctggccccaaggggaagaagaagggagtaaccttcacaatcgactgtacgaagccggtggaagataagattatggacattgcttcgctggagaagtttcttctggagaggattaaagtcggaggcaaggctggtgctcttggcgatgccgtctctgttactcgtgagaagagtaaaattactgtcacttctgatagcaacttctccaagaggtatctgaagtacttgacgaagaagtacctgaagaaacacaacgttcgggattggctacgagtgattgctgcgaacaaagataggaacgtttacgaactcaggtacttcaacattgccgagaacgagggagaggaagaggattaaatttatgcattcaaggaacaagtgtagcttggaatgtgtgactggttatgttactagtgttgcttgtgtgatgctctctctatctttatatttgaactaaagcagtttagcaattttgttttgtttgacagacttagattgctgttatttttcttgtgtcatatttgagtaaaacaccaacaatatttcactcatttaattaatggtaggtggatcaaagtatttgtatgttactataattttgttattg

SEQ ID NO: 4652 - DNA, 618 bp, Cucurbita pepo
tcggtatctgagttctcaaagtctctgcagcacccgagatttttaactaaatcgaaaatgagtcgaggaggtgcagccggtcccaaggggaagaagaagggagtaaccttcacaatcgactgttcgaagccggtggaagataagattatggacattgcttctctggaaaagtttcttttggagaggattaaagtcggaggcaaggctggagctcttggcgatgccgtctctgttactcgtgagaagagtaaaattaccgtcacttctgacagtaatttctccaagagatatttgaagtacttgaccaagaagtacctgaagaaacacaatgtgcgagattggctacgagtgatcgctgcgaacaaagataggaacgtttacgaactcaggtacttcaacattgccgagaatgagggagaggaagaggattaaatttatgaatttgacattgcatttaaggaacaaattatgtcgcagcaatctctcactgtttttgttactactgttgcttgtgtgatcctttattttttctattcgaactaatgcagtttagcaattttgttttcttcgacagtcttagattgctgttgtttttgtgtcatatttgagaaacaccaa

SEQ ID NO: 4653 - DNA, 660 bp, Fagopyrum esculentum
ctcgtcatcgtttccatctcccataacactcgcctctctctctcgagcctcaacctttgaatatcgcaactctaatctcccggcgcaaaaatgagcagaggagcggccggagttgccaagggcaagaagaagggagcgtcgttcacccttgactgcactaagccagtcgaggataagatcatggacatcgcctcattggagaagttccttcaagagaggatcaaggtcggcggcaaggccggagctctcggagattccgtcactgtcactcgtgagaagaacaagatcaccgtcacctctgacagcaacttctctaagcgatacttgaagtacttgaccaagaagtacttgaagaagcacaatgttagggattggctccgggtgattgcgtcgaacaaggaccgcaatgtgtacgagcttagatacttcaacatcgctgagaacgaagctgaggaggaggaatagatagttcaagaggagcttgtttgttttttgggtttacatcctgatatttgttttggttggtttaagattatgtaatttcactcttaagagaggcttttatcttctgatattatggcaaattctgctcttgtttgtttcaaagaatattttaaaacctcctccctatttagctttatccaccttttaaaggagttc

SEQ ID NO: 4654 - DNA, 810 bp, Citrullus lanatus
actgggcggccgtcgatatctgaatcctcaacttctctacagcaactggtattctctcttcctctctcatatgattgctatcttgatccgatgctcgtttctatacttcaatacattggtttttctttctgattttgtagatttttgatcgaaaatgagtcgaggaggtgcagccggtcccaagggcaagaagaagggagtaaccttcacaatcgactgttcgaagccggtggaagataagattatggacattgcttctttggagaagtttcttctcgaaaggattaaagtcggaggcaaggctggagctcttggcgatgccgtctctgttactcgcgagaagagtaaaattaccgtcacttctgacagcaacttctccaagaggtatttgaagtacttgacaaagaagtacctgaagaaacacaatgtgcgggattggctacgagtgattgctgccaacaaagacaggaatgtttatgaactcaggtacttcaacattgccgagaacgagggagaggaagaggattaaatttatcaattcagacattgcattcaagggaaaactgcgtctctatgtccctggaatgtgtccctgtttttgttactattgttgcatgtgtgatgctctatttttatttgaactaatgcagtttagcaattttgttttctttgacagacctagattggtgttatttttttgtgtcatatttgagtaagaccaaaatttcactttaaatcacccatgtttctcacaatctcatgaaatctaggtggatgaatctatatttatctgactaaaattttgaattg

SEQ ID NO: 4655 - DNA, 788 bp, Malus domestica
gcgatctttaaccttcttggtcgtcttctgttctctctcatttcctaacagaacccatcacccccttctctctcgactcccggagataatcgacaatgagtcgaggaactgcagcaggtcccaaggggaaaaagaagggagtgacttttaccattgattgtggaaagccagtggaggacaagatcatggacattgcttcccttgagaaatttcttcaggagaggatcaaggttggaggcaaggctggtgcacttggtgacgccgtcagtgtgacccgtgagaagagcaagatcactgtcacctctgacagtaacttctcaaagaggtatctgaagtacttgaccaagaagtacctaaagaaacacaacgtgcgagattggcttcgggtgattgcttccaacaaggatagaaatgtctacgaactgaggtacttcaacattgccgataacgaaggggaggaggaagattaagatgccgggtcatctaagaaccttgttcacttattcaactttttcgagtggtactctgttaaaattaatgctgttttgaaattttcttttttcttttcaatttggttgttataagatatttgctattagtggatgaggatacagatctggatttgtaggaagttgaactagttatgttttaacaaattgcgccgggtgatattctcaagcttgcgtcactgctattgcttctccctgattgttgttttatcccttgtataatttatgatatcaaagcctgctgccaagttagtgttgaattttcttgatattgctaca

SEQ ID NO: 4656 - DNA, 677 bp, Malus domestica
cgatctttaaccttcttggtcgtcttctgttctctctcatttcctaacagaacccatcacccccttctctctcgactcccggagataatcgacaatgagtcgaggaactgcagcaggtcccaaggggaaaaagaagggagtgacttttaccattgattgtggaaagccagtggaggacaagatcatggacattgcttcccttgagaaatttcttcaggagaggatcaaggttggaggcaaggctggtgcacttggtgacgccgtcagtgtgacccgtgagaagagcaagatcactgtcacctctgacagtaacttctcaaagaggtatctgaagtacttgaccaagaagtacctaaagaaacacaacgtgcgagattggcttcgggtgattgcttccaacaaggatagaaatgtctacgaactgaggtacttcaacattgccgataacgaaggggaggaggaagattaagatgctgggtcatctaagcaccttgttcacttattcaactttttcgagtggtactctgttaaaattaatgctgttttgaaattttcttttttcttttcaatttggttgttataagatatttgctattagtggatgaggatacagatctggatttgtaggaagttgaactagttatgttttaacaaattgcgccgggtgatattctcaa

SEQ ID NO: 4657 - DNA, 756 bp, Theobroma cacao
cctcactctgctaaatgcatttttatatattcaaaacgtagaggcagcgaaggtagtctctgactctctgctcttgctttcctctctttcttctcccgattcctctcctttgtgttgatttgtctcggtggaaaagcagttaggtggtgcgaagatgagtcgcggagtagcatctggacccaaggggaagaagaagggagcgtcgttcaccatcgactgcgcaaagccggtggaggataagatcatggacatcgcctcactggaaaagttcctccaggaaaggatcaaggtcggtggcaaagccggtgctcttggcgactccgtcactctcacccgcgacaaaagcaaaatcaccgtcacctctgacgccaacttttctaagcggtatcttaagtacttgactaagaagtacttgaagaagcacaatgtccgggattggcttcgggtgattgcttccaacaaggatcgtactgtttatgaactccgctacttcaacattgctgagaatgagggggaggaggaagagtgaagaatcagttcagtattttctccggttaccaatttggtttattagttctgaggaccttgtttatctatttcaggtgtctaatctttggacatgtttgggttgatttttgacccaagtttttgttgccgatagttacattttttgtttgtgtcagtctattagatgctattaaaaggatgcatatttctttttcgagttgattataagagctcttaaatgattttcca

SEQ ID NO: 4658 - DNA, 1092 bp, Gossypium hirsutum
atcaacgcagagtacgatggggctggcactcaaagctattccacaacacagaggcagctaaggtaatccatctctctctgccttccgctttgtttttcctccttcctttctttcttgttgatttggctcagaaaactcagtgagttggtgcgaagatgagtcgtggggcagcagcgggacccaaggggaagaagaaaggggcctcctttaccatcgactgttctaagccggttgaagataagatcatggacatagcctctctagaaaagttcctccaggaaaggatcaaggtcggtggcaaagccggtgctctcggcgattccgtcactgtcacccgcgacaagagcaaaatcactgtctcctccgactccaacttctctaagcggtatcttaagtacttgactaagaagtacttgaagaagcacaatgttcgggattggcttcgagtgattgcttccaacaaggatcggactgtttacgagctccgatacttcaacattgcggagaatgagggtgaggaggaagagtgaagaccggttcagctttttctctattcatcacccctttgtttggtttatttgttatgaggaacctagtttatcaatttcaggtgtcgaatctttggacttgatttggttgttttttgaaccctagtctgttttcaatgaaattttggttgctcatagtaaaacattatgttttcaaaggcgttgatttggaagaccctcttaatggaatcaataagagggaatgtgtttttcttttcctaattgcaatttgtctttctcttacaaaattttggtgaggtcttaagtgtgatattgataaatggaattgtagtaaaatcatgaagtgagctgtaggagtatcagtgatatgtaaactaataagtttggtcgaatgtactgaaaatcattgatgagaaagatgattgagagggcagagagggattatgaagagattggagatggtgtgttttgtttaagcttagcctgttttattcccttcaattatttttttaggttgatgtcatggttagccattttaagtttgtgcagtggggtaattgtacaaagaaaatatctgatcttc

SEQ ID NO: 4659 - DNA, 576 bp, Mesembryanthemum crystallinum
  misc_feature (451)..(451): n is a, c, g, or t
  misc_feature (454)..(454): n is a, c, g, or t
aagagattgagcgaaatgagccgaggagcagcagttgcaaaggggaagaagaagggagcctccttcaccattgactgcaccaagccagtcgatgacaagatcatggacattgcttcccttgagaagttccttcaggagagaatcaaggtcggtggcaaggctggaaatctcggtgattccgtcactgtttctcgtgagaagaacaagatcactgtcacctctgactccaacttctctaagaggtacttgaagtacttgacaaagaagtacttgaaaaagcacaatgttcgtgattggcttcgtgtcattgcttccaacaaagatcgtaatgtctatgaactgaggtacttcaatattgccgagaatgaagcagaggaagaagattagatttgaggactttcattgatgctggatctacttgatgtgtcatcttttttgttttaatttagantgnaatgttttttggcatcttctctgttgggaaaatcttggaagagtggtttggctattggcttaaaactttagtattcctggccctgtcctttatatctagcacatgcatgcatcaacttatct

SEQ ID NO: 4660 - DNA, 574 bp, Jatropha curcas
attccaacgccgctcatctcttcgtttactacgttctccgcatcatttgctggtttttctaaggacaaccaaagatgagtcgagggactgctactggaaccaaggggaagaagaaaggagctacatttactgtcgattgttcaaagccggtagaggataagatcatggacattgcctctctcgagaagtttctccaggagagaatcaaggttggaggcaaggctggtgcacttggcgatactgttaccgttactcgtgaaaagagcaaaatcaccgtcacttccgaaagcaacttctccaagaggtatctgaagtacttaaccaaaaagtacttgaagaaacacaatgtgagggattggttgagagtgattgcatcaaacaaagatagaagtatatacgaattaaggtacttcaacattgctgagaatgagggggaggaggaagactaactatttgcaactcaatgtacctgtcttagtttttgcctattttgaacttctcttgtttattgtatagttgaatgatatgctacatttatcaacagaaatgttgttctataattttggttcttgaa

SEQ ID NO: 4661 - DNA, 735 bp, Lotus japonicus
ggatcgccgttgtcatccctcttcgcagtcctcgccgctgctcttcttcacgtgcatctccgagagttgaagaaaatgagtcgaggtgttgcagctggagccaaggggaagaagaaggcggtgaccttcaccattgactgtgcaaagccagtggaggataagatcatggacattgcttcacttgagaagttccttcaggagaggatcaaggttggtggtaaggctggtgctcttggtgatgttgtctccattgctcgtgacaagaacaagatctctgttacctctgacagcaacttctccaagaggtacttgaagtacttgaccaagaagtacttgaagaaacacaacgttagagactggctcagagtgattgcttcaaacaaagatagaagtgtttatgaactgaggtacttcaacatcgctgagaacgaaggggaggaagaagattaattgtttaaccagcttatttattttaagaactttgtttaccatttttcctagggctactttcccttttggcaagtattgcttgagatacaatgttttgtttagatctgttgcaatttcacagttttgattgtcattgatgttgaattgggaatagagtttgcatattattctgtgttgtttccaccttaaagacagttgctctgctttgtgtttctttgaacgaattttcccataaagacacatacctcgccctatatcgatacataagctcagtgtcttgttcca

SEQ ID NO: 4662 - DNA, 652 bp, Momordica charantia
aatcctcaacttttctgcagcaactgagacttttgatcgaaaatgagtcgaggaggtgcagcaggtcccaagggaaagaagaagggagtaaccttcacaatcgactgttcgaagccggtggaagataagattatggacattgcttcgctcgagaagtttcttcttgagaggattaaagttggaggcaaggccggtgcgcttggcgatgccgtctctgttactcgtgagaagagtaaaattaccgtcacttctgacagtaatttctccaagaggtatttgaagtacttgaccaaaaagtacctgaagaaacacaatgtgcgggattggctacgagtgatcgctgccaacaaagataggaacgtttatgaactcaggtacttcaacattgccgaaaatgagggagaggaagaggattaattttatcgatttagacattgcatttgagaaacaagtgtccttatgtcgcacgaatctctcactgtttcaattactagtgttgcttgtgtgatgctctatttttatctgaactaatgcagtttagcaattttgttttctttgacagaaacttagattgctgttatttttttgtgtcatatttgagtaagtccaacaatttttcacttataatcagcaatgtttcatatatcttatt

SEQ ID NO: 4663 - DNA, 630 bp, Rosa hybrid cultivar
gagagtagaaaaccctaaataccagaggagacagacgcagccgaaggtctctagccatatcacatcttcaagaaccaaagaagcgaaaatgagtcgcggagcagttgccggagccaagggcaagaagaagggagcttcgttcgtgattgactgcgggaagccggtggaggataagatcatggacatcgcctcactggagaagttcctccaggagcgtatcaaggtcggcggcaaggccggagctctcggtgactctgttaccgtttctcgtgagaagaacaagatcaccgtcacttctgacaacacattctccaagaggtatctcaagtacttgaccaagaaatacttgaagaagcacaatgtgagggattggcttcgtgtgattgcatccaacaaggaccgcaatgtgtatgaattgagatacttcaacattgcagagaacgagggcgaggaagaagactgagaaatcagtctcctattttgaggcactatccattaagcttagttctagaacttatcgtgttttcccctggcttgatagacttttatttgggcttgactgtgaaattaagtttatcctccgagtattttgtactgagattagtttttgattatcacattatctttctg

SEQ ID NO: 4664 - DNA, 755 bp, Sarracenia psittacina
tgtcgccgcttcatctgcgcttcgtgctgaaacaaactttgctgcgtgggaatacaaagatgagtcgaggtggaagcgcatctggtggtggtgcgaaggggaagaagaagggggcgacgttcacgatcgactgcgcgaagccggtggaggataagattatggaagtcgcctccctcgagaagttccttcaggagaggatcaaggtcgggggcaaggccggtgccctcggtgactccgtcaccgtcacccgcgagaagagcaagatcgtcgtcacctccgacagcaatttctccaagcggtatttgaagtacttgaccaagaaatatctgaagaaaaacaacgttcgtgattggcttcgtgtgattgcgtccaacaaagatcgaaacgtttatgagcttaggtacttcaacattgctgagaacgagggcgaggacgaagattagtagtcagatctccgatctttatgtgagtgataacaccttccatcgatctgttttgtggtccttattatgtttactttgaaccattttctttccaattttgtttcttgaattataatttttgccatatcatcgtttattgttgctgcggagttcagttgcaaggactgcctattattgacacaatattttgaaattatttgaaatttttattagtttgatgatattctgatctgtttcactttgggcatgtggtttatatcacaatccttgattcggaattttataaatattgacagaggagaactatattta

SEQ ID NO: 4665 - DNA, 709 bp, Manihot esculenta
gttactgcggcgctccaaaaccctaaagcaccatctctatccagtcgctattccaattaaagagaagtgaagaaaatgagtagaggtggagctgccggggccggtggagccaaggggaagaagaagggagctacatttactattgattgctcgaagccggtcgaggataagattatggacattgcctctctcgaaaagttccttcaggagcgcatcaaagtcggtggcaaagccggggctctcggtgattccgtcaccgtcacccgtgaaaagttcaaggtcacggtcacatgtgactccaacttctccaaacgatatctgaaatacttgacaaagaagtacttgaagaagcacaatgtgcgggattggcttagggtcattgcttccaacaaggatcgtaatgtttatgagctgagatactttaacattgccgagaatgaaggcgaggatgaagaatagattatcagtttgttcttttcatgcttctatctaatttttccctctttgtaggtgatgtttattacttgatctatggtctctttcgaatttttggaagttgaaacatcgaaattttgtcagagttatttactttgttcaggatttttttgttaaaacaagaatgcttgccttgattatttatatcactcttatcctttcttgagaaattattattggtatgacacccgtaataaagttcctcgtttccatg

SEQ ID NO: 4666 - DNA, 738 bp, Amsonia hubrichtii
agcaaagaagaaacgttttagtattagtcttctcctcatacgcaccttcaatcagagtcggctgccgagtgtagattagagaggaacatagaagatagaaaatgagtcgaggggcaggagcagctggagccaagggtggcaagaagaagggggccacctttgtgatcgattgtgcaaaacctgtggaagacaagatcatggaaatcgcatcgctggagaagttcctccaggagagaatcaaagtcggaggcaaggctggtgctctcggagattccgtcaccgttacccgtgacaagagcaagatcaccgtcacctccgactccactttctccaaaaggtatctcaagtacctaacaaagaaatacttgaagaagcacaatgtgagagattggcttcgggtgatttcttcaaataaagaccgaaatgtttatgaactgcggtactttaacattgctgagggtgagggtgaggaagaggattgaagctacgatggatgttactttatgcttcttttagctgtcacttcagttttttgaaacaacaatctgcttatttgaatctctatcgaccttctgagttattttgtagttctgtccatcttatgatttttgtttatttgcaaaagtgacatgtagtagatagtatatctttgttatgagaatcaagtatggagagtaatgattattgcaactatctttgttatgagaatcaagtatggagagtaatgattattgcagt

SEQ ID NO: 4667 - DNA, 896 bp, Tabernaemontana elegans
acgcattagtgtcagtcttctcttgatacaccttcaatcagagtcggccgccgagggtagactagggaagactaggtaagaggatagaaaatgagtcgaggggcaggagcagctggagccaagggtggcaagaaaaagggggccacatttgtgatcgactgtgcaaaaccagtggaagacaagatcatggaaatcacatcgctggagaagttcctccaggagagaatcaaagtcggagggaaggctggtgctctcggagactccgtcaccgttacacgtgacaagagcaagatcaccgttacctctgactccgccttctccaaaaggtatctcaagtacctaacaaagaaatacttgaagaagcacaatgtcagagattggcttcgtgtgattgcatcaaacaaggaccgaaacgtttatgaactgcggtactttaacattgctgagggtgagggtgaggaagaagattgaagctataatggatctttcttttaagcttctgttagctgtggcccaagtattgtgaaacatctttttacttatttcaacctcctgcagttattttgtagttttgttcatttatgatttttgtttactttcaaaagggacatgtagtagagtagtatatccttgttctgagaatcaagcctgagagtaatgattattaacagtattcatgtgttttgtttctaatacttggtacttgaatctgctgattacaatgtcagtgtttgctactggtgtgctattctgctggaaaacatcaggaatttagccggaattggcggttgagttaacttgttctgcatatgtctctgtggcttcatcctgtttgtaaatcatattatgtttctatgtcagcgatgtttcctaatagattagttttggagaaaagc

SEQ ID NO: 4668 - DNA, 628 bp, Fagopyrum esculentum
cagcagatccttatattcccttcattaaccctaaaactgagcagccgtcgtctttttcattctcgcttctcccaccatttctggataggcaggtcggcaaataagacagaggaaaatgagcagaggagcggccgccggagttgccaagggcaagaagaagggagtatccttcacactcgactgtaccaagccagtggaagataagatcatggacatcgcttcactcgaaaagtttcttcaggagaggatcaaggtcggtggtaaggccggcgctctcggtgactctgtcaccgtctcccgcgagaagaacaagatcaccgtcacctccgacagcaacttctctaagcgttacttgaagtacttaaccaagaagtacttgaagaagcacaatgttcgtgattggcttcgtgtgattgcttctaacaaggatagaagcatttacgagctgagatacttcaacattgctgagaatgaggcagaggaggaagattaaaatcattaatcttagtagttcatttctttcttggtgttttctaaggattttgtcatctttttgtattctaagttcacaacatttgccctttcatctttttggaacttctcatctttttgacattgattttttttt

SEQ ID NO: 4669 - DNA, 818 bp, Vitis vinifera
cgtacataaatcttaaccctagcttatcctccctttctctgcggcgcaaccccaatcttaggattttgtgagttgcagagcaagggacgctatgagtagaggcagcgcaacgggtgggcccaagggcaagaagaagggagccaccttcaccatcgactgtgccaagccggttgaggataagatcatggacatcgcctcgctcgaaaaattccttcaggagcgcatcaaggtcggcggcaaggccggtgctctgggagattccgtcaccgttacacgtgacaagagcaagatcaccgtcacctccgaaagcagtttctctaaacggtatctgaaatatttgacaaagaaatacttgaagaaacacaacgtgagagattggcttcgggtaattgcttccaacaaggatcgcaatgtgtatgaattgcgatacttcaacattgctgagaatgagggtgaggatgaagactgaagatatggacctgtatttactttataggtttctttgttctcattatggtggaatcttctttggtgaattgtctttgttcgtggttgcttttgtactttgtggaacttgagattttgaagttttggttatgctcaaccataaatttacgttcccttgttgctatatttggtttgttatattgcttacatttgtattttaattttttatgatttagtttctcactattggtgaatgaaaggatatttgccttacaccctttaatgtctgccgaggccctttaatgtcatgagctatataacatacttaccaatggaagtatctgatgagctgaaaacacaatcacattgtt

SEQ ID NO: 4670 - DNA, 713 bp, Vitis vinifera
aaatcttaaccctagcttatcctccctttctctgcggcgcaaccccaatcttaggattttgtgagttgcagagcaagggacgctatgagtagaggcagcgcaacgggtgggcccaagggcaagaagaagggagccaccttcaccatcgactgtgccaagccggttgaggataagatcatggacatcgcctcgctcgaaaaattccttcaggagcgcatcaaggtcggcggcaaggccggtgctctgggagattccgtcaccgttacacgtgacaagagcaagatcaccgtcacctccgaaagcagtttctctaaacggtatctgaaatatttgacaaagaaatacttgaagaaacacaacgtgagagattggcttcgggtaattgcttccaacaaggatcgcaatgtgtatgaattgcgatacttcaacattgctgagaatgagggtgaggatgaagactgaagatatggacctgtatttactttataggtttctttgttctcattatggtggaatcttctttggtgaattgtctttgttcgtggttgcttttgtactttgtggaacttgagattttgaagttttggttatgctcaaccataaatttacgttcccttgttgctatatttggtttgttatattgcttacatttgtattttaattttttatgatttagtttctcactattggtgaatgaaaggatatttgcctta

SEQ ID NO: 4671 - DNA, 691 bp, Arachis hypogaea
acgggggaacaccaaaacgaaaccctagctggatacgaaaacaaaaaccctagcttatattgggagaaaggaagcctctgttgtcagcagcaacacaagctactaccttgtgcttcggagagagagtgagaagagagagaaaatgagccgcggagcaggagctggtggagcgaaggggaagaagaagggagcgagcttcgtgatcgattgcgcgaagcccgttgaggataagatcatggacatcgcatcgctcgagaagttccttcaagagaggatcaaggtcggaggcaaagccggtgctctcggcgattccgtcaccgttacaagggacaagtccaagatcaccgtcacctccgattccagcttctccaagcgatacctgaaatacttgactaagaagtacttgaaaaagcacaatgtgagggattggcttcgtgtgatctcctccaacaaggacaggaatgtgtatgagttgagatacttcaacattgccgagaatgagggtgaagaggaagagtgaacaatctagtcttctgtcacaagacattatccattaggcgtatttattgtggagtctatctaaatctatctgttgtgttttttggttaactttgtgactggttgcttcagaattcctgaatttattttcgaatcaactttttgtcccaatgaaagcttgatagtaattttt

SEQ ID NO: 4672 - DNA, 736 bp, Populus trichocarpa
atcccaatatagtctctcacccgcgcggcggtcttttatctgctgggagagagagacggttccctttttgtgtaaatctagaacgtctttgagagagtaaaattgcaaaaatgagtaaggcagcagcagcaggtggagccaaggggaagaagaagggagcgtccttcgtcattgattgcgccaagccagtggaggacaagatcatggatatcgcctctctcgagaagttcctccaggagaggatcaaggttggcgggaaggccggtgctcttggtgacactgttaccgtcactcgtgagaagagcaagatcaccgttacttccgatagcaacttctctaagcggtatcttaagtacttgaccaaaaagtacttgaagaaacacaatgtgagggattggcttcgagttatttcttcaaacaaggacaggaatgtttatgaattgcgttactttaacattgctgagaatgagggggaggaggaagactgaagactcggtacactattttttcagattgtttacttattttagggcctcctttatctatatcagctgttggatctataggcttgttattagatgttattaataccatccgaatttcttgctagagtttgtctatagagattggcatggctaggtttttatatatgccttctctttcgcatcattatagtttttgccacccttgttttgaataaatgcatactcatggtggctgttgctttacctctact

SEQ ID NO: 4673 - DNA, 637 bp, Rhizophora mangle
gattctcgttccatttcagcggcgggcggcgttgctccaaaaccctttcattgtgctgagatagttaggcgaaacattcagaaaaaaaatgagcaaaggaggagcagccggtggggccaagatcaagaagaagggagcgacgttcacgatcgactgctccaagccggtggaggacaagatcatggacatcgcctcacttgagaagttcctacaggaacgcatcaaagtcggcggcaaagccggagctctcggcgattccatcaccgtcgtccgtgagaagtcaaaaattatcgtcacttctgattcccccttctcgaaacgatatctgaagtacttggtaaagaagtacttgaagaagcacaatgtgcgagactggcttcgggtgattgcagcgaacaaggaccgtaatgtttatgaattgagatactttaacattgctgagaatgaaggcgaggaagaagactaaacgttgcccatgttttctgccttttatcttcttggtagaatcttctctatatgtatctcatttctttgagtttgcttcagagtatttcggaattctgtggattcaaaattttgtcaagcttcagcttcattgagattctgacaagtgatgaacgaagaatgtttgccccgg

SEQ ID NO: 4674 - DNA, 689 bp, Vitis vinifera
caaaccgaaccctctctctatccctcttcatcttcgttgttgattctgtgattcgcagagcagaggcacaagaatgagtcgcggcacagcatctgggccgaagggcaagaagaagagtgcgacgttcacgatcgactgctccaaaccagtggaggataagatcatggacgtcgcatcactagaaaagttcctccaggagcgaatcaaggtcggcggcaaggccggcgctctcggtgactccgtcaccgtcacccgcgagaagagcaagatcaccgttacctccgatagcaacctctctaaacggtacctcaagtatctgactaagaagtacttgaagaagcacaacgtgagggattggcttcgggtgattgcctccaacaaagaccgcaatgtttatgaattgcgctacttcaacattgctgagaatgaaggggaagaggaagaatgaagatctggcccccatgttagtttagtttatccagagctccttttatgttttcagctccctcctctgcccattcatcatagatggttttgtgacaacacttgagctgttttcccgaaattttgtttgctgatgattggatttgtctgggtttcacaaaattaaatcatatttggttgaactaatagcaatagaattttctttctagtggaaaattaatgaatattgttgagctttattgcca

SEQ ID NO: 4675 - DNA, 621 bp, Tripterygium wilfordii
atctttgctgcaattaacaaggataatcgaagatgagtcgaggaagtgcaacgggtgccaaggggaagaagaaggaagcgacgttcacgatcgattgcgggaagcctgtagaggataagatcatggacattgcatcactggagaaatttttgcaggaaaggatcaaggtcggaggcaaggctggtgcacttggtgattccatcaccgtaagcagagagaagagtaagatcaccgttacctctggcagcaacttctccaagcggtatctcaagtatttgacaaagaagtacttgaagaagcacaatgtaagggattggctccgggtgatcgcatccaacaaagatcgcaatgtttatgagttgaggtacttcaacatcgctgagaatgaggccgaggaagaagattgaaacaatttctttatcgaaggaccttgttggctagtcagaagcttttacaattttgtttatttgcctacacattcagtattgctgttggatttgtatgtgtgccttattagcactagttaagcatatcaatttttggcttacataaaacccctaaagaagttgagtgtcgatttttctgagattccaagggtttaaaattgctgttgcaagttat

SEQ ID NO: 4676 - DNA, 667 bp, Acacia harpophylla
ggcctctcttcaccatcacaactcgcaaggatacagagcataatcggagaagcgaagatgagccgcggaacatctacaggggctaagggcaagaagaagggagctaccttcgtgatcgactgtgcaaaaccagttgaagataagatcatggacatcgcttccctggagaaattccttcaggagaggattaaggttggtggcaaggccggtgcccttggcgattccgtcactgttagtcgggacaagagcaagattaccgtcacctccgacagcaacttctccaagagatatctgaaatacttaactaagaagtatttgaagaagcacaatgtgagggattggcttcgggttattgctgcaaacaaggaacgcaatgtgtatgagctacgatacttcaacattgctgagaatgagggcgaggaggaagactaaatgtgtctttagctgccttgaggagttatgtgttatgttaggcttagttattgtggagtcttaattatcagttttgactattggtttgccagctgttcttcaatatgcttgcgtttcttttggttccagctttatgtccttttgttgttttatagactttgttggagaggtaatctcaagaatttttagatgctctatatgcagcgcatatatattgagtatcttgatttcggtt

SEQ ID NO: 4677 - DNA, 798 bp, Phaseolus coccineus
agaggcaaatctaaaccctaagtatcagccacacttcaacgccgctcctttcttcactctgagttgtgctgtttcggtgtagcttaagaaagtgagaagaatgagtcgaggtgtaactgctccgaagggcaagaagaaaggggtcacattcaccattgactgcgcgaagccagtggaggataagatcatggacattgcgtcactcgagaagtttcttcaagagaggattaaggttgctggcaaggccggtgctctcggtgacaccgtcgccgtcgcacgcgagaagaccaaaatcattgttacatcggacagcaacttctccaaacggtacctcaagtacttgactaagaagtatttgaagaaacacaatgttcgtgactggctcagagtgattgcttctaacaaagatagaaacatttatgaactcaggtacttcaacattgctgagaatgaaggagaggaagaagaatagttatgttgtctgtttattcatttgagaaccttgtttaccctttttctcaatgctagattctgttttggcttgagctctgtttacattagttgcaatttaacagttttgtttatttgagagttctgattcagaatagagttcacattatatttttgcctttgatactgttgctatgcattattaaactaatattgcgatcatctcaaagcccatctgcggtcgcatattatttgttcttatgtatttgcaattgaagaatgtttgatcaaaatattagttaattgtttctggaaaagcaatatagaatttggtttgcttactgactt

SEQ ID NO: 4678 - DNA, 965 bp, Vitis vinifera
cgggtcggggcgggtgacccgggaaacccgcgaatttgccattcctattcacgactcattcccgactcacgagtcacagtccccaaaaccctagctcctccaaaaaccctaaaacgcccctatcttcagccgcttcatttttctccatattatcactcgcggcacaaaccgaaccctctctctatccctcttcatcttcgttgttgattctgtgattcgcagagcagaggcacaagaatgagtcgcggcacagcatctgggccgaagggcaagaagaagagtgcgacgttcacgatcgactgctccaaaccagtggaggataagatcatggacgtcgcatcactagaaaagttcctccaggagcgaatcaaggtcggcggcaaggccggcgctctcggtgactccgtcaccgtcacccgcgagaagagcaagatcaccgttacctccgatagcaacctctctaaacggtacctcaagtatctgactaagaagtacttgaagaagcacaacgtgagggattggcttcgggtgattgcctccaacaaagaccgcaatgtttatgaattgcgctacttcaacattgctgagaatgaaggggaagaggaagaatgaagatctggcccccatgttagtttagtttatccagagctccttttatgttttcagctccctcctctgcccattcatcatagatggttttgtgacaacacttgagctgttttcccgaaattttgtttgctgatgattggatttgtctgggtttcacaaaattaaatcatatttggttgaactaatagcaatagaattttctttctagtggaaaattaatgaatattgttgagctttattgccatattatgcgtgatttgattgaggttattaaagagtttaactcttcttgggtttgtgccttcccagcatcttaaccatcagttattagatgcatgggcaactgttattgtatc

SEQ ID NO: 4679 - DNA, 666 bp, Vitis vinifera
ctcgcggcacaaaccgaaccctctctctatccctcttcatcttcgttgttgattctgtgactcgcagagcagaggcacaagaatgagtcgcggcacagcatctgggccgaagggcaagaagaagagtgcgacgttcacgatcgactgctccaaaccagtggaggataagatcatggacgtcgcatcactagaaaagttcctccaggagcgaatcaaggtcggcggcaaggccggcgctctcggtgactccgtcaccgtcacccgcgagaagagcaagatcaccgttacctccgatagcaacctctctaaacggtacctcaagtatctgactaagaagtacttgaagaagcacaacgtgagggattggcttcgggtgattgcctccaacaaagaccgcaatgtttatgaattgcgctacttcaacattgctgagaatgaaggggaagaggaagaatgaagatctggcccccatgttagtttagtttatccagagctccttttatgttttcagctccctcctctgcccattcatcatagatggttttgtgacaacacttgagctgttttcccgaaattttgtttgctgatgattggatttgtctgggtttcacaaaattaaatcatatttggttgaactaatagcaatagaattttctttctagtgga

SEQ ID NO: 4680 - DNA, 526 bp, Hevea brasiliensis
agggccggcagctggagctaaggggaagaagaagggagcggcctttgtgattgattgcgggaaaccagtggaggataagattatggacatcgcctcactggaaaagttcctccaggagaggattaaggttggtggcaaggccggtgccctcggtgacaccgtaaccgtcactcgtgacaagaccaagatcaccgttacctctgacagcaatttctctaaaaggtatcttaagtacttgaccaagaagtacttgaagaaacacaatgtgcgagattggcttcgggtgattgcttccaacaaagacaggaatgtgtatgaactgcgatacttcaacattgctgagaatgagggagaggaggaagattaatcatccaattcagtattttatatgtttaaattttcctgtttagagcctcattatctatttgagctgttggatgtgcaagactcgttggggttgttttgtgatcctttctgaatttgtggaaattttgactgcttataattagatatcttctttcgatgt

SEQ ID NO: 4681 - DNA, 500 bp, Pisum sativum
gtgccaagggaaagaagaagggtgcaaccttcaccattgactgtgctaagccagttgaagacaagatcatggacattgcttcccttgagaagtttcttcaagagaggatcaaggtcggtggcaaagctggtgctcttggtgattctgttactgttaccagggagaaatccaaaatcactgttacctcagacagcaacttctccaagaggtatttgaagtatttgacaaagaagtacttgaagaaacacaatgtaagagactggctcagagtgattgcttcaaacaaagatagaaatatctatgagctgaggtacttcaacattgctgagaacgagggagaggaagaagattaatcgaatgatcagcttatttcctagagttagtgttccttttggcatgtataagtattgcttgagatatgatccaatgtttagactttgtttcaatttaacagttttgattttgtgttgccattaatgaaattcagaatacagttttca

SEQ ID NO: 4682 - DNA, 521 bp, Pisum sativum
gtgccaagggaaagaagaagggtgcaaccttcaccattgactgtgctaagccagttgaagacaagatcatggacattgcttcccttgagaagtttcttcaagagaggatcaaggtcggtggcaaagctggtgctcttggtgattctgttactgttaccagggagaaatccaaaatcactgttacctcagacagcaacttctccaagaggtatttgaagtatttgacaaagaagtacttgaagaaacacaatgtaagagactggctcagagtgattgcttcaaacaaagatagaaatatctatgagctgaggtacttcaacattgctgagaacgagggagaggaagaagattaatcgaatgatcagcttatttcctagagttagtgttccttttggcatgtataagtattgcttgagatatgatccaatgtttagactttgtttcaatttaacagttttgattttgtgttgccattaatgaaattcagaatacagttttcattttattaaaaaaaaaaaaaa

SEQ ID NO: 4683 - DNA, 766 bp, Actinidia deliciosa
  misc_feature (49)..(51): n is a, c, g, or t
gcaaaaaccctagccgcgacaatgctccccatttttctgctcccgccgnnncatcttcggtttcagctcaaacaaaacttctctctctaaaagatgagtcgaggcggaagtgcggcggccggtggtggtgcgaaggggaagaagaaggcagcgacgttcacgatcgattgcgcgaagccggtggaggacaagatcatggaaatcgcctccctcgagaagttccttcaggagaggatcaaggtcggcggcaaggctggtgctctcggagactccgtcaccgtcactcgcgacaagagcaagatcaccgtcacctctgacagcaacttctccaagcggtatttgaagtacttgaccaagaaatacctgaagaaacacaacgttcgtgattggctccgtgtgatttcttccaacaaagatcgaagtgcttatgaacttaggtacttcaatattgctgagaacgagggcgaggatgaagattgataaccggtctgtgttgatctgatagcattttggtttcattgcagtttgtagttctcattatctttgtgctctgttcacaattttgtttcttgaattggagtattcgtgctctgttcacaattttgtttcttgaattggagtattgccggctatgctattgctggaaagagagagtggcacttgccatatcagagttggtataattgtggtcgtggagtgtgattgtgatgattatgcggattattgacacaatcttttgaatttatttggaatttcctttaattaa

SEQ ID NO: 4684 - DNA, 753 bp, Sarracenia psittacina
tctgtcgccgcttcatctgcgcttcgtgctgaaacaaactttgctgcgtgggaatacaaagatgagtcgaggtggaagcacatctggtggtggtgcgaaggggaagaagaagggggcgacgttcacgatcgactgcgcgaagccggtggaggataagattatggaagtcgcctccctcgagaagttccttcaggagaggatcaaggtcgggggcaaggccggtgccctcggtgactccgtcaccgtcacccgcgagaagagcaagatcgtcgtcacctccgacagcaatttctccaagcggtatttgaagtacttgaccaagaaatatctgaagaaaaacaacgttcgtgattggcttcgtgtgattgcgtccaacaaagatcgaaacgtttacgagcttaggtacttcaacattgctgagaacgagggcgaggacgaagattagtagtcagatctccgatctttatgtgagtgattacaccttccatcgatctgttttgtggtccttattatgtttactctgaaccattttctttccaattttgtttattgaattatagtttttgccgtatcatcgtttattgttgctgcggagttcagttgcaaggactgcctattattgacacaatattttgaaattatttggaatttttatttagtttgttgatattctgatctgtttcactttggacatgtggtttatatcacaatccttgattcggaattttataaatattgacagaggagaactat

SEQ ID NO: 4685 - DNA, 697 bp, Cucurbita pepo
gtacatctttgcaggaagttagagcaaagcagaagcaaaaatgagccgtggagcagccgcatccggtggccctaaggggaagaagaagggtgtgaccttcgttatcgattgtgcgaagccagttgaggacaagatcatggacatcgcctcattggagaagtttcttctcgagaggatcaaggtcggcggtaaagctggagcacttggtgactctgttactgtcactagggacaagaacaagattactgtcaactcagacagcaatttctccaagaggtatctcaaatatttgaccaagaagtatttgaagaaacataacgttagagattggcttcgggttattgcttcgaacaaggaccgcaatgtctatgaattgagatacttcaacattgccgagaatgagggtgaggaagaagactgaagttgaagtccttatattttggaagcattgtttgcagtaggattagctatatttccataccttgtctcgaagcgttttccatatagaacatagcaaggggattgcctgagttatgagatgatgcaactcttgtttatttctgaagttttaatatctataaattttgctcatgtagctctcttcttttgattgatttgaagatacttttcttactacgagagtattagcaaaagtgacaatctgtacttggtttgagaaattggaattggcacagtt

SEQ ID NO: 4686 - DNA, 634 bp, Vinca minor
ccagttccagtcccagtttcagtcttctcttcataagcaccttcaaccagagtcagccgcggcggagtagtgtagactaagagaaaatgagtcgaggagcaggagcagctggagccaagggcgggaagaagaagggagcaaccttcgtgatcgattgtgcgaagccggtggaagacaagatcatggaaattacatcgctggagaagtttttgcaggagagaatcaaagttggaggcaaagctggtgctcttggagattccgtcaccgttacccgtgacaagagcaagatcaccgttacctcggactccactttctccaagaggtatctcaagtacctaacaaagaaatacttgaagaagcacaatgtcagagattggcttcgtgtgatttcatcaaacaaagacagaaatgtttatgaactccggtacttcaacattgctgagggtgaaggcgaagaagaagattaagttttcggatgtgacttttatgcttctgttagctgtggtttaagttttcggaaacatcattttgcttatttccaatctctatcaatttcgtggagttatttttgtagttttgaccatcttatgatttttgtttcacttgcaaaaggaacatgtagtagaatagtgta

SEQ ID NO: 4687 - DNA, 834 bp, Citrullus lanatus
aggacactttaacaaattcgaaactaaataggttatttctgcttaaagaaaacatatcgccttcgtgctttaaaacaactcaaaaccctaaaatcagcgccgattgctctatacatctctgcaggaagttagggcaacaagttgcaaagcataagcaaaaatgagccgtggagcagccgcatccggtggcccgaaggggaagaagaagggcgtgaccttcgtcatcgattgtgcgaagccagtcgaggacaagatcatggacatcgcctcgttggagaagtttcttctcgagaggatcaaggttggcggtaaagctggcgcacttggtgactcggttaccgtcactcgagacaagaacaagatcaccgtcaactccgatagcaatttctccaagaggtatctcaaatacttgactaagaagtatttgaagaaacacaacgttagagattggcttcgggttattgcttcaaacaaggatcgaaatgtctatgaattgagatacttcaatattgccgagaacgagggtgaggaagaagactgaggttaaaatccctatattttggaagcagtgtttgctgtaggattagttatatttccataccttgtcttgaagcttcccatataaaacatagcaagaactctcagagttatgagatgatgcgactcttgtctatttctgaggttttaatatctataaattttgctcacgtagctcccttcttttggttggtttgaagatacttttcttactctgagagtatggttgttgtcttggcaaagtgatataatttgtatttggttcgaagaattgaaatttcgacttcctcgtaagaa

SEQ ID NO: 4688 - DNA, 834 bp, Cucumis sativus
aaactcaaaaccctaaattcagcgccgattgttcaatacatctttgcaggaagttagagcaaagcagaagcaaaaaatgagccgtggagcagccgcatccggtggccctaaggggaagaagaagggtgtgaccttcgttatcgattgtgcgaagccagttgaggacaagatcatggacatcgcctcattggagaagtttcttctcgagaggatcaaggtcggcggtaaagctggagcacttggtgactctgttactgtcactagggacaagaacaagattactgtcaactcagacagcaatttctccaagaggtatctcaaatatttgaccaagaagtatttgaagaaacataacgttagagattggcttcgggttattgcttcgaacaaggaccgcaatgtctatgaattgagatacttcaacattgccgagaatgagggtgaggaagaagactgaagttgaagtccttatattttggaagcattgtttgcagtaggattagctatatttccataccttgtctcgaagcgttttccatatagaacatagcaaggggattgcctgagttatgagatgatgcaactcttgtttatttctgaagttttaatatctataaattttgctcatgtagctctcttcttttgattgatttgaagatacttttcttactacgagagtattagcaaaagtgacaatctgtacttggtttgagaaattggaattggcacagttctgaggaagttcaaactgtttggtactgtttgcggaagagtttgcaaccctagtggtttacttcaatggaggacatcaaataaacttaaattcttgagaaa

SEQ ID NO: 4689 - DNA, 673 bp, Cynara scolymus
gcgggggtacaattatctcattcagttgcagttcgccgtcttcgaatttagaggagagaagccaagatgagtcgtggagcaggaggtgcgggagccaagggcggaaagaagaagggagcgacgttcgtgattgattgcgggaagcctgttgaggacaagattatggaaatcgcatcgcttgagaagttccttcaggagagaatcaaggttggcggcaaggctggtaatctcggagactctgttacaatttcacgtgaaaagaacaagatatccgtcacctccgatagcaacttctccaaaaggtatttgaaatatctaacaaagaagtacttgaagaaacacaatgtgagggattggcttcgagtgattgcttctaacaaagaccgtaacgtgtacgagttacgttatttcaacatcgctgagaatgagggcgaagaagaagactgagcaggaattcgacctcggttttatgtttttttgatctggcttggcttgggcttgccttttagacgtatgttatatcagtcttttcttcattcttccattcagaacagtattgtgtaatagagtttttgagtttaggtgcttttgcactcatcttcatttcacttctatgggatcattttctcacgagattttgaattttctgaattattgtttgcttatcgaattc

SEQ ID NO: 4690 - DNA, 832 bp, Panax ginseng
attcgcggaacgtccatttaaaagatctcggttcttcctctcattctttttctccccttttatgtctctagcagcagcgacgacaaacccttgtcccttcgtcgctccctcgccagcgacctcctcctcttcctcctcctttatctctctctcttgctctcttacaatagatcgatagtctcctcctttatcttcataaacatcccatattcagttacagtcagccgttttaaagttcaatctgagaagaaaagcgaagatgagtaaagggacaggaggagcggccggagccaaggggaagaagaagggagcgaccttcgtgattgactgcggaaagccggtggaggacaaaattatggacattgcttcactggaaaagttccttcaggagagaatcaaggtcggcggcaaggccggagctctgggtgattctgtctccgtcgtccgcgagaagagcaagatcaccgtcacctctgacaacagcttctccaaaaggtatcttaaatacctaacaaagaagtacttgaagaagaacaatgtgagggattggcttcgagtgattgcatccaacaaggaccgtaatgtttatgagttacgttacttcaacattgctgagaatgagggagaggaggaagactgaacacactgttcaatttcgtaatgtttatgagaggatgagtaagacttaacactgttcaatttagttttctgttatatgttttgttttgtttaattgtcctgtgtttatttttaacaaatttaccctttgaaagtgcgaaagtggggttcagtgtttttggttttgactactaagcattcggaattgatctcg

SEQ ID NO: 4691 - DNA, 617 bp, Actinidia deliciosa
  misc_feature (38)..(38): n is a, c, g, or t
  misc_feature (76)..(76): n is a, c, g, or t
  misc_feature (78)..(78): n is a, c, g, or t
ttgattgttgaagcagcgaagatgagtaggggtagcgnagcggcggcggcggcgaaggggaagaagaagggagtgncnttcacgatcgactgtgggaagccggtggaggataagatcatggacatcgcctcgctggaaaagttcctccaggagcgtatcaaagtcggcggcaaggccggtgctctcggagactccgtcactgtctctcgcgagaagagcaaaatcaccgtcacctccgattctgacttctctaagcgatatctgaagtatctgacaaagaaatacctgaagaaacataacgtgcgtgattggcttcgagtcattgcatcaaacaaggagcgtaatgtttacgagttgcgctacttcaacattgctgagaacgagggcgaagacgaagactaaatgcttcctttcaaagcctgtatttcctctctccactaaatttgatttgtttcgtttagagggcatgtgtacttcagaacttgctattttggattttgtttttgttattgcaaaatttggtttctgcattgctttccttcatacgagtttcctgtttttgtcatgtttggctgaaatatttccagtttatttgcttgttattactatgggaattg

SEQ ID NO: 4692 - DNA, 827 bp, Cucumis melo
aaaacacaaactcaaaaccctaaattcagcgccgattcttcaatacatctctgcaggaagttagggcaaagcagaagcaaaaatgagccgtggagcagccgcatccggtggccccaaggggaagaagaagggtgtgaccttcgttatcgattgcgcgaagccagttgaggacaagatcatggacatcgcctcattggagaaatttcttctcgagaggatcaaggtcggcggtaaagctggagcacttggtgactctgttactgtcactagggacaagaacaagatcaccgtcaactccgacagcaatttctccaagaggtatctcaaatatttgactaagaagtatttgaagaaacacaatgttagagattggcttcgggttattgcttcgaacaaggaccgcaatgtctatgaattgagatacttcaacattgccgagaatgagggtgaggaagaagactgaagttgaagtctttatattttggaagcattgtttgcagtaggattagctatatttccataccttatctcgaagcgttttccatatagaacatatagcaaggggattgcctgagttctgagatgatgcaactcttgtttatttctgaagttttaatatctataagttttgctctcgtagctctcttcttttgcttgatttgaagataattttcttactatgagagtattggtcagtttgtactttgtttgaggaattggaattggcagttcttctgagaaagttgaaactgtctggtactgtttgcggaagagtttgcaaacctaatggtttacttcaatggaggacatcaaataaacttaaattc

SEQ ID NO: 4693 - DNA, 765 bp, Momordica charantia
ccttaaaataccaactcaaaaccctaactccagcgccgttgttcgatatctctctctgcagaagtttaggtcaagaaattgctgcccgagaagcgaaaatgagccgtggagcagcagcatccggtggcccaaaggggaagaagaagggcgtgaccttcgttattgattgtgcgaagcctgtggaggacaagatcatggacatcgcctcattggagaagtttcttctcgagaggatcaaggttggcggcaaagctggggcactcggtgactcggttaccgtcactcgggacaagaacaagatcacggtcaactccgatagcaacttctccaagaggtatcttaaatacttgactaagaagtacttgaagaaacacaatgtcagagattggcttcgggtaattgcttcgaacaaagatcgcaatgtctatgaattgagatactttaacattgctgagaacgagggcgaggaagaggattgaggttgaagcatcgtttcagtaggattagttgtagtggcgggcgttctcatattaaggttgttgaaattatatttccataccttgtcttgaagctttcatatagatctgtaaggattatttgagttatgagatgatggaactcttgtttctttctgaagtttcaatatctatagattttgttcacttatagctcccttgtgttggttggtttgaagatgttttttcttgctcggagtatactgttcttgtcttgcaaaaatgatgtatgtgtacttggttcattaag

SEQ ID NO: 4694 - DNA, 643 bp, Carthamus tinctorius
caattctcgcattccattgcacttcgccgtcttcgaatctagaggtagagaaggagccaagatgagtcgtggagctggaggtgctggagccaagggggggaagaagaagggagcgacgtttgtgatcgattgcgggaagcctgttgaggataagatcatggaaatcgcatcgcttgagaagttccttcaggagaggatcaaggttggcggtaaggctggtaatctcggagactctgttacgatctcgcgtgagaagaacaagatttccgtcacttccgatagcaacttctccaaaaggtatttgaaatacctaacaaagaaatacttgaagaaacacaatgtgagagattggctccgagtgatcgcttctaacaaagaccgtaacgtttacgagttacgttacttcaacatcgccgagaacgagggcgaagaggaagactaaggagatggtcgggctcgtttatgttttgtttttgtttttgacctggtttggcaatttagacatgttatatcagccttttctgaactgtattgtagtagagttttgagtttaggtgcttttgcactcatcttcatttcacttccaagtgttgattttgtttcgagatcttgaattttctcgattttcatttgcatccaaaaa

SEQ ID NO: 4695 - DNA, 572 bp, Euphorbia peplus
gaaaaatgagccgagcagccggtgccggaggtcccaaggggaagaagaagggagcaactttcaccattgattgcacgaagccggtggaggacaagatcatggacatcgcttcgctcgagaagttcctccaggagcgtatcaaagtcggcggtaaagctggagctctcggtgattccgtcaccgtttcccgcgagaagtccaagatcaccgtcacttctgactccaacttctccaaacgatatctcaagtatttgactaagaaatacttgaagaagcacaatgtgagggattggcttcgtgtgattgctgctaacaaggacaggaatgtgtatgagctgagatacttcaacattgctgagaatgaaggagaggatgaagagtaaattctttcagtcctttttcaatgtgtcatttctcaagtttctttttgtttcatagaaacttattagggtctttgttatgttttagatatggatttcaatgaaattttgttaaaaattctatcatcagatgtgtttggatttttgctatgattgagatatttattatggaatcaagaatgcttttatatc

SEQ ID NO: 4696 - DNA, 595 bp, Fagopyrum esculentum
ctgccgtcgtcttttccttctctcatctcccaacatttgccggcaaatcagacggagaaaatgactagaggagcggctgccggagttgctaagggcaagaagaagggagtatccttcacactcgactgcaccaagccagtagaagataagattatggacatcgcgtcactcgaaaagttccttcaggaaaggatcaaggtcggtggtaaagccggcgctctcggcgactctgtcaccgtctctcgcgagaagaacaagatcaccgtcacctccgacagcaacttctctaagcgttacttgaagtacttaaccaagaagtacttgaagaagcacaatgttcgtgattggcttcgtgtgattgcttctaacaaggatagaagcatatacgagctgagatacttcaacattgctgagaatgaggcagaagaagaagattaaaatcagtaatcttaggagttgttcgtttctttcttggtgttttctaaggattttatcaactttttgtattctaagttcaacctttgccagttcatccttttcgaacttctcatctttttgacaatggatttttttttgggaatgattgtgattcatt

SEQ ID NO: 4697 - DNA, 672 bp, Fagopyrum esculentum
ttttcattctctcttctcccaccatttctggataggaaggtcgacaaatcagacggaggaaaatgagcagaggatctgctgccggcgttgccaaaggcaagaagaagggagtatccttcacactcgactgcactaagccagtggaagataagattatggacatcgcttcactcgaaaagttccttcaggagaggatcaaggtcggtggtaaggctggcgctctcggcgattctgtcaccatctctcgcgagaagaacaagatcaccgtcacctccgacagcaacttctctaagcgttatttaaagtacttaacaaagaagtacttgaagaagcacaatgttcgtgattggcttcgtgtgattgcttctaacaaggatagaagcatatacgaactgagatacttcaacattgctgagaatgaggctgaagaagaagattaaaatcagtttttgtattccaagttcaagattatccatttcatctttttggaacttcccatctttttggcattggattttttttgcatggttgtgatttatattagacgattagtatttgagaattatagccattgcaaacctcaaaatctcaagttagccacactggattacacatataaattcattgagtatattggatattctgatttagacatgacgaagtcttaaagct

SEQ ID NO: 4698 - DNA, 610 bp, Silene vulgaris
atttcctgccgtcataccaaccctaatttcttcaatcagatttgcaggatcaatcaaaaagggggaaaaatgagcaaagcagcagcaacaaagggtggtaagaagaaaggtgcaacatttacaattgattgcactaaaccagttgaagataagatcatggatattgcttcacttgagaaatttcttcaagaacgtattaaagttggtggtaaagctggtaatttgggtgattctgttactgtttctcgtgaaaagaacaagattactgtcacttctgattccaatttctccaaaaggtacttgaagtacttgaccaagaagtatttgaagaagcacaatgtgagggattggcttcgtgtcatagctgccaacaaggaccgaaatgtgtatgagctaaggtacttcaacattgccgagaatgaggcagaggaagaagattagatgtttagaatcaacgtctgtttcagatctttcaatatgtgttttacttgagacatcttgcttttgtttcattttagattgtatgagttcgacttttattcactggcaaaatattcgtaatagtattttttgtggactagttctgtgccagtcgatcacgcattgttgt

SEQ ID NO: 4699 - DNA, 440 bp, Tripterygium wilfordii
accggtaatcatttttctttactcaagagaaatgagcaaaggaagtggcggtccggctaaggccgggaagaagaagggagcgaccttcacgatcgactgtggtaagccggtggaggacaagatcatggacatcgcctcgctcgagaaatttctccaggagcgcatcaaggttggcggcaaagcgggcgcccttggcgactccatcaccatctctcgtgagaagtcgaagatcaccgtcacttctgattccaacttctccaagcggtatctgaagtacttgacaaaaaaagtacttgaagaagcataacgtgagggattggcttcgcgtgattgcatctaacaaggaccgcaatgtttacgaactcaggtacttcaacattgctgagaatgaaggcgaggaggaagattaaacaatctaattcagtattgattactcttga

SEQ ID NO: 4700 - DNA, 679 bp, Medicago truncatula
gcgttttatatgagcgtataaactggaaccaaacctataccctaatctcttctgccacttgtgctgtgttccgttctcttgtggctaaagagattcattcatagaagacaaaatgggtcgagtagatgcagctggttcaaagggaaagaagaagggagttataacattcaccattgactgtgccaagcccgttgaagacaagatcatggacatcgcttctctcgaaaagttccttcaagagagaattaaggttggtggtaaacccggtgctcttggtgatgctgttactgtttcaagggaaaagagcaagattgctgttacttctgatagcaacttctccaaacggtatctcaagtatttgaccaaaaagtacttgaagaaacacaatgtaagggattggctcagagtgattgcttcaaacaaagatagaaatgtttatgagctgaggtacttcaacattgctgagaatgaaggagaggaagaagactgagtgtctgttcagattattcatttcagaactttgttaaaccattttctcatgttagcttctcttttggctatggaatgctcgagacatgttgctttggttgcattagctgcaatttaacaattttgttcaattaagaattgtggtaacacttttgttggaatggaaattgagtttattgttatgcattca

SEQ ID NO: 4701 - DNA, 546 bp, Avena sativa
atctcttcagaggttcctagaagcaaaaatgggtcgtgtagatgcagctggttccaagggtaagaagaagggatctacaaccttcaccatcgactgcgctaagcccgtagaggacaagatcatggacattgcttctctcgagaagtttcttcaagagaggattaaggtcggtggtaaagctggtgctctgggtgatgctgttactgtttcacgcgagaagagcaagatcactgttacttctgatagtaacttctccaaaaggtatctcaagtacttgaccaaaaaatatttaaaaaagcacaatgtgcgggactggctccgtgtcatttcttctaacaaagatagaaatgtttatgagttgcgctatttcaacatagcggagaatgaaggagaggaagaagattaattgtgttttatttattttagaatcatgttaaacccttgcttgtgatatcttctcttttgcatgattattgtttaagacatgttgctttggtttcattagttgcaagtaaacaattttgtttaattaagagttgtgatgcc

SEQ ID NO: 4702 - DNA, 594 bp, Euphorbia esula
  misc_feature (14)..(14): n is a, c, g, or t
accctagcttctanaatttgaagaaaaatgagccgagcagccggtgccggaggtcccaaggggaagaagaagggagcaactttcaccattgattgcacgaagccggtggaggacaagatcatggacatcgcttcgctcgagaagttcctccaggagcgtatcaaagtcggcggtaaagctggagctctcggtgattccgtcaccgtttcccgcgagaagtccaagatcaccgtcacttctgactccaacttctccaaacgatatctcaagtatttgactaagaaatacttgaagaagcacaatgtgagggattggcttcgtgtgattgctgctaacaaggacaggaatgtgtatgagctgagatacttcaacattgctgagaatgaaggagaggatgaagagtaaattctttcagtcctttttcaatgtgtcatttctcaagtttctttttgtttcatagaaacttattagggtctttgttatgttttagatatggatttcaatgaaattttgttaaaaattctatcatcagatgtgtttggatttttgctatgattgagatatttattatggaatcaagaatgcttttatatc

SEQ ID NO: 4703 - DNA, 676 bp, Euonymus alatus
actcgtccttctctcagattagccgctcgtacgaaccgaacgtctcagcctcttcaatctctgcagcaattaacggataatcgaagatgagtcgaggaagtgcaacgggtgccaaggggaagaagaaggaagcgacgtttacgatcgactgcgggaagcctgtagaggataagatcatggacattgcatcactggagaaatttttgaaggagaggatcaaggtcggaggcaaggctggtgcacttggtgattccatcaccataaccagggagaagtctaagatcaccgttacctctaacagcaacttctccaagcggtatcttaagtatttgacaaaaaagtacttaaagaagcataatgtgagggattggctccgggtgattgcatccaacaaagatcgcaatgtttatgagctgaggtacttcaacattgctgaaaacgaggccgaggaagaagattgaaacaatttctttatcaaaggaccttgttggctagtcagaagctttttacaattttgtttatttgcctagacattcagtattgctgttgttggatttggaagcttgtgagtctttaaattttaacaaggatgattgggtttgataagcacctcaattttggcttacataaaccctataaaaaagttatgtcgatttgttatgagattctaagagca

SEQ ID NO: 4704 - DNA, 463 bp, Sarracenia psittacina
ggggatccagccagagtaagaggcgcgaagatgagtcgtggggcgacggctggactgaagggcaagaagaagggagcgacgttcgtgattgactgtggaaagccggtggaggacaagatcatggacatcgccacgttggaaaagtttctacaggagagaatcaaggtcggcggcaaggccggtgctcttggcgactccgtcaccgtaactcgcgacaagaacaagattaccgtcacctccgacagcaatttctccaagcggtatcttaaatacttgacaaaaaagtacttgaagaagtacaatgtgagggattggctccgggtaattgcttccaacaaagaccggaatgtctacgagttgcgatacttcaacattgcagagaatgaaggggaagatgaagactgaagatacagtggccttttctcatattttatctgttctgatttgctctgaatgttgtagg

SEQ ID NO: 4705 - DNA, 665 bp, Sarracenia psittacina
ggggaacgcacagcggctcctcttactatctctaccactcccttttcgatttcatatccagccagagtagaggcgcgaagatgagtcgtggggcggcggctggaccgaagggcaagaagaagggagcgacgttcgtgattgactgtggaaagccggtggaggacaagatcatggacatcgccacgttggaaaagtttctacaggagagaatcaaggtaggcggcaaggctggtgctcttggcgactccgtcaccgtaactcgcgacaagaacaagattaccgtcacctccgacagcaatttctccaagcggtatcttaaatacttggcaaaaaagtacttgaagaagtacaatgtgagggattggctccgggtaattgcttccaacaaagaccggaatgtctacgagctgcgatacttcaacattgcagagaatgaaggggaagatgaagactgaagatacagtggccttttctcatattttatctgttctgatttgctctgaatgttgtagggcctctcttgtttcttttaagctgttgaacttggcaacccattgggttggcgatctagtttaccttagataatgaatgctctttggcaaattttgttattaaggttgtttttgtggctcactagcagacatgcaatatatgttacataagaa

SEQ ID NO: 4706 - DNA, 614 bp, Tripterygium wilfordii
tagggagggcacaatgagtcgaggtactgcaacgggagccaaagggaagaagaagggagcgacgttcgtgattgactgcgcgaagccggtagaggataagattatggacattgcctcattggaaaagtttcttcaggagaggattaaggtcggcggcaaggctggtgccctcggtgacgccattaccgtgacacgagagaagagtaagataacagttacctccagcagcgacttctctaagaggtatcttaagtacttgactaagaagtatttgaagaaacacaatgtgcgtgattggcttcgggtgatttcctccaacaaggataggaatgtttatgaattgcgttacttcaacatagctgagaacgaaggggaagaggaagagtagagacctagctctgtatcttcttatattatccatttgatttacttgttttaggcttctttatatactaaatcggtcagacgacagacttactgtggttgttttgtgatctttcataatacattatctgctgataacttaaaattgttctaatgttttaggggcaattggatatgatgcggtttcttctccttatgctcgcttatttggcttagtgatacttatagca

SEQ ID NO: 4707 - DNA, 690 bp, Persea americana
agcttcctcccatctccagccgcttcaaggaaggaaaggattgttgcaaaaatgagccgaggcagcgcagctggccccaaggggaagaagaaggcgtcgactttcacgatcgactgcgcgaagcccgtggaggataagatcatggacattgcatcgctcgagaagttcctgcaggagcggatcaaggtcggagggaaggccggcgccctcggagacgttgtctccatctcccgcgaaaagaataagatatccgtaacctccgacagcgccttctcgaagcggtatctgaagtacttaacaaagaagtacttaaagaagcacaatgtgcgtgattggctgcgagtgattgcatccaacaaagatcgcaatgtctacgagctgcgctatttcaacattgcagagaatgagggagaagaggaagactgattggatcatgcattttcatttccctctgcatttaaattttagttcagcactcttttgttccagtgaagtttcagaactcttctaggccaagatgtgtgattcttaatcggaacatgtcattttccatcatagataattgaatattgaattatattttcatgtgagattaggttgaaaatggaattttgtagaggatttgcaagcacctcataagacttaaaacttgcacatgtgggttggtagtgcgaatgcttcggatatgct

SEQ ID NO: 4708 - DNA, 731 bp, Castanea mollissima
ctcgtattccattctcatctctcacgccgctcagctccaagctctgtaacttgaggatagtcgaagatgagtcgagggagtgcaccagttcccaaggggaagaagaagggagtctcgtttactgttgactgtacgaagccagtggaggacaagatcatggacattgcatccttggagaagtttctccaggagaggatcaaggttggaggcaaggctggtgctcttggtgacactgtcactgtaacccgggagaagagcaagatcactgttacttctgacagtaacttctctaagaggtatctgaagtacttgacaaaaaagtacctgaagaaacacaatgtgcgtgattggctccgcgtgatttcttcaaacaaagatagaaatgtgtatgaacttaggtacttcaacattgctgagaatgaaggggaggaagaagattgaaaatctgaattggcttagtcatttaagacttttgtttaccttatattcagggatctttctttctgttttagcgttgcctttggggtgctgctttttgatgaaactgtttgacaattttgttaattaaattagagattttacaatattcctattgttggattggtaatatagaaagtctgtcattgtcgaatccagctttgttgttttgatgcattgtattggagttgcaagcaacttttatgaggttacaaattgtgcttaattctttttttgcattcttcaccatttaa

SEQ ID NO: 4709 - DNA, 536 bp, Gerbera hybrid cultivar
attcttcaaacctgtagttgcagagagaagagaagatgagtcgaggagcaggagcgaaggggggaaagaagaagggagccacgttcgtaattgattgtgggaagcctgttgaggacaagatcatggaaatcgcatcactcgagaagtttcttcaggagagaatcaaagtcggcgggaaggctggtaatctcggagattccgttaccatttcccgtgaaaagaacaagatctccgtcacctccgacagcaacttctccaaaaggtatctgaaatacctaacgaagaagtacttgaagaaacacaatgttagagactggcttcgtgtgattgcttctaacaaagaccgcaatgtttatgagctccgatacttcaacattgctgagaatgaaggcgaagaggaagattaatcagagactgggttgaaatatagttttatattcatcacttttttgacttataatatcatttttctttttcatccgaccatttgagattggtttgtagtaggtttccctgcatttgcgaatttcttttac

SEQ ID NO: 4710 - DNA, 563 bp, Jatropha curcas
caaggggaagaagaaaggagcaactttcactattgattgcgcgaagccggtggaggataagatcatggacattgcctctctcgaaaaaattcctccaggagcgcatcaaagtcggcggcaaagctggagctctcggtgattccgtcactgtcacccgtgaaaagtccaagatcactgtaacatccgactccaacttctccaaacgatatctcaagtacttgacaaagaaatacttgaagaagcacaatgtgagggattggcttcgagtcattgcttccaacaaggatcgtaatgtttatgagctgagatacttcaatattgctgagaatgaaggtgaagaggaagagtaaattgtatcagtttgtccttttcatgtcactattctcatttttttccctctcttcatagtaatctttcttactattgactttaattatgctttctttagtaagttttagaacttgaagatgatgatattttgttaaaagcctattcctagttatggttggatattaaccatattttgagatttttggttttggataaagaatgcttgccaaaac

SEQ ID NO: 4711 - DNA, 605 bp, Tropaeolum majus
cggccgggggtatatcttcaaaactacaaaggccgcttggctctacactcagtttctaggaacttcgttatacagaagataatccaaaatgagtcgaagcaatgttgctggatcaaagggaaagaagaagggagtcaccttcaccatagattgtgcaaagccagttgaagacaagattatggacattgcttctcttgagaagtttcttcaggagaggatcaaggttggaggcaaagccggtgctcttggcgacagtgtcactattacccgtgaaaagaccaagattgttgtcacttccgacagtacattctccaaaaggtatctcaagtacttgaccaaaaagtacttgaagaagcacaatgttcgtgattggcttcgagtgattgcggccaacaaggatcgcaatgtttacgagctaaggtactttaacattgctgagaatgatgctgaggaagaagactaaaagcattgacccatttatcttaagagattttggactattttgcctattttaaaattaatgttctttgaatttagattgtgaaatgctatctttgtttggaaggagataaagtagttttgtcattttaaagaaaaacctcgtt

SEQ ID NO: 4712 - DNA, 650 bp, Populus trichocarpa
aaaaccctagtctctccttctcttcttctcacagacgccgcctcttctcttttcctccacagtcgccaccgattgatcaaagatgagtaaggcaacagcatcaggagccaaagggaagaagaaaggtgtaaccttcacggtagattgtacaaagccagtggaggacaagattatggacattgcgtcattggagaagtttcttcaagagaggatcaaagttggaggcaaagctggtgctctcggtgacaccgttactgttacacgtgaaaagagcaagattactgtcacttctgacagtaacttctccaaaaggtatctgaagtacttgacaaagaagtatttgaagaaacacaatgttagggattggctacgagtgatttcatccaacaaagatcgcaatgtttatgagttgagatacttcaacattgctgagaacgagggagaggaagaagactgaagtttaggtcttatagcctcgattatgttgctgcctagattgaaccctcttcatctttttttgtttgatcaagtgatggcacatttactgagttaatgtttttataattttgttattgagttggtgcttttgcaatattactactgccaaatttagaacctacctgccattaagaaaatctgggttttgctca

SEQ ID NO: 4713 - DNA, 652 bp, Musa acuminata
aagaccttcgtcttggaagcggcggcattacaggggcaggtgagaggatgagtcgcggtggggcagcggcggctgccgcgaagggcgggaagaagaagggttccaccttcgtcatcgattgcgcgaagccggtggaggacaagatcatggacatcgcctccctggagaagttcctccaggagaggatcaaggtggcaggcggcaaggccggcgcactcggcgacgccgtaaccgtcacccgcgacaagagcaagatcaccgtcacctccgagggtcccttctcgaagcggtacttaaagtacctgacaaaaaagtacttgaagaagcacaatgtgcgggattggctgcgagtgattgcttctaacaaagatcgcaatgtttacgagcttcgatacttcaacattgctgagaacgagggagaagaggaagagtgatgatggtgtgcccttattatccctttttgttgccttgtttggttaattgatgataaattagaagttttctcctgttgtggtttgttatgttcaaacacggtttttactttttatcatttcaatttcagaaggtttctcccttattcggtagtctatttatttagcagtaaacaatttgatggtttccttgtgatgcttaatcaataattattcttctt

SEQ ID NO: 4714 - DNA, 740 bp, Quercus alba
gcagagtacatgggagagacacatagcaagggcttgcgcagtgggtttagtccttagggaagcgaaaatgagccgacgggcagcgggaacgggagcggcggggctgaaggggaagaagaagggggccacattcgtgatcgactgcgcaaagccggtggaggataagatcatggacatcgcctccctcgagaagttcctccaggaacgcatcaaggtcggcggcaaggccggcgctctcggcgactccgtcatcgtctcccgcgagaagaacaagatctccgtcacctccgattccaacttctccaaacgttatcttaaatacttgaccaagaagtacttgaagaagcacaacgtgagggattggcttcgggtgatttcttccaacaaggacaggaatatttatgaattgagatatttcaacattgccgagaatgagggcgaggaggaagattgaaattatagtattctatgtcgaggcatcatccattagaggactttttatttttatttttttgaggaacattcattagaggacttagttgttctagagcgtctttttatattttccagcattgttttgatctatccactagacgggattgttttctgattttcaaagtttatttcctcttaaaaattttgtactgttaattctggttatcacattattagttgtggttgatgcaatacatgtttctctctctggagttgtattgtggtatgcctgatggtttttaata

SEQ ID NO: 4715 - DNA, 665 bp, Mimulus guttatus
gttgtttttcactctctctctctctctcttcacacagtcaagcggcggcgaagatgagtaaaggaggagcagcggcggcgggagccaagggcgggaagaagaaggtcgcgacatacgtgatcgattgcgctaaacctgtggaggataagattatggagattgcttctctcgagaagttcctgcaggagagaatcaaggtcggaggtaaagccggcgctcttggcgattccgttaccgttacccgtgagaagaacaagatcaccgttaccgctgacgccactttctccaagaggtacctcaagtatttgacaaagaaatacttgaagaagcacaacgttagggattggcttcgggtgattgcttccaacaaagacaggaacgtttacgaacttcgctacttcaacattgctgagcaagagggtgaggaagaagactagaagacttgtaactctccacccttttttgctacaaacgactttttcgttcgatctatttatgttgtcggttttgttcaattttctgaatccttagtttatcgagtttgcatttttcgtttatttgatgattctctatgattttgtttttttatatgattaattcagtgactacagatatctctcatttttaatatttgggctatattgtttttctggtttcttagttta

SEQ ID NO: 4716 - DNA, 787 bp, Catharanthus roseus
aataccctaaccctagttcttattgttatcccagcacagcaaggagcacatgttctactagttcgagtcttcctcttcatacgcagcttcaatcagagtcggccgccgagtgtagacgagaaaatgagtcgaggcgccggagcagctggagccaagggtggtaagaagaagggagcgaccttcgtgatcgattgtgcaaaaccagtggaagacaagattatggaaatcacgtctttggagaagttccttcaagagagaatcaaagtgggaggtaaggctggtgctctcggtgaatccgtcacggttactcgtgacaagaacaagatcaccgtcacctccgattccgctttttccaaaaggtatctcaagtacctaacaaagaaatacttgaagaagcacaatgtcagagattggcttcgtgtgatttcatcaaacaaagacagaaatgtttatgaactgcggtactttaacattgccgagggtgaaggcgaggaagaagattaaagcaacaatggatgtaaccttaatgcttctgctagttttggcttaagtttttgaaacatcattttaactttttcaatctctatcaaaccctcttggcgttatatttgtagttttgtccatcttatgatttttgtttacttgcgaaaggaccatgtagaatagtatatccttgttcttcttgaatcaagtatggagagagtattgattattgcatctttgttgtggtttgtttctagttcgtgatatttggatctgttgcctttagaatctgctccaatagctc

SEQ ID NO: 4717 - DNA, 639 bp, Cirsium arvense
ccgggggggtaccaaaatcatcatcgcattccaatcgcacttcgccgtcttcgaatctacaggttatagaagccaagatgagtcgtggagcaggaggtgctggagccaagggcgggaagaagaaggcagcgacgtttgtgatcgattgtggaaagcctgttgaagataagatcatggagatcgcatcgcttgagaagtttcttcaggagagaatcaaggttggaggtaaggctggtaatctcggtgactctgttacgatttctcgtgagaagaacaagatatcagtcacttccgatagcaacttttccaaaaggtatttgaaatacctaacaaagaaatacttgaagaaacacaatgtgagagattggcttcgagtgatcgcttctaacaaagaccgtaacgtttatgagctacgttacttcaacatcgccgagaacgagggagaagaggaagactaagcagtggtcgagctcgtttatgttttgtttttgtttttgacctggtttggctatttagacatgttatatcagtctttcctgaactgtattgtagtagagttttgagtttaggtgcttttgcactgatcttcagtttacttccaagtgatgattttcatacaagatctttgaattttctcga

SEQ ID NO: 4718 - DNA, 578 bp, Cirsium arvense
ttcccctatccagtttcagctcgccgtcttcgaaaaccaaagagagattcccacagaagaagcgaagatgagtcgaggagcaggaggtgccggcgccaagggcggaaagaagaagtcagcgacttttgtgattgattgtggaaagcctgttgaggataagatcatggagatcgcatcacttgagaagtttcttactgagagaatcaaggttggcggtaaagctggtaatctcggagattccgttactattactcgtgaaaagaacaagatctccgttacctctgatagcaacttctcgaaaaggtacttgaagtatttgacaaagaaatacttgaagaagcacaatgtgagggattggcttcgtgtaattgcttcaaacaaagaccgcaatgtttatgagctacggtacttcaacattgctgagaatgagggtgaggaagaagattaagccgggttcgatcttattttatgtagttttttggcatggttttggtttcttggacttgttacatcagtttcttttttacttcagactttgaaatattgttttgcagtaaaatttctgggtcaatgtgatt

SEQ ID NO: 4719 - DNA, 658 bp, Cucurbita pepo
aggaagttagggcgccaagctgcacagagcagaagcaaaaatgagccgtggagcagccgcatccggtggcccgaaggggaagaagaagggcgtgaccttcgttatcgattgtgcgaagccagtcgaggacaagattatggacatcgcttccttggagaagtttcttctcgagaggatcaaggtcggcggcaaagctggggcacttggtgacgctgtcactgttacacgggacaaaaacaagatcaccgtcaactccgatagcaacttctctaagaggtatcttaagtacttgactaagaagtatttgaagaagcacaacgttagagattggcttcgggttattgcttcgaacaaggaccgcaacgtctatgaattgaggtacttcaacattgccgagaacgagggcgaggaagaagactgaggctcaagtcttacaaattggaagcattgtttgcagtaggactagttgtagcggcctttctcattttgaaggttgttgaaattatatttccatacctcgccttgaattgagttatattatgagatgatgcaactcttgtttaattctgaagtcttaatatctataaattttgatcacgtagttcccttctgtcggttggttgaagatatactctttctttgtcttacttatttaacg

SEQ ID NO: 4720 - DNA, 552 bp, Flaveria ramosissima
tctagagtatcaagatgagtcgcggtgcaggagctgctggagccaagggcggaaagaagaagcaatcgacgttcgtgatcgattgcgggaagcctgttgaagataagatcatggaaatcgcatcgctcgagaagtttcttcaggagaggatcaaagtcggtggaaaagctggtaatctcggagactctgttacgattacgcgtgagaagaacaagatctctgttaccgctgatagcaatttctccaaaaggtatctgaagtacctaacaaagaaatacttgaagaaacacaatgtgagagactggcttcgagtgattgcttcaaacaaagaccgcaatgtgtacgagctacgttacttcaacattgcagagaatgagggtgaagaagaagactgaacctacagttgatcttgttttgtgtttgttcttgaacctggtttttctttttaattatgttatatcagaatttttgttcatgagtctatgcagaactgtattgtagcagagctttgaagtttgagggctgttgcactgatcttgatttcacatccat

SEQ ID NO: 4721 - DNA, 665 bp, Flaveria ramosissima
agttctcgcagtctttgaatctagagtatcaagatgagtcgcggtgcaggagctgctggagccaagggcggaaagaagaagcaatcgacgttcgtgatcgattgcgggaagcctgttgaagataagatcatggaaattgcatcgctcgagaagtttcttcaggagaggatcaaagtcggtggaaaagctggtaatctcggagactctgttacgattacgcgtgagaagaacaagatctctgttaccgctgatagcaatttctccaaaaggtatctgaagtacctaacaaagaaatacttaaagaaacacaatgtgagagactggcttcgagtgattgcttcaaacaaagaccgcaatgtgtatgagctacgttacttcaacattgcagagaatgagggtgaagaagaagactgaacctacagttgatcttgttttgtgtttgttcttgaacctggtttttctttttaattatgttatatcagaattttgttcatgagtctatgcagaactgtattgtagcagagtttgaaagtttgagtgctattgcactgatcttgatttcacatccatggggtttgcatctttacactattgtttctgtcttgcattagatatgagcataataaaaaaactaaaattttattgcgactatgatgaaaaatact

SEQ ID NO: 4722 - DNA, 700 bp, Catharanthus roseus
agtggatccaaagaattcggcacgaggcttcatacgcagcttcaatcagagtcggccgccgagtgtagacgagaaaatgagtcgaggcgccggagcagctggagccaagggtggtaagaagaagggagcgaccttcgtgatcgattgtgcaaaaccagtggaagacaagattatggaaatcacgtctttggagaagttccttcaagagagaatcaaagtgggaggtaaggctggtgctctcggtgaatccgtcacggttactcgtgacaagaacaagatcaccgtcacctccgattccgctttttccaaaaggtatctcaagtacctaacaaagaaatacttgaagaagcacaatgtcagagattggcttcgtgtgatttcatcaaacaaagacagaaatgtttatgaactgcggtactttaacattgccgagggtgaaggcgaggaagaagattaaagcaacaatggatgtaaccttaatgcttctgctagttttggcttaagtttttgaaacatcattttaactttttcaatctctatcaaaccctcttggcgttatatttgtagttttgtccatcttatgatttttgtttacttgcgaaaggaccatgtagaatagtatatccttgttcttcttgaatcaagtatggagagagtattgattattgcatctttgttgtggtttgtttctagttcgtga

SEQ ID NO: 4723 - DNA, 644 bp, Centaurea maculosa
  misc_feature (9)..(9): n is a, c, g, or t
  misc_feature (67)..(67): n is a, c, g, or t
  misc_feature (143)..(143): n is a, c, g, or t
  misc_feature (278)..(278): n is a, c, g, or t
  misc_feature (287)..(287): n is a, c, g, or t
  misc_feature (531)..(531): n is a, c, g, or t
gcgggggtncaaatatcatcgcattccatcgcacttcgccgtcttcgaatctacaggttatagaagncaagatgagtcgtggagcaggaggtgctggagccaagggcgggaagaagaaggcagcgacgtttgtgatcgattgnggaaagcctgttgaagataagatcatggagatcgcatcgcttgagaagtttcttcaggagagaatcaaggttggaggtaaggctggtaatctcggtgactctgttacgatttctcgtgagaagaacaagatatcngtcacttcngatagcaacttttccaaaaggtatttgaaatacctaacaaagaaatacttgaagaaacacaatgtgagagattggcttcgagtgatcgcttctaacaaagaccgtaacgtttatgagctacgttacttcaacatcgccgagaacgagggagaagaggaagactaagcagatggtcgagctcgtttatgttttgtttttgtttttgacctggtttggctatttagacatgttatatcagtctttnctgaactgtattgtagtagagttttgagtttaggtgcttttgcactgatcttcagtttacttccaagtgatgattttcatacaagatctttgaattttcttgattttcatttg

SEQ ID NO: 4724 - DNA, 648 bp, Cichorium intybus
catcttccattgataggttgcagctcgccgtcttcgaagcacagccaatcttctatcattcccggcgtgcattttgtgggtatataaaaagaagcaaggatgagtcgaggagcaggaggtgccggagcaaaagggggtaagaagaagtcagcgacttttgtaattgattgtgggaagcctgttgaggataagatcatggagattgcttcgcttgagaagtttcttcaggagagaatcaaggtcggtggtaaagctggcaatctcggggattccgttactatttctcgtgaaaagaacaagatctccgtcacctcggacagcaatttctccaaaaggtacttgaaatacttgacaaagaagtacttgaagaagcacaatgtgagggactggcttcgcgtaattgcttccaacaaagaccgcaatgtgtatgagctaagatacttcaacattgctgagaacgagggtgaggaggaagactgagaagtgtgtcctctttttgacttggtttttttggaatggattttggttttggcttcttagacttatattatatcagtttcttttgtcttcagactttgaaatattgttttgcagtaaaattgtggctttatgtgattttgttagtttctgttgttgaggtaaaacaac

SEQ ID NO: 4725 - DNA, 626 bp, Cichorium intybus
tgcttggcgggggacgtaccaggttctgttttgcagctcgcattcttcaacccatagttgtagagagaaagagagaagcgacgatgagtcgaggagcgggaagtgccggagcaaaggggggaaagaagaaggcggccacgttcgttattgattgcgggaaacccgtcgaggacaagatcatggaaattgcatcgttggagaagttccttcaggagagaatcaaagtcggcggcaaggctggtaatcttggagactccgttaccatttcccgtgaaaagaacaagatctccgtcacttccgacagcaacttctcgaaaaggtatctgaaatacttgacaaagaagtacttgaagaagcacaatgtgagggactggctgcgtgtgattgcttcaaacaaagaccgcaatgtttatgagctgcgctacttcaacattgctgagaacgagggtgaggaagaagattgatccaatgctgtttcttggtatcattaaaccatttcgtatcgtatttgtttgcaagtagtagagttgtgagtttaggtgcctttgcaaatctgttttaacaaatttatcatgggaaatattttacattttttttcttgaattgcaattattatgggtaacaaa

SEQ ID NO: 4726 - DNA, 629 bp, Triphysaria pusilla
atctgatttgtgccccttttggctctctctaggcaaacctcacacagtcggtcgtcgttccgaaatctgtaggagctgcggatccataaaaaggaaacgaaaatgagcaaaggcgttgcagctggggcagccaagggcgggaagaagaagggatcgacattcgtgatcgattgcgcgaagcccgtggaggataagatcatggatattgcttcgctagagaaatttttgcaggaacgaatcaaggtcggcggcaaagccggcgctctcggcgattctgttaccgtcacccgggaaaagaacaaaatcactgtcaacgctgatgctgccttctccaaaaggtacctaaagtatttgacaaagaaatacttgaagaagcacaatgtgagagattggcttagagtgattgcttccaacaaagaaaggaatgtgtatgaactccgttacttcaacattgccgagcaagagggagaagaggaagactaaatctacacattgttgcgcattttatcctcatttgcattttcagaacaattttttgggatctatttatgttgtttattttgtcctctttaaatttcatagacctcctctgtatgcaagctcaaattttcttgaatttagctactcta

SEQ ID NO: 4727 - DNA, 573 bp, Euphorbia peplus
ggcgctgccaaaccctaatttccacagatttcgcaggaaaaatgagccgagcagccggtgccggaggtcccaagggcaagaagaagggagccaccttcaccattgattgcacgaagccggtggatgacaagatcatggacatcgcttccctcgagaagttccttcaggagcgtatcaaagtcggcggcaaagctggagctctcggcgattccgttacggtttcccgtgagaagtctaagattaccgttacttctgactctaacttctccaaacgatacttgaagtatttaacaaagaagtacttgaagaagcacaatgtgagggattggcttcgtgtgattgctgctaacaaggacaggaatgtttacgagctgagatacttcaacattgctgagaatgaaggagaggatgaagagtaaattctttcagtccttctcaatgtgtcatttcttgagtttctttttgtttcatagagacgtattaggttctttgttatgtcctagatatggaagacaggaaattttgttaaaattttatcatcagatatgtttgaacttttgctatgattgagat

SEQ ID NO: 4728 - DNA, 753 bp, Lippia dulcis
tttttcattctctccacatacttcacacagcgccggcggcggatttccgaaccgaaaaaacagaaaagatgagtaaaggcgcggcggcggctgccaaaggcgggaagaagaagggggcaagcttcgtgatcgattgctcgaagccggtggaggataagattatggagatcacttctctcgagaagttcttacaggagagaattaaggtcggtggaaaagctggagctcttggtgattctgttactgtaactcgtgagaagaacaaaatcaccatcaccgccgattccgctttctccaagagatacctgaagtatctgacaaagaaatacttgaagaagcacaacgtgagggattggcttcgtgtgattgcctccaacaaagacaggaatgtttatgagctgcgctacttcaatattgccgaacaagaaggagaggaagaggattaaacactttgttcacattgctgttgtgcgtcacagccactttttggatcaatttattttgctggttctgtttaccgtcttgaattttacggacgccctagtttgcatctttggtaattgtgaattttttttaatcaagcagcagtaaactgcttttcagtccatgcaatctttagagtattgtgcgtggaacatattaattttctgatatcgttcttatagaggctctagttgtttttgatttattaattaacataatatggagactttatttactaaaaaaagaaaaaagtaccgactgcgactctgt

SEQ ID NO: 4729 - DNA, 740 bp, Trigonella foenum-graecum
ctataccctaatttctgccactgccgtccattttttcattcattcatccgcaccgcgctgtgtcctctttcagtgttgctgaagagattcattcaaagaagaaaaaatgggtcgtgtagatgcagctggttccaagggaaagaagaagggagtgataacattcactattgactgtgccaagcccgttgaagacaagatcatggacattgcctctctcgaaaagtttcttcaagagaggattaaggttggtggtaaacccggtgctcttggtgatgctgttactgtttcgagggaaaagagcaagatcactgttacttctgatagcaacttctccaaaaggtatctcaagtacttgaccaaaaagtatttgaagaaacacaatgtacgtgactggctcagagtgattgcttctaacaaagaaagaaatgtttatgaactgaggtacttcaacattgctgagaatgaaggagaggaagaagattaagtgctgtgttcagtttattcattttagtaccttgttaaacccttttctcatgttagcttctcgtttggctaagtattgctcgagacatgttgctttggttgcattagatgcgatttaacaattttgtttaattaagagctgtgatgccgcttttgttggaatgaaaatagagttcatctgttatacaatcaagtaacacctttgatacaattcttgtggtaactttttcctgaatgtctagtattattttcacatt

SEQ ID NO: 4730 - DNA, 652 bp, Lactuca sativa
atcttcacattcataggttgcagctcgccgtcttcgaagcacgcacagccaatcttctatccttctctagggagatttagaaaaagaagcgaagatgagtcgagcaggaggtgccggagcaaaggggggaaagaagaagtcagcgacttttgtgattgattgtgggaagcctgtcgaggataagatcatggagatagcatcactcgagaagtttcttcaagagagaatcaaagtcggtggtaaagctggtaatctcggcgattccgttacgatttctcgtgagaagaacaagatctccgtcacatcagacagcaacttctccaaaaggtacctgaaatatttgacaaagaaatacttgaaaaagcacaatgtgagggactggctacgtgtgattgcctccaacaaggatcgtaacgtatatgagctaagatacttcaacattgctgagaacgagggtgaggaggaagactgagagattattttgttttttgtttttattgctatggattttggttttggcttcgtagacttattattatcatctcagtttctattttctttggattttgaaatattaatttgcacgacaagtgtggctccattcaatgtgcttttgctaattactcttgctgtgttaatctgattttgtgtt

SEQ ID NO: 4731 - DNA, 642 bp, Lactuca sativa
atcttccattcataggttgcagttcgccgtcttcgaagcacgcacagctaatcttctatccttctctagggagatttagaaaaagaagcgaagatgagccgagcaggaggtgccggagcaaaggggggcaagaagaagtcagcgacttttgtgattgattgtgggaagcctgtagaggataagatcatggagatagcctcactcgagaagtttcttcaagagagaatcaaagtcggtggtaaagctggtaatctaggtgattcagttactatttctcgtgagaagaacaagatctccgtcacgtcagacagcaacttctccaaaaggtatttgaagtatttgacaaagaaatacttgaagaagcacaatgtgagggactggcttcgtgtaattgcttccaacaaggaccgcaacgtatatgagctacgatacttcaacattgctgagaacgagggtgaggaagaagactaagcactttgtttcttctttttggcatatggcttcttagacttattattattatatcatcttctgttttctttgtattttgaaatattggtttgcagtagaattgtgcttttgctaattactcttgctgtggtaatctgattttgtgttatggtagtgttgattgtttatgga

SEQ ID NO: 4732 - DNA, 666 bp, Lactuca sativa
ccgtcgccttatagcaccaaactacacattcataggttgcagctcgccgtcttcgaagcacgcacagccaatcttctatccttctctagggagatttagaaaaagaagcgaagatgagtcgagcaggaggtgccggagcaaaggggggaaagaagaagtcagcgacttttgtgattgattgtgggaagcctgtagaggataagattatggagattgcctcactcgagaagttccttcaagaaagaatcaaagtcggtggtaaagctggtaatctcggtgattcagttacgatttctcgtgagaagaacaagatctccgtcacatcagacagcaacttctccaaaaggtacctgaaatatttgacgaagaaatacttgaagaagcacaatgtgagggactggctccgtgtgattgcttccaacaaggaccgtaacgtatatgagctaagatacttcaacattgctgagaacgagggtgaggaggaagactgagattgctttgttttatttttttgggcatggattttggttttggcttcttagacttattattattattattatcatctcagtttctattttctttggattttgaaatattaatctgcattagaagctatgtgcttttgctatttacactctctgtgttaatctgattttgtgttat

SEQ ID NO: 4733 - DNA, 666 bp, Lactuca sativa
ccgtcgccttatagcgcccatcttcacattcataggttgcagctcgccgtcttcgaagcacgcacagccaatcttctatccttctctagggagatttagaaaaagaagcgaagatgagtcgagcaggaggtgccggagcaaaggggggaaagaagaagtcagcaacttttgtgattgattgtgggaagcctgttgaggataagattatggaaatagcctcactcgagaagtttcttcaagagagaatcaaagtcggtggtaaagctggtaatctcggtgattcagttactatttctcgtgagaagaacaagatctccgtcacatcagacagcaacttctccaaaaggtacctgaagtatttgacaaaaaaatacttgaagaagcacaatgtgagggactggctccgcgtgattgcttccaacaaggaccgtaacgtatatgagctaagatacttcaacattgctgagaacgagggtgaggaggaagactgagattactttgttttttttttctggcatggattttgtttttggcttcttagacttattattatcatctcagtttctattgtctttggattttgaaatattaatttgcattagaagtgtggctacattctatgtgcttttgctagttacacttgctgtgttaatctgattttgtgtt

SEQ ID NO: 4734 - DNA, 1230 bp, Brassica napus
taaataagtttcataataaccagaaaccaaacatataattctgacattgcataataatcatagagctcaatctcaaaaccgtttcgaaaagaaaaaccaaaataaagaatctgagatcaacaaccacagaaactaacaccaccttggaaagagttttatgttttgtctctggtcttaaccaaatagatcaaaaccaaagtcaccttcctcctcttcagattcttccttcttcttctcttcctcctttgcggcagcggcggactcacctccaccactggctcctccagctgctgcaccacctccggcagcaaatcctcctccagaaccaccgccgatgatcacctggaagacggcggaggtaggggagacgagggagaaggaagactgaactccaccggaggaatcggcggagagagcagtctgaacaagcttgcgctggagatcgtaggtggaagaagcggaggcttcgaggtctccctcgtgctgcttagcggtccattctccgcctttgcttttgcaaacgaatgtgaatactcccatcttcttctcctttcttcgtctcctctctcgttcaaccggcgccgctcgtcttcaaggaaaggtttgagagaaaatgagtcgtggaggtgcagccgttgccaagggaaagaagaagggagtgtccttctccattgattgctccaagcctgtcgatgacaagatcatggagattgcttccctcgagaagttccttcaggagaggatcaaagtcggtgggaaagccggtgctctcggtgattccgtcacaatcacacgtgagaagaacaagatcactgtcacctctgatggtcaattctccaagaggtatttgaagtacttgacgaagaagtacttgaagaagcacaacgtgagggattggcttagagtgattgcggccaacaaggaccgtaacctctatgagttgaggtacttcaacattgctgagaacgagggagaggaagaagactagaagagctctactcttgtttcctgtttcttccgttgttttggtttctgctttttgctgctatcaatacaatttatcttggttcttttttttgtgagagatcttatctagttttggttgaagttaattatcatttcagacagttgtttaagaagattattttggtaattatcttatggttgaagaatctgttaatgaccttatggttgaaattaactcaagagtaataaagttgactgtaaccg

SEQ ID NO: 4735 - DNA, 544 bp, Brassica napus
ggaaaggtttgagagaaaatgagtcgcggaggtgcagcagttgcaaagggaaagaagaagggagtgtccttctccattgactgctccaagcctgtcgatgacaagatcatggagattgcttccctcgagaagttccttcaggagaggatcaaagtcggtggcaaagccggtgcccttggtgattccgtcacaatcacacgtgagaagaacaagatcactgttacctctgatggtcaattctccaagaggtatttgaagtacttgacgaagaagtacttgaagaagcacaatgtgagggattggcttagagtgattgcggctaacaaggaccgtaacctctatgagttgaggtacttcaacatcgctgagaacgagggcgaggaggaagactagaagagcgctctactcttgtttccctgtttcttctgttgttttggtttctgtcttttgctgctatcaatacaatttatcttggttcttttttgtgagagatcttatctagttttggttgaagttaattatcgtttcagactgttgtttaaga

SEQ ID NO: 4736 - DNA, 541 bp, Euphorbia peplus
aaaggcaagaagaagggagcaaccttcactatcgactgtgcaaagccggtggaggataagattatggacatcgcctcgctcgagaaattccttcaagagagaatcaaagttggaggaaaggctggtgctcttggtgattccgtcactgtctcccgtgataaaaacaagatcaccgtcacttctgatagcaatttctccaagaggtatctcaagtacttaacaaagaagtatttgaagaaacacaatgtgagggattggctaagagtgattgcagccaacaaagatagaagtgtatacgagttgaggtacttcaatattgctgagaacgagggagaagaggaagattaactttcaacttcttttccatcgaatttagtgggttttgaactagttgtttattgtttggctttgatgctttgctacaatttttgactcatcttgtctatcattttgcttatcaaaattgaatattttgcttatcaaccaatgttgtctatcattttgcatatatgttaattgtgctgtcttgggctgaaaaaaa

SEQ ID NO: 4737 - DNA, 571 bp, Valeriana officinalis
gtcgagctggtgttgccaagggagggaagaagaaggggtccacgttcaccatcgactgcggaaagccggtcgaggataagatcatggaaatcgcttcacttgaaaaattccttcaggagaggattaaggtcggcggtaaggccggtgctctcggcgactccgtcaccgttactcgtgagaagagtaaaattactgttacttctgacagtaacttctccaagaggtatttgaagtacctgacgaagaagtatctgaagaaaaacaatgtgcgtgattggctgagggtgatcgcatcaaacaaggatcgcaatgtctatgaactcaggtatttcaatatagctgagaacgagggtgaagaggaggattgattcatactctactagatctctgtttacctgttttgttccttaggttttgtattacttaatattggttttgtgctactctttttcttgtcaattttgcttgttgctaaatacagtatttaatttgggatttgaatcaaactggtactactggtggttggttttaaatctgctctgtacttatgttaccatgtctatttagattc

SEQ ID NO: 4738 - DNA, 723 bp, Arabidopsis lyrata
gcaaaaaccctagccctttgctttattctcctcagagcaaaaagacgccgctcgtctcttcagagagtttcaccttctagggtttgttcaagagagaaggcttggaaaaatgagtcgaggaattgcagctgttgccaagggaaagaagaagggagtttccttcaccattgattgttcgaaacctgttgatgacaagatcatggagattgcttcccttgagaagtttcttcaggagaggatcaaggtcggtggcaaagctggtgcactcggtgattctgtcacaatcacccgtgagaagagcaagatcactgttacttcagatggccaattctccaagaggtatttgaagtacttgacaaagaagtacctcaagaagcacaatgtgagggattggcttagagtgattgcagcaaacaaggaccgtaacctctatgagttgaggtacttcaacattgctgagaacgagggagaggaggaagactaaacctcagaaaccagtttggtttagaactatactctattccatgtttctgttttttggtttctactcggtactcaatacaatttgtctttgcccttttttttgtcagatgttatttagttttgttgaagttaactctcgttggttatcttactttaagagcccatatggatctttttcagataatcgttttaaaaagtttggtaatgatgaatttaactaatgttgaggattaaagaact

SEQ ID NO: 4739 - DNA, 786 bp, Arabidopsis thaliana
ggcaaaaaccctagccatctgtttcattctccccaaagcaaaaaagacgccgctcgtctcttcagagaatttcaccttctagggtttgttcaagagaagtcttgggaaaatgagtcgtggaggtgcagctgttgccaagggaaagaagaagggagtttccttcaccattgattgttcaaagcctgtcgatgacaagatcatggagattgcttcccttgagaagtttcttcaggagaggatcaaggtcggtggcaaagctggtgcacttggtgattctgtcacaatcacacgtgagaagagcaagatcactgtcactgcagatggccaattctccaagaggtatttgaagtacttgacaaagaagtacctgaagaagcacaatgtaagggattggctcagagtgattgcagcaaacaaggaccgtaacctctatgagttgaggtacttcaacattgctgagaacgaaggagaggaggaagactaaacctcagaatccagtttggtttagaagtatactctattccatgtttctgttttttggtttctactcggtattcaatacaatttgtcttttcccttctgtcatttttgtcagatgttatttagttttgttccagttaactcttgttggttatcttactttaagagctcatatggatctcgttctttcagattgtcgttaaaaaagttggataatgatggaatgattggtttatgaggattaaagaactcgaacgtgaatcgaagataatctttcaatttaaaatatttttgcaggattacttc

SEQ ID NO: 4740 - DNA, 621 bp, Aristolochia fimbriata
gatctctaactgtggaacgtagagagttggaaattggaagaggagagaggctaaaatgagtcgaggaagtgcagcaggtcccaaggggaagaagaagggagctaccttcactatagactgcgcgaagcctgtggaggacaagatcatggacattgcgtccctggagaagttccttcaagagagaattaaggtcggtggtaaagcgggggctcttggtgatgttatttccattacgcgtgacaaaagcaaaatcactgtcacctcagacagtgctttgtccaagaggtatttgaaatatttgactaagaaatacttgaagaagcacaacgttcgtgactggctgagggttattgcatctaacaaggataggaatatgtatgagctgcgatacttcaacattgcagagaatgaaggagaagaagaagattgagattctatgtttagttccttcagtttggtatttttagtttctaaaaagtgtttttgtaggcttaactactatgaatacgttgattttggcttaatgtaaaacgattctgtgacaattagacttgggtggaagatcgagtaaagagtatttcagtattggagttatgcctattagtttgtgttgagggtctc

SEQ ID NO: 4741 - DNA, 640 bp, Brassica juncea
ccgtctcctctctcgttcaaccggcgccgctcgtcttcaaggaaaggtttgagagaaaatgagtcgtggaggtgcagccgttgccaagggaaagaagaagggagtgtccttctccatcgactgctccaagcctgtcgatgacaagatcatggagattgcttccctcgagaagttccttcaggagaggatcaaagtcggtggcaaagccggtgcgctcggtgattctgtcaccatcacccgtgagaagaacaagatcactgtcacttctgatggccagttctccaagaggtatctgaagtacttgacgaagaagtacttgaagaagcacaatgtgagggattggctcagagtgattgcagccaacaaggaccgtaacctctatgagttgaggtacttcaacatcgctgagaacgagggagaggaagaagactagaagagctataactcttctgtttccggttttttgttttatgttcgttgttgctcgatacaattttatcatcgcccttgtgttctttatcgacatatcttgttttagttttgttgaagttaactcttcttggttcagacaatattttggtactatgattcaataatcggttaatgaggattaaaatatttcatagtaaaacaaaacccc

SEQ ID NO: 4742 - DNA, 476 bp, Brassica juncea
aaaaagacgccgctcgtcttcaaggaaagggttgagagaaaatgagtcgtggaggtgcagccgttgccaagggaaagaagaagggagtgtccttctccattgattgctcgaagcctgtcgatgacaagatcatggagattgcttccctcgagaagttccttcaggagaggatcaaagtcggtgggaaagccggtgcccttggtgattctgtgacaatcactcgtgagaagaacaagatcactgtcacttctgatggccaattctccaagaggtacctcaagtacttgactaagaagtacttgaagaagcacaatgtgagggattggcttagagtgattgcagccaacaaggaccgtaacctctatgagttgaggtacttcaacatcgctgagaacgagggagaggaagaagactagaagagttatagctcttctagtcttcttcttcaacatcgctgagaacgagggagaggaaga

SEQ ID NO: 4743 - DNA, 647 bp, Brassica rapa
ggagccacattttgtttcccgtctcctctctcgttcaaccggcgccgctcgtcttcaaggaaaggtttgagagaaaatgagtcgtggaggtgcagccgttgccaagggaaagaagaagggagtgtccttctccattgattgctccaagcctgtcgatgacaagatcatggagattgcttccctcgagaagttccttcaggagaggatcaaagtcggtgggaaagccggtgctctcggtgattccgtcacaatcacacgtgagaagaacaagatcactgtcacctctgatggtcaattctccaagaggtatttgaagtacttgacgaagaagtacttgaagaagcacaacgtgagggattggcttagagtgattgcggccaacaaggaccgtaacctctatgagttgaggtacttcaacattgctgagaacgagggagaggaagaagactagaagagctctactcttgtttcctgtttcttccgttgttttggtttctgctttttgctgctatcaatacaatttatcttggttcttttttttgtgagagatcttatctagttttggttgaagttaattatcatttcagacagttgtttaagaagattattttggtaattatcttatggttgaagaatctgttaaagag

SEQ ID NO: 4744 - DNA, 634 bp, Brassica rapa
gagccacattttgtttcccgtctcctctctcgttcatccggcgccgctcgtcttcaaggaaaggtttgagagaaaatgagtcgtggaggtgcagccgttgccaagggaaagaagaagggagtgtccttctccattgactgctcgaagcccgtcgatgacaagatcatggagattgcttccctcgagaagtttctccaggagaggatcaaagtcggtggcaaagccggtgcgctcggtgattccgtcacaatcacacgtgagaagaacaagatcactgttacctccgatggtcaattctccaagaggtatttgaagtatttgacgaagaagtacttgaagaagcacaacgtgagggattggctgagagtgattgcggctaacaaggaccgtaacctctatgagttgaggtacttcaacattgctgagaacgagggagaggaagaagactagaagagctctactccttgtttcttttgttgttttggtttctgctttttgctgctatcaatacaatttatcttggttcttttttgtgagagatcttatctagttttggttgaagttaattatcatttcagacagttgtttaagaagattattttggttattatcttatggttgaagaatctgttaa

SEQ ID NO: 4745 - DNA, 692 bp, Brassica napus
gagcaaaaaccctagccacattttgtttcccgtctcctctctcgttcaaccggcgccgctcgtcttcaaggaaaggtttgagagaaaatgagtcgtggaggtgcagccgttgccaagggaaagaagaagggagtgtccttctccattgattgctccaagcctgtcgatgacaagatcatggagattgcttccctcgagaagttccttcaggagaggatcaaagtcggtgggaaagccggtgctctcggtgattccgtcacaatcacacgtgagaagaacaagatcactgtcacctctgatggtcaattctccaagaggtatttgaagtacttgacgaagaagtacttgaagaagcacaacgtgagggattggcttagagtgattgcggccaacaaggaccgtaacctctatgagttgaggtacttcaacattgctgagaacgagggagaggaagaagactagaagagctctactcttgtttcctgtttcttccgttgttttggtttctgctttttgctgctatcaatacaatttatcttggttcttttttttgtgagagatcttatctagttttggttgaagttaattatcatttcagacagttgtttaagaagattattttggtaattatcttatggttgaagaatctgacaaaaaaaaaaaaaaaaaagccgacctacggcctctagaat

SEQ ID NO: 4746 - DNA, 621 bp, Cicer arietinum
gggaaaccctagtttgtatcctagaggagtgcgaaaatgagcggagctaaggggaagaagaagggaacaagcttcgtcatcgattgtgcgaagccggttgaggataagattatggacattgcttccttggagaagtttcttcaagagaggattaaggttggtggtaaagctggtgctctcggtgattccgttacagttactcgtgaaaagagcaagatcaccgttacctccgatagcaatttctccaaacggtatctgaagtacttaaccaagaagtacttgaaaaagcacaatgtgagggattggcttcgtgtgattgcctccaacaaggaccgcaatgtctatgagttgagatacttcaacattgctgagaatgagggtgaagaggaagactgaagaacttgttctgtgccttgatgcattatccgttaggtgtaattgttttggaatctcttttgtcgattgtttttgtcaactttttactggttgtgtaagaatttgtgtctttaatttggtaccatttatttcccgcagcaagttttatagttattatcattggagattttgccataaaaattcagatgcagttatttatatgctggaatgttaaatttaactgcc

SEQ ID NO: 4747 - DNA, 707 bp, Cleome gynandra
tcggggtctctctctctctccgcacgccgctcattgcttcaggcagcttcagcatctagggttttctcaatacctccaggattctgagaaaaacgagttgggtgtgaattctctctgcttttctcaatacctccagaggaaggttaaaacatgagccgcggtggtgctgtagcccccaaggggaagaagaagaatgtctccttcaccattgactgttcgaagcctgtcgaggacaagatcatggagattgcttcgctggagaagtttcttcaggagaggatcaaagtcggtggaaaagccggcgcacttggtgatactgtcaccataacccgtgacaaaaccaaaattactgtcacttctgacagccagttctccaagaggtatctcaagtacttgacaaagaagtacctgaagaagcacaatgttagggattggcttcgtgtgattgcatcgaacaaggaccgtaacctctacgagttgaggtacttcaacatcgccgagaatgaaggagaagaggaagattaaagcccttgaactatttcggtttcaatgtacaagtatgttttgttcctatgctgttttggtcgctttctatagttcatcatctatgcttttgtggtgttagaatcttaattagttcagtctaagctattctactctttataatggatttttgttccttcagaccatgtctagacttgttactt

SEQ ID NO: 4748 - DNA, 729 bp, Cleome spinosa
cactttaaaatttaaatgcgtaataaaaccctagacattttcttctcctcttccagctttgggacgccgcttctttcttcaggcacatcttctagggtttctccccgcagcttcagaggaaggttaagaaaatgagtcgaggtggtgcagttgctcccaaggggaagaagaagaatgtgtccttcaccatcgactgctcgaagccagtcgaggacaaaatcatggagattgcttcgcttgagaagtttcttcaggagaggatcaaggtggggggtaaggccggcgccctcggtgatactgtcaccatcacccgtgacaagaacaagatcactgtcacttctgacagccagttctccaagaggtatctcaagtacttgacaaagaagtacctgaagaagcacaacgtgagggattggcttcgtgtgatagcttcgaacaaggacaggaacgtctatgagctgaggtacttcaacattgcagagaacgaaggagaagaagaagattaaaacaatgcccccttgagccaccagttcagttttagaacactaatatactctctgtttctgtgttttctggtcgatgctcctctctttggtcgtcaccaactcttgtgctagaatcttaaagtttggtttaaatcttctctctttcgctgttgaactccactttatattgattttgtttgtttaaaacattgctcgagttctaggagcagtctcctgagagaaa

SEQ ID NO: 4749 - DNA, 508 bp, Heritiera littoralis
ggtcgccgcctttctttctctttagtttcagcttcaacgtcttcgtctccggataaattgaaaatgagtcggggtagtgcagcgggacccaaagggaagaagaagggagttaccttcactatcgattgtacgaagccagtggaggataaaatcatggacattgcctcactggagaagtttcttcaggagagaattaaggttggaggcaaggctggtgcgcttggtgaaatcgtaactctcacccgggagaagagcaaaatcaccgtcacttctgatggggccttctccaagaggtatctgaagtacttgaccaaaaaatacttaaagaagcacaatgttcgggattggctccgagtgattgcatccaacaaagatcgaactgtttatgaactaaggtacttcaacattgctgagaacgaggctgacgaagaagattgatatctgggaacgagcagggaatgagcagttgtaatgctagttgcttcagtacctttttatttttcagtat

SEQ ID NO: 4750 - DNA, 819 bp, Quercus alba
atggggattccattctcatctctcacgccgctcagctccaagctctgtaactcgaggataatcgaagatgagtcgaggaagtgcaccagttcccaaggggaagaagaagggagtctcatttactgttgactgtacgaagccagtggaggacaagatcatggacattgcatccctggagaagtttctccaggagaggatcaaggttggtggcaaggctggtgctcttggtgacactgtcactgtaacccgggagaagagcaagatcactgttgcttctgacagtaacttctctaagaggtatctgaagtacttgacaaaaaagtacctgaagaaacacaatgtgcgtgattggctccgcgtgatttcttcaaacaaagatagaaatgtgtatgaacttaggtacttcaacattgctgagaatgaaggggaggaagaagattgaaaatctgaactggcttagtcatttaagacttttgctcaccttatattcagggatctttctttctgttttagtgttgcctttgggatgctgctttttgttgaaactgtttaacaattttgttgagtaaattagagattttacaatattcctattgttggattggtaatatagaaagtctgtcattgtcgaatccagctttgttgttttgattattggagttccaagcaacttttatgaggttacaagttgtgcttgattctttcttttgcattcttcaccgtttaatgcattacttaccagaccatacttatatcataattaaaaatttcaaattcgctacttaagataaggcatgcttattcgcttatctgcttatt

SEQ ID NO: 4751 - DNA, 828 bp, Quercus alba
atggggattccattctcatctctcacgccgcttagctccaagctctgtaactcgaggataatcaaagatgagtcgagggagtgcaccagttcccaaggggaagaagaagggagtctcgtttactgttgactgtacgaagccagtggaggacaagatcatggacattgcatccctggagaagtttctccaggagaggatcaaggttggtggcaaggctggtgctcttggtgacactgtcactgtaacccgggagaagagcaagatcactgttgcttctgacagtaacttctctaagaggtatctgaagtacttgacaaaaaagtacctgaagaaacacaatgtgcgtgattggctccgcgtgatttcttcaaacaaagatagaaatgtgtatgaacttaggtacttcaacattgctgagaatgaaggggaggaagaagattgaaaatctgaactggcttagtcatttaagacttttgcttaccttatattcagggatctttctttctgttttagcgttgccttgggatgcttgctttttgttgaaactgtttaacaattttgttgagtaaattagagattttacaatattcctattgttggattggtaatatagaaagtctgtcattgtcgaatccagctttgttgttttgatgcattgtattggagttccaagcaacttttatgaggttacaaattgtgcttgattctttcttttgcattcttcaccgtttaatgcattactttctagaccatacttgttatatcataattaaaaatttcaaatttgctacttaagttaaggcatgcttatttgcttatctgcttatt

SEQ ID NO: 4752 - DNA, 538 bp, Raphanus sativus
  misc_feature (219)..(219): n is a, c, g, or t
  misc_feature (222)..(222): n is a, c, g, or t
  misc_feature (297)..(297): n is a, c, g, or t
aaaatgagtcgtggaggtgcagctgttgcaaaggggaagaagaagggagtgtccttctccattgactgctcgaagcctgtcgatgacaagatcatggagattgcttccctcgagaagttccttcaggagaggatcaaagtcggtggcaaagctggtgcgctcggtgactctgtcacaatcacccgtgagaagaacaagatcactgtcacctctgatggncanttctccaagaggtacctcaagtacttgacaaagaagtacttgaagaagcacaatgtgagggattggcttagagtnattgcggccaacaaggaccgtaacctctacgagttgaggtacttcaacattgctgagaacgagggagaggaagaagactagaagagctatgctcgtacttcttgtttctgattgttttgttttctgctctttctttgctgttcagtacaatttatctccgttctttttttgtgacagatcttatctagttttggttgaagttataactcttgtttttgagagtttgataaaaaaaaatatt

SEQ ID NO: 4753 - DNA, 651 bp, Raphanus sativus
  misc_feature (444)..(444): n is a, c, g, or t
ggagccacattttgtttatcgtctcctcctctctctctcgttcaagagctaatagacgccgctcgtcttcaagaggaaaaggttgagaaaatgagtcgtggaggtgcagccgttgcaaagggaaagaagaagggagtgtccttctccattgactgctccaagcccgtcgatgacaagatcatggagattgcttccctcgagaagttccttcaggagaggatcaaagtcggtggcaaagctggtgcgctcggtgactctgtcacaatcacccgtgagaagaacaaaatcactgtcacttctgatggccagttctccaagaggtacctcaagtacttgacaaagaagtacttgaagaagcacaatgtgagggattggcttagagttattgcggccaacaaggaccgtaacctctacgagttgaggtacttcaacattgctgagaangagggagaggaagaagactagaagagctatgctcgtacttcttgtttctgattgttttgttttctgctctttctttgctgttcagtacaatttatctccgttctttttttgtgacagatcttatctagttttggttgaagttataactcttgtttttgagagtttgataaaaaaaaatatttttctaaagatcttatgtttaaaaaa

SEQ ID NO: 4754 - DNA, 617 bp, Raphanus sativus
ggagccacattttgtttctcgtctcctcctcctctctcgttcaagagctaaaagacgccgctcgtcttcaaggaaaaggttgtgaaaatgagtcgtggaggtgcagcagttgccaagggaaagaagaagggagtgtccttctccattgattgctcgaagcctgtcgatgacaagatcatggagattgcttccctcgagaagtttcttcaggagaggatcaaagtaggtgggaaagctggtgcgcttggtgattctgtcactatcacccgtgagaagaacaagatcactgtcacctctgatggccaattctccaagaggtacctcaagtacttgacgaagaagtacttgaagaagcacaatgtgagggattggctcagagtgattgcggccaacaaggaccgtaacctctatgagttgaggtacttcaacattgctgagaacgagggcgaggaagaagactagaagagctactatactcgtgccttcttgtttctggttgttttgttttctgctgctctttgctgttcagtacaatttgtctccgttctttttttttgtgacagatcttatctagttttggttgaagtttactcttgttttagagagtttgataaaaa

SEQ ID NO: 4755 - DNA, 648 bp, Raphanus sativus
  misc_feature (536)..(536): n is a, c, g, or t
ttgtttctcgtctcctcctctctcgtccaagagctaaaagacgccgctcgtcttcaaggaaaaggatttaaaaaatgagtcgtggaggtgcagcagttgccaaggggaagaagaagggagtgtccttctccattgactgctcgaagcccgtcgatgacaagatcatggagattgcttccctcgagaagttccttcaggagaggatcaaagtcggtggcaaagctggtgcgctcggtgattcggttacgatcacccgtgagaagaacaagatcactgtcacctctgatggccaattctccaagaggtacctcaagtacttgacgaagaagtacttgaagaagcacaatgtgagggattggcttagagtgattgcggccaacaaggaccgtaacctctatgagttgaggtacttcaacattgctgagaacgagggagaggaagaagactagaagagctactatactcgtaccttcttgtttctggttgttttgttttctgctgctctttgctgttcagtacaatttatctccgttctnttttttgtgacagatcttatctagttttggttgaagttaactcttgttttagagagtttgataacaaagtatttttctaagatcgtataattgaaaaatatgttagtgttta

SEQ ID NO: 4756 - DNA, 656 bp, Carthamus tinctorius
  misc_feature (36)..(36): n is a, c, g, or t
ggcggggatcccccttccttcagctcgccgtcttcnaatcacagtctgtagagagagagagtgagagaaacagagagaatcgaagatgagtcgggtagcaggaggtgccaagggaggaaagaagaagggagccacttttgtgattgattgtggaaagcctgttgaggataagatcatggagatcgcatcactcgagaagtttcttcaggagagaatcaaggttggcggtaaagctggtaatctcggagattccgttaccattacccgtgagaagaacaagatctccgtcacatctgacagcaacttctctaaaaggtaccttaaatacttgacaaagaagtacttgaagaagcacaatgttagggattggcttcgtgtaattgcttcaaacaaagaccgcaatgtttatgagcttcggtactttaacattgctgagaacgagggtgaggaagaagactaagccagggttccatcctgttttatgtagtttcttggcatgattttgacttgggtttctgggacttgttatatcagtttctttttctttttttattcagactatgaaatattgttttgcagtaaaattaaaatttgggatctatgtgattttggcaaaagttttgttgatgagatctgaattggtcagcttattcaaa

SEQ ID NO: 4757 - DNA, 737 bp, Fragaria vesca
tgctgggggcagtagaaaaccctaaatagctagcagaggagacgaaacgcagccgaagctctctagccaaaaacccaaagaagcgaaaatgagccgcctagctgtttcgggagccaagggcaagaagaagggagcttcgttcgtgattgactgcgggaagccggtggaggataagatcatggacatcgcctcactggagaagttcctccaggagcgaatcaaggtcggcggcaaggccggtgctctcggtgactctgtttccgtcactcgtgagaagaacaagatcaccgtcacttctgactccaccttctccaagaggtatctcaagtacttgaccaagaagtacctgaagaagcacaatgtgagggattggctccgtgtgattgcatcgaacaaggaccgcaatgtgtatgaattgagatacttcaacattgcagacaacgagggcgaggaagaagactgagaaatcagcttcctattttgaggcaatatccattaagcttagttctagaacttatcgtgtttttccctggcttgatagacttttatttgggcatgactttgaaattaagtttatcctcaagagtattttgtactgagattcagtttttgattatcacattgtctttctggttggtgcaatgcatattgctctgaaggttatgtttatgagttcaatttgttgataatttgatattttcatcactcggtgcaaataatgcatctcattttgcaaa

SEQ ID NO: 4758 - DNA, 926 bp, Vitis vinifera
tgtatcagttggtctgcctggcaagagaccttttgagggtctactgcaactcgaaagccaacttagagtgtgctgtgtgcgcaagtatgcacgcatgcggcaagtcgagtgcatcattaaatgaaatcacaacgggtattgaaagttgtaacaatgtgattgtgttttcagctcatcagatacttccattggtaagtatgttatatagctcatgacattaaagggcctcggcagacattaaagggtgtaaggcaaatatcctttcattcaccaatagtgagaaactaaatcataaaaaattaaaatacaaatgtaagcaatataacaaaccaaatatagcaacaagggaacgtaaatttatggttgagcataaccaaaacttcaaaatctcaagttccacaaagtacaaaagcaaccacgaacaaagacaattcaccaaagaagattccaccataatgagaacaaagaaacctataaagtaaatacaggtccatatcttcagtcttcatcctcaccctcattctcagcaatgttgaagtatcgcaattcatacacattgcgatccttgttggaagcaattacccgaagccaatctctcacgttgtgtttcttcaagtatttctttgtcaaatatttcagatacctgcggtaccgtttagagaaactgctttcggaggtgacggtgatcttgctcttgtcacgtgtaacggtgacggaatctcccagagcaccggccttgccgccgaccttgatgcgctcctgaaggaatttttcgagcgaggcgatgtccatgatcttatcctcaaccggcttggcacagtcgatggtgaaggtggctcccttcttcttgcccttgggcccacccgttgcgctgcctctactcatagcgtcccttgctctgcaactcacaaaatcctaagattggg

SEQ ID NO: 4759 - DNA, 1470 bp, Cirsium arvense
aaaatcatcatcgcattccaattgcacttcgccgtcttcgaatctacagaagccaacaagatgagtcgtggagcaggaggtgctggaggagccaagggcgggaagaagaaggcagcgacgtttgtgatcgattgtggaaagcctgttgaagataagatcatggagatcgcttcgcttgagaagtttctacaggagagaatcaaggttggaggtaaggctggtaatctcggtgactctgttacgatttcgcgtgagaagaacaagatttccgtcacttccgatagcaacttttccaaaaggtatttgaaatacctaacaaagaaatacttgaagaagcacaatgtgagagattggcttcgagtgatcgcttctaacaaagaccgtaacgtttatgagctacgttacttcaacatcgccgagaacgagggagaagaggaagactaagcagatggtcaagctcgtttatgttttgtttttgtttttgacctggtttggcaatttagacatgttatatcagtcttttctgaactgtattgtagtagagttttgagtttaggtgcttttgcactatcttcttttttctgaacacttgtttatctgggttggcatcgaaaacctcattgatttcgatcttaaccctttgaaatcaccagccccaacagaaactggcctagaatttggacttccatttgcttcattagcacccaaatcctcccttttctccaatctcatagacttcgaacgccaattcaacggagtcgcagaacaagaatcggaatcagaatcagtttctttgaacttctcctctaacttgattggaaccaaacccctaaactttcgattcttgattccattcccaccaaccaaagaatcttcaacaaccgaatcacacccacctccgttactagactttccaaccgcagaatccaagcttttcgatccaaggcttcgcacaggcaaacacaagggtttatttgtttgattgtttttggtttactcagttgctcaagaacatagttttcatcattaataacaaccaaggattcccctaaaaagtactgatttagcttcttctcatcagatttttcaaacccatttccaaattcagataatcttgaacctgaacccttacattcatcaaactcatcaaacccatatgaagattgaattccatcttcgaaaatcgatgaaatatgagatatcccagataaatatgtttcttttgtaccattattaacattatcatcatcatcaaaactatgaaccctatccaattttctgctaaataatccataacaaacagcaatgccgatgactaaaaggtaaaagagctcccagagcttggtggcaatggtggttttcttgaaaaattcaggaacttgtgaagggaaaaatgagaaaacaagaagaacaagtatgactatgagagatttagagaagaaatggtgtgtgaaagggaacttacttttt

SEQ ID NO: 4760 - DNA, 705 bp, Cleome spinosa
gacgcgcggcgagaactgaaccacaactgtagcccagcgtcaggggaaataacccagtgattcgccgagcagaggaagacgacgatgagtcgaggagcggcggcgtcggtggcagcgaaaggggggaagaagaaggcggcgagcttcgtcatcgactgctcgaagccagtggaggataagatcatggacatcgcttctctggagaagttcctccaggagaggatcaaggtcggcggcaaacccggtgctctcggagatgcaatcaccgttactcgtgacaagaacaaaatcactgtcactgccgacacgaacttctctaaaagataccttaagtacttgactaagaagtacttgaagaagcacaatgttcgtgattggcttcgagtgattgcctcgaacaaggataggagtgtctatgagctacggtacttcaacattgccgagaacgagggcgaagaggaagactgaaaactccaacccggttggtttggttgcattttgtttattttccatcgtctcgtcagttgtctgaacatgctgagatcctgtccaaaaatgttatcctgagaaatttcagttgcagagttctttagcttgtctgttagtttcccactttcataagacggcaatttctcttctgcaatccaatttcgtattcacgcttgtttatggcttctgaaatcgaacttcgtctgatcatatttc

SEQ ID NO: 4761 - DNA, 730 bp, Eucalyptus grandis
  misc_feature (60)..(60): n is a, c, g, or t
cggctcattctcagcggcgcgccatcagcagcagagcagctccaaagtcgcagaaggcgnggtaggtaaagcgtattcgagttccggtcgggagagatgagcagaggagggagctccggcggcggcgccaaggcggcgaagaagaagggagcgacgttcgtgatcgactgcgccaagccggtggaggacaagatcatggacatcgcctccctcgagaagttcctccaggagcgcatcaaggtcgacggcaaggccggcgccctcggcgactccgtcaccgtctctcgcgacaagtccaagatcaccgtcacctccacctccgacttctcgaagcggtaccttaagtacctgacaaagaagtacttgaagaaacataatgttcgggattggctccgcgtgattgcttcaaacaaggaccgcagtgtctatgagcttaggtacttcaacattgctgagaacgagggagaggaggaagattaagaatctgctcaaaagatttcgtttccgacatttcaatgttgttattggattttggttgttactctggtttttggattgcaaacagattttccttgtcctttcaatatgaatcgaaatagagttttgagttccaacattgttgagctggggacataaacacatgatgaaatatgctaccttagtgtatgctggagatttgattaaaaatacatccgagctaaagagcagacggcttataaattgcttttct

SEQ ID NO: 4762 - DNA, 613 bp, Elaeis guineensis
  misc_feature (360)..(360): n is a, c, g, or t
ctaaccttactcaaaacgtcacgccgccgaggtccagagagcaagagaggagatgagtcgcggggcgagcggggtggcggcgaagggagggaagaagaaagggtcgacgtttacgatcgactgcgcgaagccggtggaggacaagatcatggagatcgcctccctcgagaagttcctccaggagcgcatcaaggtcgccggcggcaaggccggtgccctaggcgaccaggtcaccgttacacgcgacaagtccaagatcaccgtcacctctgagggccccttctccaagcggtatttgaagtacctgacaaagaaatacttgaagaagcacaatgtgcgggattggcttcgagtgattgnatccaacaaagatcgcagtgtttatgagctgcgatacttcaatattgctgagaatgagggggaggaggaagattaattgtcttttccagttctatatgctatgcttgtttcagttaaattttgaggttttagaaggtttctttttcatctgaggctgccatattggaactctatattcctgtctttgcatttatatgactagaatttgtaagcttctaattaccaggaatcaaattgtgttggtattgccgtt

SEQ ID NO: 4763 - DNA, 772 bp, Populus trichocarpa
cccctccatttctgcagcactccaaaaccctaactatcccctccgataatcaatcaaagaaaatgagcaagggagcagcagctgtaggcggggccaagggaaagaagaaaggagcaacaacgttcacgatcgattgtgcaaagccagtggaagataaaattatggacattgcctcactggaaaagttcctccaagaacgcattaaagtcggcggcaaacccggagctctcggtgattccgttacagtcacccgtgacaagtccaagatcaccgtcacctgtgactctagcttctccaaacgttatttgaagtatttgacaaagaagtacttgaagaagcataacgtgagagattggcttagggttatttcatcgaataaggacaggaatgcttatgagctgagatactttaacattgctgagaacgaaggcgaggaagaagattgagcgtatttatgaattcttctgttttgtttttgttttcttacattttgaaatgagattatttgaaattttggtggacaccccgcgctgttttgcctcgtgtgaatttatgtttggttactacaggcttcgctttatttgagaccatattctaattattgttgaatttgagaatgttttgccttgatattgtttgtcttgtatatcatatatctctgtgttgctagtagttgagcctggataatgcttgtgtgtggtgcacacagtccacttctgtattatggtttatcaacaatgtattaccaggtttttgaacctgtgagatcgtt

SEQ ID NO: 4764 - DNA, 755 bp, Vinca minor
agtcgaggagcaggagcagctggaaccaagggtgggaagaagaagggagcaacgttcgtgatcgattgtgctaagccagttgaagataagatcatggaaattgcatcgcttgaaaagtttttgcaagagagaatcaaagttggaggcaaagctggtgctctcggtgattccgttaacgttacccgtgacaagagcaagatcaccgtcacctctgactccactttttccaagaggtatctcaagtacctaacaaagaaatacttgaagaagcacaatgtcagagattggcttcgtgtgatttcttcaaacaaagacagaaatgtgtatgaactccgatattttaacattgccgagggtgaaggcgaagaagaagattaaagctacaatgaatgtgatttttatgcttctgttagctgtggtttaagttttcgcaaatgtcattttgcttatttcaatctctatcaacctcctggagttatttttgttgttttatcgatcttatgatttttgtttacttgcaaaaggaacttgtagttgaatagtatatcctttgttctcagaatcaagtctggagagtaatgacctattgcagtcttaatgtggtttctttctactgtctcccagagtacatcagtaatttggaagaatggttatttgtttatttatcttggtctgcagtagctattttttacaagaaaaattaactgtattccaagtaaaaatagttattttttttctattgttggatagaagat

SEQ ID NO: 4765 - DNA, 636 bp, Cichorium intybus
gcggggactacatcatcgcattctagttgcagttcgccgtcttcgaatctaaaggagcaagatgagccgtggagcaggaggtgcgggagccaagggtggaaagaagaagacatcgactttcgtgattgattgcgggaaacctgttgaggataagattatggagattgcatcactcgagaagtttcttcaggagagaatcaaggttggcggcaaggctggtaacctcggagactctgttaccatttcacgcgaaaagaacaagatatccgtcacctccgatagcaacttctctaaaaggtatctgaaatacctaacgaagaaatacttgaagaaacacaatgtgagggattggcttcgagtgattgcttccaacaaagaccgtaatgtgtatgagctacgttacttcaacattgctgaaaatgagggagaagaggaagactgagtgcaacacagtcgattttgctttatgtttgttttttgacctgttttggccttctaaatttattatatcagacttttctttgtcaatctgttcagaactgtattaaagtagagttttgagtctaagtgatcatgcactgatctcaattcttaatttcatcttcctgggatgcatctctcttcactttttaaaaa

SEQ ID NO: 4766 - DNA, 555 bp, Triphysaria pusilla
cgtcgatccaaaacctgtacgagctgcggattcataaaaaggaaacgaagatgagcaaaggcgttgcagctgggggagccaagggcgggaagaagaagggatcgacattcgtgatcgattgcgcgaagcccgtggaagataaaatcatggacattgcttcgctcgagaaatttttgcaggaacgaatcaaggtcggcggcaaagccggcgctctcggcgattctgttaccgtcacccgggaaaagaacaaaatcaccgtcaacgctgatgctgccttctccaagaggtacctcaagtatttgacaaagaaatacttgaagaagcacaacgtgagagattggcttagagtgattgcttccaacaaagaaaggaacgtgtatgaactgcgttacttcaacattgccgagcaagagggagaggaggaagattaaatctacacattgttgttcggttttccgctttttgcaatttaagaaccatagtgtgggatctatatatgtttgttttgttctctttgaatttaatagacctccttcgtatgcgagctcaactttt

SEQ ID NO: 4767 - DNA, 593 bp, Valeriana officinalis
gctggtgttgccaagggagggaagaagaaggggtccacgttcaccatcgactgcggaaagccggtcgaggataagatcatggaaatcgcttcacttgaaaaattccttcaggagaggattaaggtcggcggtaaggccggtgctctcggcgactccgtcaccgttactcgcgagaagagtaaaattactgttacttccgacagtaacttctccaagaggtatttgaagtacctgacgaagaagtatctgaagaaaaacaatgtgcgtgattggctgagggtgatcgcatcaaacaaggatcgcaatgtctatgaactcaggtattttaatatagctgagaacgagggtgaagaggaggattgattcatactctactagatctctgtttacctctgttttgttccttaggttttgtattacttaatattggttttgtgctactctttttcttgtcaattttgcttgttgctaaatacagtatttaatttgggatttgaatcaaactggtactactactagtactggtggttggttttaaatctgctctttacttatcatgttaccatgtctatttagattctagattacgattc

SEQ ID NO: 4768 - DNA, 710 bp, Taraxacum officinale
cggccggggaatcttgaattgatagggtgcagctcgccgtcttcgagcaaggctttctctgcgtgcatttgttggagatatagaaagaagcgaagatgagtcgagtagcaggagcaaaggggggaaagaagaagacggctacttttgtgattgattgtgggaagcctgttgaggataagatcatggagattgcctcacttgagaagtttcttcaggagagaatcaaggtcggtggtaaagctggtaatctcggagattccgttactatttctcgtgaaaagaacaagatctccgtcacctccgacagcaacttctccaaaaggtacctgaaatacttgacgaagaagtacttgaagaagcacaatgtgagggactggcttcgtgtaattgcttcaaacaaagaccgcaatgtttatgagctaaggtacttcaacattgctgagaatgaaggcgaggaggaagattaagctgttcgttttttggcatgatttttggttttggcttcttagacaatttattatatcaattttctttttcgtcagactttgaaatattgttttgcagtaaaattgtgggtctttgtgctgattcgtattggttttgtgctgattcatgtcattttattttgagtagtaggtttacagtttatcatattttatctgtattgtcctcaaatttactgatgaaaaaccaatcactgcattacgatc

SEQ ID NO: 4769 - DNA, 631 bp, Tragopogon dubius
cgggggcttcctgtcgccttatagcaccactcttcacattgctaggttgcagctcgccgtattcgaagcacacccaatccatcgttctctgggcgcatttgatagaagaagcgaagatgagtcgagcaggaggtgccggagccaagggcggaaagaagaaggcagctaccttcgtgattgattgtggaaagcctgttgaggataagatcatggagatcgcgtctctcgagaagtttcttcaggagagaattaaggtcggtggtaaagctggtaatctcggcgattccgttactatttctcgtgaaaagaacaagatctccgtcaccgcggacagcaacttctccaaaaggtacctgaaatacttgacaaagaagtacttgaagaagcacaatgtgagggattggcttcgtgtaatcgcttctaacaaagatcgcaatgtttatgagctacgatacttcaacattgctgagaatgagggtgaagaggaagactgagcaaggtgttaacttcatctttttacttagttttttggcatggattttggttttggcttcttggacttgttatatcagattcatttttcttgggagtttgaaatattgttttgcagtaaaattatgggtttatgtgc

SEQ ID NO: 4770 - DNA, 1904 bp, Triphysaria pusilla
aaaataaagcaagacaaaatatttgaagctcacatttggtggaggtctatgaaatcccaataggacaaaacaaacataaatagatgcaaaaattgtttctgaaagtcgaaaaaagcataaaggacaaaaacacagaaaatcggtagatttaatcttcctcctctccctcttgctcagcaatgttgaagtaacggagttcatacacattcctttctttgttggaggcaatcactctgagccaatctctcacattgtgcttcttcaagtatttctttgtcaaatactttaggtaccttttggagaagttagcatcagcattgacggtgattttgttcttctcacgagtgacggtaacagactcaccgagcgcgccggctttgccgccgaccttgattcgttcctgcaaaaacttctcaagcgaggcgatctccatgatcttatcctcgacaggcttcgagcaatcgatcacgaaggtcgaccccttcttcttcccgcctttggccgcagctgctacgcctttgctcattttcgtttcttattacccgcctgctccattttatttcttctctctaaagacgactttctagctcaaggtgtttgatcatttaaaccttcccttgagcatcggatattgtaattttgaaggtcaatttatcattaatagaatggattttttatttggtaacttgagcggaggatcctcgtcttttaaccaggacattgtcaggtgtccgtttctacgtaacattaatgagccaactaacttatccttctcaactgcgatgactttccctatccctgcaagggaagggaaaggtccaattttcgaggatggtcctaattttgatacggcatttaggcttttccacgggcagaatggcgttgtcccactttccgggaggtcatttgtacgcactgagaagccgaaccctcgttccgaatcatcgccggcccagttcaacccattggctgcaaaggcagcaaccatcagcctctctggatttgggcctggtgggccttttggatttgatgcgttttcagagaagtttaagaatgcaaagaagaaatcagaatcatccaaaaacgagaagagagacaaaacgaaatccgaacacgaagcaatgggcgatgagtggctgaaaagcggcaactgcccaatcgcaaagtcgtaccgagccgtgagcagcgtcctccccctcgtagccaaagccctccagcccccgtccgggttcaactaccgctgcccgaaggcaatagtcgctgcccggagtgcccttgcaaaaactgccttcgccaagaacctccgcccccagcccctcccctccaaggtcctcgtcatcggcgtcttaggcatggcggccaatatacccttgggtgtatggagggagcacacagagaaattctccccgtcctggttcgcagcagtccatgctgcagttccgttcatagcgatgattaggaagtcagttctgatgcctaaggcggctatggcgttcacgattgcggcatctattttgggccaggtgatagggtcacgggccgagaggtacaggcttaagaaactggttttggatcagggtttggttagtgggggcccggctgctgggttggggtttgagactgggcgttgcggagaacttgttgagtggaaagagaatcgtgtgcaggtggcatcatcgtcttcgggtgatgtgtttgggtgatttattttatcttgaggttttggtgttgtgcattgtgtgtgatgagactttttcgtttattattatttccccgtaaactcgaataaattgaggggatgggatttatttgtactcacatattatacatgtaattttcgattaatcaacactgagtaaaagctggtttgggattctgaggattgattttatgttaattcagta

SEQ ID NO: 4771 - DNA, 662 bp, Triphysaria pusilla
gtcgccgtcgatccaaaatctacaccagagctttgcaggcggaaccaaaaaggaaacgaaaatgagcaaaggcgttgcagctgcggccaaaggcgggaagaagaaggggtcgaccttcgtgatcgattgctcaaagcctgtcgaggataagatcatggagatcgcctcgcttgagaagtttttgcaggagcgaattaaggtcggcggcaaagccggcgcgctcggcgagtctgttaccgtcactcgcgagaagaacaaaatcaccgtcaatgctgatgctaacttctccaaaaggtacctaaagtatttgacaaagaaatacttgaagaagcacaatgtgagagattggctcagagtgattgcttccaacaaagaaaggaatgtgtatgaactccgttacttcaacattgccgagcaagagggagaggaggaagattaaaactacccgttttcgtgtttttgtgctttatgctttttcgactttcagaaacaaattttggatttatttatgtttgttttgtcctcttggatttcatagactgcaattgaatgtgagcttgaatattcttcaatttgatgttggcttgcttactttatatttagtgtactaatactaccatacttattgtagagataccttgaggaatgaaaatttactgtcc

SEQ ID NO: 4772 - DNA, 1090 bp, Cirsium arvense
ctttttgatagcgttttgttgcattgtgggggatcattagatggcatagattgcacatcgagcactgcattgaactcgggaaatctattagacttgttcttcgaaccacaaattttattaccgtatggtaatgatagcatctttgttggctcccaggaaatagcgttgaccggcatgatttcaagcattctgattcactttggttttaaaagcaaatcgatcaaagaagcaacatagaaggagcagcagatggatagcgatccttggattggttcagaggcactctcagccactcaatgaacgattttcagatagaattttgagtttctctcaaacaaacatttcgtcgaacaggtggtaggcaaacaatcctataaatttgacacaatcctataaagttttaaggagcttaccggaataaagagtggctgccggagactatggcggttaccggtggtgcgcagaatcgagagagagagagtgagagaaacagagagaagcgaagatgagtcgagcagcaggaggtgccaagggaggaaagaagaagtcagccacttttgtcattgattgtggaaagcctgttgaggataagatcatggagatcgcatcactcgagaagtttcttcaggagagaatcaaggttggcggtaaagctggtaaccttggagattccgttaccattactcgtgagaagaacaagatctccgtcacctccgacagcaacttctctaaaaggtaccttaaatacttgacaaagaagtacttgaagaagcacaacgtgagggattggcttcgtgtgattgcttcaaacaaagaccgcaatgtttatgagctacgatacttcaacattgctgagaatgagggtgaggaagaagactaagcaagggtttgatcttgttttatgtagttttttggcatgattttgacttggaattgttatatcagtttcttttttattcagactatgaaatattgttttgcagtaaaattaaaatttgggatctatgtgattttggcaagttttttgtggatgataaaaaagctacagttatctcaaatttagattgttcgaaagccgaaagcaaacact

SEQ ID NO: 4773 - DNA, 811 bp, Euonymus alatus
aacaaactcacataaatcccgcggcattgttgagctgtgcatctcggctgagtgattttgtgactggagaagtagggagagcaaaatgagtcgcggcactgcaacgggagcgaaggggaagaagaagggagcgacgtttgtgattgactgcgcgaagccggtggaggataagatcatggacattgcctcactggaaaagtttctcaaggagaggattaaggtcggtggcaaggctggtgccctcggtgacgccattaccgtgacacgagagaagagtaagataacagttacttccagcagcgacttctctaagaggtatctcaagtacttgactaagaagtatttgaagaaacacaatgttcgtgattggcttcgggtgatttcctccaacaaagataggaatatttatgaattgcgttacttcaacatagctgagaacgaaggggaagaggaagagtagagacctagctctgtatcttcatatattatccatttgatttacttgttttaggtttctctatatactttgtctggcagactacagacttgctgcggttgtttttgtggtttctaaagctgctgaaattttggtaacttgaaaatttgtgattctaatgttttaggggaaattggatgtgatgtagtttcttcgctttatgcttacttatttggcttagtgatacttatggcaaggaattgcattccattgtattttctgctattgatgttattaatgacaggccaaggactggttcttctcattacggttcaatttatattaaagggtggctgctttggcaggaagttacgt

SEQ ID NO: 4774 - DNA, 724 bp, Eutrema halophilum
gatcaaaacacgccgttcgtcgcttatattgttccatcctctagaattttactcggcagctacagaggtgaaaatgagtcgtggaggtgcagcagctccaaaggggaagaagaagggagtttccttcaccattgattgttcgaagcctgttgatgacaagatcatggagattgcttctttagagaagtttcttcaggagaggattaaggttggtggtaaagcaggtgctcttggtgattctgtctccataactcgtgagaagaacaagattaccgtcacttctgatggccaattctccaagagatatctcaagtacttgacaaagaagtacctgaagaagcataacgtgagggattggctaagagtgattgcagcaaacaaggaccgtaacctctatgagttgaggtacttcaacatcgctgagaacgaagcagaggaagaagactaaatccattaattttatgttcctctcttcctgttggttttgttttgattctctacaattatctctgttttttgtttagatactttttagtttgattgaagtaatactctttcttttgttgttgggttcttgagctttctatgaagtctgttttcccagacagtgttttcgatataaacgaatggagattgcgaatgattcgtttagaattttgtcgagttgatgaagattaatcatagtacaacgagaaagtatatacaatttggactaataaagttt

SEQ ID NO: 4775 - DNA, 741 bp, Eutrema parvulum
caaaaaccctagccatttgtttccgtctcctctctcgttcaagagctaatagacgccgctcgtcgcttcagagagttccaccttctaggttttgttcaagagagaagggttaaacgaaaatgagtcgtggaagtgcagccgtggccaagggaaagaagaagggagtttccttcaccattgattgctccaagcctgttgatgacaagatcatggagattgcttccctcgagaagttccttcaggagaggatcaaagtcggtggaaaagccggtgcactcggtgattctgtcacaattacccgtgacaagaacaagatcactgttacttctgatggccaattctccaagaggtatctgaagtacttgacaaagaagtacttgaagaagcacaatgtgagggattggctcagagtgattgcagcgaacaaggaccgtaacctctatgagttgaggtacttcaacatcgctgagaatgagggagaagaagaagactagaactatactcctatatttcctgtttctgttgttttggtttctgctcgttgttgctcaatacaatttatcttccgtccttctgctcttttttgacagatcttatttagtttggttgaagtttaactcttgtttcagaccgttgtttaagaacaatattttggtaaagatcgtatgattcaagaatctgtcaatgaggattaaataaattattgacgaaaatacttttagagtaagtaatagaacagtg

SEQ ID NO: 4776 - DNA, 574 bp, Tripterygium wilfordii
gggctgattgatttgtgactggaggaagtagggagagcaaaatgagtcgcggtgctggaacaggagcgaaagggaagaagaagggagcgacgttcgttattgactgcgcgaagccggtggaggataagatcatggacattgcctcactggaaaagtttcttcaggagaggattaaggtcggcggcaaggctggtgccctcggtgacgacattaccgtgacacgagagaagtctaagatcacagttacctccagcaacgacttctctaagagatatcttaagtacttgactaagaaatatttgaagaaacacaatgtgcgtgattggcttcgggtgatttcctccaacaaagataggaatgtttacgaattgcggtacttcaacatagctgagaacgaaagggaagaggaagagtagagacctagctctgtatcttatattatccatttggtttacttattttaagcttctttatatactttgcctgttagactacagacttgctgcggttgttttctgaccttccgtaatacattatctgctgaaattttggtaacttagaacggttgttctat

SEQ ID NO: 4777 - DNA, 603 bp, Brassica juncea
cgccgctcgtctcttcagacagttccacgatttgttcaagagaaagaaaaatgagtagaggaagtgcagccgttgccaagggaaagaagaagggagtttccttctccattgactgctccaagcctgtcgatgacaagatcatggagattgcttccctcgagaagttccttcaggagaggatcaaagtcggtggcaaagccggtgccctcggtgattccgtcacaatcacccgtgagaagaacaagatcaccgtcacttccgatggtcagttctccaagaggtatctgaagtacttgacgaagaagtacttgaagaagcacaatgtgagggattggctgagagtgattgcagcgaacaaggaccgtaacctctatgagttgaggtacttcaacatcgctgagaacgagggcgaggaagaagactagaagagctataactcttctgtttccggttttttgttttatgttcgttgttgctcgatacaattttatcatcgcccttgtgttctttatcgacatatcttgttttagttttgttgaagttaactcttcttggttcagacaatattttggtactatgattcaataatcggttaatgaggat

SEQ ID NO: 4778 - DNA, 621 bp, Brassica oleracea
ggttctgtctcctcagctaaaagacgccgctcgtctcttcagacaagttccaccttctacgatttgttaaagagagaagagggttgaaagatgagtcgtggaagcgcagccgttgctaagggaaagaagaagggagtctccttctccattgactgctccaagcctgtcgatgacaagatcatggagattgcttccctcgagaagttcctccaggagaggatcaaagtcggtggcaaagccggtgccctcggtgactctgtcacaatcacacgtgagaagaacaagatcaccgtcacttctgatggtcagttctccaagaggtatctcaagtacttgacgaagaagtatttgaagaagcacaacgtgagggattggctcagagtgattgcagccaacaaggaccgtaacctctacgagttgaggtacttcaacatcgctgagaacgagggtgaggaagaagactagaagatctttatactctctgtattggttgctgctcgttcgttgttgctcaatacaatttatatttcttttttcacagatcttatctagttttggttgaagttaaactcttgttttcagacaattatttgagaaaaaatatcatatgattcctgaatc

SEQ ID NO: 4779 - DNA, 645 bp, Brassica oleracea
gcgtctcctcagctgaaaatcgccgctcatctgttcagagacagttccacgatttgttcaagagaggaaaaaaaatgagtagaggaagtgcagccgtcgccaagggaaagaagaagggagtgtccttctccatcgactgctccaagcctgtcgatgacaagatcatggagattgcttccctcgagaagttccttcaggagaggatcaaagtcggtggcaaagccggtgcactcggtgattccgtcacaatcacccgtgagaagaacaagatcactgtcacttctgatggcaagttctccaagaggtatttgaagtacttgacgaagaagtacttgaagaagcacaatgtgagggattggctcagagttattgcagccaacaaggaccgtaacctctacgagttgaggtacttcaacatcgctgagaacgagggcgaggaagaagactagaagaaagaacctacactcctgtttccgtgttttttttttgtttatgttcgttgctgctcagtacaatttatcttcttccgtctgttcttttttcttgttgaagttagttttggttgaagttaacttttgtttcagacgattgcttaagaaaaaaatattttggcatgattcaattatctgttaatgatgatgatta

SEQ ID NO: 4780 - DNA, 824 bp, Brassica rapa
gtctttcacaatccaaaacaggatccacattgttctccatacgaaccatagaaactaacaataatacgctgttttaaatattggataagaaaatgcaacaacaaaaactctcaaaatgtttcttccgacagtgattccttcagaacctgagtttggtaaagaaccatctgttcttcccggtcttgaaacgttcctcgagctgggttctgtctcctcagctaaaagacgccgctcgtcatcttcagacaagttccaccttctaggctttgttaaagagagagagaagaggattgaaagatgagtcgtggaagtgcagcagttgccaagggaaagaagaagggagtgtccttctccatcgactgctccaagcctgtcgatgacaagatcatggagattgcttccctcgagaagttccttcaggagaggatcaaagtcggtggcaaagccggtgcacttggtgactctgtcaccatcacgcgcgagaagaacaagatcaccgtcacttctgatggtcagttctccaagaggtatctcaagtacttgacgaagaagtatttgaagaagcacaacgtgagggattggctcagagtgattgcagccaacaaggaccgtaacctctacgagttgaggtacttcaacatcgctgagaacgagggtgaggaagaagactagaagatctttatactcttcttgtattgttttctgctcgttcgttgttgctcaatacattttatatttcttttttcacagatcttatctagttttggttaaactcttgttttcagacaattatttgagaaaaaatatcgtatgattcctgaatc

SEQ ID NO: 4781 - DNA, 848 bp, Brassica rapa
cctttcttctcctccaccaccagaaacagactttccttgtactgaaactggagattcctcctctctctctgtatgtttatccaagtgcttctctttcgctatacttttgctgtattcctctgatttctccaaacccaactcgtcgttgttcacatcatcgagccgatcgctgctagagtccgaccacaactcgctaaaaagcttagggccataaggagctgaaaatcgccgctcatctgttcagagtcagttccacgatttgttcaagagaggaaaaatgagtagaggaagtgcagccgttgccaagggaaagaagaagggagtttccttctccattgactgctccaagcctgtcgatgacaagatcatggagattgcttccctcgagaagtttcttcaggagaggatcaaagtcggtggcaaagccggtgccctcggtgattctgtcacaatcacacgtgagaagaacaagatcaccgtcacttccgatggtcagttctccaagaggtatctgaagtacttgacgaagaagtacttgaagaagcacaatgtgagggattggctgagagtgattgcagccaacaaggaccgtaacctctacgagttgaggtacttcaacatcgctgagaacgagggcgaggaagaagactagaaggaagaactgcacactcctgtttccggtttttgtttcgttgtttgctcaaatacaattttatcatcgcccttgtgttctttattgacacatcttattttagttttgttggagttcttaactcttgtttcagaggattgtttaagaaaagtattttggtaatgattccaagaatctgttaatgaggattaaaaaa

SEQ ID NO: 4782 - DNA, 612 bp, Brassica rapa
gagctgaaaatcgccgctcatctgttcaaacagttccacgatttgttcaagagagcaaaaatgagtagaggaagtgcagccgttgccaagggaaagaagaagggagtgtccttctccattgactgctccaagcctgtcgatgacaagatcatggagattgcttccctcgagaagttccttcaggagaggatcaaagtcggtggcaaagccggtgccctcggtgattccgtcacaatcacccgtgagaagaacaagatcaccgtcacttccgatggtcagttctccaagaggtatctgaagtacttgacgaagaagtatttgaagaagcacaatgtgagggattggctgagagtgattgcagcgaacaaggaccgtaacctctacgagttgaggtacttcaacatcgctgagaacgagggcgaggaagaagactagaagaactaaaactcctgtttccggtttttgtttcgttgtttgctcaaatacaattttatcatcgcccttgtgttctttattgacacatcttattttagttttgttggagttattaactcttgtttcagaggattgtttaagaaaaatattttggttatgattcaagaatctgttaat

SEQ ID NO: 4783 - DNA, 755 bp, Phaseolus coccineus
agttttacaagacagaaaccctagtttatattggtctctcagtttgtgcctctgctgcttatcaccgtcacgagggagagagtgtgttagagagagagagaggcgcgaaaatgagcggggccaaggggaagaagaaggcatcaagcttcgtgatcgattgcgcgaagccggtggaggacaagattatggacattgcttctctcgagaagtttcttcaagagaggattaaggtcggcggcaaggccggtgcactcggcgattccgttaccgttacaagggagaagagcaagatcaccgtcacctctgacagcaacttctctaaaaggtatctgaaatatttgaccaagaagtacttgaaaaagcacaatgtgagggattggcttcgggtgattgcatccaacaaggacaggaatgtctatgagttgagatatttcaacattgctgagaatgagggtgaagaggaggactgaggatctaattctgtcttctggcatttcccttaggtttagtagttgaggagtctcttttatcatgtcttttttattgacttgttactggttgtttaaatattcctgtgtttaatttggaatcgactttattatgccttcatatgaagttttatagtgattatttgagaggttatcataaaaatcagatgtttattttttatctctctctgccagtttcgaactgaaggacttgttgcttggagtccccggccataatggccactctgcgttagaataccactgctt

SEQ ID NO: 4784 - DNA, 684 bp, Brassica napus
aaattagggctacaagagcccactttaaaagcagaaaaacccttagccatttggtctcgtctccgcagctgaaaatcgccgctcatctgttcagagacagttccacgacttgttcaagagaggaaaaaaaaaatgagtagaggaagtgcagccgtcgccaagggaaagaagaagggagtttccttctccatcgactgctccaagcctgtcgatgacaagatcatggagattgcttccctcgagaagttccttcaggagaggatcaaagtcggtggcaaagccggtgccctcggtgattccgtcacaatcacccgtgagaagaacaagatcactgtcacttctgatggccagttctccaagaggtatttgaagtacttgacgaagaagtacctgaagaagcacaatgtgagggattggctcagagttattgcagccaacaaggaccgtaacctctacgagttgaggtacttcaacatcgctgagaacgagggcgaggaagaagactagatgaactatactcctgtttccggttttttgtttatgttcgttgctgctcagtacaatttatcttcttccgtctgttcttttttcttgttgaagttagttttgtttgaaggtaacttttgtttcagacgattgtttaagaaaaaaatattttggcatgattcaataatctgttaatga

SEQ ID NO: 4785 - DNA, 629 bp, Brassica napus
ggtctccgcagctgaaaatcgccgctcatctgttcagagacagttccacgacttgttcaagagaggaaaaaaaaaatgagtagaggaagtgcagccgtcgccaagggaaagaagaagggagtttccttctccatcgactgctccaagcctgtcgatgacaagatcatggagattgcttccctcgagaagttccttcaggagaggatcaaagtcggtggcaaagccggtgccctcggtgattccgtcacaatcacccgtgagaagaacaagatcactgtcacttctgatggccagttctccaagaggtatttgaagtacttgacgaagaagtacctgaagaagcacaatgtgagggattggctcagagttattgcagccaacaaggaccgtaacctctacgagttgaggtacttcaacatcgctgagaacgagggcgaggaagaagactagatgaactatactcctgtttccggttttttgtttatgttcgttgctgctcagtacaatttatcttcttccgtctgttcttttttcttgttgaagttagttttgtttgaaggtaacttttgtttcagacgattgtttaagaaaaaaatattttggcatgattcaataatctgttaatgatg

SEQ ID NO: 4786 - DNA, 694 bp, Brassica napus
atcgccgctcatctgttcagacagttccacgatttgttcaagagaggaaaaatgagtagaggaagtgcagccgttgccaagggaaagaagaagggagtgtccttctccattgactgctccaagcctgtcgatgacaagatcatggagattgcgtccctcgagaagttccttcaggagaggatcaaagtcggtggcaaagccggtgccctcggtgattctgtcacaatcacacgtgagaagaacaagatcactgtcacttctgatggtcagttctccaagaggtatctgaagtacttgacgaagaagtatttgaagaagcacaatgtgagggattggctcagagtgattgcagcgaacaaggaccgtaacctctacgagttgaggtacttcaacatcgctgagaacgagggcgaggaagaagactagaagaactaaaactcctgtttccggtttttgtttcgttgtttgctcaaatacaattttatcatcgcccttgtgttctttattgacacatcttattttagttttgttggagttattaactcttgtttcagaggattgtttaagaaaaatattttggttatgattcaagaatctgttaatgaagattaaataacttagtcaggaaaataattcaaagtaattaattggacagtggttaattatataattcaacaattactcatgatcattc

SEQ ID NO: 4787 - DNA, 596 bp, Brassica napus
gtctcctcagctaaaagacgccgctcgtcatcttcagacaagttccaccttctaggctttgttaaagagagagagaagaggattgaaagatgagtcgtggaagtgcagcagttgccaagggaaagaagaagggagtgtccttctccatcgactgctccaagcctgtcgatgacaagatcatggagattgcttccctcgagaagttccttcaggagaggatcaaagtcggtggcaaagccggtgcacttggtgactctgtcaccatcacgcgcgagaagaacaagatcaccgtcacttctgatggtcagttctccaagaggtatctcaagtacttgacgaagaagtatttgaagaagcacaacgtgagggattggctcagagtgattgcagccaacaaggaccgtaacctctacgagttgaggtacttcaacatcgctgagaacgagggtgaggaagaagactagaagatctttatacttttcttgtattgttttctgctcgttcgttgttgctcaatacattttatatttcttttttcacagatcttatctagttttggttaaactcttgttttcagacaattatttgagaaaaaa

SEQ ID NO: 4788 - DNA, 669 bp, Brassica napus
atcaacgcagagtacgcgggggtctcctcagctgaaaatcgccgctcatctgttcaaacagttccacgatttgttcaagagagcaaaaatgagtagaggaagtgcagccgttgccaagggaaagaagaagggagtgtccttctccattgactgctccaagcctgtcgatgacaagatcatggagattgcttccctcgagaagttccttcaggagaggatcaaagtcggtggcaaagccggtgccctcggtgattccgtcacaatcacccgtgagaagaacaagatcaccgtcacttccgatggtcagttctccaagaggtatctgaagtacttgacgaagaagtatttgaagaagcacaatgtgagggattggctgagagtgattgcagcgaacaaggaccgtaacctctatgagttaaggtacttcaacatcgctgagaacgagggcgaggaagaagactagaagaagaactaaaactcctgtttccggtttttgtttcgttgtttgctcgaatacaatttatcatcgcccttgtgttctttattgacacatcttattttagttttgttggagttattaactcttgtttcagaggattgtttaagaaaaatattttggttatgattcaagaatctgttaatgaagattaaataacttagtcaagaaaa

SEQ ID NO: 4789 - DNA, 614 bp, Centaurea maculosa
ccatttcccctatctcgttgcagctcgccgtcttcaatcacagagagagagtgtgtgagagaaacagagagaagcgaagatgagtcgagcagcaggaggtgccaagggaggcaagaagaagtcggccactttcgtcattgattgtggaaagccagttgaggataagatcatggagatcgcatccctcgagaagtttcttcaggagagaatcaaggttggcggtaaagctggtaacctcggagattccgtcaccattacccgtgagaagaacaagatctccgtcacctccgacagcaacttctccaaaaggtaccttaaatacttgacaaagaagtacttgaagaagcacaacgtgagggattggcttcgtgtgattgcttcaaacaaagaccgcaatgtgtacgagctacgatacttcaacattgctgagaacgagggcgaggaagaagactaagcgcgagtttgatcttgttttatgtagttttttggcatgattttgacttggttttcttggagttgctatatcagtttctttttttattcagactatgaaatattgttttgcagtaaaattaaaatttgggatctatgtgattttggcaaaagttttgtcg

SEQ ID NO: 4790 - DNA, 759 bp, Gossypium hirsutum
atggggcgctagatcaaaagaaagcagcaaatgcacaaataaaaagccttaaaaaccctagcttgcttcttcttcttggttgccgccattccccagagcttcaacgcattctttcacgggataaactgaaaatgagtcgaacggcgggatcgaaggggaagaagaagggagttaccttcactatcgattgttcgaagccagtggaggataaaatcatggacattgcctctctggaaaagttccttcaagagagaatcaaggttggaggcaaggctggtgcacttggtgaaaccgtagcactcactcgcgagaagagcaaaattaccgtcacttccgatggcgacttctctaagaggtatctgaagtacttaacaaaaaaatacttgaagaaacacaatgtacgggattggctccgagtaattgcttccaacaaagatcgaactgtttacgagttaaggtacttcaacattgctgagaacgagggagaggaagaagattgatttcttgggtgaacaaccagttttaatgctagctgatttgccacctttttttttgtttgattgttggggctttagacaaccaggtttataaaaacttttgttatttactgaaacatgagattttgcaatggctctgttttaccaattgaatgtattttatgttttgagtttgtcaattaagcttagaaatgattttcggcctcttaaaagtgtgatttatatgttggaaattagataatgactatcttgttcttatgct

SEQ ID NO: 4791 - DNA, 615 bp, Eschscholzia californica
cgcttttcttccttccctcgaaaccctaattttcatcaccgatttcgaagaagaatgagtcgaggaaacgcagctaccccaaaggggaagaagaagacagtaaccttcacaatcgactgtgctaaaccagttgaagataagatcatggatatcgcttctcttgagaagtttcttcaggaaaggatcaaagttggtggtaaagctggtgcccttggtgatgctgttactatctctcgtgagaagaacaagatctctgttacttctgacagtaccttctccaagaggtatttgaagtacttgacaaagaagtacttgaagaaacacaacgttcgtgattggctcagggttattgccgcaaacaaagacaagaatgtttatgagcttcgatacttcaacattgccgagaacgagggagaggaggaagaatgaagagttgttatatttcaggtgtttttttacaagtcgaattcttagatatgtgtttaagttgaaggttactcttgtttaatggtaattgatgtttctttcactttggattttgatgttatattagaattttattgagtacaattaggattccttttatattgaagtttgatagttggttggttactt

SEQ ID NO: 4792 - DNA, 888 bp, Actinidia deliciosa
tgttgttgatcggccgatggctgtgggataaggggtttcgggggcgggagtagggcggcgacggtggcggacgacgggataaggcacggtctcggcggtgacatggtggcgtgcgtaacgttcttggcggttacgccactctagggtaaaagaatcctcgtgccgaattcggcacgaggcacacagccgctttagcacccaaccgagtgcaggagcgaagatgagtcgaggaacagttgcggggcccaaggggaagaagaagggagcgacgttcgttctcgactgtgggaaacctgtggaggacaagatcatggagatcgcttcactggagaagttcctccaggagaggatcaaggtcggcggcaaggccggtgctctcggagactccgtcaccgtcactcgcgagaagaacaagatcaccgtcacctccgacaacaccttttccaaacggtatcttaaatacttgacaaaaaaatacctaaagaagcacaatgtgagggattggcttcgggtaattgcttccaacaaagaacggaatgtctatgagttgcggtacttcaacattcaagagaatgaaggggaagatgaagactaaagatacatcttcttgtcatcttcatattatcttgttttgtttggctcgactgctgtagagcgccccttattacttaaagttggtgaacctatcaaactatttgttttgtttggtaagtttgttatatgccctttcgcaatttggtttacagactatggttttctggttttgttactagcagacaaggtaaatgcattagatatttttgtttgagaatcatttgtgtaaagagtggcaattagttttgatctttatattttgcttcatcttgttgatgtttctaaaaaaaaaaa

SEQ ID NO: 4793 - DNA, 625 bp, Glycyrrhiza uralensis
aaaagaaaccctagtttcgggaggaggcagtagcaggaggagagtgattgaggcgcgaagcgaaaatgagcggtgcgaaggggaagaagaaggggacgagcttcgtgatcgattgcgcgaagccggtggaggataagattatggacattgcttccctcgagaagttccttcaggagaggattaaggttggcggcaaggctggtgcactcggtgattccgttaccgttacccgggacaagaccaagatcaccgtcaccttcgacagcaacttctccaaaaggtatctgaaatacttaaccaagaagtacttgaaaaagcacaatgtgagagattggcttcgggtcattgcctccaacaaggaccggaatgtctatgagttgagatacttcaacatcgctgagaatgagggtgaggaggaagactgaagatctaattctctgtcttgaggcacactccattaggtgtaattgttgtggagtctcttttatctatgttttttatcgacttgttactgattgttttcaatatttctgtgtttaatttggaaccagttgatgccttctgcgagttttatagtgattgttggagagtttatcatataaattcagatgcagttttgcgacat

SEQ ID NO: 4794 - DNA, 637 bp, Petunia hybrida
tcgccgcagcatctcaggtagggttttgctttttctgtaatcgaagatgagtaaagtaggcgccgccaagggtgggaagaagaagggagcaaccttcgtgattgattgctcaaagccagttgaggataagatcatggatatcgcttcgttggagaagtttttgcaggagcgtattaaggttggaggaaaagctggagcacttggtgattctgttactgttactcgtgataagactaaaatcactgtcacttccgacagcactttctctaagcgatacttgaagtacctgactaagaagtatctaaagaagaacaatgtccgtgattggctccgcgttatttccgcaaacaaggatagaaatgtctatgagttaagatacttcaacattgctgagaatgaggctgaggaggaagattgaagagctggaattggatcatagcagaacatcctttatctactttagtttgtagttctttatttgtcggatacttttggctgtgtaagacatcatttacaattttgtcagtgaaattaaatcatttgcacttttgcatgttgagtggagaaatgtgattaagccgtataggagttggtttattccttatatggtgtgatgttttacggatgagctatcatt

SEQ ID NO: 4795 - DNA, 704 bp, Raphanus sativus
ggacgaaaaaccctaagtcatttggttccgtctcctcagctaaaagacgccgctcgtttattcagacagtctcaccttctaggatttgttcaagagagaagggggtttgaaagatgagtcgtggaagtgcagcagtcgccaagggaaagaagaagggagtctccttctccatcgactgctccaagcctgtcgatgacaagatcatggagattgcttccctcgagaagttccttcaggagaggatcaaagtcggtggcaaagccggtgctctcggtgactctgtcacaatcacccgtgagaagaacaagatcactgtcacttctgatggtcagttctccaagaggtatctcaagtacttgacgaagaagtacttgaagaagcacaacgtgagggattggctcagagtgattgcagccaacaaggaccgtaacctctacgagttgaggtacttcaacatcgctgagaacgagggtgaggaagaagactagaagagttattacttctgtttcgtgtttctgttgttttggtttctgctcgttgctgctcagtacaatttatcttggtacttctattgtttttttgacagatcttgtttagtttggttgaacttaaacttgtttcagacacttgtttgagaaaaatttaaagatctttatgatccaatccctaaactataagataaagtcttctattaatttgggccc

SEQ ID NO: 4796 - DNA, 640 bp, Raphanus sativus
gggttttcgtctactcaactaaaaagaaaaaagaacgccgctcgtctcttcagagagtgttccactttccaggatttgctcaagaaaaaaaaatgagtagaggaagtgcagccgttgcaaagggaaagaagaagggagtctccttctccattgactgctccaagcctgtcgatgacaagatcatggagattgcttccctcgagaagtttcttcaggagaggatcaaagtcggtggcaaagccggtgcactcggtgattccgtcactatcacccgtgagaagaacaagatcactgtcacttccgatggtcaattctccaagaggtatttgaagtacttgacgaagaagtacttgaagaagcacaatgtgagggattggctcagagtgattgcagccaacaaggaccgtaacctctacgagttgaggtacttcaacatcgctgagaacgagggagaggaagaagactagaagaagaaaaactagaacttctgtttccgcttttttgttttatgttcgttgttgctcaatacaattttatcatttcccttgtgttctttatcaacgcatcctattttagttttgttgaagttaacttttgtttaagaccattgtttaagaaaagtattttggtaatgattcaa

SEQ ID NO: 4797 - DNA, 644 bp, Raphanus sativus
gtctactcaactaaaaagaaaaaaacgccgctcgtctcttcagagagtgttccactttccaggatttgctcaagagaaaaaaaatgagtagaggaagtgcagccgttgccaagggaaagaagaagggagtctccttctccattgactgctccaagcctgtcgatgacaagatcatggagattgcttccctcgagaagttccttcaggagaggatcaaagtcggtggcaaagccggtgcactcggtgattccgtcacgatcacccgtgagaagaacaagatcaccgtcacttccgatggtcaattctccaagaggtatctcaagtacttgacgaagaagtacttgaagaagcacaacgtgagggattggctcagagtgattgcagccaacaaggaccgtaacctctacgagttgaggtacttcaacatcgctgagaacgagggagaggaagaagactagaagaagagctattacttctgtttccggtttttgttttatgttcgttgttactcaaatacaatttgtcatcgcccttgtgttcttctttatcgtcgacacatcttattttagttttgttcaagttacctcttggttcagactattgtttaagaaaaatattttggtaatgattcaagaatcttttaa

SEQ ID NO: 4798 - DNA, 641 bp, Raphanus sativus
ggttccgtctcctcagctaaaagacgccgctcgtcctcttcagacaagttccaccttctaggatctgatcaagaagatgagtcgtggaagtgcagcagttgccaagggaaagaagaagggagtctccttctccatcgactgctccaagcctgtcgatgacaagatcatggagattgcttcactcgagaagttccttcaggagaggatcaaagtcggtggcaaagccggtgccctcggtgactctgtcacaatcacccgtgagaagaacaagatcactgtcacttctgatggccagttctccaagaggtatctcaagtacttgacgaagaagtacttgaagaagcacaacgtgagggattggctcagagtgattgcagccaacaaggaccgtaacctctacgagttgaggtacttcaacatcgctgagaacgagggagaggaagaagactagaagagttattacttctgtttcgtgtttctgttgttttggtttctgctcgttgctgcccattacaatttatcttggtacttctattgtttttttgacagatcttgtttagtttggttgaacttaaacttgtttcagacacttgtttgagaaaaatttaaagatctttatgatccaatcccgaaactaaaga

SEQ ID NO: 4799 - DNA, 650 bp, Raphanus sativus
aaccctaagtcatttggttccgtctcctcagctaaaagacgccgctcgtctattcagacagtctcaccttctaggatttgttcaagagagaagggggttgaaagatgagtcgtggaagtgcagcagtcgccaagggaaagaagaagggagtctccttctccatcgactgctccaagcctgtcgatgacaagatcatggagattgcttccctcgagaagttccttcaggagaggatcaaagtcggtggcaaagccggtgcgctcggtgactctgtcacaatcacccgtgagaagaacaagatcactgtcacttctgatggccagttctccaagaggtatctcaagtacttgacgaagaagtacttgaagaagcacaatgtgagggattggctcagagtgattgcagccaacaaggaccgtaacctctacgagttgaggtacttcaacatcgctgagaacgagggtgaggaagaagactagaagaactacactactgtttctgttgttttggtttctgctcgttgctgctcagtacaatttatcttggtccttctattgttttttgtcagatcttgtttagtttggttgaacttaaactcttgtttcagacacttttgtttgagaaaaaaattaaagatctttatgatccaa

SEQ ID NO: 4800 - DNA, 643 bp, Raphanus sativus
gggctttcgtctactcaactaaaaagaaaaaaacgccgctcgtctcttcagagagtgttccactttccaggatttgctcaagagaaaaaaaatgagtagaggaagtgcagccgttgccaagggaaagaagaagggagtttccttctccattgactgctccaagcctgtcgatgacaagatcatggagattgcttccctcgagaagttccttcaggagaggatcaaagtcggtggcaaagccggtgcactcggtgattccgtcacgatcacccgtgagaagaacaagatcaccgtcacttccgatggtcaattctccaagaggtatctcaagtacttgacgaagaagtacttgaagaagcacaacgtgagggattggctcagagtgattgcagccaacaaggaccgtaacctctacgagttgaggtacttcaacatcgctgagaacgagggagaggaagaagactagaagagttattacatctgtttccggtttttgttttgtgttcgttgttgctcaatactatttatcatcgaccttgtgttcttctttatcgacaccttattttagttttgttcaagttacctcttggttcagactattgtttaagaaaaatattttggtaatgattcaagaatcttttaa

SEQ ID NO: 4801 - DNA, 594 bp, Raphanus sativus
  misc_feature (95)..(95): n is a, c, g, or t
aaaagaacgccgctcgtctcttcagagagtgttccactttccaggatttgctcaagagaaaaaaaaaaatgagtagaggaagtgcagccgttgcnaagggaaagaagaagggagtttccttctccattgattgctccaagcctgtcgatgacaagatcatggagattgcttccctcgagaagttccttcaggagaggatcaaagtcggtggcaaagccggtgcactcggtgattccgtcacgatcacccgtgagaagaacaagatcaccgtcacttccgatggtcaattctccaagaggtatctcaagtacttgacgaagaagtacttgaagaagcacaacgtgagggattggctcagagtgattgcagccaacaaggaccgtaacctctacgagttgaggtacttcaacattgctgagaacgagggagaggaagaagactagaagagctattacatctgtttccggtttttgttttgtgttcgttgttgctcaatacaatttatcatcgaccttgtgttcttctttatcgacaccttattttagttttgttgaagttacctcttggttcagactattgtttaagaaaaatatt

SEQ ID NO: 4802 - DNA, 644 bp, Raphanus sativus
ggggctttcgtctccctcgactaaaaaaaaaaagaacgccgctcgtctcttcagagagtgttccactttccaggatttgctcaagagaaaaaaaaatgagtagaggaagtgcagccgttgccaagggaaagaagaagggagtttccttctccattgattgctccaagcctgtcgatgacaagatcatggagattgcttccctcgagaagttccttcaggagaggatcaaagtcggtggcaaagccggtgcactcggtgattccgtcacgatcacccgtgagaagaacaagatcaccgtcacttccgatggtcaattctccaagaggtatctcaagtacttgacgaagaagtacttgaagaagcacaacgtgagggattggctcagagtgattgctgccaacaaggaccgtaacctctacgagttgaggtacttcaacatcgctgagaacgagggagaggaagaagactagaagagttattacatctgtttccggtttttgttttgtgttcgttgttgctcaatactatttatcatcgaccttgtgttcttctttatcgacaccttattttagttttgttgaatttacctcttggttcagactattgtttaagaaaaatattttggtaatgattcaagaatcttt

SEQ ID NO: 4803 - DNA, 772 bp, Raphanus sativus
  misc_feature (760)..(760): n is a, c, g, or t
ggacgaaaaaccctaagtcatttgggtccgtctcctcagctaaaagacgccgctcgtctattcagacagtctcaccttctaggatttgttcaagagagaagggggttgaaagatgagtcgtggaagtgcagcagtcgccaagggaaagaagaagggagtctccttctccatcgactgctccaagcctgtcgatgacaagatcatggagattgcttccctcgagaagttccttcaggagaggatcaaagtcggtggcaaagccggtgctctcggtgactctgtcacaatcacccgtgagaagaacaagatcactgtcacttctgatggtcagttctccaagaggtatctcaagtacttgacgaagaagtacttgaagaagcacaacgtgagggattggctcagagtgattgcagccaacaaggaccgtaacctctacgagttgaggtacttcaacatcgctgagaacgagggtgaggaagaagactagaagagttattacttctgtttcgtgttgctgttgttttggtttctgctcgttgctgcccattacaatttatcttggtctttttcagatcttgtttagtttggttgaacttaaactcttgtttcagacacttttgtttgagaaaaaaattaaagatctttatgatccaatcccgaaactacagattgtgggtttatgtatatccgcccccattagcacaacacccataactagtgattatcttagtgttaatttgtgaaatatgatttatgtggntttcaaatttca

SEQ ID NO: 4804 - DNA, 583 bp, Rosa hybrid cultivar
gctctcagtcttcttcatccagaaccccttcacctcttgactctccgataattgacaatgagtcgaggagctgcaggaggccccaaggggaagaagaagggagtggcttttaccattgattgtggtaagccagtagaagacaagatcatggatattgcatccctcgagaagtttctccaggagaggatcaaggttggaggcaaggctggtgccctaggtgacgctgttactgtgactcgtgacaagagcaagctgaccgtctcctctgacaacaacttctctaagagatatctgaagtacttgaccaaaaagtatctgaagaaacacaacgtccgagactggcttcgtgttattgcttccaacaaggaccgaaatgtctatgaattgaggtacttcaacatagctgagaatgaagcagaggaggaagattgatattcgggaatatttttgtcgaaccttactgttttctttgtggcactttggtgaattaatgccgttttgcaattttgttttcttaaatctagttgtgagatattgctactattggacaagattataaggtgttcaattcatgtttaaccaa

SEQ ID NO: 4805 - DNA, 777 bp, Glycine max
aaagacagaaaccctagtttatattggtgtctctgttctttgacactgctgcagcttatcatcaccatcgcgcccaagagagagagagagagagaggcgcgaaaatgagcggagcgaaggggaagaagaagggagcgagctttgtgatcgattgcgcgaagccggtggaggataaaattatggacattgcttctctggagaagttccttcaggagaggattaaggttggcggcaaggccggtgcactcggcgattccattactgtcactagggacaagagcaagatcaccgtcacctccgacagcaacttctctaaacggtatctgaaatatttgaccaagaagtacttgaaaaagcacaatgtgagggattggcttcgcgtgattgcatccaacaaggagcggagtgtctatgaattgagatacttcaacatcgctgagaacgagggtgaagaggaagactgaagatctaattctgtgtcttgaggcattttctgtttaggtttagttattgtggagtctcttttatctgttttatttatttaacttgttactggtttaaatattcctgtgttttatttggaccgacgttatgtcttcatatgaaatttcatagaggttattggagatgttgtcattaaaagtcagatgcaatacatgctactttatgttggcatgtatctttaatttggcttccatttacagttactgtgggagaagttttcagtttggcctccaatgcggcatataaaattgctgttcacgtcgattataatca

SEQ ID NO: 4806 - DNA, 448 bp, Thellungiella halophila
gatcaaaacacgccgttcgtcgcttatattgttccatcctctagaattttactcggcagctacagaggtgaaaatgagtcgtggaggtgcagcagctccaaaggggaagaagaagggagtttccttcaccattgattgttcgaagcctgttgatgacaagatcatggagattgcttctttagagaagtttcttcaggagaggattaaggttggtggtaaagcaggtgctcttggtgattctgtctccataactcgtgagaagaacaagattaccgtcacttctgatggccaattctccaagagatatctcaagtacttgacaaagaagtacctgaagaagcataacgtgagggattggctaagagtgattgcagcaaacaaggaccgtaacctctatgagttgaggtacttcaacatcgctgagaacgaagcagaggaagaagactaa

SEQ ID NO: 4807 - DNA, 657 bp, Brassica napus
atcgccgctcatctgttcaaacagttccacgatttgttcaagagagcaaaaatgagtagaggaagtgcagccgttgccaagggaaagaagaagggagtgtccttctccattgactgctccaagcctgtcgatgacaagatcatggagattgcttccctcgagaagttccttcaggagaggatcaaagtcggtggcaaagccggtgccctcggtgattccgtcacaatcacccgtgagaagaacaagatcaccgtcacttccgatggtcagttctccaagaggtatctgaagtacttgacgaagaagtatttgaagaagcacaatgtgagggattggctgagagtgattgcagcgaacaaggaccgtaacctctatgagttaaggtacttcaacatcgctgagaacgagggcgaggaagaagactagaagaagaactaaaactcctgtttccggtttttgtttcgttgtttgctcgaatacaatttatcatcgcccttgtgttctttattgacacatcttattttagttttgttggagttattaactcttgtttcagaggattgtttaagaaaaatattttggttatgattcaagaatctgttaatgaagattaaataacttagtcaggaaaataagtcaaagtaattaattggacag

SEQ ID NO: 4808 - DNA, 683 bp, Elaeis guineensis
gaggccaaaaccctaaccccagtcgtcgcagcgggtggagagagaagggagaagatgagccgcggcgggagcatggcggcgtcaaagggagggaagaagaagggttcgacgacgttcacgatcgactgcacaaagccggtggatgacaagatcatggacatcgcctccctcgagaagttcctccaggagcgcatcaaggtcgccggcggcaagcccggcgccctcggggaccaggtctctgtcacccgcgaaaagtccaagatcatcgtcacctccgagggacccttctctaagcggtatttgaagtatctaactaagaaatacttgaagaaacacaatgtgcgagactggttgcgtgtgattgcttccaacaaagaccgcagtgtttatgagctccgatacttcaacatagccgaaaatgagggcgaggaggaagaatgatggcactgtcatctgttttatttctgccaccctttgaatttagtcctgagatatttgaagttcctttttgtttcaagacaagcatatcgttactacgtctctctttgtttgagtaatagatatgaatgctgtcagctgtcatggatttctgaagcctttgggctgtggatatgtactttttatcgtattttgttgttgttttattttttttggattctattttgcatctaggctttgaactt

SEQ ID NO: 4809 - DNA, 516 bp, Manihot esculenta
atgagtagaggtggagcagctggggccggtggagccaaggggaagaagaagggagaaacatttacgattgattgctcgaagccagtcgaagataagattatggacattgcctctctcgaaaagttcctccaggaacgcatcaaggtcggtggcaaagccggagttctcggtgattccgtcaccgtcacccgtgagaagtccaagatcaccgtcacctccgactcccgcttctcccaacggtatctgaaatacttgacaaagaagcacttgaagaagcacaatgtgcgggattggcttcgggtcattgcttccaacaaggatcctaatgtttacgagctaagatactttaacattgctgagaatgaaggggaggatgaaggatagaatgtacctatttgacctttccattcccccaatctcctttttgtgttttattttgttccacacttcatctaggttcttttttttttttaactttttcgaatattttgaatttgaagaacttgaaaatttttc

SEQ ID NO: 4810 - DNA, 638 bp, Ambrosia trifida
ctcgcatcctacttccagttagcagcagcagcctttgaatctagcagaggatcaagatgagtcgtggagcaggagctgcaggagccaagggcggaaagaagaagcaatcgacgttcgttattgattgcggtaagcctgttgaagataagatcatggagattgcatcgcttgagaagtttctacaggagaggattaaggttggaggcaaagctggtaatctcggtgactctgttaccatttcacgtgaaaagaataagatctctgttactgctgatagcaatttctccaaaaggtatttgaagtacttgacaaagaagtatttgaagaaacataatgtgagagattggcttcgggtgatttcgtctaacaaggatcgcaatgtgtacgagttgcgttacttcaacattgctgagaacgagggtgaagaagaagattaaattggcagttgagcttgttttgtgtttgttttttgacctggttttctgttttaattatgttatatcagaattttgtttatggatctatgcagaactgtattgtagtggagttctgaagtttgagtgcagttgcacttgtctttattttacatctttataattttgcattagataaaagaaaaagaaaaagtaccgactgcg

SEQ ID NO: 4811 - DNA, 654 bp, Cirsium arvense
cagttgcagttcgccgtcttcgaatctagagggaagaagccaagatgagtcgtggagcaggaggtgcgggagccaagggtgggaagaagaaggcagtgacgttcgtgattgattgcggtaagcctgttgaggataagattatggaaatcgcatcgcttgagaagtttcttcaggagagaattaaggttggcggcaaggctggtaacctcggagactctgttacaatttctcgtgaaaagaacaagatatctgttacctccgatagcaacttctccaaaaggtatttgaaatacctaacaaagaaatacttgaagaaacacaatgtgagggattggcttagagtgatttcttctaacaaagaccgtaacgtgtacgagttacgttatttcaacattgctgagaacgagggcgaagaggaagactaagcagacattcgacctcagtttttatgtttgttttttttgacctggcgttggctttttagacatatgttatatcttcagtcttttctttattcttcccttgagaacagtattattgtagtagagttttgagtttaggtgcttttgcattctcatcgtcatttacttccatgggattattttcacaagatttttaattttatctatattctcttttgcgtaaaaaagaaaa

SEQ ID NO: 4812 - DNA, 581 bp, Cucurbita pepo
agcgagttgcagagaaggagcagaaatgagccgtggagcagcagcatccggtggccccaagggcaagaagaagggttcgacctttgtcatcgattgtgcgaagccagttgaggacaagatcatggacatcgcctccttggagaagtttcttctcgagaggatcaaggttggcggcaaagctggggcatttggtgactcggttaccgtcactcgcgacaagaacaagatcaccgttaactccgatagcaacttctccaagaggtatcttaaatacttgactaagaagtatttgaagaaacacaatgttagagattggcttcgggttatcgcttcaaacaaggactgcaacgtctatgaattaagatacttcaacactgctgagaatgagggcgaggaagaggattgaggttcaaggcatatattttggaagcatcgtttgtagtagtaggaattaagcttgttgaaattatatttccataccttgtcttgaagctttccatatagagatcagcaaggattctttttagtcatgagattatgcaactcttgtttactactgctgaagttttatctataaattt

SEQ ID NO: 4813 - DNA, 478 bp, Flaveria ramosissima
gtacgcggggatcgcatccagttgcagttctcgcagtctttgaatctagaggtgtgagaatcacattttgaatctagagtttcaagatgagtcgcggtgcaggagctgccggaggcaagggcggaaagaagaagacatcaacgttcgtgatcgattgtgggaagcctgttgaagataagatcatggaaatcgcatcgctcgagaagtttcttcaggagaggatcaaagtcggtggaaaagctggtaacctcggagactctgttacgatttcgcgtgagaagaacaagatctctgttaccgctgatagcaatttctccaaaaggtatctgaaatacctaacaaaaaaatacttgaagaaacacaatgtgagagactggcttcgggtgattgcttcaaacaaagaccgcaatgtgtacgagctacgttacttcaacattgcagagaatgagggtgaagaagaagactgaacctacagttg

SEQ ID NO: 4814 - DNA, 724 bp, Silene vulgaris
attgcagccgtgtttctcctcaaaccatcttcatcttctctcatttttcccagatttacagcagattcagaagtcagaaaaaatgagtaaagtcggagcagtaacaggaaagggaggtaagaagaagggagcagtaacattcactattgactgttctaaacctgttgaagacaagatcatggatattgcttctcttgagaagtttcttcaagagcgaattaaggttggtggtaaagctggtaatcttggtgatgctgttactgtttctagggagaagaacaagattactgtcacttctgactccaatttctctaagaggtacttgaaatacttgaccaagaagtacttgaagaagcacaatgtcagggattggcttcgtgtcatcgctgccaacaaggaccgtaatgtgtacgagctgaggtacttcaacattgctgagaatgaggctgaggaagaagactaggtggttccaaggtacttctgttttgtggtggtttgtaattcacgacaatatacttccgtttaaatttagattgtatttgtttgatatcttttcttttgggatgctttcgtaagcctggttttggtaattttggagaacagctagtagtgtctctggccttcatattttagcatgtcaatgatccaacttttacgtgcacatgttaatttccatcttatgagttatgagctcgatgcagtaatccaagaattatgttttcaa

SEQ ID NO: 4815 - DNA, 719 bp, Silene vulgaris
tacaggaacaatacaaaagggggaaaaatgagcaaagcagcagcaacaaagggcggtaagaagaaaggttcatcaacctttacaattgattgctctaaaccagttgaagataagatcatggatattgcttcacttgagaaatttttccaagaacgtattaaagttggcggtaaagctggtaatttgggtgattctgttactgtttctcgtgaaaagaacaagattattgtcactgctgatgccaatttctccaaaaggtacttgaagtacttgaccaagaagtatttgaagaagcacaatgtcagggattggctccgtgtcatagcggccaacaaggaccgaaatgtgtatgagcttaggtacttcaacattgctgagaatgaggcagaggaagaagactagatgtttagaaacgtcggtttcagatctttcaatatgtgttttgcttgagacatcatgcttttgtttcattttaaattgtatgagtttgacttttaatgactggcaaaatattcgtaataggattttttgtggactagtattgtgccagttgatcgacgcattgttgtctctgaaatgcagcaagtttaagatttttttggtcaatttttctgaagaagttgtcctcggcatttgtttcttggattaaagccctgattttgcctacaatttagacgtagacaactgcgattctcattttcccaacaatgagatcttct

SEQ ID NO: 4816 - DNA, 723 bp, Taraxacum officinale
attaaaccctaaagacctgttgtcccctttcaccaactcattgcattctagttgcagctcgccgtcttcgaatctagaggatcaagatgagtcgtggagcaggaggtccgggagccaagggcggaaagaagaagacatcgacttttgtgatcgattgcgggaagcctgttgaggacaagatcatggagattgcttcacttgagaagtttcttcaggagagaatcaaggttggcggcaaggctggtaacctcggagactctgttaccatttcacgcgaaaagaacaaaatctctgttacatctgatagcaacttctccaaaaggtatctgaaatacctaacgaagaaatacttgaagaagcacaatgtgagggattggcttagagtgattgcttcaaacaaagatcgcaatgtgtatgagttgcgatacttcaacattgctgaaaacgagggtgaagaggaagactgatcagattagacctttagaatttgttttatgtttatgttttgcccttttttaatttgttatatccaactttttcttttgatcagttcagaacggttttgtagtagagttttgagttttggtgatttctgaacttgttatatccaacttttctacacttgttgcatcagataatttgctattttgctgggaacacctactattttctgatgatcaattgagataatgtttccatttggaagaaaaaaaaaaaaaaaaa

SEQ ID NO: 4817 - DNA, 769 bp, Mimulus guttatus
cgcacagtcgttttcagattctgattggattcattgatttagccattgatttagctgcttgcaggcaagaagaataaaaagagagagagagcgaaaatgagcaaaggagcggcagctgcgggtgcgaaaggtgggaagaagaaggtagcaacctacgtcatcgattgttcgaagcctgtggaggataagataatggagattgcttccctagagaagtttttgcaggaaaggatcaaggtcggtggcaaggccggcgctctcggtgattctgttaccgtcacccgtgagaagagcaagattaccgtcactgccgatgctactttctccaaaaggtacctcaagtatttgacaaagaaatacttgaagaagcataatgtgagagattggctccgtgtgattgcttccaacaaagaccgaaacatctacgaacttaggtatttcaacattgctgagcaagagggagaggaagaggactagatatatagattccgattttcttcctttttgtttttgctggaacagactttttttgaatttattacttctatctgagtattgggatttaacaagactttctattttatgaatctgcatgttgggcaaatgatgctttatgttacctcttattctatcaatctctctttttcagcatgtgccgctgctatttatttgatatcgtgtattttgtaccaactatgattgtctggaggttttggtgctctcgacacttgctatttgatctgttgtagattttcatttttgttgattt

SEQ ID NO: 4818 - DNA, 600 bp, Ambrosia trifida
gtatccactatctacaacactctctatacaatcattatacaataatcaagcattttaatcaatacccattaatttatttggctccaattcgcagaaaaaagttaataaatcgaaaatgagtcgaggggcagctgcaggagcaaagggtgggaagaagaaaacggcgtcgtttgtgatagactgtggaaagccagtagaggataagataatggagattgcatcacttgagaagtttcttcaagagaggattaaggttggtggtaaagcagggaatcttggtgattctgttactatttctcgtgagaagaataaaattactgttactgctgacagtaatttctccaagaggtacttgaagtacttgacaaagaaatacctgaagaagcacaatgtgcgggattggcttcgtgtgatcgcttctaacaaagatctcaatgtttatgagctacgatacttcaacattgctgagaatgagggcgaggaggaagattaagcagcgacgataccacaacattgagaatgagggtgggggttagattaaagcaaggtttttccatgtaggatttttcatggcatgtgattcttaatttcacattatat

SEQ ID NO: 4819 - DNA, 716 bp, Euonymus alatus
ccaaccaaacacaaagcctctgagcgttacaagaaccctaaccctagctatctcgcactctaggtagccacggcgcaccagaacccttgcaagttgcaatccacaccggtaatcgttttctttaatcaagaaaaatgagcaaaggaagcggcggttcgacgaaggccgggaagaagaagggagcgaccttcacgatcgactgcggtaagccggtggaggacaagatcatggacatcgcctcgctcgagaaatttctcaaggagcgcatcaaggttgccggcaaagcgggagcccttggcgactctatcaccatctctcgtgagaagtcaaagatcaccgttacttctgattccaacttctccaagcggtatctgaagtacttgacaaaaaagtacttgaagaagcataacgtgagggattggcttcgcgtgattgcatctaataaggaccgcaatgtttacgagctcagatacttcaacattgctgaaaatgaaggcgaggaggaagattagacattctaattcagtatggattactcgagtgccctgtcttatcccttttttcttaatatgagtgaatcttttattggcaagttttggaatttcatatgaaatcttctcttctttatactgaatccttgctatgcttagttatgattttaatttctggctgctgtctattttttaaatttatccaattattattgagtgtgctgc

SEQ ID NO: 4820 - DNA, 662 bp, Artemisia annua
ggtatcaacgcagtactccgacgggggcctttcaccaattcattccagttcgccgtcttccaatcttcagaagtagcaaaaatgagtcgagcagcgggagcaaagggtggaaagaagaagacatcgacatttgtgattgattgtgggaagccagttgaggacaagattatggaaattgcttcccttgagaagtttctccaggagaggatcaaggttggtggcaaagctgggaatctcggtgactctgttaccatttctcgcgaaaagaacaagatttcggttaccgctgatagcaacttctccaagaggtaccttaaataccttaccaagaagtacttgaagaaacacaatgtgagggattggcttagagtgattgcttccaacaaggaccgcaatgtgtatgagctacgttacttcaacatcgctgagaatgagggtgaagaggaagactgagtggacagttgaccttgttttatgtttgttttttgacctcgcttgctttttaaaagatgttatatcagctttttcttcaggactgtattgtagtagagttttgagcttattaggtgcttttgcactcatctttatctatccaagtatccaactatcttctctggcctttcaaatgagcttttgaatcttctgttttcattatctatatc

SEQ ID NO: 4821 - DNA, 637 bp, Ipomoea batatas
atccatccatcgccgacttcaatcactttgttcaggcaaagaatcaagatgagcaaagggagcagtggggtcgtcaagggagggaagaagaagggggcaacgttcttcatcgactgctcgaagccagtcgatgacaagatcatggacattgcatcactggagaagttcctgcaggagcgcatcaaggtcggcggcaaggccggagccctcggcgactctgtcaccgtcacccgcgacaagacaaagatcaccgtcacctctgattccaacttttccaagaggtatttgaaatacttgacaaagaaatacctaaagaagaacaatgtgcgtgactggctccgtgttattgcttcaaacaaggatagaagtgtgtatgaactgaggtacttcaacattgccgagaatgatgcggaggacgaagattaagagtagtaatcactccttttttccagatggtattgtatttgtagttttgaactgccattatattacttgtattctctgaatcagatgttgcacctttttccttgctctacttcattagatcatcagatattgcacctctttcctgtctctactggtaaaattagattctcattgtggaattttatttttcctcatttttgttatattgtga

SEQ ID NO: 4822 - DNA, 663 bp, Ipomoea nil
cttcctcacattcccagcatccatcgcagccgacttcaatcactttgttcaggcaaagagtcaagatgagcaaagggagcagtggggtcgtgaagggagggaagaagaagggcgcaacgttcgtcatcgactgctcgaagccagtcgatgacaagatcatggacattgcatcgctggagaagttcctgcaggagcgcatcaaggtcggcggcaaggccggagccctcggcgactctgtcaccgtcacccgcgacaagacaaagatcaccgtcacctctgattccaacttttccaagaggtatttgaaatacttgacgaagaaatacctaaagaagaacaatgtgcgtgactggctccgtgttattgcttcaaacaaggatagaagtgtgtatgaactaaggtacttcaacattgctgagaatgatgcagaggacgaagattaagagtagtaatcactctttttttccagatggtattgtatttttagttttgaactgtcattatattacctgtgtttgaacatgtattctctgaatcagatgttgcacctttttcctttctctacttctcattagatcatcagatattgcacctcttttctgtctctactggtaaaattagattttcattgtggatttttatttttcctcatttttgttatat

SEQ ID NO: 4823 - DNA, 1588 bp, Papaver somniferum
  misc_feature (82)..(83): n is a, c, g, or t
  misc_feature (91)..(91): n is a, c, g, or t
  misc_feature (102)..(103): n is a, c, g, or t
  misc_feature (105)..(105): n is a, c, g, or t
  misc_feature (110)..(110): n is a, c, g, or t
  misc_feature (719)..(719): n is a, c, g, or t
  misc_feature (721)..(721): n is a, c, g, or t
  misc_feature (729)..(729): n is a, c, g, or t
  misc_feature (1079)..(1079): n is a, c, g, or t
  misc_feature (1259)..(1259): n is a, c, g, or t
  misc_feature (1271)..(1271): n is a, c, g, or t
  misc_feature (1277)..(1278): n is a, c, g, or t
  misc_feature (1289)..(1289): n is a, c, g, or t
gggtacgatgtgacgcagtgcggcgctctagtagtagtgtatgcatgagctcaggatcggagctctacactacgtctcttcnntctccaanagagtgaatcnngnaaaanaatccaaagaagagaagatgagtaaaggaacagtagcaggtgccaagggtggcaagaagaagacatcaacatacacaatcgattgtgcaaaaccagttgaagataagattatggatattgcttcccttgagaagtttcttcaagagagaatcaaagttggtggtaaagctggtgctcttggtgatgttgttactatcactcgtgagaagaacaaaatctctgttaccgctgatagtaacttctctaagaggtatttgaagtatttgacaaagaagtacttgaagaagcacaatgttcgtgactggcttcgggtgattgcatccaacaaagacaggaatgtttatgagcttaggtacttcaacattgccgagaatgagggagaggatgaagagtgaagactgcatctcgttatatattatctgttttttgatatgttgaaattttagacaaggtgaagtttactctatttagaagggccatcagtgtttcagacacttcagattttgatgccagctaaattttttgttgattactattagggtcactttattattattctcactatgaagtttggtaattgattgattagcttttgacttccgagtaaananaaaaaaanaaaaactcgagttcacttcatatcttcaaggagctacatgtaacaatggaagaatatacaaactatctcttactaacttacaacttcgtggttcaatttctccatttctagctaattgcacaaatcttcaatcacttgatctttcctcaaacctgataacaggacccattcctgatgatattcagttcttagttaatcttgctgttcttaatctctctgctaatcgactcactggtatcatcccacctcaactcgcttcctgtgcgtatcttaacatcatagatctgcataataatctgttaacgggttcaattccacagcaattagggggtttagtgagattgagttcntttgatgtttcgaataataagttatcaggtccaattccagcttcattagggaatagaagtgggaattcaccgaagtttaatgcaacttcatttatgggtaataaagatgtttacggatatccattaccaccattgaagactaaaggtttatcagtaatggctattgttggtattggtttnggaagtggattnttaagnntggttcttagntttactgctgtttgtatttggttaagggttactgaacaacaagctgttaatgctgaagaaggaaaagtatctcagtttatgcccgagtattgaagacaaatttaagctctatttccccttcaggtattgattttgattggagttactaacctaaaccgaattctagtttgatgggtctatctagtttttttctttctttctggttttactgatttgtggatgtttttttttgggttttgattaatattttttgtacttaaattaacatgcaatgtaaaactaattcacatttgaattcc

SEQ ID NO: 4824 - DNA, 577 bp, Brassica napus
gtctcctctcactcgttcaaccggcgccgctcgtcttcaaggaaaggtttgagagaaaatgagtcgcggagctgcagccgttgccaagggaaagaagaagggagtgtccttctccattgactgctcgaagcctgtcgatgacaagatcatggagattgcttccctcgagaagttccttcaggagaggatcaaagtcggtggcaaagccggtgcccttggtgattccgtcacaatcacacgtgagaagaacaagatcactgttacctccgaaggccaattctccaagaggtatttgaagtacttgacgaagaagtacttgaagaagcacaatgtgagggattggcttagagtgattgcggctaacaaggaccgtaacctctatgagttgaggtacttcaacatcgctgagaacgagggcgaggaggaagactagaagagcgctctactcttgtttttgcctgtttcttctgttgttttggtttctgctttttgctgctatcaatacaatttatcttggttctttttttgtgagagatcttatctagttttggttgaagttaattatcgtttcagactc

SEQ ID NO: 4825 - DNA, 435 bp, Euphorbia peplus
ctaaaggcaagaagaagggagcaactttcactatcgactgtgctaaaccagtggaggataagattatggacattgcctctctcgagaaattccttcaagacagaatcaaagttggtggcaaggctgctcttggtgattccgtcactgtttcccgtgacaaaaacaagatcaccgttacctccgataccaacttctccaagaggtatctcaagtacttaacaaagaagtatttgaagaaacacaatgtgagagattggctaagagtgattgcagccaacaaagatcgaagtgtatacgaattgaggtacttcaatattgctgagaacgagggagaagaggaagactgacttcgaacatcttttccatagaatttagtgagttttgaacttgttgtttactgtttgggtttgatgctctgctacaattttcgactca

SEQ ID NO: 4826 - DNA, 753 bp, Primula obconica
actagagtagcggcgaagatgagcaaatcaacggcgacgaaggggggtaagaagaaaggagtgacgttcacgattgattgtgcaaagccggtggaggataagatcatggagattgccacactggaaaagtttctccaggagaggattaaggtcggcggcaaggctggtgctctcggtgacgctgtcaccgtcgcccgtgacaagaccaagatcaccgtcacctctgacgccaatttctccaagaggtatctcaagtacttgacaaagaaatacttgaagaaaaacaatgtgcgtgattggcttcgtgtcattgcatcgaacaaggatcgcaatgtttacgagctcagatactttaacattgctgagaatgagggagaagaggaggattgatttcccagctgaaggcattcctatatcgtcccagtattttgttttagttttcgagtgtttttatgtgctttggatcttttcatttaattttgtagttgcgttattggaatatgcaaaattagttttgctttcttgaatgaatgacttttgaaagatatttatgcagcttttatttgtttccaggccttcactgcttatattttttccattttttgtgggttgattttgccagatcaaaattttagggatttgttaagattatgcttaggtgttaaatgatcttgattttctgggtttaaatgattatttggtgaattaaatttaaattggttttttaggtcatttgcattttagataatctgt

SEQ ID NO: 4827 - DNA, 730 bp, Eutrema halophilum
ggcagaaaccctagacatttgcttccgtcttctctcgttcaagagcctaaaagacgccgctcgtctcttcagacagttccaccttctaggatttgttcaagagagaagggttgagaaatgagtcgtggaagtgcagccgttgccaagggaaagaagaagggagttgccttcaccattgattgctccaagcctgtcgatgacaagatcatggagattgcttccctcgagaagttccttcaggagaggatcaaagtcggtggtaaagccggtgccctcggtgattccgtcacaatcacccgtgacaagaacaagatcaccgtcactgctgatggccaattctccaagaggtatctgaagtacttgacaaagaagtacctgaagaagcacaatgtgagggattggctcagagtgattgcagcgaacaaggaccgtaacctctatgagttgaggtacttcaacatcgctgagaacgagggagaggaagaagactagaaaaaccctttaaaccggttttgcttaggacgatacttcctattccctgtttctgttgttttggtttctgctctctgttcgaatacaatttattatcttcgcccttccgttgtttttgacagatcttatttagtttggttgaagttaactcttcttcttggtttcagacaattgtttaaggaaaatatattttggtaaaaatcgtatgattctagaatgtgttaatgaaagcctttat

SEQ ID NO: 4828 - DNA, 579 bp, Trigonella foenum-graecum
tgagcggagtcaagggaaagaagaaggcaacaaccttcgtgatcgattgcgcgaagccggttgaagataagattatggatatcgcgtccctcgagaagtttcttcaggagaggattaaggttggtggtaaagctggtgctctcggtgattccgttactgttactcgtgaaaaatccaagatcaccgtcacctctgatagcaatttctccaaaaggtatctgaagtacttaaccaagaagtacttgaaaaaacacaatgtgagggattggcttcgtgttattgcgtccaacaaggaccgcaatatctatgagttgagatacttcaacattgctgagaatgagggtgaagaggaggactgaagatattgttctgtgtcttgaggcattctccattaggtgtaattgctgtggattctcggttatctatgttttttgtcaacttgttactggttgtttaaaattttgcgtgtttaaattggaaccaattatttccccttgcaagttttatagttattattggagattttgtcgtaaaaattcagatgcaattatttatttgctatcattgtttaatttcctc

SEQ ID NO: 4829 - DNA, 662 bp, Acacia harpophylla
ggactccggggagacctgtattagaaggaggcctctgcgactgtgtgattgtgtgactccgccgagacgccagaatgagccgcgaggcagcaactggagccaagggcaagaagaagggagtcagcttcgtgatcgactgtgcgaagccggtcgaagataagatcatggacgttgcctcgcttgagaagttccttcaggagaggattaaagtcggtggcaaagccagtgtcctcggtgattcagtcaccgtcactcgtgacaagagcaaaatcaccgttacttccgacagcaatttctctaaaaggtatttgaaatatttgacgaagaagtacctgaagaagcataatgtgagggattggcttcgtgtgattgcgtccaacaaggagcgcaatatctatgaattaagatacttcaacatcgccgagaacgagggagaggaggaagactagaggtccgagtctgtcacggggcattaagccgctcccaactaggctgtgttattgtggagtttccttcgtcgttgtttattatattaacttttagtggttaattaatattcttgtgtttcttttttgttgatcaacttttcgtccgtttaagttttatactgtagtgatcattctaattattaaaactggttttgaatgagcacatatgtttgc

SEQ ID NO: 4830 - DNA, 655 bp, Arabidopsis lyrata
aaaaaaccctaattgcatttttcttcttctctttcaaagatcaatagacgccgctcttcgcttcacacagttcccatcttcttcaacttcagaggtgaaaatgagtcgtggtaatgcagcagcgactaagggaaagaagaagggagtttccttcactatcgattgttcgaagcctgtggatgataagattatggagattgcttctttagagaagtttcttcaggagaggattaaggttggtggtaaagctggtgctcttggtgattctgtttctatcactcgtgagaagagcaagattactgtcacttctgatggtcaattctccaagagatatctcaagtacttgacaaagaagtacttgaagaagcataacgtgagggattggctcagagtgattgcggcaaacaaggaccgtaacctctatgagttgaggtacttcaacattgccgagaacgaagcagaggaagaagattaaaaaacggttttgggctagtgctatatcctctgttcctctctttctgttggtttggttttgattcttcaattatcttctgttttgtgttagatattatttagtttgattgaagtaatactcgtttccttttgttgttgcgaaacttgagattttctatggagtctatttcttctaaacagt

SEQ ID NO: 4831 - DNA, 705 bp, Arabidopsis thaliana
aaaaaaacctaataacatcttcttcttcgtcttcaaagatcaaaaaacgccgctcctcttcacacagttccatcttcttcaacttcagaggtgaaaaatgagtcgtggtaacgcagcagcagctaagggaaagaagaagggagtttccttcactatcgattgttctaaacctgtggatgataagattatggagattgcttctttagagaagtttcttcaggagaggattaaggttggtggtaaagctggtgctcttggtgattctgtttctatcactcgtgagaagagcaagatcactgtcactgctgatggtcaattctccaagaggtatcttaagtacttgacaaagaagtacttgaagaagcacaacgtgagggattggcttagagtgattgcggcgaacaaggaccgtaacctctatgagttgaggtacttcaacattgccgagaacgaagctgaggaagaagattaaaaccggttttggtctagtgctatatcctctgttcctctatttctgttggtttggttttgattcttcagttttgtgttagatattattatgtagtttgattgaagtaatactctttgcttttgttgttgcgtacttgagattttctatggagtctatttcttccaaacagtaatgatgtgaaattggactaatatgatttagggtttgattaagttattcattggaggataaaa

SEQ ID NO: 4832 - DNA, 688 bp, Artemisia annua
agtactccgacggggactcttcctcacatttccctttagcagcagcagccgtcttccaaaccaaccacaaagtttgtaggagaaagattcagaagtgaagatgagtcgtggagcagtagcaaagggtggaaagaagaaggtctccaccttcgtgattgattgtggtaagccagttgaggacaagatcatggagattgcttcacttgagaagtttctccaggagaggatcaaggttggtggcaaagctggaaacctcggtgattcagttactatttcacgtgagaagaacaagatctccgtcactgctgacagcaatttctcaaagaggtacctaaaatacttgacaaagaagtacttgaagaagcacaacgtgagagattggcttcgtgtgattgcctcaaacaaggaccgcaacgtttatgagctaagatacttcaacattgctgagaacgagggtgaggaggaagattaagcagggggcgtctatcttgtcttatttagttttgtttggcatgggctttgtagactttatatattggtttctgttttcttcagacttccagatattgttttgcagtaaaatttctggtctatgtgattttgcaaaagcctatagttaaattcatgagatactgttttctaccaaaaaaaaaaaaaaaaacatgtcggatctagaatcgtgtctgat

SEQ ID NO: 4833 - DNA, 425 bp, Brassica juncea
gacgccgctcgtctcttcagacagtctcaccttctaggatttgttcaagatgagtcgtggaagtgcagcagttgctaagggcaagaagaaaggagtttccttttccattgactgctcaaagcctgtcgatgacaagatcatggagattgcttccctcgagaagttccttcaagagaggatcaaagtcggtggcaaagccggtgcgctcggtgattctgtcaccatcacccgtgagaagaacaagatcactgtcacttctgatggccagttctccaagaggtatctgaagtacttgacgaagaagtacttgaagaagcacaatgtgagggattggctcagagtgattgcagccaacaaggaccgtaacctctatgagttgaggtacttcaacattgctgataacgagggagaggaagaagactaga

SEQ ID NO: 4834 - DNA, 622 bp, Brassica oleracea
gagccacattttgtttcctcgtctcctctcactcgttcaaccggcgccgctcgtcttcaaggaaaggtttgagagaaaatgagtcgcggagctgcagccgttgccaagggaaagaagaagggagtgtccttctccattgactgctcgaagcctgtcgatgacaagatcatggagattgcttccctcgagaagttccttcaggagaggatcaaagtcggtggcaaagccggtgcccttggtgattccgtcacaatcacacgtgagaagaacaagatcactgttacctccgaaggccaattctccaagaggtatttgaagtacttgacgaagaagtacttgaagaagcacaatgtgagggattggcttagagtgattgcggctaacaaggaccgtaacctctatgagttgaggtacttcaacatcgctgagaacgagggcgaggaggaagactagaagagcgctctactcttgtttttgcctgtttcttctgttgttttggtttctgctttttgctgctatcaatacaatttatcttggttctttttttgtgagagatcttatctagttttggttgaagttaattatcgtttcagactcttgtttaagagaagaatatcttggc

SEQ ID NO: 4835 - DNA, 693 bp, Brassica napus
atcaacgcagagtacgcggggagccacattttgtttcctcgtctcctctcactcgttcaaccggcgccgctcgtcttcaaggaaaggtttgagagaaaatgagtcgcggagctgcagccgttgccaagggaaagaagaagggagtgtccttctccattgactgctcgaagcctgtcgatgacaagatcatggagattgcttccctcgagaagttccttcaggagaggatcaaagtcggtggcaaagccggtgcccttggtgattccgtcacaatcacacgtgagaagaacaagatcactgttacctccgaaggccaattctccaagaggtatttgaagtacttgacgaagaagtacttgaagaagcacaatgtgagggattggcttagagtgattgcggctaacaaggaccgtaacctctatgagttgaggtacttcaacatcgctgagaacgagggcgaggaggaagactagaagagcgctctactcttgtttttgcctgtttcttctgttgttttggtttctgctttttgctgctatcaatacaatttatcttggttctttttttgtgagagatcttatctagttttggttgaagttaattatcgtttcagactaaaaaaaaaaaaagaaagaagctccaggctggggtcgcctctacgtgatggccatatactagtgtggtctcccttcc

SEQ ID NO: 4836 - DNA, 657 bp, Brassica napus
atcaacgcagagtacgcgggggtctcctcagctaaaagacgccgctcgtctcttcagacaagttccaccttctacgatttgttaaagagagaagagggttgaaagatgagtcgtggaagcgcagccgttgccaagggaaagaagaagggagtctccttctccattgactgctccaagcctgtcgatgacaagatcatggagattgcttccctcgagaagttccttcaggagaggatcaaagtcggtggcaaagccggtgcactcggtgactctgtcacgatcacacgtgacaagaacaagatcactgtcacttctgatggtcagttctccaaaaggtatctcaagtacttgacgaagaagtatttgaagaagcacaacgtgagggattggctcagagtgattgcagccaacaaggaccgtaacctctacgagttgaggtacttcaacatcgctgagaacgagggagaggaagaagactagaagatctttatactcttcttgtattggtttctgctcgttcgttgttgctcaatacaatttatatttcttgtttcacagatcttatctagttttggttgaagttaaaacttttgttttcagacaattatttgagaaaaaaaatatcgtatgattcctgaatcttttattggggattaa

SEQ ID NO: 4837 - DNA, 688 bp, Liriodendron tulipifera
aaaaagcctctttctccacccagcgagtcttcgctcctgacacgggatcgaggagctgctaaaatgagccgagggagtgcagcgggccccaaggggaagaagaaggtatcaacgttcacgatcgattgtgcaaagcccgtggaggacaagatcatggacatcgcttcccttgagaagttcctgcaggagaggatcaaggtcggcggcaaggccggctcccttggcgatgtcattaccattgcccgcgacaagaacaaaatcatggttacctccgacagtgcattctccaagcggtatttgaagtacctgacaaagaaatacttgaagaagcacaatgtgcgtgattggctgcgagtaattgcgtcgaacaaagaccgcaacatgtatgagctacgttacttcaacattgcggagaatgaaggggaggaggaagactgagcatatttttccttcttttttttattattattatccattttgccatattttctacttttcttttaatttttggcaaagtatcccaaactagtggttagtaggcttgtggtttctttcaagcatagtgtcttttgtttagagaagtggagtgtggagctaggtttttttctcctcgttgatattcgatagatggattttttttttaatgaatcattgcttcattataataagcaggtgtattgatttctgg

SEQ ID NO: 4838 - DNA, 644 bp, Lotus japonicus
gttatcagaaagaaggtgtaggaggaagagttgcagagtgagagagagagaggtgcgaagatgagtggagcgaaggggaagaagaaggcgacgagcttcgtgatcgattgcgcgaagccggtggaggataagatcatggacatcgcttcccttgagaagtttctgcaggagaggattaaggtcggcggcaaagctggtgcgctcggcgattctgtcactgtttctcgtgagaagagcaaaatcaccgtcacctccgatagcaacttctccaaacggtatctgaagtacttaaccaagaagtacttgaaaaagcacaatgtgagagattggctacgtgtgattgcctccaacaaggaccggaatgtctacgagttgagatacttcaacattgctgagaatgagggtgaggaggaagactgaagatctaagactctgtcttgaggcattatccattaggtgtaattgttgcggaaattgcttttaatctatgttatgtatcgacttttttctggttgtttaaattttcattgtgaaccaatgttatgccatagaattcagatacacagttcgcatcttacatgttgggattgctatcttttatttggtcactatttactaattacagcaggagatatgtttgagtt

SEQ ID NO: 4839 - DNA, 668 bp, Medicago truncatula
attgaataatataatataaactcggggggttttgtatgacggaaaccctagttttgcatcatcaggaacaagggggtgaagtctgaacgcgaaaatgagcggagtgaagggtaagaagaagggaacaagcttcgtgatcgattgcgcgaagccagttgaggataagattatggatatcgcttccctcgagaagtttcttcaggagaggattaaagttggcggtaaagctggtgctctcggtgattccgttactgttactcgtgaaaagtccaagatcaccgttacctccgacagcaatttctctaaaaggtatttgaagtacttgaccaagaagtacttgaaaaagcacaatgtgagggattggcttcgtgttattgcatccaacaaggaccgcaatatctatgagttgagatacttcaacatcgctgagaatgagggtgaagaggaagactaaagatcttgttctctgtcttgaggcattctccattaggtggtgtagttgctgtggagtctcgtttatctatgttttttgtcaacttgttactggttgtttaaaattttgtgtttactttggaaccaattatttccctaccaagttttatagttattattggagactttgtcataattcagattcagttatttatatgctggcatggttaaattta

SEQ ID NO: 4840 - DNA, 692 bp, Tropaeolum majus
ataattgcagtgtaccctgttattcttccaaaccctaatatttcttctcatatatattctgtattcaatcttagccgctgttagctcctctttctcaggttctgccatttttttcttgattcagagaagttatttgaaaatgagtcgcactacgggagttaagggaaagaagaagggagtgaccttcaccattgactgtgctaagccagtggaggacaaaatcatggacattgcttcccttgagaagttccttcaagagagaatcaaggttggaggcaaggctggtgctcttggtgattccgtcagtattgtacgtgaaaaaaccaagattgttgtcacttcagacagtaccttctccaaaaggtacctcaagtatttgactaagaaatacttgaagaaacacaatgttcgtgattggcttagggtgattgcagccaataaggaccgtactgtctacgagctaagatacttcaacattgctgagaacgatgctgaggaagaagattgagcgtattaatcagttttatctaaaagctagttaccttaatttcaaatttttttgtttagagagttatgtgattctacttttaatcaattctgtttgtttacaatcatgttgctatgtttttggaatttagaaatggaagaatatctctgtttaaaagtttatatttcattgctgtggtttgtgt

SEQ ID NO: 4841 - DNA, 708 bp, Orobanche aegyptiaca
ttagaccatctcacgaaaccctaataaaccattattactgagttgcgccatttcactctcttctacacgaacttcacatagtcggccgtcgatccacacccatttacaggctttattaaaaaaaataacgaagatgagcaaaggcgtagcagcttccaaaggcgggaagaagaagggatcgagcttcacgatcgattgttcgaagcctgttgaggataagatcatggagattgcttcgctcgagaaatttttacaggaaaggattaaggtcggcggtaaagccggcgctctcggagattctgttactgttacccgggagaagaacaagatcacggtcactggtgatgcgaccttctccaaaaggtatctcaagtatttgacgaagaaatacttgaagaagcataacgtgcgagattggcttcgagtgattgcttccaacaaagaaaggaacgtgtatgaacttcgttacttcaacatcgccgagcaagagggagaggaagaagattaatcatagagattggtttcttattacgacctttttgcttcagttcggttttatcagaaccgttttcttggatttatttatctttgttttttccacctggaatttcgtaaacttcctactaaaatgagcttgaaatctggattttgatgctttcttttgcgccttattttatatataagtagtgccgtggcagtatatctcgt

SEQ ID NO: 4842 - DNA, 644 bp, Petunia hybrida
cgcgggggctcttcacagtttctcccatagccgcagctgattcctaacaactactcaggaaagatgagtaaagctggagccacaaaagggggaaagaagaagggagcaaccttcgtaattgattgtgcaaagccagttgatgataagattatggaaattgcttcacttgagaagttccttcaggaacgtattaaagttggtggtaaagctggtgctcttggtgactctgttactgttactcgtgacaaaaccaaaattaccgtcacttctgacagcaccttctccaagaggtatttgaagtatttgaccaagaaatatcttaagaagaataacgtccgtgactggcttcgagttatttcctcaaacaaggatcgcaatgtgtacgaactccggtacttcaacattgctgagaatgaggctgaggaggaagattgagaacttgaagcagtaggttgtagttctctttttgtttgatattgttgcttgcgctcatatttagactttctgtcggaatcaaatcttttgcatttttgcccggtttcaagggagaaatgagattgtgttactggagttggtttattttttctatctttacctctttaagtctttttgttgccgggtaaatgttactacttctcatgtca

SEQ ID NO: 4843 - DNA, 597 bp, Raphanus sativus
  misc_feature (21)..(21): n is a, c, g, or t
ctcctctctctctcgttcaanagctaaaagacgccgctcgtcttcaagaaaaaggttgagaaaatgagtcgtggagctgcagcagttgccaaggggaagaagaagggagtgtccttctccattgattgctcaaagcccgtcgatgacaagatcatggagattgcttccctcgagaagttccttcaggagaggatcaaagtcggtggcaaagctggtgcgcttggtgattctgtcacaatcacccgtgataagaacaagatcactgtcacttctgatggccaattctccaagaggtacctcaagtacttgacgaagaagtacttgaagaagcacaatgtgagggattggctgagagtgattgcggccaacaaggaccgtaacctctatgagttgaggtacttcaacattgctgagaacgagggagaggaagaagactagaagagctactatactcgtaccttcttgtttctggttattttgttttctgctgctctttgctgttcagtacaatttgtctccgttctttttttttgtgacagatcttatctagttttggttgaagttataactcttgttttagagagtttgataaaaaaa

SEQ ID NO: 4844 - DNA, 645 bp, Glycine max
aaaccctagcctagtgctcatcaccatcgcaaggggagaaagggagaggcgcgaaaatgagcggagcgaaggggaagaagaagggagcgagcttcgtgatcgattgcgcgaagccggtggaggataagattatggacattgcttctctggagaagttccttcaggagaggattaaggtcggcggcaaggccggtgcactcggcgattccattaccgtcaccagggacaagagcaagatcaccgtcacctccgacagcaacttctctaaacggtatctgaaatatttgaccaagaagtacttgaaaaagcacaatgtgagggattggcttcgcgtgattgcatccaacaaggagcggaatgtctatgagttgagatacttcaacattgctgagaacgagggtgaagaggaagactgaagatctaattccgtgtcttgaggcattttctattaggtttagttactgtggagtctcttttatctgtgttgtttatttgacttgttactggttgaaatattcctgtgttttatttggaccaacttttatgccttcatatgaaattttatagagattgtttgataaaaagtctgatgccaatacatgctactttatgtcggcatgcatctttaatttggttaccatttac

SEQ ID NO: 4845 - DNA, 868 bp, Fragaria vesca
tagtttcacttgttaagctaatgctatgaatttctattttttgtaaacaataatatgtggcaaccgtgccacgtgtaagatctaatctgaattaaaacacagtatgctacacccgtttgcacctgattgctgtcctcgactagtaaaaccctaacgtctgcttcctctttatattagcacaacgctgccgcctcacctctttcctctcagtcttcttcactcacaagcacaacccctcatctctcgctctccggataattgacaatgagtcgaggagctgcagcaggccccaaggggaagaagaagggagtggcttttaccattgattgtggtaagccagtagaagacaagatcatggatattgcatccctcgagaagtttctccaggagaggatcaaggttggaggcaaggccggtgcccttggtgactctgttactgtgtctcgtgacaagaataagctgactgtctcctctgacagcaacttctctaagagatatctgaagtatttgacgaagaagtatctaaagaaacacaatgtccgagattggcttcgtgtgattgcatccaacaaggaccgaaatgtctatgaattgaggtacttcaacatagctgacaatgatgccgaggaggaagactgagattctggaatatttgtcatcaaatgctgtttttgttgtggcactctgttgaggttaatgctgttttgcaattttgttttcgtaatctagttgtgagatattgatactattggacaaggtttatggtgttcaattcatgtttaaccaattgtcgatggcttatcaaattttcctgctcaaaattggtcagtagatcatgacttgaatcaacaaatctactttcaagctc

SEQ ID NO: 4846 - DNA, 589 bp, Helianthus annuus
caggtcgccgtcttcaatcaccacagttcgtagaaaaacatacacaatcgaagatgagtcgcggagcagtagcagcaaagggcgggaagaagaaaacggcgacgtttgtgatcgattgtggaaagccggtagaggataagatcatggagattgcgtcacttgagaagtttcttcaggagagaattaaggttggcgggaaagctgggaatctcggggattctgttacgatttctcgtgagaagaataagatctctgttactgctgatagcaatttctccaaaaggtacttgaaatacttgacaaagaaatacttgaagaagcacaatgtgcgggactggcttcgtgtgatcgcgtctaacaaagaacgcaatgtttatgagctacgatacttcaacattgctgagaacgagggtgaagaggaagattaagcaagtttattatttaggttttttttttctggcatgtgattttgaaacttattatatcttgttttttttttacttcagatttttagatattgttttgcagtaatatttatgctttatgtgcctttgcgcgttctttgttaaaagcgatcacacaaaaccct

SEQ ID NO: 4847 - DNA, 648 bp, Thellungiella halophila
ggtcttctctcgttcaagagcctaaaagacgccgctcgtctcttcagacagttccaccttctaggatttgttcaagagagaagggttgagaaatgagtcgtggaagtgcagccgttgccaagggaaagaagaagggagttgccttcaccattgattgctccaagcctgtcgatgacaagatcatggagattgcttccctcgagaagttccttcaggagaggatcaaagtcggtggtaaagccggtgccctcggtgattccgtcacaatcacccgtgacaagaacaagatcaccgtcactgctgatggccaattctccaagaggtatctgaagtacttgacaaagaagtacctgaagaagcacaatgtgagggattggctcagagtgattgcagcgaacaaggaccgtaacctctatgagttgaggtacttcaacatcgctgagaacgagggagaggaagaagactagaaaaaccctttaaaccggttttgcttaggacgatacttcctattccctgtttctgttgttttggtttctgctctctgttcgaatacaatttattatcttcgcccttccgttgtttttgacagatcttatttagtttggttgaagttaactcttcttcttggtttcagacaattgtttaagg

SEQ ID NO: 4848 - DNA, 1006 bp, Triphysaria pusilla
ggcgtggttgagtttatccttttgccctattacagatctgagcctcatattgtaattttttcttggctaagtagttttttaaatttttggtctatattgttgttttttggtttgttgcacccagtgaaaaggaaaaaggatcgaaaaacttgaatcgagataaaattgatggttcgtagatgctcgtcttgctcggcttcaaaaccctagacccagcagctcccagtctctcttatatccccatttcacttttctctccacaaactccacgcagtcgcctgtcaattccatatccgaaaaagtagcaaagatgagtaagggcgcggcggcggcgaaaggagggaagaagaaggggtcgagcttcgtgatcgattgctcgaagccggtggaggataagattatggagattgcttcattagagaagtttttgcaggagagaatcaaggtcggagggaaagccggcgctctcggtgattctgtcaccgttagtcgtgagaagaacaagatcactgttaccgctgattcgaatttctccaaaaggtatctcaagtatttgacaaagaaatacttgaagaagcataacgttagggattggcttcgggtgattgcttccaacaaagaacgcaatgtttatgagttgcgctacttcaacattgctgagcaagagggagaggaagaggactaaacttttagattggtaacatgttgatcatttgtcagagccactttttggattcatttatgttgttggttctacactccttatcttgactttgcatttttggttaatgtgacattttatgttgccttgttaattgtattggtaccttattatcaaggtgattcttatatagatctagtgctttcaatgcctaatccctcaagtgatttataaaaaagttttgttaaatcatgtgggttattgagttggctgtgctgtattttctgttaaactcaggtcgaaataatatcttgagtgatgaataccaagaaaaaaaaaaaaaaa

SEQ ID NO: 4849 - DNA, 669 bp, Brassica napus
ctcctcagctaaaagacgccgctcgtctcttcagacaagttccaccttctacgatttgttaaagagagaagagggttgaaagatgagtcgtggaagcgcagccgttgccaagggaaagaagaagggagtctccttctccattgactgctccaagcctgtcgatgacaagatcatggagattgcttccctcgagaagttccttcaggagaggatcaaagtcggtggcaaagccggtgcactcggtgactctgtcacgatcacacgtgacaagaacaagatcactgtcacttctgatggtcagttctccaaaaggtatctcaagtacttgacgaagaagtatttgaagaagcacaacgtgagggattggctcagagtgattgcagccaacaaggaccgtaacctctacgagttgaggtacttcaacatcgctgagaacgagggagaggaagaagactagaagatctttatactcttcttgtattggtttctgctcgttcgttgttgctcaatacaatttatatttcttgtttcacagatcttatctagttttggttgaagttaaaacttttgttttcagacaattatttgagaaaaaaaatatcgtatgattcctgaatcttttattggggattaaataaaataattattcagattaaaaaaaaaaaaaaa

SEQ ID NO: 4850 - DNA, 589 bp, Platanus occidentalis
gttatttgttagtttaaagtagtaagtagagtcgccgccccgaagggcaagaagaagggggcgagcttcgtcatagactgtgcgaagccggtggaagacaagatcatggatatcgcgtccttggagaagttcctgcaggagaggatcaaggttggaggcaaggctggtgccctcggcgattccattaccatttcccgcgataagaacaagatcaccgttacctccgataatcctttctccaagaggtatttgaagtatctaacaaagaaatacttgaagaagcacaacgtgagggactggctgcgggtgattgcatccaacaaagaccgcaacatgtatgagctgcgatacttcaacattgctgagaatgagggcgaagaagaggattgattgatccatcagtttccttgtgttttcctttccgccagttcagtttatcattgtaggaacacagtaccagttttgctttcagaggaactaattagtgtacctgaattttgcccacttgttccttaactgtccaagtgattaaaatatcatattgagcacagcgttttagtatgtgtttgttcatttgattgttctgtct

SEQ ID NO: 4851 - DNA, 757 bp, Amorphophallus konjac
gccgaagcgagaggcgccgccgcaggaagcattggcaggaagaagagatgagccgcgggggcagcgccggaccgggggtgcgaaagggaaagaagaagggcgccacgaccttcaccatcgactgcgcgaagcccgtggaggacaagatcatggacatcgcctccctggagaagttcctgcaggagcgcatcaaggtcgccggcggcaagcccggcgccctcggtgacgccgtcaccgtctctcgcgacaagaacaagatcaccgtcacctccgaggggcccttctccaagaggtacctgaagtacttgacgaagaaatatttgaagaagcacaacgttcgggactggctgcgagtgattgcatctaacaaagaccgcaacgtgtatgagctgcggtacttcaacattgcagagaacgagggagaggaggaagactgatttcgttacaactttcatgtctgtgttgaggttgtctttaggttcagagttttgtttggagaaacctgctatattaaagatttcttttttcttcagtcgataggtttctagtcccacctacctttctttccatcatgaatatgctgggaaattcgatattgaattcccttatcccctgcttagcaatctcctactttttaatgatgtattggagtcgttgtttttgccaactttgatcgaagcgaagtttgggtttttgttgatttgtggatgtgttgtgacgatgagcaatgcttgcctaaatgagatctcctactgaa

SEQ ID NO: 4852 - DNA, 760 bp, Eucalyptus grandis
ctctctccttttactctcctccgattctcagcggcgcgccatcatcagcagagcagctccaaagtcgcagaaggcgtggtaggtaaagcgtattctagttccggtcgggagagatgagcagaggagggagctccggcggcggcggcgccaaggcggcgaagaagaagggggcgacgttcgtgatcgactgcgccaagccggtggaggacaagatcatggacatcgcctccctcgagaagttcctccaggagcgcatcaaggtcgacggcaaggccggcgccctcggcgactccgtcaccgtctctcgcgacaagtccaagatcaccgtcacctccacctccgacttctccaagcggtaccttaagtacctgacaaagaagtacttgaagaaacataatgttcgggattggctccgcgtgattgcttcaaacaaggaccgcagtgtctatgagcttaggtacttcaacattgctgagaacgagggagaggaggaagattaagaatctgctcaaaagatttcgtttccgacatttcaatgttgttattggattttggttgttactctggtttttggattgcaaacagattttccttgtcctttcaatatgaatcgaaatagagttttgagttccaacattgttgagctggggacataaacacatgatgaaatatgctaccttagtgtatgctggagattttgattaaaaatacatccgagctaaagagcagacggcttataaattgcttttctaagaataaa

SEQ ID NO: 4853 - DNA, 779 bp, Orobanche aegyptiaca
tcccatttttcacttctctcttcacacagtcgacggcggacgattccatagccgtaaggaaaaagaacacatgaagatgagtagaggctcggcggcggcggcggcgggtgctaaaggcgggaagaagaagggagctaccttcgtgatcgattgttcgaagccggtggaggataagattatggagattgcttcgctcgagaagttccttcaggagaggattaaggtcggcgggaaagccggcgctctcggagattccgtcaccgtcgctcgtgagaagaacaagatctccgtcaccggagatgcggctttctccaaaaggtatctcaagtatttgaccaagaaatacttgaagaagcataacgtgagggactggcttcgggtgattgcttcgaacaaagaacgcaatgtttacgaactccgctacttcaacattgctgagcaagaaggagaggaagaagagtaatcgtacaacttttgttcatgttccttttcagtttcgtctccttttcctcagagccactttttttggatccatttatgttggttctgttctgtatgtcaactgggatattcgacattcaatattttatgagttttgcatttttggataatttgagacatatttatgttggttctgttctgcatttttggtgcatttttgcttataattgtattcttcaaacattattttgataagagtagctagctgtttgtttgagtttttggcatgttaatagtgtttaatagcctagggcatgtacagtggcatagtggcttgg

SEQ ID NO: 4854 - DNA, 589 bp, Ipomoea nil
gatctccttctcatatcctaatatactcctttcagccgctcaggaaacctaagcagagaagaatgagcaaaggaagcagcggaggtggggccctcaagggagggaagaagaagggggcgacgtttgtgatcgactgctcgaaacctgtggacgataagattatggacattgcctcactggagaagttcctccaggagcgcattaaggtcggcggcaaggccggagccctcggcgactccgtcaccgtcacccgtgacaagaccaagatcaccgtcacttccgactccaacttctccaaacgatatttgaaatacttgacaaagaagtatctaaagaagaacaatgtccgtgactggctccgcgtcatttcttcaaacaaggatagaagtgtctacgaattgaggtacttcaacattgctgaaaatgatgccgaggatgaagattaagcgggggtgaatacgtccttttcgccatgtcttggatttgcagtgtgttgctcttgtcgttatataccctgttttgaatggcttttgcaatttttactttgtgaacctgtaaaatgagatttgcaattttggagttagtttga

SEQ ID NO: 4855 - DNA, 561 bp, Nicotiana tabacum
aggtcgaagatgagtaaaggaagcagtggaggaggagccatgaaaggtggaaagaagaagggagcaacattcgtgattgattgttcaaagccagtggaggataagatcatggaaattgcttcacttgagaaattcttgcaggaacgcatcaaagttggaggaaaagctggggctctcggtgactctgtcactgtcacccgtgacaagaccaaaattaccgtcacctccgacaccactttctccaagaggtatttgaaatacttgacgaagaaatatctaaagaagaataacgtgcgtgattggcttcgagttatttcctcaaacaaggatcgcaatgtgtacgagttaaggtacttcaacattgctgagaatgaggctgaggaggaagattgagaactagaagcagtagattgtaattgttctctcttttttgacataatttacactttttgtctggaatcaaatcttttgcatttttgccctgtttttaagggacaaatgagattgtgttactggagttggtttatttcttctataacttagcttttaactttttgggtg

SEQ ID NO: 4856 - DNA, 686 bp, Humulus lupulus
ctttcaactctcccctcgcgccggctctgtcatacaccagctctatttgcacgcaacagattaacatgtacgcatggtacagaacattatgctgagctagtttggcatgttatttgattcttttggtacagaacaagcaaatatgagtcgaggaagtgcagcagctcccaaggggaagaagaagggagcaacatttacaattgactgcggtaagccagtggaggacaagatcatggatattgcatctcttgagaagtttcttcaggagaggattaaggtcggtggcaaggccggtgccctcggtgactcagtcactgttacccgtgagaagagcaagattactgttacatctgacagtaatttacttcctaacgaaggtatttgtaaataacttgactaagaagtatttgtaaaagacacaatgttcgtgattggctccgtgtgatctcatccaacaaggatcgtaatgtttatgaactgaggtacttcaacattgccgagaacgagggtgaggaggaagattaaacctctgtaatatttaatttgtcagaacttaatattcttgttgccagaatttccttttgatgtttttactgaaaaccaattattcttcacaattttgtttattgaagctagagattttgaaatatttctgctgttttatgagaatatattagcatgtttgg

SEQ ID NO: 4857 - DNA, 555 bp, Flaveria ramosissima
gactcttcacatttcctctatccatttgcagatcgccgtcttcgaaaccacagagaaagatacattagcgaagatgagtcgaggagccgccggtgccggagcaaaggggggaaagaagaagacatcgacgtttgtgatcgattgtggaaagcctgttgaggataagatcatggagattgcttcacttgagaagtttcttcaggagagaatcaaagtcggaggtaaagctggaaatctcggtgattccgttacgatttcgcgtgagaagaacaagatctctgttaccgctgatagcaacttctctaagaggtaccttaagtacttgacgaagaaatacttgaagaagcacaatgtgcgtgattggcttcgtgtgatcgcatccaacaaagaccgcaatgtttatgagctacgatacttcaacattgctgagaacgagggtgaggaggaagattaaacatgatgtttacttgttttatgtaggttttgttggcatgtgattcttgaacttattacatcggttttgttttgtactttggtattttcagatattgtttt

SEQ ID NO: 4858 - DNA, 551 bp, Flaveria ramosissima
cagatcgccgtcttcgaaaccacagagaaagatacattagcgaagatgagtcgaggagccgccggtgccggagcaaagggaggaaagaagaagacatcgacgtttgtgatcgattgtggaaagcctgttgaggataagatcatggagattgcttcacttgagaagtttcttcaggagagaatcaaagtcggaggtaaagctggaaatctcggtgattccgttacgatttctcgtgagaagaacaagatctccgtcaccgctgatagcaacttctctaagaggtaccttaagtacttgacaaagaaatacttgaagaagcacaatgtgcgtgattggcttcgtgtgatcgcgtccaacaaagaccgcaatgtttacgagctacgatacttcaacattgctgagaacgagggtgaggaggaagattaagcaagatgtttactttgttttatgtaggttttgttggcatgtgattcttgaacttattacatcggttttgttttggtctttggatttccagatattgttttgcagtaaaatctatcgtttatgtg

SEQ ID NO: 4859 - DNA, 569 bp, Flaveria ramosissima
atttcccctatccaattgcatatcgccgtcttcgaactcacagagaaaaatacattagcgaagatgagtcgaggagccgccggtgcgggagcaaaggggggaaagaagaagacatcgacgtttgtgatcgattgtggaaagcctgttgaggataagatcatggagatcgcgtcacttgagaagtttcttcaggagagaatcaaggtcggaggtaaagctggaaatctcggtgattctgtgactatttcgcgtgagaagaacaagatctccgtcactgctgatagcaacttctctaaaaggtacctgaagtacttgacaaagaaatacttgaagaagcacaatgtgcgtgattggcttcgtgtgatcgcgtctaacaaagaccgcaatgtttatgagctacgatactttaacattgctgagaacgagggcgaggaggaagattaagcaaggtgtttactttgttttatgtaggtttttttgtcttgtgattcttgaacttattatatcagttggttttgttctggctttggattttcagatattgtattgcagtaaaatttataatttat

SEQ ID NO: 4860 - DNA, 580 bp, Flaveria ramosissima
tcttcacatttcacctatccatttgcagatcgccgtcttcgaaaccacagagaaagatacattagcgaagatgagtcgaggagccgccggtgccggagcaaaggggggaaagaagaagacatcgacgtttgttatcgattgtggaaagcctgttgaggataagatcatggagattgcttcacttgagaagtttcttcaggagaggattaaagtcggaggtaaagctggaaatctcggtgattccgttacgatttcgcgtgagaagaacaagatctctgttaccgctgatagcaacttctctaagaggtatcttaagtacttgacaaagaaatacttgaagaagcacaatgtgcgtgattggcttcgtgtgatcgcgtctaacaaagaccgcaatgtttacgagctacgatacttcaacattgctgagaacgagggtgaggaggaagattaaacaaagaccgcaatgtttactttgttttatgtaggttttgttggcatgtgattcttgaacttattacatcggttttgttttggctttggatttccagatattgttttgcagtaaaatctatcgtttatg

SEQ ID NO: 4861 - DNA, 542 bp, Ocimum basilicum
gcacgaggcctcgtgccgaattcggcacgagggtcgattccacacctgcgaaaacatacatagtgcgaagatgagcaaaggcggggcagcggcgacggccaaaggcgggaagaagaagggggttagcttcgtgatcgattgtgggaagccggtagaggataagatcatggaaatcgcttcgctcgagaagtttctgcaggagcgaattaaggtcggcggtaaagctggagctctcggcgattccgttaccatttcccgagacaaaagcaagatcactgtcacagccgattctgctttctccaagaggtacctgaagtatttaacgaagaaatacttgaagaagcataatgtcagagattggcttcgtgttatcgcttcaaacaaagatcgaaatgtgtatgaattgcgctacttcaacattgctgagcaagagggtgaggaggaagactgaatatagttgataagtttctttaatgcttgcccaacattgttgaaactgccttttggataggtcgtaagttgttcgttcgatctttttgaga

SEQ ID NO: 4862 - DNA, 696 bp, Taraxacum officinale
ttctgctttgcagctcgcattcttcgaaccgataggcgatagttgtatagagaaagagagaagcgaagatgagtcgagcagcaggtggtgctggaacgaagggagggaagaaaaaaacagcaaccttcatcattgattgtgggaagcccgttgaggacaagatcatggaaatcgcatcattggagaagttccttcaggagagaatcaaagtcggcggcaaggctggcaatcttggagactccgttaccatttctcgtgaaaagaacaagatctccgtcacttccgacagcaacttctcgaaaaggtatctgaaatacctgacaaagaagtacttgaagaagcacaatgtgagggattggcttcgtgtgatttcttcaaataaagaccgcaatgtttatgaattacggtacttcaacattgctgaaaacgagggtgaggaagaagattgatgctgtttcttgatttccatagtttttggttgaaatctatttcaagtggtagagttctgcatgcagttttattttaacaaacttattccaatttgttttaagcaaatatattctacatgaacttagtgattaatatcttttccttattttttaatatttttgaactccgaacaacactcttatttctctgttagctgttttgttcctgactcttaatcttgaatgttggaaatggtttggatgaact

SEQ ID NO: 4863 - DNA, 597 bp, Gerbera hybrid cultivar
cgtcttcggatctagagttgcattaagggagaagcgaagatgagtcgtggaacaggaggtgcggggacgaaggggggaaagaagaaggcatcgacgttcgtgatcgattgcgggaagcctgttgaggacaagatcatggaaatcgcatcacttgagaagtttcttcaggagagaattaaggtcggcggcaaggcaggtaatctcggagactccgttaccatttcccgtgagaagaacaagatctccgtcaccgccgataacaacttctctaaaaggtatttgaaatacttaacgaagaaatacttgaagaaacacaatgtgagggattggctacgagtgattgcttcaaacaaagaccgtaacgtgtatgagttacgttacttcaacattgccgagaacgagggtgaagaggaagattaatcttcttacatgttctttggcttggcttcttaaacttgtttcatgaattttcttctttgttaaaccgtctgaattgtagtagggttttgagcttaaattttgtccctttctgttgtttcttgcatgcctaatgagtttgttttagcgtttatagttatgggcagtattcgacaccct

SEQ ID NO: 4864 - DNA, 574 bp, Guizotia abyssinica
actcttcatatttcccctaatccaattgcaggtcgccgtcttccaaaccacagatctataagcgaagatgagtcgaggagcagccggcgccggagcaaaaggtggaaagaagaagacagcgacgtttgtgatcgattgcggaaagcctgtggaggataagatcatggagattgcatcacttgagaagtttcttcaggagagaatcaaggttggcggtaaagccggtaatctcggcgattccgtcactatttctcgtgagaagaataagatctccgtcactgccgatagcaatttctcgaaaaggtacctgaaatacttaaccaagaaatacttgaagaagcacaatgtgcgtgactggcttcgtgttatttcttccaacaaagaccgcaatgtttacgagctacgatacttcaacattgctgagaacgaaggcgaggaggaagattaagcaaggtgtttactttctttcatgtaggttttcttggcatgcgattcttgaacttattatatcggtttccttttttcctcagatattgttttgcagtaaaatttatggcctatgtgcttttgcaaa

SEQ ID NO: 4865 - DNA, 627 bp, Lactuca sativa
cgggggctgggtacctaatttaaaccctaaacgacctccttcgactctaccagctcatatcgcattctagttgcagaggccgtcatcgaatccagagagcagtagcaagatgagtcgtggagcaggaggtgccggagccaagggcggaaagaagaagacagcgacgtttgtgattgattgtgggaagcccgttgaagacaagattatggagattgcatcacttgagaagtttcttcaggagagaatcaaggttggcggcaaggctggtaacctcggtgactctgtttccatttcacgtgaaaagaacaagatctccgtcacctccgatagtaacttctccaaaaggtatctgaaatacctaacgaagaaatacttgaagaaacacaatgtgagagattggctccgagtgattgcttctaacaaagatcgcaatgtgtatgagttgaggtacttcaacattgctgagaatgagggtgaagaggactgagcagacaagtcgattttgcttttatgttaattttttttgagtttctaaaattgttatatcagacactcttctttgttgaccagttcagaactgtattgtagtagagatttgagttttgatgaattttctctcatcttgat

SEQ ID NO: 4866 - DNA, 617 bp, Salvia sclarea
ggtcgactccatagacgaaagcgtcgaagatgagcaaaggtgcggcagcggcgggagccaaaggcgggaagaagaagggggcgactttcgtgatcgattgcacgaagccggtggatgataagattatggagattgcttcgctcgagaagtttttgcaggagagaatcaaggtcggcggaaaagccggcgctctcggggattccgtcaccgtaactcgtgacaaaagcaaaatcaccgtcaccgccgattccgctttctccaagaggtacattaagtatttgactaagaaatacttgaagaagcataacgttagagattggcttcgggtgattgcttccaacaaagagcggaatgtttatgaactgcgctacttcaacattgctgagcaagagggcgaggaagaagattaaacgtgtgagggttctgatgctccactttttggatcagtttgtgttgttgattttatcgttcatctcaaaattttctaaattccctagattttgagcttggatttttagctaccttcttgctttatgttgccgtatttcgtataattattcagcagcaatagatcactttttgaagaagtgtatttgtggtatagctttattgccgag

SEQ ID NO: 4867 - DNA, 483 bp, Zinnia violacea
cacacacacacacagagaaacgaagatgagtcgaggagcaaccggtgccggagcaaaaggcgggaagaagaaaacggcgacgtttgtgatcgattgtgggaagcctgttgaggataagattatggagattgcgtcacttgagaagtttctccaagagaggattaaagttggaggtaaagctggtaatctcggtgattccgttacgatttctcgtgagaagaataagatctctgttactgctgatagcaatttctccaaaaggtacttgaaatacttgacaaagaagtacctgaagaagcacaatgtgcgagattggctccgtgtgattgcttccaacaatgaccgcaatgtttatgagctaagatacttcaacattgccgagaacgagggtgaagaggaagattaagcctaggtgtttcatctaggtttttcatggcatgcaatcctttaaacttattacatctgtttctttttttgtttgcc

SEQ ID NO: 4868 - DNA, 589 bp, Panax ginseng
attcgcatcccctctacctgtgtaggtttaccgaagaagaagaaggatgagtccaataagtgcggcgaagggtgggaagaagaaaggagctacattcacgatcgactgtggaaagccggtagaggataagattatggagattgcttcactggagaagtttctccaggagcggatcaaagtcggtggcaaggccggtgctctcggcgacgccgtcactgttgttcgcgagaagagcaaaattattgtcacttctgacagtgacttctccaagaggtatttgaagtacttaacaaagaagtacttgaagaaaaacaatgtgcgcgattggctcagggtgatagcgtccaacaaggaccgaaatatatatgaattgaggtacttcaacattgccgagaacgagggtgaggaggaggattgataatgcaaatcagtctatacatttatttactggcctcattctgtattttttgtttgcgtttcatctgtgtggaatcagggattttacattgttgttacatttggaattgtagaatctgacagtaggcatccctaattactttatcagcaatgatgatttaagtatcctgtt

SEQ ID NO: 4869 - DNA, 439 bp, Tamarix hispida
ggggaacgctaacgcttcccatttcggacgctctccgtcacgccttcgcgccccgcatcctgctgacttgaaggagcaaaaatgagtcgaggaacagccgcagctgggggtaagggaaagaagaagggatcgaccttcacaatcgattgtgggaagccagttgaggataagatcatggacattgcatctctcgagaagttccttcaggagagaattaaggttggtggcaaagctggtaatctcggtgataccgtgactattactcgtgagaagaacaagatcagcgtcacatctgacagcaacttctccaagaggtacttgaaatacttgaccaagaagtacttgaaaaagcacaatgttagggattggctccgtgttattgcatccaacaaggaccgcaatgtctatgagttaagatacttcaacattgctgagaatg

SEQ ID NO: 4870 - DNA, 547 bp, Arnica chamissonis
ggagcaagatgagccatggagccggagcaaaggggggaaagaagaaaacatcgacgttcgtgattgattgcgggaagcctgttgaggacaagatcatggaaattgcatctctggagaagtttcttcaggagagaatcaaggtcgccggcaaagctggaaatctcggagactctgttaccatttcacgtgaaaagaacaagatctccgtcaccgccgatagcaacttctccaaaaggtatttgaaatacctaacaaagaaatacttgaagaaacataatgtgagggattggcttcgggtgattgcttctaacaaagaccgcagcgtgtatgagttacgttacttcaacattgctgagaatgagggtgaagaggaagactgagcggaaagttggactctttttatgtttgtttttttttaaatatgttatcagatttttttcaccagctgttggaaactataacgcagtagaattttgagtttaggtgctcttgccctgatcttgatttctacttccatgggatatgtcttcttttgtaccaaatcatg

SEQ ID NO: 4871 - DNA, 556 bp, Flaveria ramosissima
gcagttctcgcagtctttgaatctagaggatcaaaatgagtcgcggtgcaggtggagccaagggcggaaagaagaaaacatcgacgttcgtgatcgattgtgggaagcctgttgaagataagatcatggaaatcgcatcgctcgagaagtttcttcaggagaggatcaaagttggtggaaaagctggtaatctcggagactctgttacgatttcgcgtgagaagaacaagatctctgttaccgctgatagcaatttctccaaaaggtatctgaagtacctaacaaagaagtacttgaagaaacacaatgtgagagactggcttcgagtgattgcttcaaacaaagaccgcaatgtgtacgagctacgttacttcaacattgcagagaatgagggtgaagaagaagactgaacctatagttgatcttgctttgtgtttgttcttgaacctggtttttctttttaattatgttatatcagaattttgttcatgggtctatgcagaactgtattgtagcagagttttgaagtttgagtgctattgcactgattcttgta

SEQ ID NO: 4872 - DNA, 945 bp, Aristolochia fimbriata
cctcactagggttagggtttttgcagccgtaaggagaggaggggctgcgcggagcagtgaggaaaggctgcgagaatgagtcgaggaaatgctcccaagggcgggaagaagaagggggcgaccttcgtgatcgactgcgcgaagcccgtcgaggacaaaatcatggatatcgcctccttggagaagttcctccaggagcgcattaaagttggcgggaaagctggggcgctcggagatgccatcaccatctctcgcgataagagcaagatcaccgttacttcagataaccctttttcgaaaaggtacctgaaatacctgacgaaaaaatatttgaagaaacacaacgttcgggattggttgagagtgattgcatccaacaaggaccgcaatatctatgagctccgttacttcaacattgcagagaacgaggccgaggaagaagattaaattgttcttgtttgtagcgtaacttgttttcttgaggggtagtttatttgaatagataatttgcaagagttttgccgtcgaatccatccaaagatatattttgttttggttttatttttcgtcgtgctcatattgaaccattgaaccaatacacaatattgatttttaatgtccctcctaggtactgtttttcagtctacgcgataaatgcccgtagttgctactcttgtttagctattaaacccgtcaatattagttatgtaaaatacgttctgggttaattttacgtcttttcctgttagttacatctttgacacaatgtgccatgttgtgttcgaaagtgactccttacgtgaaaagctttttatttatttatttaaacggggaatggactttggctagttaaaataaagttatttgtaaatactctatcctttgcttgtttccaatggcaattagatgtgaaaatatgtttatagatccattgatctcaatcaa

SEQ ID NO: 4873 - DNA, 696 bp, Nuphar advena
  misc_feature (136)..(136): n is a, c, g, or t
  misc_feature (166)..(166): n is a, c, g, or t
  misc_feature (190)..(190): n is a, c, g, or t
  misc_feature (671)..(671): n is a, c, g, or t
cctaaccctaactcaatatctttttctttcactcctcccctcttctgctctctccgggcgattcacaatctgaagatcaagttctgcaataggcagggaagtcaagatgagtcgaggaggtgccgcccccaagggnaagaagaaggcatccaccttcactattgantgtgcaaaacctgtagaagacaanatcatggacataacatcatttgagaagtttctacaggacaggatcaaggttggaggcaaaactggtgttcttggggataccatcacaattactcgtgaaaagaacaagatcagtgtcacctctgagagtgcattttcgaaaaggtatctgaaatatttaacaaagaagtacttgaagaagcacaatgtaagagactggttgcgtgtgatcgcatctaacaaagaccggagtgtgtatgagctgaggtacttcaacattgcagagaacgaggctgaggaggaagattgatgagcggcacttagaattcttttcacatttctccaaacctcttttaacttttggtatttataatttcctgttatcgccattagatattgtgtgaaagacacactgcgattgaagttttggatatgatggcatttcaatcctttgtggggaccatttttaattggtagcctcaattcaattcagcaaatgcaangtgacctcatagttattctcccact

SEQ ID NO: 4874 - DNA, 566 bp, Helianthus annuus
aattccatttcgccgtcttcgaaacgaatccacagaacaaacggttttgaagcgaagatgagtcgaggagcagtaacaaagggcgggaagaagaaaacggcgacgtttgtgatcgattgtggaaagccggtggaggataagatcatggagattgcgtcgcttgagaagtttcttcaggagaggattaaggttggaggtaaagctggtaatttaggggattctgttacgatttctcgtgagaagaataagatctctgttactgctgatagcaacttctcaaaaaggtacctgaagtacttgacaaagaaatacttgaagaagcacaatgtgcgagattggcttcgtgtgatcgcttccaacaaagagcgcaacgtttacgagttaagatacttcaacattgccgagaatgagggtgaagaggaagactgagcagagcaggttatggttgttttataatatttttaaagacttgttattgttccgactctttaatattattttgcagtcaaatttctggtctatgtgctttaacttgttatccataagtaacccaagttttgttgcaa

SEQ ID NO: 4875 - DNA, 677 bp, Nicotiana tabacum
  misc_feature (271)..(271): n is a, c, g, or t
gcaaaaaccctaacactctcctcatattgctcaatcgcgcgcagcttcttccttaaacactaaactcaggtaggaatttcgataaccaatttcgaagatgagtaaaggtagtggagcagcaaagggtgggaagaagaagggggcaaccttcataattgattgttcgaaaccggtggaagataaaatcatggaaatcgcctcgcttgagaagtttctgcaggaacgcattaaggttggtggaaaagccggtgccttgggcgacaccgtcacngtcacacgtgacaagaccaagattactgtcacttccgacagcactttctccaagcggtacttgaagtacctgacaaagaaatatctgaagaagaataatgtccgtgattggctgcgagttatttcttcgaacaaggatcgaaatgtttatgagttgaggtacttcaacattgctgagaatgaggccgaggaggaagaatgagaagctggtgttagtctatcatctctctttttgtatgatactgtttgagtgtctgggacattatttacaattttctgtggttcaaatcttttttactttagcctgtttcaaaagataatgaggttggctatgttggagcttgctttgactgatatatttttttctttaatgcttgttgggtgaggacagtcccatcatcattgtc

SEQ ID NO: 4876 - DNA, 573 bp, Triphysaria pusilla
acactccagcagtcggcggtcgatttcatatcccttgcaggtaaaagtagcaaagatgagtaaaggcgcggcggtggcgaagggcgggaagaagaagggatcgagcttcgtgatcgattgctcgaagccggtggaggataagattatggagattgcttcacttgagaagtttttgcaggagaggatcaaggtcggagggaaagccggcgctctcggtgattctgtcaccgtctctcgtgagaagaacaagatcaccgtcactgctgattcgaatttctcaaaaaggtatctcaagtatttgaccaagaaatacttgaagaagcataatgtgagggattggcttcgggtgattgcttcaaacaaagaacgcaatgtttatgagctacgctacttcaacattgctgagcaagagggagaagaagaagattaaacttctttttgattggtaccatgttaatcttttatcagagacactttggatttgtgttgttggttatacaatccatattttatgagactgcagttttggttaatggttaatgttatgtttattattgccttaaatgatttatt

SEQ ID NO: 4877 - DNA, 594 bp, Lactuca sativa
ggtccgttcctgcttcgcggctcgcattcttggaaccgatacttgtagagatacagaagaagcaaagatgagtcgaggagcagtagcgaaggggggaaagaagaagattgcgacattcgttattgattgcgggaagcctgttgaggacaagattatggaaattgcgtcattagagaaattccttcaggagagaattaaagtcggcggcaaggctggtaatcttggagactccgttaccatttcccgtgaaaagaacaagatctccgtcacttccgacaacaacttctccaaaaggtatctgaagtacttgacaaagaagtacttgaagaagcacaattcgagggattggcttcgtatgattgcttgaaacaaagaccgcaatgtttatgagttacgctacttcaacattgctgaaaacgagggtgaggaggaagattgattttcttctttctttcttatctcatgcttttcaagttaccctatttattttcagaaatattctacatcactaagttttcatctttttatgtttatattttctgagttgcaatgagtgacaatacaattttttttttgttagttactttattccta

SEQ ID NO: 4878 - DNA, 619 bp, Linum usitatissimum
ccacgcgtccggtgagttagagcagcagaagaggaacagagattagcagagatggctcgcggcgtggcggcagcagcagctggaacgaagggtggaaagaagaagggagtttccttcgtgatcgattgcgggaagcccgtcgaagataagattatggacatcgcctctctggagaagttcctccaggaaaggatcaaggtcgggggcaaggccggcgctcttggcgacgttgtctccatctccagggagaagaacaagatcactgtcacctccgacagcaatttctctaagaggtatctgaagtacttgaccaagaagtacctaaagaagcacaacgtgcgagattggctccgtgtgattgcttcaaacaaagagaggaatgtctatgaacttcggtacttcaatattgcagagaacgagggagaagaggaggattgaagactcaatcctgcacttatttgaatatcagctgtgttctttttgggcttctttcgcactctgtttgaatgatggttttgatatgtttagcgtgttgccaagctggatgcattgcactcacttatcgcctgttggaaattttggttcaatgattattagatatcaaaactttttttggatc

SEQ ID NO: 4879 - DNA, 834 bp, Linum usitatissimum
tgctgttcatatataagttggggaaaggttttggttggacggccacatttttcccataactgtgagttagagcagcagaagaggaacagagattagcagagatggctcgcggcgtggcggcagcagcagctggaacgaagggtggaaagaagaagggagtttccttcgtgatcgattgcgggaagcccgtcgaagataagattatggacatcgcctctctggagaagttcctccaggaaaggatcaaggtcgggggcaaggccggcgctcttggcgacgttgtctccatctccagggagaagaacaagatcactgtcacctccgacagcaatttctctaagaggtatctgaagtacttgaccaagaagtacctaaagaagcacaacgtgcgagattggctccgtgtgattgcttcaaacaaagagaggaatgtctatgaacttcggtacttcaatattgcagagaacgagggagaagaggaggattgaagactcaatcctgcacttatttgaatatcagctgtgttctttttgggcttctttcgcactctgtttgaatgatggttttgatatgtttagcgtgttgccaagctggatgcattgcactcacttatcgcctgttggaaattttggttcaatgattattagatatcaaaactttttttggatcagctgcctatctcggcacattcggctcctcttgcttttctcttcgatgcctgatttggctatgttcgtcgtgatgtttgtgtattagggatagcgtacatgcgttacacgtttacgaatttcggtattgatgtggtacattacaaagttcacatcttgcttctgc

SEQ ID NO: 4880 - DNA, 1620 bp, Plantago ovata
gccgctaatcacaggtgaattttgggtaagctaagatgagtagaggagctgcagcagctgcccagaagggtggaaagaagaaggcatcgagcttcgttatcgattgcggtaagcctgttgaggataagatcatggacatcgcttcgctcgagaagtttctccaggagcgcatcaaggtcggaggcaaagctggtgctctcggtgacactgttacaatcacccgtgacaagactaagatctccgtcactgctaatgacactactttctccaaaaggtatcttaagtacttgacaaagaagtacctaaagaagaacaatgtgcgtgattggctcagggtgatagcttctaacaaagataggagtgtttacgagttgagatacttcaacattgctgaaaatgaggccgaagaggaagattgaagactgatatagtcttgtgtaatgtttttgaggttttgagttggtatttggtttatttttatggatatcttgttagacatctgtttccattctgttctctggagaactaatacagaaatgacattcggctgtggtgatgatatgtgaaattaacttatgctgtgaagaaagaaaagaaaaaaaaaaataggcgtctacagcatgtttcttgcatcaccatgcagctatttcaagtccagctgctgcaagaacttcttctcagcgatacgctccttctatcaagccaacccagttcgtctgcaaggcacagaagcacgaagatgaagcttccgtaatgtcgcgtagattggctcttactgtcttgattggtgctgctgctgttggctctaaggtttcccctgctgatgctgcctatggtgaatcagcaaacatctttggcaagccgaaaacaggcagcacagaattcaagccatacactggtgatggatttaagttggatgttccagccaagtggaacccgagcaatgaagtcgagttccctggtcaagtcctcagatacgaggacaacttcgacgccactagcaacctgagtgtcatgatcaccccaactgacaagaaatcgatcacagattttggttcccctgaagatttcctctctaaggtggactatctgctgggaaaatcggcctactttggtaaaactgattccgagggtggatttgattcgggtgctgtggcaactgcaaacatattggagaccgcgacaccagaaataggtggaaagcaatattacttcgtgtcagtgttgacaagaactgctgacggagatgaaggcggtaaacatcagttgattactgctacggttaacaatggcaagctctacatttgcaaggcacaagccggagacaagagatggttcaagggtgcaaggaagtttgttgaaaatgcagcaaattccttcagtgttgcttaaagagcagcatactaataatatactatggagatgtgatgagtatatttgtatgtgatctttaacctgcaatatataacattttatgatgtttgatctgcacaattattagagacgtacgttgagttatgtttaaggaacaagttattattgcatgtggataattcaaataaggtttttgatcataaactctcatatcatcattatactttcatgatatcatgtactagg

SEQ ID NO: 4881 - DNA, 668 bp, Lactuca sativa
cagctcatatcgcattctagttgcagaggccgtcatcgaatccagaggagcaagatgagtcgtggagcaggaggtgcgggagccaagggcggaaagaagaagacatcgacgtttgtgattgattgtggaaagcctgttgaagacaagattatggagattgcatcacttgagaagtttcttcaggagagaatcaaggtcggcggcaaggccggtaacctcggtgactctgttaccatttcacgcgaaaagaacaagatctccgtcacctccgatagcaacttctccaaaaggtatcttaaatatctaacgaagaaatacttgaagaaacacaatgtgagagattggctccgagtgattgcatccaacaaagatcgcaatgtgtatgagttgaggtacttcaacattgctgagaatgagggtgaagaggacagatcagagaagtcgattttgcttttatgtttgttttttttggctttttaaatttgttatgccagacatttttctttgttgaccagtccagaactgtattgtagtagagatttgagttattatgccttttcacttgtcttgattacacctcaatccttattgcctgctttgagcttttgaattcgtagttttcttttgggttgatgatttgaaacgggtaagatatataatttaactaa

SEQ ID NO: 4882 - DNA, 552 bp, Flaveria ramosissima
gcagatcgccgtcttcgaaaccacagagaaagatacattagcgaagatgagtcgaggagccaccggtgccggagcaaaggggggaaagaagaagacatcgacgtttgtgatcgattgtggaaagcctgttgaggataagatcatggagattgcttcacttgagaaatttcttcaggagagaatcaaagtcggaggtaaagctggaaatctcagtgattccgttacgatttcgcgtgagaagaacaagatctctgttaccgctgatagcaacttctctaagaggtaccttaagtacttgacgaagaaatacttgaagaagcacaatgtgcgtgattggcttcgtgtgatcgcatccaacaaagaccgcaatgtttatgagctacgatacttcaacattgctgagaacgagggtgaggaggaagattaagcaagatgtttactttgttttatgtaggttttgttggcatgtgattcttgaacttattacatcggttttgttttggctttggattttcagatattgttttgcagtaaaatctatcgtttatgtgc

SEQ ID NO: 4883 - DNA, 581 bp, Lippia dulcis
caaaccctaatatatctgtttatctctcttcctctctttctcaacccacagttcacgcactcagccgttcgattcaacacctgctaataaaattgcgaagatgagcaaaggcacggcggctgcggcggtgaagggtgggaagaagaagggcgttaccttcgtgatcgattgctcgaagccggtggaggataagatcatggagatcgcttcgctggagaagtttttgcaggagagaatcaaggtcggtggcaaagctggtgctctcggagattccgttactgtcagccgtgacaagagcaagattaccgtcaccgccgatgccgccttctccaaaaggtatttgaagtatttgactaagaaatacttgaaaaagcacaatgtgagggattggcttcgagtgatttcatccaacaaagaaagaaacgtgtacgaacttcgttacttcaacattgctgagcaagagggcgaggaggaagattaaatatagtgagagtagtttcatgttccttttatgcctgatcaaaaccacttttttggataaattcgtgttgtttgtccctcttcattataacatttctgag

SEQ ID NO: 4884 - DNA, 569 bp, Aquilegia formosa
cagaagaaaaagaagtgagcaaatggcagtgaagatgaaccgaggtggtagtgcagcaggtactaagggtgggaagaagaaggcatcaaccttcgtgattgattgtgctaagccagttgaagataagattatggacatcgcttcattggagaagtttcttcaagagagaatcaaggttggtggtaaagctggtgctcttggtgatgttgttaccatttctcgtgagaagaacaagatctctgttacctctgacagcaccttctctaagaggtatctgaagtacttgacaaagaagtatttgaagaagcacaatgtaagagactggcttcgtgtgattgcttccaacaaagagagaaatgtttatgaactcaggtacttcaacattgctgagaatgaagcagaagaggacgattgagggtggcaaatcctttgtcattcatattagtagtttgacgattttcccgttaggttggtcttgtaattcaacattttagactttattgaaagtgttctgttaaatttgctatcatattttgttttgacagattataagttcctttatagttcga

SEQ ID NO: 4885 - DNA, 612 bp, Euonymus alatus
gacggcacaccagaacccttgcggtccaaaccggcaatcgttctctttattcaagaaaaatgagcaaaggaagcggcggtgcggggaaggccgggaagaagaagggagtgacctttacgatcgactgcggtaagccggtggaggacaagattatggaaatcgcctcgcttgagaaatttcttctggagcgcatcaaggttggcggcaaagcgggggcccttggcgactccattaccatctctcgtgagaaatcgaaaatcaccgtcacttctgattccaacttctccaagcggtatctgaagtacttgacaaagaagtacttgaagaagcacaacgtgagggattggcttcgcgtgatttcatctaacaaagaccgcaatgtttacgagctcagatacttcaacattgctgagaatgaaggagcggaagaagattagacattccaattcagtgttgattactcctgagccccctgttttatcagctgttttcttatatgattgaatcttttgttggcaagttttgaaatttcttatgagatcttctcttctttgtgctgaatctttgctatacttggttatgattattttcttattcagtttctgggtgttg

SEQ ID NO: 4886 - DNA, 1084 bp, Solanum lycopersicum
caaaatgctgatggaccgcaacgacgatccacaatagaaacataaatcacacccagtaatatataaaccccacgctcagaaaccctaaccatttctcttctcattattcctcccaattgccgcagcttttcaggtaggtttttatcctgttaatcgtcggagaagatgagtaaaggaagcagcggagccaccaagggtgggaagaagaagggagccaccttcgtgattgattgcgcaaagcctgttgaggacaacatcatggaaatcgcctctttggagaagtttcttcaggagcgcatcaaggttggaggaaaggctggagctcttggtgactccgtgactgtcacacgtgacaaaaccaaaatcaccgtcacctccgatagcaccttctccaagaggtatttgaaatacttgactaagaagtatttaaagaagaacagtgtccgtgattggctccgagtaatttcctcaaacaaggaccgtaatgtttatgagttgaggtacttcaacattgctgacaatgaggctgaggaggaagattgagaagcttgaattggtcagcttgatagaaagtgtcctttgttgaactttagttttgtagctcttcattatctggattttttttgccttgtgagacgttatttacaattttgtcaacgaagttataactatgctctttgcccctaaatggagaatgtgattagctagctatcttgtagttggtttatttctcctgcaatgcaatcaatcttcttagatttgttttctaaacgtttgctatttagagattgtatctgatcaaggatacttgctggtttcttttgcgctgcatttgcgagaatatgatttacatcatcactacttggcttttgttggtggaaaaagttgctaagttgctgtttgacgttcccaaattgttgttggtgaggtactcattatgatgcttaagtaacttagttgtctgcggtgttgtgatttcttgtttgtttacatacgaagatgaattcattattgtattaattgaagtagaacaaaagctttggaagctaggaattcaagtattattggttaaaactgaaacaaa

SEQ ID NO: 4887 - DNA, 544 bp, Ocimum basilicum
agcttttcaggtaggttttttccctgttaatcgtcggagaagatgagtaaaggaagcagcggagccaccaagggtgggaagaagaagggagccaccttcgtgattgattgcgcaaagcctgttgaggacaacatcatggaaatcgcctctctggagaagtttcttcaggagcgcatcaaggttggaggaaaggctggagctcttggtgactccgtgactgtcacacgtgacaaaaccaaaatcaccgttacctccgatagcaccttctccaagaggtatttgaaatacttgactaagaagtatttaaagaagaacagtgtccgtgattggctccgagtaatttcctcaaacaaggaccgtaatgtttatgagttgaggtacttcaacattgctgacaatgaggctgaggaggaagattgagaagcttgaattggtcagcttgatagaatgtcctttgttgaactttagttttgtagctcttcattatctggattattttgccttgtgagacgttatttacaattttgtcaacgaagttataact

SEQ ID NO: 4888 - DNA, 476 bp, Cleome gynandra
tcgggggacgcacatccccatcttctctttgatttttcgactttgtgagtttttccgacgaagtaggtagcggcggcaatggctcgaggagcggcagcgacggtagcgggagggaagaagaagggatcgacgttcgtgatcgactgtgcgaaaccagtggatgataaaattatggacatcgcctctcttgagaagttccttcaggagcggatcaaggtcggcggaaagcccggagctcttggagacgccgtcactgttactcgtgacaagaccaagatctccgtgaccgcctcatctgacttctccaagcggtacctcaagtacttgacgaagaagtatctgaagaagaacaacgtgcgtgactggctgcgggtgatcgcatccaacaaagacagaaacatctatgagcttcgatacttcaacattgcagagaatgagggagaggaggaagactaagcttaattcttttcttttgt

SEQ ID NO: 4889 - DNA, 668 bp, Cleome spinosa
agtcgatcctccgttcgattttgtcgactttgcgaggtttttttttccggtccaaggagttggggcgacgatggctcgaggagcggcggcgacggcagcgggagggaagaagaagggatcgactttcctgatcgactgcacaaaaccagtggatgataagatcatggacatcgcctcccttgagaagttccttcaggagcggatcaaagttggcggcaagcccggtgctcttggcgatgccgtcactattactcgcgacaagagcaaaatcactgtcaccgccacttccgacttctccaaacggtacctcaagtacttgacgaagaagtatctgaagaagcacaacgtgcgtgactggctgagggtgattgcctccaacaaagacagaaatgtctatgagctacgatacttcaacatcgcagagaacgagggagaggaggaagactaagcttcttcttattgctctacctccttttgtgggtttctttttgttctctgcttgctgcctccgttgctatcttagttctgattattactgtgaaaccttcatttcatgtaacttgaagtttttggttgttcgaaatactccaatgggatccagagaaatcgttgttttggtttgtatcagactgttcatggcattaaattcaaagggtttattaaaaaaa

SEQ ID NO: 4890 - DNA, 723 bp, Nicotiana benthamiana
  misc_feature (617)..(618): n is a, c, g, or t
gaattaagctactgttgttgaatcatgactgttttgtttcttcaggtgcatcttttcctcgtgccgaattcggcacgaggcgcagcttctcagggtttgtgtttttttctttaatcgttggagaagatgagtaaaggaagcagcggagccaccaagggtgggaagaagaagggagcaaccttcgtgattgattgctcaaagcctgttgaggataagatcatggatatcgcttcactggagaagtttctgcaggagcgcatcaaggtcggaggaaaggctggagctctcggtgacgccgtcactgtcacccgtgacaaaacaaaaatcactgtcacctccgagagcactttctccaagaggtatctgaagtacctgaccaagaagtatctcaagaagaacaatgtccgtgattggctgagagttatttctgcaaacaaggatcgcaatgtctatgagctaaggtacttcaacattgctgagaatgaggctgaggaggaagattgaggagctggaagtttgtagtttcttcttatctgatattgttgtctgcgtgagacattatttacaattttgtcggagaaatcaaatatttgcacttttgcccagttaaatgggannaaagacattaggccatcttgtagtttttatatcttatatattgtggtgttttaggagtgaacaatcatcaatcttgaaaaatgccattttttttcgttacttcta

SEQ ID NO: 4891 - DNA, 940 bp, Solanum phureja
caaaattctgatggaccgcaacgacggtccacataaacataaaatctcactcagtaatatataaaccccacgctcagaaaccctagccatttctcttctcattgttcctcccaaatcgccgcagcttttcaggtagggttttttcctgtaatcgtcggagaagatgagtaaaggaagcagcggagccaccaagggtgggaagaagaagggagccaccttcgtgatcgattgcgcaaagcctgttgaggacaacatcatggaaatcgcctctttggagaagtttcttcaggagcgcatcaaggttggaggaaaggctggagctcttggtgactccgtgactgtcacacgtgacaaaaccaaaatcaccgtcacctccgatagcaccttctccaagaggtatttgaaatacttgactaagaagtatcttaagaagaacagtgttcgtgattggctccgagtaatttcctcaaacaaggaccgtaatgtttatgagttgaggtacttcaacattgctgacaatgaggctgaggaggaagactgagaagcttgaattggtcagcttgatagaacgccctttgttgaactttagttttgtagttcttcattatctggatttttttttgccttgtgagacgttatttacaattttgtcaatgaagttataactatgctctttgcccctaaatggagaatgtgattagctagctatcttgtagttggtttatttctcctgcaatgcaatgttttaggggtgagttatcaatcttctcctattgttttctaaacgtttgctatttagagattgcttctgatcaaggatacttgctggttgctttttcactgcatttgcaagaatataatttaccttgtcagtacttagctttgctggtgtaaaatgttgctaagttgctatctgacgtttccaaattgatgtaggtga

SEQ ID NO: 4892 - DNA, 599 bp, Helianthus annuus
ggaactgcaactaggatgcgatccccgcagtctttgaatctaggatcaagatgagtcgtgtagcaggagcaaagggcggaaagaagaagcaatcgaccttcgtgatcgattgcggaaagcctgttgaagacaagatcatggagattgcatcacttgagaagtttcttcaggagagaatcaaggttggtggcaaagctggtaatctcggagactctgttactatttcacgtgaaaagaacaagatctctgttaccgccgatagcaatttctcgaaaaggtatttgaagtatttaacgaagaagtatttgaagaagcacaatgtgagggattggcttcgggtgattgcgtctaacaaggagcgtaatgtgtacgagttgcgctacttcaacattgctgagaatgagggtgaagaggaagattgaatcggcagttgagcttgttttgtgtttgttttttgacttggattttatttttggttatgttatattggaattttggttaggggtttattatgcagaactgtattgtagtggagttttgaagtttgagtgcctttgcactgatcttgatttcacaattcacatccatgggatatgcat

SEQ ID NO: 4893 - DNA, 638 bp, Nicotiana tabacum
cctcatgcggccgctcgcagcttctcaggtagggtttgtgttttttctttaatcgtaggagaagatgagtaaaggaagcagcggagccaccaagggtgggaagaagaagggagcaaccttcgtgattgattgctcaaagcctgttgaggataagatcatggatatcgcttcactggagaagtttctgcaggagcgcatcaaggtcggaggaaaggctggagctcttggtgacgccgtcactgtcacccgtgacaaaacaaaaatcactgtcacctccgagagcactttctccaagcggtatctgaagtacctgaccaagaagtatctcaagaagaacaatgtccgtgattggctcagagttatttctgcaaacaaggatcgcaatgtctatgagctgaggtacttcaacattgctgagaatgaggctgaggaggaagattgaggagctggaatcttaattgaatctttagtttgtagtttcttcttatctgatattgttgtctgcgtgagacattatttacaattttgtcggtgaaatcaaatatttgcacttttgcccagttaaatggagaaaaagagattagccatcttgtagtttttatatcttatatattgtggtgttttaggagtgagcaaaa

SEQ ID NO: 4894 - DNA, 1083 bp, Solanum lycopersicum
caaaatgctgatggaccgcaacgacgatccacaatagaaacataaatcacacccagtaatatataaaccccacgctcagaaaccctaaccatttctcttctcattattcctcccaattgccgcagcttttcaggtagggtttttcctgtcaatcgtcggagaagatgagtaaaggaagcagcggagccaccaagggtgggaagaagaagggagccaccttcgtgatcgattgcgcaaagcctgttgaggacaacatcatggaaatcgcctctttggagaagtttcttcaggagcgcatcaaggttggaggaaaggctggagctcttggtgactccgtgactgtaacacgtgacaaaaccaaaatcaccgtcacctccgatagcaccttctccaagaggtatttgaaatacttgactaagaagtatttaaagaagaacagtgtccgtgattggctccgagtaatttcctcaaacaaggaccgtaatgtttatgagttgaggtacttcaacattgctgacaatgaggctgaggaggaagactgagaagcttgaattggtcagcttgatagaaagtgtcctttgttgaactttagttttgtagctcttcattatctggattttttttgccttgtgagacagtatttacaattttgtcaacgaagttataactatgctctttgcctcaatatggagaatgtgattagctagctatcttgtagttggtttatttctcctgcaatgcaatcaatcttcttagatttgttttctaaacgtttgctatttagaggttgcttctgatcaaggatacttgctggtttcttttgcgctgcatttgcgagaatatgatttacatcatcactacttggcttttgttggtggaaaaagttgctaagttgctgtttgacgttcccaaattgttgttggtgaggtactcattatgatgcttaagtaacttagttgtctgcggtgttgtgatttcttgtttgtttacatacgaagatgaattcattattgtattaattgaagtagaacaaaagctttggaagctaggaattcaagtattattggttaaaactgaaacaaa

SEQ ID NO: 4895 - DNA, 561 bp, Euphorbia peplus
gcagccggggccggagcaggggaagaagaagggagcaaccttcaccattgattgctctaagccggtggaggataagatcatggatattgcctcactcgagaagttcctccaggagcgtatcaaagttggcggcaaagccggagctctcggtgattccgtcaccgtctcccgcgaaaagtccaaaatcaccgtcacttctgactctaacttctccaaacgataccttaagtatttgacaaagaaatacttgaagaagcacaatgtgcgggactggcttcgtgtcatagctgccaacaaggataggaatgtttacgaactgagatacttcaacattgctgagaatgaaggagaggatgaggagtaaattgttaccttccttttcaacgtctcttttctcaattttattttgcccttttaatagaaacgctttagggttttctcttaatgttttagaagtggaagacaatgaaattttggcaaatttttactctctgatatgtttggattttggctatacttgttattgttattgtggaatgaagaatgattagctcatttaaa

SEQ ID NO: 4896 - DNA, 512 bp, Platanus occidentalis
tacgcccaaagggcaagaagaagggagcaagcttcgtgattgactgcgcgaagccagtggaagacaagattatggacatcgcgtccttggagaagttcctgcaggagaggatcaaggtcggaggtaaggctggtgccctcggcgacgccattaccgtttcccgcgaaaagaacaagatcaccgtcacctccgataatgccttctccaagaggtatttgaagtatctaacaaagaagtacttgaagaagcacaatgtgagggactggctacgggtcattgcatccaacaaagaccgcaatgtctacgagctccgatacttcaatatcgctgagaatgagggtgaggaagaggattgataaatttggcagttcttttctcttctccaattcagttaatcatcttagtgacattgtaccagtttttttttcctttagaggaaccaactaatgttcctgaatttagctcgcttatttctctttcactcccaagtgtttgacatatcatgatgagca

SEQ ID NO: 4897 - DNA, 661 bp, Eutrema parvulum
gaaaatgactcgtggaagtgcagcagctccaaaggggaagaagaagggagtttccttcaccattgattgttcgaagcctgttgatgacaagatcatggagattgcttcgctagagaagtttcttcaggagaggattaaggttggtggtaaagcaggtgcacttggtgattctgtctcaatcactcgtgacaagaacaagattaccgtcacctctgatggccaattctcaaagagatatctcaagtacttgacaaagaagtacctgaagaagcacaatgtgagggattggctcagagtgattgcagcgaacaaggaccgtaacctctatgagctgaggtacttcaacattgccgagaatgaagccgaggaagaagactaaaaccaagatttttctgttcctctcttgctgttggttttgtttttattctacaattatcccttttttttgttagaaattatcatagtttgattgaagtaatacactttcttttgctattgcgcacttgagcttctatggagtcttctattttcctgacattttttgggtaaaccgagtggagtttgcaaatcattccttcagaaatattgtctagttgatgaagattgatgatgctacaaggtgaaagaaagatgaattggacttgtatggtttggttatgtt

SEQ ID NO: 4898 - DNA, 879 bp, Eucalyptus grandis
aagaaccctaacctatggctcttcctctctgctctcctcttctggttctctctcccgctgcttcgttccatttcgagcttcggcaaaaacttttggaaggatatagtgagtgaagatgagtcgggcaagtgtggctggaccaaagggaaagaagaaaggggtatcctttacgatcgactgtgcgaaaccagtggaggacaagatcatggacattgcgtcatttgaaaagtttttgcaggagaagatcaaggtcgatggaaaggctggtgccctcggcgacattgttactgtcacgcgggacaagaccaagattaccgtgacttccgaaagtagtttctctaaacgttatctgaagtatttgacaaagaagtacctgaagaaacacaatgttcgagattggctgcgggtgattgcatcaaacaaggaccgaaatatctatgaagtcagatacttcaatatcgctgagaatgaaggggaggaagaagattgaacatttagctttcaaaggagtgcttgttgctttccctgtgccttccaagttgataagtattggattttgcattctgctcttttattttcttgagtggagaaattttgtgatgtagctgttattagaaagggtcagtaatggaagctgcggaaatcttgtgcgggctgtaattatacgtttgctctttttctcttaagttgttgagtccctcaagctttgcggagatttaggccggttttttaagcttgcatctcattagagggacaattgtttgttagttgtcaaaaatgtagttgtcctgtcataattatctagatttcctgatactcgaattcaactctttcatgccgtttttccacgttataaaatcttccttatcccttggagta

SEQ ID NO: 4899 - DNA, 791 bp, Eucalyptus grandis
aagtttcggtccggattcccgggatggttctctctcccgctgcttcgttccatttcgagcttcggcaagaacttttggaaggctgatcgcctctatatgccgctttgccttcggaagctgaactttttttggacttggaggcctgcccgagatcgaaccctttgcgctgattaattagctttcatgcaattgatgttttcatacggtcgtcgcatgttctttctgctgccgctgtgtttgtcaagttcctgttcgtatttctggatatagtgagagaagatgagtcgggcaagtgtggctggaccaaagggaaagaagaaaggggtatcctttacgatcgactgtgcgaaaccagtggaggacaagatcatggacattgcgtcatttgaaaagtttttgcaggagaagatcaaggtcgatggaaaggctggtgccctcggcgacattgttactgtcacgcgggacaagaccaagattaccgtgacttccgaaagtagtttctctaaacgttatctgaagtatttgacaaagaagtacctgaagaaacacaatgttcgagattggctgcgggtgattgcatcaaacaaggaccgaaatatctatgaagtcagatacttcaatatcgctgaaaatgaaggggaggaagaagattgaacatttagctttcaaaggagtgcttgttgctttccctgtgcctttccagttgataagtattggattttgcattctgctcttttattttcttgagtggagaaattttgtgatgtagctgttattagaaagggtcagta

SEQ ID NO: 4900 - DNA, 967 bp, Helianthus annuus
cgcagcgtacgcggggaccaagcctttaacaacaatctttcttgtacccaaacaagttgatttaaataaacgtttgaacatggttttcaggaccggatcggaaatcaaacggtttgactgtcacacaatacaaggaaaccgcaatagaaatccaaataacacatacataggtttctttatttcttacatgaaaacaaaacaccagttcttgtttgggtcaaagctcgatctcatcttcagcagttgcaaggatcgcacttgcagttacttccgcacttgcaggcgtttccgctctcggcaacctcggtttcctcagcaaaagtcatcctgggtgcaacaccgtcgacgatgatagtggtggtggtggtcgacatctcgacgttgcaggagttgcagttggcctccgtcttcgaatccagcagcaggagcaagatgagtcatggaggagcgaagggcgggaagaagaagcaatcgacgttcgtgattgattgcgggaagcctgttgaggataagatcatggagattgcatctcttgagaagtttcttcaggagagaatcaaggttggtggcaaagctggaaatctcggtgactccgttaccatttcccgtgaaaagaacaagatctccgtcactgctgatagcaacttctccaaaaggtatttgaaatacctaacaaagaaatacttgaaaaaacacaatgtgagggattggcttcgggtgattgcttctaacaaagaccgcaatgtgtatgagttacgtaacttcaacattgctgagaacgagggcgaagaggaagactgagctgaaggttgaccttgttttatgtttgtttgttttttacctggattggcttttaaagtatgttatcagatttattttatcaactgtattctggtacgattttgagttttaggtgcttttgcactgatcttgatttcacttccatggcaaatgcatctttgattca

SEQ ID NO: 4901 - DNA, 638 bp, Helianthus annuus
gttggcctccgtcttcgaatccagcagcaggagcaagatgagtcatggaggagcgaagggcgggaagaagaagcaatcgacgttcgtgattgattgcgggaagcctgttgaggataagatcatggagattgcatctcttgagaagtttcttcaggagagaatcaaggttggtggcaaagctggaaatctcggtgactccgttaccatttcccgtgaaaagaacaagatctccgtcactgctgatagcaacttctccaaaaggtatttgaaatacctaacaaagaaatacttgaaaaaacacaatgtgagggactggcttcgggtgattgcttctaacaaagaacgcaatgtgtatgagttacgttacttcaacattgctgagaacgagggcgaagaggaagactgagcggaaggttgactttgttttatgtttgtttttctacctggattggcttttaaaatatgttatcagatttattttatcaactgtattctggtacaattttgagttttaggtgcttttgcactgatcttgatttcacttccatggcaaatgcatctttgattcatctaaactaattcttgtttatggcatttaaattgagctttttagaatttcaccacaaaaaaaaaaaaaa

SEQ ID NO: 4902 - DNA, 573 bp, Triphysaria pusilla
cttttctctccacacactccagcagtcggcggtcgatttcatatccgtaaaagtagcaaagatgagtaaaggcgcggcggtggcgaagggcgggaagaagaagggatcgagcttcgtgatcgattgctcgaagccggtggaggataagattatggagatcgcttcacttgagaagtttttgcaggagagaatcaaggtcggagggaaagccggcgctctcggtgatgctgtcaccgtgtctcgtgagaagaacaagatcaccgtcactgctgattcgaatttctcaaaaaggtatctcaagtatttgaccaagaaatacttgaagaagcataatgtgagggattggcttcgggtgattgcttcaaacaaagaacgcaatgtttatgagctacgctacttcaacattgctgagcaagagggagaggaagaagactaatctttttgattcgtaacatgttgatcatttgtcagagctactttttggattcatttatgttggttctacactccttatcttgactttgcatttttttgttaatgtgactattatgttgccttgttaagtgtattggt

SEQ ID NO: 4903 - DNA, 556 bp, Triphysaria pusilla
cggcggtcgatttcatatcccttgcaggtaaaagtagcaaagatgagtaaaggcgcggcggtggcgaaaggcgggaagaagaagggatcgagcttcgtgatcgattgctcgaagccggtggaggataagattatggagatcgcttcactggagaagtttttgcaggagaggattaaggtcggagggaaagccggcgctctcggtgatgctgtcactgtgtctcgtgagaagaacaagatcaccgtcactgctgattcgaatttctcgaaaaggtatctcaagtatttgaccaagaaatacttgaagaagcataacgtgagggattggcttcgggtgattgcttcaaacaaagaacgcaatgtttatgagctacgctacttcaacattgctgagcaagagggagaagaagaagactaatcttcttttttatttgtaccatgttaatcttttcttagagccactttttggatacatttatgttgttggttctacaatccatatcttatgagactgcagttttggttaatggttaatgttatgtttattattgccttaa

SEQ ID NO: 4904 - DNA, 770 bp, Euonymus alatus
cggccgggggcaacaaactcacataaaacccgcggcattgttgagctgtgcatctcggctgcttgattttgtgactggagaagtagggagagcaaaatgagtcgcggcactgcaacgggagcgaaggggaagaagaagggagcgacgtttgtgattgactgcgccaagccggtggaggataagatcatggacattgcttcactggaaaagtttctcaaggagaggattaaggtcggtggcaaggctggtgccctcggtgatgccattaccgtgacacgagagaagagtaagataacagttacttccagcagcgacttctctaagaggtatcttaagtacttgactaagaagtatttgaagaaacacaatgttcgtgattggcttcgggtgatttcctccaacaaagataggaatatttatgaaattgcgttgcctcaacatagctgagaacgaaggggaagacgaagagtagagacctagctctgtatcttcatatattatccatttgatttacttgttttaggtttctttatatactttgtctggcagactacagacttgctgcggttgtttttgtggtttctaaagctgctgaaattttggtaacttgaaaatttgtgattctaatgttttaggggcaattggatgtgatgcagtttcttcgctttatgcttacttatttggcttagtgatacttatggcaaggaattgcattccattgtattttctgctattgatgttattaatgacaggccaaggacgggttcttc

SEQ ID NO: 4905 - DNA, 463 bp, Sarracenia psittacina
atatccagccagagtagaggcgcgaagatgagtcgtggggcggcggccggaccgaagggcaagaagaagggagcgacgttcgtgattgactgtggaaagccggtggaggacaagatcatggacatcgccacgttggaaaagtttctacaggagagaatcaaggtaggcggcaaggctggtgctcttggcgactccgtcaccgtaactcgcgacaagaacaagattaccgtcacctccgacagcaatttctccaagcggtatcttaaatacttggcaaaaaagtacttgagaagtacatgtgagggattggctccggtaattgctccaacaaagaccggaatgtctacgagctgcgaaacttcaacattgcagagaatgaaggggaagatgaagactgaagatacagtggccttttctcatattttatctgttctgatttgctctgaatgttgtagggcctctc

SEQ ID NO: 4906 - DNA, 557 bp, Ambrosia trifida
aaagttgagcactgcaacaatatttgaacaagaggtgcacatagataagaaatttgactgcaaaaaaatatttggaagtctgaataacaagtcattatgaaacaacccaacctgctctgctcagtcttcttcttcaccctcattttcggcaatgttgaagtatcttaactcgtaaacattgcggtctttgttggaagcgattacacggagccaatctcgcacattgtgcttcttcaagtatttcttggtcaagtatttcaggtaccttttggagaagttactatcagcagtaacagtaatcttattcttctcacgagaaatagtaacggaatcgcctaaattaccagctttaccaccaaccttaatcctctcttgaagaaacttctcaagtgatgcaatctccattatcttatcttctaccggctttccacagtcgatcacaaacgacgccgttttcttcttccctccctttgttccggcaactcgactcatcttcgattccaaatcgttcttctctgtgattggattggtttggtttcgaagacggcgaaatgaaa

SEQ ID NO: 4907 - DNA, 598 bp, Linum usitatissimum
gagttagagcagcagaagaggaacagagattagcagagatggctcgcggcgtggcggcagcagcagctggaacgaagggtggaaagaagaagggagtttccttcgtgatcgattgcgggaagcccgtcgaagataagattatggacatcgcctctctggagaagttcctccaggaaaggatcaaggtcgggggcaaggccggcgctcttggcgacgttgtctccatctccagggagaagaacaagatcactgtcacctccgacagcaatttctttaagaggtatttgaagtacttgaccaagaagtacctaaagaagcacaacgtgcgagattggctccgtgtgattgcttcaaacaaagagaggaatgtttatgaacttcggtacttcaatattgcagagaacgagggagaagaggaggattgaagactcaatcctgcacttatttgaatatcagctgtgttctttttgggcttctttcgcactctgtttgaatgatggttttgatatgtttagcgtgttgccaagctggatgcattgcactcacttatcgcctgttggaaattttggttcaatgattattagatatcaaaactttt

SEQ ID NO: 4908 - DNA, 648 bp, Avena sativa
gccgcctgcgcgccgccacacaaaccaccaccaacccgagcgtaggctgaggaggaagagaaggtgagatggctcgcggcgcggcggcggtggcggctgccaagggcaagaagaaggggtcggtctccttcgtgatcgactgcactaagcccgtcgaggacaagatcatggagatcgcgtcgctggagaagttcctccaggagcgcatcaaggtcgccggcggcaaggccgggaacctcggcgactccgtcaccgtcacgcgcgacaagagcaaggtcaccgtcacctccgacggcaacttctccaagaggtacctgaagtacttgaccaagaagtacttgaagaagcacaacgtgcgtgactggctacgtgtgatcgcagccaacaaggagcgcaatgtttacgagctccggtacttcaacatcgctgagaacgagggcgaggaggaagattagagtgcattccacttatattgtagtcttgggcttgttgggttttgatacttgatctgagtacctctagctatctacctatcttatgttgtgctctggtgaacatggatggtttgattttaaggatccttatattttgtcgtgtcaactatgaattcatatgttgtgaacctagacaagatttgctcttatttta

SEQ ID NO: 4909 - DNA, 611 bp, Setaria italica
ccacccgagcaccagccgagcggaggagagatggcgcgcggcgtggtggcggcgaagggcggcgcggccgcggggaagaagaaggggtcggtcaccttcacgatcgactgcaccaagcccgtggaggacaagatcatggagatcgcctcgctcgagaagttcctgcaggagcgcatcaaggtcgccggcggcaaggccgggagccttggcgactccgtcaccgtctcccgcgagaagaccaaggtcaccgtcacctccgacggccccttctccaagaggtataccacgcctgaagtacttgaccaagaagtacttgaagaagcacaatgtgcgggactggctacgcgtgattgcggccaacaaggaccgcaccgtgtatgagctccggtacttcaacattgccgagaatgagggcgaggaggaagattagagtgcattccacttatatcttagttttgagcttgttgaattttgatacttgtacccggtagtcatttgcacctatcttcccatgttatgctgtggtgaattttggatggttaatttgaagaatccttacatttgatcgcctcaatttttgtgcctactttgtgtctgcaagttatctgtga

SEQ ID NO: 4910 - DNA, 785 bp, Plantago ovata
atccgatagggtttctggagaaggtatttgagttcgtggcgaaggagagtgatctattcattctcccgcaccgccgccaccgttctcagtcgtcgtcacagacaggtaacaacatgagtaaaggagctgctgcagctacccaaaagggtggtaagaagaaggcatcggtcttcgtcatcgactgcggcaagcctgtcgaagacaagatcatggacatcgcttcgctcgagaaattcctccaggaacgcatcaaggtcggaggcaaagctggtgctcttggtgactctgttacgatcacccgtgacaaaactaagatctccgtcaccgccaatgacactaccttctccaaaaggtatctgaagtacttgacaaagaagtatctgaagaagaacaatgttcgtgactggctccgtgtgattgcttcaaacaaagaccgaagtgtttatgaattgaggtacttcaacattgccgaaaatgaagctgaggaggaggattaaagatagacttgcctaccagatctctattggcatgctacattttcattgttctagtttgttttcttttcactctatccatgttagacttcttcatccattttgtttctggaaccagaatgattatgaatattgttatattttagaatggagaaaagaattgtgaggcgcttctagtacaaggctcagcatattattacaccaaccaatcttaattgtgtttgttgattatagatagtatgctatattttgttacaccaattaatggcaactcttgtttaaccaattgaa

SEQ ID NO: 4911 - DNA, 522 bp, Thalictrum flavum
gcagcaaaggggttaagggaaatgttccaaagggagggaagaagaagggagcaagcttcgttatagattgtgcaaagcctgttgaagacaagatcatggatattgcttcacttgagaagtttttgcaagaaaggattaaggttggtggtaaagctggagctcttggtgattcagtcactatttctcgtgaaaagaataagatcactgttacttctgacaacactaccttttcaaagaggtatttgaagtacctaacaaagaagtacctgaagaagcacaatgtcagagactggcttcgagtcattgcttccaacaaagaccgtaatgtctatgagttgcgttactttaacattgccgaaaacgaagcagaggaagaggattaataaatttatgtatgtttgttttgttggtagttcacatttgggatgtttgggatacaattcaagttttatgttttattcgcttaatgaattctaattacttctattattctagtagtttttagactatctctaagttacg

SEQ ID NO: 4912 - DNA, 749 bp, Nicotiana benthamiana
ttcggccattacggccgggactgatgtattcaacgagtttatagccttggccgacaggcccgggtaatctttgaaatttcatcgtgatggggataggcgcagctgaacacatctactcaggtcgaatatgagtaaaggaagcagtggaggaggagccaccaaaggtggaaagaagaagggagcagcattcgtaattgattgttcaaagccagtggaggataagatcatggaaattgcttcactcgagaaattcctgcaggaacgcatcaaagttggaggaaaagctggggctctcggtgacactgtcactgtcactcgtgacaagaccaaaattaccgtcacctcagacagcactttctccaagaggtatttgaaatacttgacgaagaaatatctaaagaagaataacgtgcgtgattggcttcgagttatttcttcaaacaaggatcgcaatgtgtacgagttaaggtacttcaacattgctgagaatgaggccgaggaggaagattgagaactatggcttcgagttatttcttcaaacaaggatcgcaatgtgtacgagttaaggtacttcaacattgctgagaatgaggccgaggaggaagattgagaactagaagcagtagattgtaattgttctctcttttttgacatagtttacactttttgtctggattcaaatcgtttgcatttttgctctgtttttaagggagaaatgagattgtgttactggaattggtttatttctt

SEQ ID NO: 4913 - DNA, 558 bp, Lippia dulcis
gaaggcggcaaagatgagcaaaggtgcggcggcgacgggatccaaaggcgggaagaagaagggcgcgaccttcattatcgattgcacgaagccggtcgaggataagattatggagattgcctcgctcgagaagtttttgcaggagagaattaaggtcggcgggaaagccggcgctctcggggactccgtcaccgtaactcgtgacaaaagcaagatcaccgttaccgctgattccgctttctccaagaggtatattaagtatctgactaagaaatacttgaagaagcataacgtcagagattggcttcgggtgatcgcttccaacaaagatcggaatgttatgaactgcgctacttcaacattgctgagcaggagggcgaggaagaagattaaattgcagcattttggatcagttatccagttctgagttgttggtttagccttcaggatttcatctcaaaaattaacaatcccctagattttgagcttggattttagctctctcttattgcattatgttgctcgtatttcatatataattattcagcagcagtagat

SEQ ID NO: 4914 - DNA, 772 bp, Setaria italica
ccgagcaccagccgagcggaggggagatggcgcgcggcgtggtggcggcgaagggcggcgcggccgcggggaagaagaaggggtccgtctccttcgtgatcgactgcaccaagcccgtggaggacaagatcatggagatcgcctcgctcgagaagttcctgcaggagcgcatcaaggtcgccggcggcaaggccgggagccttggcgactccgtcaccgtctcccgcgagaagaccaaggtcaccgtcacctccgacggccccttctccaagaggtacctgaagtacttgaccaagaagtacttgaagaagcacaatgtgcgggactggctacgcgtgattgcggccaacaaggaccgcaccgtgtatgagctccggtacttcaacattgccgagaatgagggcgaggaggaagattagagtgcattccacttatatcttagttttgagcttgttgaattttgatacttgtactcggtagtcatttgcacctatcttcccatgttatgctgtggtgaattttggatggttaatttgaagaatccttacatttgatcgcctcaatttttgtgcctactttgtgtctgcaagttatctgtgactggagaaaatgtcatgtttagaattcctccgacttcaagattgtactctgattgacgccaaaggtgatacagagaatattgcgttggtgtgaaaattatgagcggtacttattctgcttccttcccactgtctgaagtctattgacattgtaccgtgcaagcatatcaaag

SEQ ID NO: 4915 - DNA, 734 bp, Sorghum bicolor
ccctctcgtcccggaaaaccctagccgccacaccccacgacccactcgagcaccgagccgagggaaggagggaacgggcgatggcgcgcggcgtggtggcggcgaagggcggcgcggccgcgggcaagaagaaggggtcggtcgccttcacgatcgactgcaccaagcccgtggaggacaagatcatggagatcgcctcgctcgagaagttcctccaggagcgcatcaaggtcgccggaggcaaggccggcagcctcggcgactccgtcaccatctcccgcgagaagaccaaggtcaccgtcacctctgacgggcccttctccaagaggtacctgaagtacttgaccaagaagtacttgaagaagcacaacgtacgggattggctacgcgtgattgcagccaacaaggaccacagtgtctatgagctccggtacttcaacatcgccgagaatgagggcgaggaggaagattagagtgcatcacacttatatcttagttttgaactcattgaattttgatacttgtacccgtagttctgcaactgtccttatgttatgcggtggtgaattttggatggttaatttgaagaatccttacatttggctgcctcaacatcagagtgccctagtctctgtacaagttatgtgtgaacagcgaaatgtaatgtgcaggatttcttgcatttcttaatatttttatactctggttggtgccaaaggttattttcattgctg

SEQ ID NO: 4916 - DNA, 842 bp, Sorghum bicolor
tccgctccaacaaaccggcccgccaactggcgggcgctcgaatggcagcccacgtaccctatatatatcttgccagccgcatcctcgctccctctcgtcccggaaaaccctagccgccacaccccacgacccactcgagcaccgagccgagggaaggagggaacgggcgatggcgcgcggcgtggtggcggcgaagggcggcgcggccgcgggcaagaagaaggggtcggtcgccttcacgatcgactgcaccaagcccgtggaggacaagatcatggagatcgcctcgctcgagaagttcctccaggagcgcatcaaggtcgccggaggcaaggccggcagcctcggcgactccgtcaccatctcccgcgagaagaccaaggtcaccgtcacctctgacgggcccttctccaagaggtacctgaagtacttgaccaagaagtacttgaagaagcacaacgtacgggattggctacgcgtgattgcagccaacaaggaccacagtgtctatgagctccggtacttcaacatcgccgagaatgagggcgaggaggaagattagagtgcatcacacttatatcttagttttgaactcattgaattttgatacttgtacccgtagttctgcaactgtccttatgttatgcggtggtgaattttggatggttaatttgaagaatccttacatttggctgcctcaacatcagagtgccctagtctctgtacaagttatgtgtgaacagcgaaatgtaatgtgcaggatttcttgcatttcttaatatttttatactctggttggtgccaaaggttattttcattgctgctggtttgaaacttttgac

SEQ ID NO: 4917 - DNA, 637 bp, Tabernaemontana elegans
aagggggccggagctggagccctcaagggagggaagaagaagggagcaacattcgtgattgattgctcaaagccggtggaggataagattatggacatctcctccttggaaaagtaccttcaggagcgaatcaaggttggcggcaagcccggtgcccttggcgactccgtcactgtcacccgtgacaagactaagatcagtgtcacagctgattccaacttttccaagcggtatttgaagtacttaacaaagaagtatctcaagaagaacaatgtgcgtgattggcttcgtgtgatttcatcaaacaaggaccgtagcgtgtatgaattgagatacttcaacattgctgagaatgaggctgaggaggaagaatgataatttgtttggatcccttattcagaaggcttcattattggattgcttaatctgtacttttgatacctttagaatttgggggattgaattggattatgttttacagtttttattctggagacaaacgagcaaattattgagaagaagttttggacttaggccaactgaaaaatctgttcgcatttctcaagttgaatacaattagatctacgcattttgccttttggtcaatttctgaaataacttttatgtaattcaactt

SEQ ID NO: 4918 - DNA, 499 bp, Cicer arietinum
ttcgattagcgtggtcgcggccgaggtgttgtcgccgctgctcttcaatcggaaggaggtttacaaaaaagagaagagaaaatgagtcgaagtggtgcagctggagccaagggaaagaagaagggtgcaacattcaccattgactgttctaagccagtggaagacaagatcatggacattgcatctcttgagaagtttcttcaagagaggatcaaagtcggtggcaaagctggtgcccttggtgattctgtcactgttacccgtgagaagagcaagatcactgttacctctgacagtaacttttccaaacgatatttgaagtatttgacaaagaaatacttgaagaagcacaatgttagagattggctcagagtgattgcttcaaacaaagatagaagtatctatgagctgaggtacctcggccgcgaccacgctaatcactagtgaattcccggccgcctgcaggtcgaccatatgcccgacctcccaacgcgttggc

SEQ ID NO: 4919 - DNA, 564 bp, Utricularia gibba
cggcggcggcagttaccggaaagtgaagatgagtaaaggtgcagttgccggcgcgaaaggcgggaagaagaagaccgcaactttcgtcatcgattgctccaagcccgtagaagataagattatggagatcgcgtctctcgagaagttcctccaggagaaaatcaaggtgggtggtaaaaccggcgccctcggggaatcagtcaccgtcattagggagaaaaacaagatctctgttactgctgataccgctttctccaaaaggtacctcaagtatttgaccaagaaatacttgaagaagcacaatgtgcgagactggctgcgggtaattgcctcaaacaaagaccgtaatgtatatgagttgcggtacttcaacattgctgagcaggagggagaggaagaagattaaacttccacaccgcgctgcctcgcctcttgtcactctgttttttttgtgctccagaataccctcttctcattgaaaccgtatgttgcattttgattctagacaatgttgtgtctcgttacttgtttccttgcaatatcacttttatgcagacgtgtttc

SEQ ID NO: 4920 - DNA, 627 bp, Senecio madagascariensis
acgcgggggccgtcttcaaatccaaaaaggtaagcgaaaatgagccgtgttgcgggagcaaagggaggaaagaagaagctgtcgacattcgtgatcgattgcggaaagccggttgaagataagatcatggagattgcttctctcgagaagtttcttcaggaaaggattaaggtcggtggcaaagccgggaatctcggggagtctgttaccatttctcgtgagaagaataagatctccgttaccgctgacagcaatttctccaaaaggtatcttaagtacttgacgaagaaatacttgaagaagcacaatgtgagggattggcttagggtgattgcgtcaaacaaggaccgcaatgtgtatgagctacgttacttcaacaacgcagagaacgagggtgaggaagaagactaaacaacatggtgttgcagaccttgttttatgtagttttttggcaattgcttgagcttcgtagacttgtgatatcagtttcttatttgtcagacttaaatattgttatgccgtaaaattttcctgtctgttcttttgcaaggaaaatctgctgtttagatatctaaattttcctatagcatttattctcagtattattttgctcaagtgaaacctgtt

SEQ ID NO: 4921 - DNA, 748 bp, Ambrosia trifida
tctcattccagttgccgttggccgtcatcgaatctaggagcaagatgagtcatggaggagcaaagggtgggaagaagaagacatcaacaaccttcgtaattgattgcgggaagcctgtagaagataagatcatggagattgcatctcttgagaaatttcttcaggaaagaatcaaggttggtggcaaagctggaaaccttggtgactcggttaccatttcccgtgaaaagaataagatctctgttactgctgatagcaacttctccaaaaggtatctgaaataccttacaaagaagtacttgaaaaagcacaatgtgagggattggcttcgggtgatctcttctaacaaagaccgcaatgtgtatgagttacgttactttaacattgctgagaatgagggtgaagaggaagactgagcccaaggttgaccttgttttatgtttgttttccttttacctggattggcttttaaaatatgtttatcagatttattttatcaactgtattttggtacaattttgagtttaggtacttttttcttttttcaatttaaaacttctgaagttttatttcatcatctgttcatccattttcttgattcacatatattgtaatacaaaacaataaaaaccagtagaaacatatataatcaatttcattataataatcatggaacaacaaataattagagtcactagcaccggtacacataatatgctcgcggccgtggctgtggaaggcagaccgc

SEQ ID NO: 4922 - DNA, 559 bp, Brassica napus
tgcagcagttgccaagggaaagaagaagggagtgtccttctccatcgactgctccaagcctgtcgatgacaagatcatggagattgcttccctcgagaagttccttcaggagaggatcaaagtcggtggcaaagccggtgcacttggtgactctgtcaccatcacgcgcgagaagaacaagatcaccgtcacttctgatggtcagttctccaagaggtatctcaagtacttgacgaagaagtatttgaagaagcacaacgtgagggattggctcagagtgattgcagccaacaaggaccgtaacctctacgagttgaggtacttcaacatcgctgagaacgagggtgaggaagaagactagaagatctttatacttttcttgtattgttttctgctcgttcgttgttgctcaatacattttatatttcttttttcacagatcttatctagttttggttaaactcttgttttcagacaattatttgagaaaaaatatcgtatgattcctgaatcttttaatgcggattaaataattattcagattgattaactggatagt

SEQ ID NO: 4923 - DNA, 446 bp, Euphorbia peplus
aagaagaagggagcaactttcaccattgattgcacgaagccggtggaggacaagatcatggacatcgcttcactcgagaagttcctccaggagcgtatcaaagtcggcggcaaagctggagctctcggcgattccgtcaccgtttcccgcgagaagtccaagatcaccgtcacttctgactccaacttctccaaacgatatctcaagtatttgacaaagaagtacttgaagaagcacaatgtgagggattggcttcgtgtgattgctgctaacaaggacaggaatgtgtacgagctgagatacttcaacattgctgagaatgaaggagaggatgaagagtaaattctttctcgagtttctttttgtttcatagaaacatattagggttctttgttatgttttagatatggatttcaatgaaattttcttaaaaattctatcatcag

SEQ ID NO: 4924 - DNA, 692 bp, Artemisia annua
cagtggtatcaacgcagtactccaacgggggcactttgcagcttcctttttccaaaccaacaggtacaattctcaccacttccagaaacaaaaatgagccgtgtagcagcaggtggtaaaggcgggaaaaagaagtcagtgacatttgtgatcgactgtgggaagccagttgaggacaagatcatggaaattgcatcgcttgaaaagtttcttcaagaaaggattaaagttggtggcaaagctggtaatcttggtgattctgtcactatttcccgcgaaaagaataagatttctgttactgctgattccaacttctctaaaaggtatcttaaataccttacaaagaagtacttgaagaagcacaatgtcagggattggcttcgtgtgattgcctccaacaaagagcgtaatgtttatgagttgcggtacttcaacattgctgaaaatgaaggtgaggaggaagattgagcagagttcatgtttaatagactttcttggcatggtttctagtccttactatttacaaacccttttgaaattgttttgaagtagaattatgagtttaaatgccctcacaaattagtatcaccaaagatatctgaatttatcgtcacaaccatgaaagttttttcctgaatatatattgttatgtgggcatatatcaaatgcgatttcttccatgtagttgtttt

SEQ ID NO: 4925 - DNA, 587 bp, Brassica rapa
gacgccgcagttccatcttccagcattttcctacggagagagagaggtgaaaatgagtcgtgcagcagctccaaagggaaagaagaagggagtttcctttaccatagattgttctaagcctgttgatgacaagatcatggagattgcttccttagagaagtttctccaggagaggattaaggttggtggcaaagctggtgctctcggtgatactgtctcaatcactcgtgacaagaacaagatcacagtcacctctgatggccagttctccaagagatacctcaagtacttgacaaagaagtacctgaagaagcacaatgtcagagattggctcagagtgattgcagccaacaaggaccgtaacctctatgagttgaggtacttcaacattgctgagaacgaagctgaggaagaagactaaataaaccaagatttttttctgatcatctcttcatcttagttggtttttgattctactacaatcatctctgttctggttagatactatctagtttggttgaagggatacgttttggtttgttactgcgcatttgagcttctatggagtcttgtttttttttttccgg

SEQ ID NO: 4926 - DNA, 630 bp, Brassica napus
gacgccgcagttccatcttccagcattttcctacagagagagagaggtgaaaatgagtcgtgcagcagctccaaagggaaagaagaagggagtttcctttaccatagattgttctaagcctgttgatgacaagatcatggagattgcttccttagagaagtttctccaggagaggattaaggttggtggcaaagctggtgctctcggtgatactgtctcaatcactcgtgacaagaacaagatcaccgtcacctctgatggccaattctccaagagatacctcaagtacttgacaaagaagtacctgaagaagcacaatgtgagagattggctcagagtgattgcagccaacaaggaccgtaacctctatgagctgaggtacttcaacattgctgagaacgaagctgaggaagaagactaaacaaaccaagattttttctgatcatctcttcatcttagttggtttttgattctactacgattgtctctgttctggttagctattatctagtttggttgaagggatacactttggtttgttaccgcgcatttgagcttctatggagtcttgtttttttttccagacagttatttcggttaaccgagtggagttcgcaaatgtttcgttcc

SEQ ID NO: 4927 - DNA, 608 bp, Zingiber officinale
  misc_feature (28)..(28): n is a, c, g, or t
  misc_feature (30)..(30): n is a, c, g, or t
  misc_feature (66)..(66): n is a, c, g, or t
  misc_feature (70)..(70): n is a, c, g, or t
  misc_feature (74)..(74): n is a, c, g, or t
  misc_feature (79)..(79): n is a, c, g, or t
  misc_feature (104)..(104): n is a, c, g, or t
  misc_feature (125)..(125): n is a, c, g, or t
  misc_feature (137)..(137): n is a, c, g, or t
  misc_feature (143)..(143): n is a, c, g, or t
  misc_feature (146)..(146): n is a, c, g, or t
  misc_feature (209)..(209): n is a, c, g, or t
  misc_feature (212)..(212): n is a, c, g, or t
  misc_feature (239)..(239): n is a, c, g, or t
  misc_feature (260)..(260): n is a, c, g, or t
  misc_feature (269)..(269): n is a, c, g, or t
  misc_feature (311)..(311): n is a, c, g, or t
  misc_feature (338)..(338): n is a, c, g, or t
  misc_feature (389)..(389): n is a, c, g, or t
  misc_feature (459)..(459): n is a, c, g, or t
  misc_feature (479)..(480): n is a, c, g, or t
  misc_feature (483)..(483): n is a, c, g, or t
  misc_feature (494)..(494): n is a, c, g, or t
  misc_feature (534)..(534): n is a, c, g, or t
gcacgaggtctcttcaagcggcggcttnantcgatcgggaaatgagtcgtggcagcggagggtcgncggncgcngccgngaagggcgggaagaagaaaggttcnaccttcgtcatcgactgcgcnaagccggtggangacaanatnatggacatcgcctccctggagaagttcctccaggagcgcatcaaggtgaacggaggcaaggcnggngcccttggtgacgccgtcaccgtcacncgtgacaagagcaagatcacngtcacctcngaagggcccttctccaagcgatacttgaagtacctaacgaanaagtttctgaagaaacacaatgtgcgngattggctgcgagtcattgcttcgaacaaggaccgcaatgtttacgaactncggtattttaacattgcagagaacgaaggcgaggacgaagattaatctgccatgttaccctttcctcaantttagaaggcttcttgtttnntantgtttgtttangcttaaacttgagtaagcttatctttgaatgaatgcttantatttcgatttgacacctccatgtgtgagcttgtttaggtcaaaaatattctgtctgatattatttttgggctt

SEQ ID NO: 4928 - DNA, 545 bp, Liriodendron tulipifera
  misc_feature (543)..(543): n is a, c, g, or t
agaagatgagccgaggaggaagcgctccgaagggagggaagaagaagggagcgatcttcgtcatagactgtgcgaagccggtggaggacaagatcatggaaatcgcctctttggagaaattcctccaagagcggatcaaggtcggtgggaaggccggctctctcggagactccatctccatctcccgcgacaagaacaagatcactgtcacctccgacaatccattgtccaagaggtatttgaagtatctaaccaagaagtacttgaagaagcacaatgtgagggattggttacgggtcattgcctcgaacaaagaccgcaacgtatacgaactccgttacttcaacatcgcagagaatgaggctgaggaagaagattgatattttctttcgtccttttgtttctcttctatcatttatttttgcagtctttagtaatatctatccagagaccagaataccaattttgccatgcaacggattgtaggatttgttgcaccatcaagaagtttcaatttttcctatcaaatgaggattctatctnag

SEQ ID NO: 4929 - DNA, 784 bp, Carica papaya
cctcacggacggcgcacgtcttctcacctccaacatcttcgactttcgttggagcaacagtagataagtgaaaatgagtcgaggaagtgcaggagcacccaaggggaagaagaagggtgtcagttttaccattgattgttcaaagccagcagaagataaaatcatggatgttgcatcacttgagaagtttcttcaggagaggatcaaggttggtggaaaggccggtgctcttggtgaagttataactattacacgtgaaaagggcaagattattgtcacttctgagagccagttctcgaagaggtatcttaagtacttggctaagaaatatttgaagaagcacaatgtgcgagactggctccgagttgttgcatcgaacaaggaccgcggtgtttatgagttgaggtacttcaacattgatgagaatgaaggggaagaagaggattgaaagttataactgttttactcaacaactttgttttaccttattttgaaatatgggttgtttagtttttagttatgtgattcaaactttatatttatggaactattgtggttttacaattttgtttattgaattgaagatcttgcactgatgctgttgttgcaatgcgggatatagaagagttgctctactaaatgaagtaacttggatctctccatgctttagcttttcaaatttgggactatctggtgattattgaatcaatcttaatagggttctaatatggtgcctaaggaaacaccatacctctggttaatctcagttaagatttcatatttc

SEQ ID NO: 4930 - DNA, 749 bp, Panicum virgatum
gaaaaaccctagccgccacacctcacgacccacccgagcaccagcggaggggcaggggagatggcgcgcggtgtggtggcggcgaaggccggcgcggccgggggcaagaagaagggctcggtcaccttcacgatcgactgcaccaagcccgtggaggacaagatcatggagatcgcctcgctcgagaagttcctgcaggagcgcatcaaggtcgccggcggcaaggccgggagcctcggcgactccgtcaccgtctcccgcgagaagaccaaggtctctgtcacctccgacgggcccttctccaagaggtacctgaagtacttgaccaagaagtacttgaagaagcacaacgtgcgggattggctacgcgtgattgcagccaacaaggaccgcactgtctatgagctccggtacttcaacatcgccgagaatgagggcgaggaggaagattagagtgcattcaacttatatctcagttttgaacctgttgaaatttgatacttgtacccgtagtcatttgcacctatcttctcatgttatgctgtggtgaattttggatggttaatttgaagaatccttacatttggtcgcctcaacttctgagtgcctactcttggtccatgcaagtttaagttgtcaacggagaaaagtagtgtgtagggtttctctcaacttctcgcttgtactctgattgacgcctacagtttatattgctttggtgtgaaaattatcagcgttacttttctgct

SEQ ID NO: 4931 - DNA, 366 bp, Ricinus communis
tggaggagcaaagggtgggaagaagaggggagcgaccttcactattgactgcgcaaagccagtggaggataagatcatggacattgcctctctggagaaatttctccaagaaaggattaaggttggcggcaaggccggtgctcttggcgacaccgtttccgtctctcgtgagaagaccaagattaccgttacctctgacagtaacttctctaaaaggtaataattgaccaagaaatacttgaagaaacacaatgtgcgagattggcttcgtgtgattgcttccaacaaagataggaatgtttatgaactccgttacttcaacattgctgagaatgagggagaggaggaggattgaagatctggttc

SEQ ID NO: 4932 - DNA, 451 bp, Sarracenia psittacina
agaggcgcgaagatgaagtcgtggggcgacggctggaccgaaggcaagaagaagggagcgacgttcgtgattgactgtggaaagccggtggaggacaagatcatggacatcgccacgttggaaaagtttctacaggagagaatcaaggtcggcggcaaggccggtgctcttggcgactccgtcaccgtgactcgcgacaagaacaaggttaccgtcacctccgacagcaatttctccaagcggtatcttaaatacttgacaaaaaagtacttgaagaagtacaatgtgagggattggctccggtaattgcttccaacaaagaccggaatgtctacgagttgcgatacttcaacattgcagagaatgaaggggaagatgaagactgaagatacagtggccttttctcatactttatctgttctgatttgctctgaatgttgtagggcctctc

SEQ ID NO: 4933 - DNA, 459 bp, Brassica juncea
acattttgtttcccgtctcctctctcgttcaaccggcgccgctcgtcttcaaggaaaggtttgagagaaaatgagtcgtggaagtgcagccgttgccaagggaaagaagaagggagtctccttctccatcgactgctctaagccagtcgatgacaagatcatggagattgcttccctcgagaagttccttcaggagaggatcaaagtcggtggcaaagccggtgcactcggtgattccgtcacaatcacccgtgagaagaacaagatcactgtcacttccgatggccagttctccaagaggtatctcaagtacttgacgaagaagtacttgaagaagcacaatgtgagggattggctgagagtgattgcagcgaacaaggaccgtaacctctatgagttgaggtacttcaacatcgctgagaacgaggaccgtaacctctatgagttgaggtacttcaa

SEQ ID NO: 4934 - DNA, 1182 bp, Theobroma cacao
tggccgttgatcaccattactttttcacagcaaacggtgcaccactgccgcatcagatcatcactcgcaccaagactatagaccgaaattaaggtccccaaattctaaatgggaaatcgtttaaccccttaaaaatccgaacgtttcttcttcttctcaagtcaccgccttttcttcagtttcagctttcaacgctcattcaccggataaattgaaaatgagtcgaggtagtgcggctggacccaaggggaagaagaagggagttacgttcactatcgattgctcgaagccggtggaggataaaatcatggaaattgcctccctggagaagtttctgcaggagaggatcaaggttggaggcaaggctgctgcgctcggtgaaactgtagctctcaccctcgagaagagcaaaatcattgtcactgctgatggcgccttctccaagagatatctgaagtacttgaccaaaaaatacttaaagaaacataatgtacgggattggctctgagtgattgcatccagcaaagatcaagctgtttatgaactaaggtacttcaacattgctgagaacgagggagaggaagaagactgatagttgggatcgacccgttgtaacactaattgcttggtcatttttttttcattttgattattttgaggctaaatatgttgaacaattgggcttacaaacttatttttgaatataacattttgcaatgccactttttgaggattgggatattaaagattgcatcatggaatgtggtatatccaattgaacccattttatattgtgattttgtagttaagcttagaatggtatcagtaaggaggattggaggcattccacttatgaccatttgctaattctctcagctttgttttttagctgattccatggtgatgctcgccactcctctaagtttcagtccttcgcgtgttttcggaagctttacagattttcatcatctagagactagactctacaatcagggtctgggcaacaccatgagaaaagggatcaaactaagttggagtactggttttttgccaatcctgatgaaaggctaaagttggaatggagtttattttgatgcaaaaggcttgaatattctcgacttagttctgctttccaagccccgttcttcctttcttcccaaccaattaatgcagactctagga

SEQ ID NO: 4935 - DNA, 640 bp, Phalaenopsis aphrodite
ttttgttcaggaaggagcgagagaaaagaagaaaagatgagccgaacgggaagcagcgccggggctaagggcgggaagaagaaaggctcgacctttttcatcgattgttcgaagccagtggaggacaagatcatggacatcgcctcactcgagaagttccttctggagcggatcaaggtcgcttctcttggcggaaaagctggtacgttgggagatgctgtacgcgttacgcgagagaagagtaagatcacggttacttctgaaggacccttttccaagagatatttaaagtatctgacgaagaagtacctgaagaaacacaacgttcgggattggcttcgagtcatcgcctccaacaaagaccggaatgtttatgagctgcgctacttcaacattgctgagaacgagggcgaggaggaggattaaaatcttagttccaggcatttgctgttctatttctctgcttcttttttgggattggacctggagaaacttgcatgttctttttgatttgctgttatttatctttgagaagtatttttttttctcttaagttggaaggaacttgtagatttgattcatgaatgtagtttgtttcagcacatatatacatatttcaaatgtcatgcaacataaaatt

SEQ ID NO: 4936 - DNA, 574 bp, Festuca arundinacea
  misc_feature (155)..(155): n is a, c, g, or t
  misc_feature (428)..(428): n is a, c, g, or t
  misc_feature (529)..(529): n is a, c, g, or t
  misc_feature (538)..(538): n is a, c, g, or t
ggcacgaggccgccacacacaccaccaccaacccgagcacagcccgaggaggaagagagggtgagatggctcgcggcgcagcgacttcggcggcggctgccaagggcaagaagaaggggtcggtctccttcgtgatcgactgcaccaagcccgtngaggacaagatcatggagatcgcgtcgctggagaagttcctgcaggagcgcatcaaggtcgccggcggcaaggccgggaacctcggcgactccgtcaccgtcacgcgcgacaagagcaaggtcaccgtcacctccgacggcaacttctccaagaggtaccttaagtacttgaccaagaagtacttgaagaagcacaacgtgagggactggctacgtgtgattgcagccaacaaggaacgcaatgtttacgagctccggtacttcaacatcgcngagaacgagggcgaggaggaagattagattgcatttcacttatattgtattctggcgctgttgagttttgatacttgaatctgagtacctctagttatctncctatcttntgttgcgccccattgaacatggataattcgatgtta

SEQ ID NO: 4937 - DNA, 751 bp, Avena sativa
gctggtaaaccctagccgcctgcgcgccgccacacagcaccaccaacccgagcgtaggccaggaggaagagaaggtgagatggctcgcggcgcggcgacggcggcggcggctgccaagggcaagaagaaggggtcggtctccttcgtgatcgactgcaccaagcccgtggaggacaagatcatggagatcgcgtcgctggagaagttcctccaggagcgcatcaaggtcgccggcggcaaggccgggaacctcggcgactccgtcaccgtcacgcgcgacaagagcaaggtcaccgtcacctccgacggcaacttctccaagaggtacctgaagtacttgaccaagaagtacttgaagaagcacaacgtgcgtgactggctacgtgtgattgcagccaacaaggaacgcaacgtttacgagctccggtacttcaacatcgctgagaacgagggcgaggaggaagattagagtgcattccacttatattgtagtcttgggcttgttgagttttgatacttgatctgagtacctctagctatctacctatcttatgttgtgctctggtgaacatggatggtttgattttaagaatccttatattttgtcgtgtcaactatgaattcatatgttgtgaacctagacaagatttgctcttattttacgaactgctgtgctaaattatgctgcttcgctcgtgtgaagtttgtagccgtgttgtttatgccctttgagcttatgtaaggtcttctg

SEQ ID NO: 4938 - DNA, 741 bp, Avena sativa
cctagccgcctgcgcgccgccacacagcaccaccaacccgagcgtaggccaggaggaagagaaggtgagatggctcgcggcgcggcgacggcggcggcggctgccaagggcaagaagaaggggtcggtctccttcgtgatcgactgcaccaagcccgtggaggacaagatcatggagatcgcgtcgctggagaagttcctccaggagcgcatcaaggtcgccggcggcaaggcagggaacctcggcgactccgtcaccgtcacgcgcgacaagagcaaggtcaccgtcacctccgacggcaacttctccaagaggtacctgaagtacttgaccaagaagtacttgaagaagcacaacgtgcgtgactggctacgtgtgattgcagccaacaaggaacgcaacgtttacgagctccggtacttcaacatcgccgagaacgagggcgaggaggaagattagagtgcattccacttatattgtagtcttgggcttgttgagttttgatacttgatctgagtacctctagctatctacctatcttatgttgtgctctggtgaacatggatggtttgattttaagaatccttatattttgtcgtgtcaactatgaattcatatgttgtgaacctagacaagatttgctcttattttacgaactgctgtgctaaattatgctgcttcgctcgtgtgaagtttgtagccctgttgtttatgccctttgagcttatgtaaggtcttctg

SEQ ID NO: 4939 - DNA, 703 bp, Linum usitatissimum
ataaataagttggggaaaggttggcttgggcggcttcatttttcccgagatttagagcatctgaagcagacgaagaatagcagtgatggctcgcggcgtggcggcagcggcagcaggaacgaagggtgggaagaagaagggagtttccttcgtgatcgattgcgggaagcccgtcgaggataagattatggacatcgcctctctggagaagttcctccaggaaaggatcaaggtcggaggcaaggccggtgctcttggcgacgttgtctccatctccagggagaagaacaagatcactgtcacctccaacagcgatttctctaagaggtatctgaagtacttgaccaagaagtacctaaagaagcacaacgtgcgagattggctcagggtgattgcctcaaacaaagagaggaatgtctatgaacttcgatacttcaacatagcagagaatgagggggaagaggaggattgaagactcaatcctgcacttatttaaatatcagctctgttcttttctgggctttttttgcactctgtttgaatgatggttttcatatgtttagcgtgttgccaagctggttgcattgcactcacttatcgtctgttggaaattttggtttaatgattattagatatcaaaactttttctggatcagctgcctatctcggctatggtttttgcttgaaatctttgcagttggac

SEQ ID NO: 4940 - DNA, 620 bp, Linum usitatissimum
gggcttcatttttcccgagatttagagcatctgaagcagacgaagaatagcagtgatggctcgcggcgtggcggcagcggcagcaggaacgaagggtgggaagaagaagggagtttccttcgtgatcgattgcgggaagcccgtcgaggataagattatggacatcgcctctctggagaagttcctccaggaaaggatcaaggtcggaggcaaggccggtgctcttggcgacgttgtctccatctccagggagaagaacaagatcactgtcacctccaacagcgatttctctaagaggtatttgaagtacttgaccaagaagtacctaaagaagcacaacgtgcgagattggctcagggtgattgcctcaaacaaagagaggaatgtctatgaacttcgatacttcaacatagcagagaatgagggggaagaggaggattgaagactcaatcctgcacttatttaaatatcagctctgttcttttttgggctttttttgcactctgtttgaatgatggttttcatatgtttagcgtgttgccaagctggttgcattgcactcacttatcgtctgttggaaattttggtttaatgattattagatatcaaaactttttttg

SEQ ID NO: 4941 - DNA, 566 bp, Camellia sinensis
ggggaatcactgcctccctcctcatcttcgctctgctcgtcgccgcttcatcttcttccctttcagttcaatcagacttcgtaccggcggtggttggaggatgagtcgaggcggaagcgcggcggccggaggtggcaaggggaagaagaagggggcgacgttcacgatcgactgcgcgaagcctgtggaggataagattatggagatcgcctccctcgagaagtttctccaggagcggatcaaggtcgggggcaaggccggtgcgctcggcgactccgtcactgtcactcgtgagaagaacaagatcactgtcacctgcgatagcaacttctccaagcggtatttgaagtacttgaccaagaaatacttgaagaaacacaatgttcgtgattggctccgggttattgcttccaacaaagatcgaaatgtgtatgaacttaggtacttcaaacattgctgagaatgagggtgaagatgaagattgatgatcgctctcatatgtcatagcattcttgtttcattgcgcagttgtagttcttgtatgtttaatttgtactctttttcac

SEQ ID NO: 4942 - DNA, 699 bp, Lippia dulcis
cacacagttcacgtactcagccgttcgattcacctgagtaaaagaaagtgtgcgaagatgagcaaaggcacggcggctgcggcgtccaagggtgggaagaagaagggggttaccttcgtgatcgattgctcgaagccggtggaggacaagatcatggagatcgcttcgctggagaagtttttgcaggagagaattaaagtcggtggcaaagctggtgccctcggtgattccgttactgtcagccgtgacaagagcaagatcaccgtcacagctgattccgctttctccaaaaggtatttgaagtatttgacaaagaaatacctgaagaagcacaatgtgagggattggcttcgtgtgatttcttccaacaaagaaagaaacgtgtacgaactgcgctacttcaacattgctgagcaagagggagaggacgaagattaaatatagagagattaagtttcatgttcattttatgcttgctcaaaattgtcaaaacctcttttttggatcaatttgtgatgtttgttctttcctgtttctaagactgagactgcttctgatattgaattttgatgttagaatctgcccttttttattacataattgcgtgtcagtagtatgtatcttttgaaaaaaacccaaaaactgtttcctaatttgagtttaggtggagtatttgtctaagttgttctggtgcagtga

SEQ ID NO: 4943 - DNA, 649 bp, Silene vulgaris
ttttcccagatttacagcagactcagaaaaaaatgagtaaagtcggaggagtagtaggaaagggaggtaagaagaagggagcagtaacattcactcttgactgctcaaaacctgttgaagacaagatcatggatattgcttctcttgagaagttttttcaggaaaggattaaggttggtggtaaagctggtaatcttggtgatactgttactgtttcaagggagaagaacaagattactgtcaccgctgattccaatttctctaagaggtacttgaaatacttgaccaagaagtacttgaagaagcacaatgtcagggattggcttcgtgtcatcgctgccaacaaggaccgtaacgtgtacgagctgaggtacttcaacattgctgagaatgaggctgaggaagaagattagttggttgcatggtatttctgttttatggtggtttgtatttcgcgacaatctatttctgttttgattcagattgtagttgtttgatatcgtatcttttgggatgctttggtaagcctggttttggtaattttagagaacaactagtaccgtctctggcctttatattttagcatgtcaatgatccaacttttacgtacactgttaatttcgatcttatgagttatgagcttgatgca

SEQ ID NO: 4944 - DNA, 761 bp, Raphanus sativus
  misc_feature (674)..(674): n is a, c, g, or t
ggaccctagacgcaaaatcttcttcctctctttcgagatcagaagacgccgcacttccatcttctgaactacaggtacactctattgcagagagttggtgaaaatgagtcgtggaagtggagcagctccaaaggggaagaagaagggaggagtttccttcaccattgattgttctaagcctgttgatgacaagatcatggagattgcttccttagagaagtttctccaggagaggattaaggttggtggtggtaaagcaggtgctcttggtgattccgtctcaatcactcgtgacaagaacaagatcaccgtcacctctgatggccaattctccaagagatacctcaagtacttgacaaagaagtatctgaagaagcacaatgtgagagattggctcagagtgattgctgccaacaaggaccgtaacctctatgagttgaggtacttcaacatcgccgagaacgaagcagaggaagaagactaaaaaaacccatcatcttttcgtctattctattacaactctctgttctgttttagatattatatagtttggttgaagggatacactttcgtttgtttgttgctgcgcatttgagctttctatggaggcttttgttttcccagacagtttattgggtaaaaccaagtggagttggcagatctttttgaactanacaggaagatagtattacaaatggagtaagtggagaaataaaatgattcgtgttctagtcaattatgggtttggattcagttgttta

SEQ ID NO: 4945 - DNA, 488 bp, Utricularia gibba
gctcttcagacggcggcggtgaccgggaggtgaaaatagagtaagggtgcagttgccggtgcgaggggcgggaagaagaagaccgcaaccttcgttatcgattgctcgaagcccgtagaggataagattatggagattgcttctctcgagaagttcctccaggagaaaatcaaggtgggtggtaaaaccggcgccctgggtgaatctgtcaccgtcactcgggagaaaaataagatctctgttaccgcggacaccgccttctccaagaggtatctcaagtatttgacgaagaagtacttgaagaagcacaatgtccgagattggcttcgggtaattgcttcaaacaaagaccgtaatgtatatgagttgcggtacttcaacattgctgagcaggagggcgaggaagaagattaaacttacacagcttggtgcccgttctctcccctctgtgtttcattatgtttcaaaatactctctacattacaccc

SEQ ID NO: 4946 - DNA, 588 bp, Antirrhinum majus
ctcgctctttctctctctctacagaaaaaagcagcgaagatgagtaaaaacgcggcagcaaaaggcggtaagaagaagggcggcgtgagcttcacgatcgattgttcgaagcctgttgaggataagatcatggagattgcttctctcgagaagtttcttcaggagagaatcaaagtcggcggtaaagccggtgccttaggtgattctgtgactgttgctcgtgataagaacaagatcaccgtcactgccgattctaccttctcaaagaggtatcttaagtatttgactaagaagtacttgaagaaacacaatgtgagagattggcttcgtgtgatttcttccaacaaggacaggaatgtttatgaactgcgctacttcaacattgctgagcaagaggcagaagaagaagactagaaactcagcttggtctcatgtttctcctatgtttgaacaactttttgaattggtttatgtgatttgtttcattaaagtttctaagacttctagtgtatgacttcgcagttttggtgaaatttgatgatttcgctgccttttttgttgaaccattaaagagcgcttgatcctttt

SEQ ID NO: 4947 - DNA, 718 bp, Setaria italica
caccaccggagcagcagcggcgcacgcggcgagcggagaggcggaggaagaggcgatggcgcgcggcgtggcggcgggggcgaagggaggcgcggccggcggcaagaagaagggcgccgttaccttcacgatcgactgcaccaagcccgtggaggacaagatcatggagatcgccacgctcgagaagttcctccaggagcgcatcaaggtcgccggcggcaaggctggcaacctcggcgagggtgtcaccgtcacccgcgacaagaccaaggtcaccgtcacctccgaggggcctttctccaagaggtacctgaagtacttgaccaagaagtacctgaagaagcacaacgtgcgtgactggctccgggtcatcgcgtcgaacaaagaccgcagtgtctatgagctccggtacttcaacatcgctgagaatgagggtgaggaggaggattaggcgcactaccttatctatgtcttgtgaacttatggacagtgttggaacagtcttgctgtagcctttgaagggatgagttttgatgtttaaattgctcttctgatctgttttaagcgtggtggaacttccaatgtgatgcttagataatcgagtccaagaattgttggttcttgcttgtctctataacatatcatcagtgttttatcgttcagttgttgacatgattgtcagcttgaaaactctagtcgtcaagctaagcaattgcaa

SEQ ID NO: 4948 - DNA, 1047 bp, Setaria italica
atgccgatgctagacgaatgcattgaccatggcaatgaggtcgaccacgaatggccaagacgccgttgcagtaatgcagttgcaggatggggggcagcacgaagaggcggagagccgaggcacacagctgggcctcacacgaaacgtcgaattactccatcgataaacgggccgaatcaactccccacctccccggcgcctcctcaaaaccctatcgtctctcgcggcgcagccaccaccaccaccggagcagcagcggcgcacgcggcgagcggagaggcggaggaagaggcgatggcgcgcggcgtggcggcgggggcgaagggaggcgcggccggcggcaagaagaagggcgccgttaccttcacgatcgactgcaccaagcccgtggaggacaagatcatggagatcgccacgctcgagaagttcctccaggagcgcatcaaggtcgccggcggcaaggctggcaacctcggcgagggtgtcaccgtcacccgcgacaagaccaaggtcaccgtcacctccgaggggcctttctccaagaggtacctgaagtacttgaccaagaagtacctgaagaagcacaacgtgcgtgactggctccgggtcatcgcgtcgaacaaagaccgcagtgtctatgagctccggtacttcaacatcgctgagaatgagggtgaggaggaggattaggcgcactaccttatctatgtcttgtgaacttatggacagtgttggaacagtcttgctgtagcctttgaagggatgagttttgatgtttaaattgctcttctgatctgttttaagcgtggtggaacttccaatgtgatgcttagataatcgagtccaagaattgttggttcttgcttgtctctataacatatcatcagtgttttatcgttcagttgttgacatgattgtcagcttgaaaactctagtcgtcaagctaagcaattgcaatctagtttcctggagaaacgcaatgaaccactgcggtctgtcctggattcagggcaggagctggttgccgagcactatgtgctcccattg

SEQ ID NO: 4949 - DNA, 754 bp, Capsicum annuum
ccgccatcgaattttcccccggagaagcgaaagactaaagatgagccgagcagcagtatcagcagcgaaaggcgggaagaagaagggagcaaccttcgttattgattgttcgaaaccagtagaagatagtattatggagattgcttctcttgataagttccttcaagagagaattaaggttggtggtaaagctggtgctcttggtgattccgttactgttactcgtgacaagaataagattaccgtcacttgcaattccgctttttccaagaggtacctcaagtaccttgtcaaaaaatacttgaagaaacacaatgtcagggattggcttagggtgattgcttccaacaaggacaggaatgtttatgaattgcgctacttcaacattgctgataatgaagcagaggaagaagattaaaatgactttcaatgtctcgctttatcttcttctttaggcggcctccttattttgcaccttatattattatctgtttgagttggtaatgagccttcatttctagattattgattttcatttcgcttatcagtaaaagaaaacattactttgatgcttttggtttgtttatctttggggtcaagtatgcaaaagtcataatttagctgtatctcccttttcctcttaatatgtaatttattgagtttatttgttgttgtttgtgcctttcgtttaatcaccccacaatttgtggcctcttctgtttgtcttaaacgagaagtatgataaggatttaga

SEQ ID NO: 4950 - DNA, 659 bp, Salvia sclarea
ctactagaccttggctgtcactcaatttattccgtttctctctctatctcttctcatctcacacacaccacgcagttggcggtcgactccatagacgaaatcggcgaagatgagcaaagcggcggcggcgggagccaagggcgggaagaagaagtcggtgaccttcgtgatcgattgcacgaagcctgtggatgataagattatggagattgcgtcgctcgagaagtttctgcaggagagaatcaaggtcggcggaaaggccggcgctctcggcgattccgtcacggtgactcgcgacaagagcaagatcaccgtcaccgccgactccgctttctccaagaggtacatcaagtatttgaccaagaaatacttgaagaagcacaacgtcagagattggcttcgggtgattgcctccaacaaagagcggaacgtttatgaactgcgctacttcaacattgccgagcaagagggtgaagaggaagactaaattgggattcgaacgatccacttgttgggatcggttcgtgttgttggttttgcctcttatcttgaaattttcgacatttcctagattatgagcttggattttagctaacttcttgctttatgttgctcgtatttttatataattattcagcagctatagatgatcccttttt

SEQ ID NO: 4951 - DNA, 669 bp, Nuphar advena
  misc_feature (65)..(65): n is a, c, g, or t
  misc_feature (216)..(216): n is a, c, g, or t
  misc_feature (258)..(258): n is a, c, g, or t
acgcctctctgtctctccgcgccattttgggatccacaatcgtcacacgcaacttatacaagagntagagaagaaaatatgagtcgtggaggtgctgcccccaagggcaagaagaaggcatctaccttcactatcgactgttcgaagcctgtggaagacaagatcatggacataacatcctttgagaagtttctacaggacaggatcaaggttggnggtaaaactggtgttcttggggacactataaccatcacccgngagaagaataagatcagtgtcacctctgagagtgcattctcaaaaaggtatctcaagtatttgacaaagaagtacttgaagaaacacaatgtaagagattggttgcgtgtgattgcatccaacaaagaccggagtgtctatgagatgaggtacttcaacattgcggagaatgaggcagacgaggaggattgatggttggtgttctcagagcttccggtctctttcaatctctcaacctcttaatttacatttgagtgtttcaaagcttttcctttttgttaccaccattaggctttttctgaacatcttagggttaatttgaagttttcattgtaaggcattagaataccttttagggacgattttgcttgatacacattttcaatgcaggacatcgtggttattctatca

SEQ ID NO: 4952 - DNA, 950 bp, Oryza sativa
ccggtaaaccctagccgcctctgcgccgccacacacccccaaccaagcttccaccagcgcgaagcggcggcgagagggcgagatggcgcgcggcgtggcggtggcggcgaagggcggcgcgggcggcaagaagaagggctccgtctcgttcgtgatcgactgctccaagcccgtggaggacaagatcatggagatcgcgtcgctggagaagttcctgcaggagcgcatcaaggtcgccggcggcaaggccgggaacctcggcgactccgtcaccgtcacgcgcgacaagaccaaggtcaccgtcacctccgacggggccttctccaagaggtatctgaagtacttgaccaagaagtacttgaagaagcacaatgtgcgggactggctacgtgttattgcggctaacaaggaccgcaatgtctatgagctcagatacttcaacattgctgagaacgagggcgaggaggaagactagagtgtattccacatatatcttagttttggagttgttgaattttgatacttcatcttagtacctctagttattcaatccatgttatgttatgctgtggtcaacttggatggttaatttgaagaatccttatatttggtcgcctcaacttcaagagtgcctactgctaatgatgacttgtgaacctagaaaagcagtatggtgacttcttatcgtgttttacatgaatcggtcggtttgtttattactgctgcttcgcaatacctgtgtggaacttgtataatctccagctgcgtcaggattctgttgtggagttgatgcttggtgtctggtagtttgaaagtccttcgtgaacttgtttggatgaagtcaaaattggcacagttgtaggtttaacgagaaaggtgaagaatagattctgcaagtatacttgaatcaccttcgttctatcaaggttctgcttgctagcttatgctct

SEQ ID NO: 4953 - DNA, 427 bp, Arnica chamissonis
aggagcagccggcgccggagcgaagggcggaaagaagaaaacgtacgacgtttgtgatcgattgtggaaagcctgttgaggataagatcatggagatcgcatcacttgagaagtttcttcaggagagaatcaaggtcgcaggtaaagctggtaatctcggtgattccgtcactatttcccgtgagaagaacaagatctccgtcaccgccgacagtaacttctcgaaaaggtacctgaaatacttgacaaagaaatacttgaagaagcacaacgtgcgtgactggcttcgtgtaatcgcgtccaacaaagaccgcaatgtttatgagctaaggtacttcaacattgctgagaacgagggcgaggaagaagattaagcaaggtgtttgatgtaggcgtttctttgcatgtgattcttaaactatttata

SEQ ID NO: 4954 - DNA, 800 bp, Phalaenopsis aphrodite
gcggttcattccacactcgccgacccttaaataccgatcgaccatctcggtccttcgaaaccctaaccctaacttcgaactcatttttgttcaggaaggagcgagagagaaggggaaaagatgagccgaacgggaagcagcgccggggctaagggcgggaagaagaaaggctcgacctttgtcatcgattgttcgaagccagtggaggacaagatcatggacatcgcttcactcgagaagttccttctggagcggatcaaggtcgcttctcttggaggcaaagctggtacgttgggagatgttgtacgcgttgcgcgagagaagagtaagatcacggttacttctgaaggacccttttccaagagatatttaaagtatttgacgaagaagtacctgaagaaacacaacgttcgggattggcttcgagtcatcgcctccaacaaagaccggaatgtttatgagctgcgctacttcaacattgctgagaacgagggcgaggaggaggactaaaatcttacttccaggcatttgctgttctatttctctgcttcttttttgggattggaccttgagaaacttgcaatgttctttttgatttgctgttatttatctttgagaagtatttttttttcccttaagttggaagaaacttgtagatttgattcatgaatgtagtttgtttcagcacatatatacatatttcaaatgtcatgcaacatgaaatttgtgctgttgatgaatgtcagggaatgtgctttgatgataagtgattaaagaagcacttttagtgtttggtttgc

SEQ ID NO: 4955 - DNA, 716 bp, Hordeum vulgare
cgcctgcgcgccgccacacgaacccccaccccaaccccgagcaccggccgaggaggaagagaaggtgagatggctcgcggcgcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaacctcggcgactccgtcaccgtcacccgcgacaagagcaaggtcaccgtcacctccgacggcgccttctccaagaggtacctgaagtacttgaccaagaagtacttgaagaagcacaacgtgcgggactggcttcgtgtgatcgcagccaacaaggagcgcaacgtgtacgagctccggtacttcaacattgccgagaacgagggcgaggaggaagattagagcgcattgttatattgtagtgcttgttgagttttgatacttgatctgagtacctccctagttatccacctatcttatgttgtgctctgttgaacatggatggtttaatttgaagaatccttatattttgtctcccctcgactgtggatccatatgtctgtgaacctatagacaagtattatggagatttgttcttgctttcacattagctgctgtgctaaaacggtggtgcttttttactcctgatgaagttttgg

SEQ ID NO: 4956 - DNA, 568 bp, Pseudoroegneria spicata
  misc_feature (208)..(208): n is a, c, g, or t
  misc_feature (388)..(388): n is a, c, g, or t
  misc_feature (535)..(535): n is a, c, g, or t
cccacccaacccgagcaccggccgaggaggaagagaaggggagatggctcgcggcgcgacggcggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggcngggaacctcggcgactccgtcaccgtcacgcgcgacaagagcaaggtcaccgtcacctccgacggcgccttctccaagaggtacctgaagtacttgaccaagaagtacttgaagaagcacaatgtgcgggactggcttcgtgtgattgcagccaacaaggagcgcaacgtgtacgagctncggtacttcaacatcgctgagaatgagggcgaggaggaagattagagtgccattgttatattgtagtgcttgttgagttttgatacttggtctgagtacctcctagttatccacctatcttatgttgtccccctgttgaacatgganggtttaatttgaagaatccttatattttgtcca

SEQ ID NO: 4957 - DNA, 680 bp, Triticum aestivum
ccccccacccaacccgagcgagcaccggccgaggaggaagagaaggtgagatggctcgcggcgcggcggcggcggcggcggccgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaacctcggcgactccgtcaccgtcacgcgcgacaagagcaaggtcaccgtcacctccgacggcgccttctccaagaggtacctcaagtacttgaccaagaagtacttgaagaagcacaacgtgcgggactggcttcgtgtgatcgcagccaacaaggagcgcaacgtgtacgagctccggtacttcaacatcgctgagaatgagggcgaggaggaggattagagtgcattgttatattgtagtgcttgttgagttttgatacttgatctgagtacctcctagttatccacctatcttatgttgtgccccgttgaacatggatggtttaatttgaagaatccttatattttgtctccccgactatggatccatatgtctctgaacctagacaagtaatatggagatttgttcttgttttcatgtgaactgctgtgtaaaacggtggtgcttttcactcctgaa

SEQ ID NO: 4958 - DNA, 456 bp, Cajanus cajan
tttgtttatcagcatcaggagaagaagggagagagaggggcgcgaaaatgagtggagcaaaggggaagaagaagggagcgagcttcgtgatcgattgcgcgaagccggtggaggataagatcatggacattgcttctctcgagaagtttcttcaggagaggattaaggttggtggcaaggccggcgcactcggcgattctgttaccgtcactcgtgacaagagcaagatcaccgtcacctctgacagcaacttctctaaaaggtatctgaaatacttaaccaagaagtacttgaaaaaacacaatgtgagggattggcttcgggtgattgcgtccaacaaggacaggaatgtctatgagttgagatacttcaacattgctgagaatgagggggaagaggaggactgaagatccaatcttctgtcttaaagcattcccctttaggcttagttattgt

SEQ ID NO: 4959 - DNA, 723 bp, Sorghum bicolor
ccagccgcatcctcgctccctctcgtcccggaaaaccctagccgccacaccccacgacccactcgagcaccgagccgagggaaggagggaacgggcgatggcgcgcggcgtggtggcggcgaagggcggcgcggccgcgggcaagaagaaggggtcggtcgccttcacgatcgactgcaccaagcccgtggaggacaagatcatggagatcgcctcgctcgagaagttcctccaggagcgcatcaaggtcgccggaggcaaggccggcagcctcggcgactccgtcaccatctcccgcgagaagaccaaggtcaccgtcacctctgacgggcccttctccaagaggtataccaccctgaagtacttgaccaagaagtacttgaagaagcacaacgtacgggattggctacgcgtgattgcagccaacaaggaccacagtgtctatgagctccggtacttcaacatcgccgagaatgagggcgaggaggaagattagagtgcatcacacttatatcttagttttgaactcattgaattttgatacttgtacccgtagttctgcaactgtccttatgttatgcggtggtgaattttggatggttaatttgaagaatccttacatttggctgcctcaacatcagagtgccctagtctctgtacaagttatgtgtgaacagcgaaatgtaatgtgcaggatttcttgcatttcttaatatttttata

SEQ ID NO: 4960 - DNA, 657 bp, Linum usitatissimum
gagatttagagcatctgaagcagacgaagaatagcagtgatggctcgcggcgtggcggcagcggcagcaggaacgaagggtgggaagaagaagggagtttccttcgtgatcgattgcgggaagcccgtcgaggataagattatggacatcgcctctctggagaagttcctccaggaaaggatcaaggtcggaggcaaggccggtgctcttggcgacgttgtctccatctccagggagaagaacaagatcactgtcacctccaacagcgatttctttaagaggtatttgaagtacttgaccaagaagtacctaaagaagcacaacgtgcgagattggctcagggtgattgcctcaaacaaagagaggaatgtctatgaacttcgatacttcaacatagcagagaatgagggggaagaggaggattgaagactcaatcctgcacttatttaaatatcagctctgttcttttttgggctttttttgcactctgtttgaatgatggttttcatatgtttagcgtgttgccaagctggttgcattgcactcacttatcgtctgttggaaattttggtttaatgattattagatatcaaaactttttctggatcagctgcctatttcggctatggtttttgcttgaaatctttgcagttggac

SEQ ID NO: 4961 - DNA, 552 bp, Fraxinus spp
agaatttgattgaaaccgaagaaaatgagtaaaggaggagcagctggcggcgctgtgaagggagggaagaagaaggcatcgaccttcgtgattgactgctcgaagccggtggaggataagatcatggacattgcttctctggaaaagttcctccaagaacgcattaaggtcggcggcaagcccggtgccctcggtgactctgttactgtcactcgcgacaaaaacaagattaccgtcgttgccaatgagaccagcttttccaagcggtacttgaagtatctgacgaagaagtatctgaagaagaataatgtgcgtgattggctgcgggtgattgcttcgaacaaggatagaagtgtttacgaattgaggtacttcaacattgctgagaatgaggctgaggaggaagagtaatggaagaacaattattattcatatttcccaagttgttttttgttggacatcaatttaaatgttttggaatcaaagggtttagatgtttgctaagctataatttcggtgcatgtgaattattgatagcattgttatgccgta

SEQ ID NO: 4962 - DNA, 627 bp, Fraxinus spp
gcggctgtcaatctcacttctcagcgggaagaatccgcgtcagagtttgttgtggaagaatttgattgaaaccgaagaaaatgagtaaaggaggagcagctggcggcgctgtgaagggagggaagaagaaggcatcgaccttcgtgattgactgctcgaagccggtggaggataagatcatggacattgcttctctggaaaagttcctccaagaacgcattaaggtcggcggcaagcccggtgccctcggtgactctgttactgtcactcgcgacaaaaacaagattaccgtcgttgccaatgagaccagcttttccaagcggtacttgaagtatctgacgaagaagtatctgaagaagaataatgtgcgtgattggctgcgggtgattgcttcgaacaaggatagaagtgtttatgaattgaggtacttcaacattgctgagaatgaggctgaggaggaagagtaatggaagaacaattattattcatatttcccaagttgttttttgttggacatcaatttaaatgttttggaatcaaagggtttagatgtttgctaagctataatttcggtgcatgtgaattattgatagcattgttatgccgtagtaaacttcatttgcagtt

SEQ ID NO: 4963 - DNA, 729 bp, Primula obconica
cagtttctctttctctcactaagacaggaggcggggggaaagatgactcgtgcggcggcgacggcgacggcggtgaaaggagggaagaaaaagggagcgacgtttacgatagactgtgggaagccggtggaagataagataatggagatagcatctctggagaagtttcttcaggagagaatcaaagtcgctggtaagcccggtgctctcggtgacggagtcaccgtcgtccgtgacaaatccaaaatcaccgttaactccgactccaccttctccaaaaggtatctcaagtatctgactaagaagtatttgaaaaagaacaatgtgcgggattggctccgagtcattgcatcaaacaaggaccgcaatgtttacgagctgagatactttaacatcgccgagaatgaaggagaggaggaagactaatttcccagctgaagtcattccattatcgtttctgcattttagtttacttttgtgtttagattgtttgctctttcaaacctgtcctttactttggttgtgcaacctggattttgcaattttgttctatcgtatttcatgtttgacttccaagaatactgtatgtggcttttatctatcaggatccaagtttcttaatgtagcacgatgtggttggcataagtgtttatttttacttggtttgtgctgatcgttaatcggtatgtgctaaatgcttatgcacctagttggtaattgataaaatta

SEQ ID NO: 4964 - DNA, 578 bp, Ipomoea batatas
cctactactccttgcagccgctccggaaagctaagcagagaaaaatgagcaaaggaagcagcggaggtggggctctcaagggagggaagaagaaggggtcgatatttgtgatcgactgctcgaaaccggtggacgataagataatggacattgcctcactggagaagttcctccaggagcgcattaaggtcagcggcaaggccggagccctcggcgactccgtcaccgtcgcccgtgacaagaccaagatcaccgtcacttccgactccaacttctccaaacgatatttgaaatacttgacaaagaagtatctaaagaagaacaatgtccgcgactggctccgtgtcatttcttcaaacaaggatagaagtgtctacgaattaaggtacttcaacattgccgaaaatgatgccgaggatgaagattaagcgggtgaatacgtcctttttgccatatgtcttggatttgcagtgtgttgctcttcttcagtcgttatataccctgttttaaatggcttttgcaattttcacatttcgaacctgtaaaacgagattgcaattttggagttagttttacct

SEQ ID NO: 4965 - DNA, 781 bp, Sorghum bicolor
aaaaaccctattgtcgctcccggcgcagccaccaccgaagcagcggcgcacgcggacgagccgagcgaggcggaggagaggagatggcgcgcggcgtggcggctggggcgaagggcggcgccgccggcggcggcaagaagaagggctccgtcaccttcacgatcgactgcaccaagcccgtggaggacaagatcatggagatcgccacgctcgagaagttcctgcaggagcgcatcaaggtcgccggcggcaaggctggcaaccttggcgagggcgtcaccgtcacccgcgacaagaccaaggtcaccgtcacctccgatgggcctttctccaagaggtacctgaagtacttgacaaagaagtacctgaagaagcacaatgtgcgtgactggctccgggttatcgcgtcaaacaaggaccgcagcgtctatgagctccggtacttcaatattgctgagaacgagggtgaggaggaggattagacgcaccaccttatctgtgtcttgtgaactttggatgtgttggaacactcatgcttgtagcctttgaagggatgagttttgatgtttaaaattggtcttatgatgtttttataagcgtgctggaacttctcatgtgatgcttagataatcgagtcgaagaattgttgttcttgcttcagcctctgtaaggatgaccgtgggcattgagtgtttatgagcgtctatagaactgactatttagctgcaggtattcatttattggagtcatttcccatcgctttggtgatgctaggttggac

SEQ ID NO: 4966 - DNA, 819 bp, Sorghum bicolor
tactacttatatataagccatctccgcggcgcatcctcaaaaaccctattgtcgctcccggcgcagccaccaccgaagcagcggcgcacgcggacgagccgagcgaggcggaggagaggagatggcgcgcggcgtggcggctggggcgaagggcggcgccgccggcggcggcaagaagaagggctccgtcaccttcacgatcgactgcaccaagcccgtggaggacaagatcatggagatcgccacgctcgagaagttcctgcaggagcgcatcaaggtcgccggcggcaaggctggcaaccttggcgagggcgtcaccgtcacccgcgacaagaccaaggtcaccgtcacctccgatgggcctttctccaagaggtacctgaagtacttgacaaagaagtacctgaagaagcacaatgtgcgtgactggctccgggttatcgcgtcaaacaaggaccgcagcgtctatgagctccggtacttcaatattgctgagaacgagggtgaggaggaggattagacgcaccaccttatctgtgtcttgtgaactttggatgtgttggaacactcatgcttgtagcctttgaagggatgagttttgatgtttaaaattggtcttatgatgtttttataagcgtgctggaacttctcatgtgatgcttagataatcgagtcgaagaattgttgttcttgcttcagcctctgtaaggatgaccgtgggcattgagtgtttatgagcgtctatagaactgactatttagctgcaggtattcatttattggagtcatttcccatcgctttggtgatgctaggttggac

SEQ ID NO: 4967 - DNA, 658 bp, Avena sativa
gctatcgtctccgcgcagccaccaccgaagcagactccggagagcaagcaaaaggcggagacagtgatggcgcgcggcgtgacggcgactaccaagggcggcgctggcgccgggaagaagaaggggtcggtcaccttcgtgatcgactgcaccaagcccgtcgacgacaagatcatggagatcgcgtcgctcgagaagttcctgcaggagcgcatcaaggtcgccgggggcaaggccggcaacctcggtgactccgtcaccgtcgcccgcgacaagagcaaggtcaccgttacctccgacggggccttctccaagaggtacttgaagtacttgaccaagaagtacctgaagaagcacaacgtgcgtgactggcttcgtgtgatttcatccaacaaggaccgcagcgtctatgagctccggtacttcaacattgctgagaatgagggcgaggaagaggattagatgcactgccttgtttctatctcttgtgaagctttgaattcgttcgggttatgcagtagagttttgatgtttaattttccaccgatgttttgaatcatggggatactccatatgatgcttagataaccaagttgaagaattgtccgttcttgttgttgttgtttattggaatgttaatgaggaagcgtggagcctt

SEQ ID NO: 4968 - DNA, 585 bp, Amsonia hubrichtii
ccgcttccatcttcttctcccgtcggacagcagtatttttgtaagacaagatgagcaaagggactggtggtggagtcctcaagggagggaagaagaagggagcaacattcgtgattgattgttcgaagccggtggaggataagattatggatatttcctcattggaaaagtaccttcaggagcgaattaaggtcggcggcaagcccggtgctcttggcgactccgtcactgtcatccgtgataagactaagatcaccgtcacggctgattccaacttctccaagcggtatttgaagtatttgacaaagaaatatctgaagaagaacaatgtgcgtgattggcttcgagtgatttcatccaacaaggatcgtagtgtttatgaattgagatacttcaacattgctgaaaatgaggctgaggacgaagaatgataattttgatggatccattattcagaagatcccattgtcggattgcttatctgtacttttgatacatttagaatttcagggattgaattggattataatttacaatttttatcctcaagacatgagaaaattattgagaaaaaagttttggacc

SEQ ID NO: 4969 - DNA, 851 bp, Pennisetum glaucum
ggcgatctccatgatcttgtcctccacgggcttggtgcagtcgatcgtctcgctcgcggcgcagccaccacaccaccaccgaagcagcagcgccgcacgcggaggacccgagcgagaggcggaggaagaggcgatggcgcgcggcgcggcggcgggtgcgaagggcggcgcggccggcggcaagaagaagggcgccgtcaccttcacgatcgactgcaccaagcccgtggaggacaagatcatggagatcgccacgctcgagaagttcctgcaggagcgcatcaaggtcgccggcggcaaggctggcaacctcggcgagggcgtcaccgtcacccgtgacaagaacaaggtcaccgtcacctccgaggggcctttctccaagaggtacttgaagtacttgaccaagaagtacctgaagaagcacaatgtacgtgactggctccgggtcatcgcatcaaacaaggatcgcagtgtctatgagctccggtacttcaatattgccgagaatgagggtgaggaggaggattaggcgcactaccttatctatgtcttgtgaacctatggacgtgttggaacagtcttgctgtagcctttgaagggatgagttttgatgtttaaattgctcttcctatgtgtttttaagtgtggtggaacttctcagggcttggttcctgtttgtctctataacatatatcgtcagcgtttgatcgttcggttggtatgattgtcagcttgaaaactctagtcgtcaagctagtttcctggagaaactcaatgatcaactgcagtctgtcctgtattcacggcaggaatccctgctgagtgctatgttctcccattggccatttctg

SEQ ID NO: 4970 - DNA, 844 bp, Oryza sativa
aaaaccctatcgcctccaccgcctcaacccggacgcagcagccgcagcggaagagggaagcgaagcaagcgaagctcgaggggagatggcgcgcggcgtggcggcggcggcggggggcaagggcggcgccgggaagaagaagggctccgtcaccttcgtcatcgactgcgccaagcccgtcgacgacaagatcatggagatcgcgtcgctcgagaagttcctgcaggagcgcatcaaggtcgccggaggcaaggccggcaacctcggcgagtccgtcaccgtctcccgcgacaagaccaaggtcaccgtcacctccgacgggcccttctccaagaggtacctgaagtacttgaccaagaagtacctgaagaagcacaatgtgcgtgactggctacgggtgattgcatccaacaaggaccgcaacgtgtacgagctccggtacttcaacatcgccgagaacgagggcgaggaggaggattagatgcactgcctttttctatgtcttgtgaacttttgaacttgctggaacactatgctgtagtcactgaagagaagaattttgatgtttcatttatcaatgtttccctgtgtgcttaaaacctatgcttaggtaagcaagttgaagaattattggttctcacctttgcagttgagcagtgtgcatttttaaagttttaactggaacctgatggagctgttagtgctgttggttcatcagctgatactgaatcgagcacatcagcttttactatggccaatatcactcggaataaatccgattcattattgtgttatgttgagtcggacattagccttgttgcatagtatctctttggaaacgatg

SEQ ID NO: 4971 - DNA, 848 bp, Solanum lycopersicum
aaggagaaaagtttggaacgtaacctaaaatagggccaaaagtgcaaattagagagaggtgccacatttagcaagtaggaacgaaggaaaaccctaatttaacagagtcaccacttccatacactcacactaggccgtggacgtcgagtttcatcctcagaagagaaatacagagagtgtaaagatgagccgagcagcagcagcagcagtgaagggcgggaagaagaagggggcaagcttcgtcattgactgttcgaagccagtagaagacagtatcatggagattgcttctcttgacaagttccttcaagagaggattaaggttggtggaaaagctggtgctcttggggattccgttactgttactcgtgacaagaacaagatcaccgtcacctgcaactcaactttttccaagaggtacctcaaataccttgtcaaaaagtacttgaagaaaaataacgtcagggattggcttagggtgattgcttccaacaaggacaggaatgtttacgaattgcgctacttcaacattgctgagaatgaagcagatgaagaagattaaacatgaccattcaatgtctctctttatcttcttctttagtcggccttcactttttgatccttatatcatctactaatgaatcctgtcttctcatttctagattttgtttttgcagtttgcttatcagtaaaagaaaacattacatcgatactttggtttgtctatctttggggataattatgaaaatgtcaatttatctgtattgcctttctcctctggatgatctcaagacatatataagattaaaatagatataatatctcataattaattctttttatgttgc

SEQ ID NO: 4972 - DNA, 635 bp, Cleome gynandra
tttttgttcgattcatcgagtaagcgagctttccgaggaagttggttacggagacgatggctcgaggaacgacggcggcttctgcgggaggaaagaagaagggatctaccttcgttattgactgctcgaaaccagtcgatgataagatcatggatatcgcatctcttgagaagttccttcaggagcgtattaaggtcggcggcaagcctggtgctcttggcgacgccgtcactattactcgcgacaaaagcaagatcaccgttaccgccaattccgacttctccaagcggtacctcaagtacttgacaaagaagtatctgaagaagaacaacgttcgtgattggctgcgagtgattgcatccaacaaagacagaaacatctacgaattacgatacttcaacattgctgagaacgaaggagaggaagaagattaagttcattgttcttcccgttgtggtttcttttccatcttccattaccgcttccataattatttagtcttggattttttgcttggaacctttgttttatgtaactcaagttttggttgtcttttatggttttctttaatgctcaattgagatcctccggattaagcattgatttgggtatgttaaaagtagttctattactgc

SEQ ID NO: 4973 - DNA, 645 bp, Solanum tuberosum
acgaaggaaaacctaatttaacagagtcaccacttccatacactcgcagtaggccgtcgagtttcctcctcagaagagaaatacagagtgtaaagatgagccgagcagcagcagcagcagtgaagggtggaaagaagaagggggcaaccttcgtcattgactgttcgaagccggtggaggacagtatcatggagattgcttctcttgacaagttccttcaagagagaattaaggttggtggaaaagctggtgctcttggagattccgtcactgtcagtcgtgataagaataagatcaccgtcacttgcaactccactttctccaagaggtacctcaaataccttgtcaaaaagtacttgaagaaaaataacgtgagggattggcttagggtgattgcctccaacaaggacaggaatgtttacgaattgcgctacttcaacattgctgagaatgaagcagatgaagaagattaaacatggccattcaatgtctctctttatctttttctttaatcggcctttgttttttgatccttatatcatctgttcgagttactaatgaaatcttgtcttctcatttctagattattgttttgcagtttgcttatcagtaaaagaaaacattacatcgatactttggtttgtt

SEQ ID NO: 4974 - DNA, 754 bp, Nicotiana tabacum
  misc_feature (730)..(731): n is a, c, g, or t
  misc_feature (733)..(735): n is a, c, g, or t
  misc_feature (737)..(738): n is a, c, g, or t
  misc_feature (740)..(741): n is a, c, g, or t
  misc_feature (743)..(745): n is a, c, g, or t
  misc_feature (748)..(748): n is a, c, g, or t
gttttgctttggggcgacggtccacagaggaaggagggaaaaccctaattaaaaaaacctcgccacacttccactgttccacgggtacacactcgcagtaggtcgtcgagtttagtcctcggaagagaaggagacagagtgtaaatatgagccgagcagcagcagcgaaaggcgggaagaagaagggggcaacattcgtaattgactgttcgaagccagtggatgataagattatggagattgcttctcttggcaagttccttcaggagagaattaaggttggtggcaaagctggtgctcttggggattccgttaccgttacccgtgacaagaacaagatcaccgtcacttctaactccgccttttccaagaggtatctcaagtaccttgtcaaaaagtacttgaagaagaataatgttagggattggcttagggtgattgctgccaacaaggacaagaatgtttacgaattacgatacttcaacattgctgagactgaggcagatgaagaagattaaacatggccattcaatatcactttatcttctttaggcagccttcttacttggaaccatttatgtcatctgttcgagttacttagcagtcttatctgcatatttctagattgtcgcagttttgatttttcggtatccttattagcaaaaagaaaacattagtttgatactttgctttgtttatatttggtgatcaagtcttattgcctttttcnncnnnannanngnnnccncatgag

SEQ ID NO: 4975 - DNA, 784 bp, Nicotiana tabacum
gacggtccgcagaggaagattggaaaaccctaattaaacaacatcgccgcacttccacacactcgcagtaggcagttgagtttagtcctcggaagagaaggagacagagtgtaaagatgagccgagcagcagtagcagcagcgaaaggcgggaagaagaagggggcaacgttcgtaattgactgttcgaagccagtggatgacaagattatggagattgcttctcttgacaagttccttcaggagagaattaaggttggtggcaaagctggtgcacttggggattccgttaccgttacccgtgacaagaacaagatcaccgtcacttctaattctgctttttccaagaggtatctcaagtaccttgtcaaaaagtacttgaagaaaaataacgtcagggattggcttagggtgattgctgccaacaaggacaggaatgtttacgaattacgatacttcaacattgctgagactgaggcggatgaagaagattaaacatggccattcgatgtcgctttatcttcttctttagtcgaccaaatttagaaccattttatctgttaagacatgcgtcttatctgcacatgtctagactgtcacagttttgatttccccccccccccccttgtcggtaacagaaaacatcactttgatattttgctttgtttatctatggggctcaagtatgcagacatgcctttttcctcttgatgttcacatgtaatatgttgagtctatttgaggtgactttcatttaatcacaccactgttgatggcttcctctc

SEQ ID NO: 4976 - DNA, 580 bp, Solanum melongena
agtccgccgccgccgaattcgtcctgtacacagaagagaatagagagtgtaaagatgagccgagcagcagcagcagcgaagggcgggaagaagaagggggcaaccttcgtgattgactgttcgaagccagtggatgacagtatcatggagattgcttctcttgacaagttccttcaggagagaattaaggttggcgggaaagctggtgctcttggggattctgttactgtctcccgtgacaagaccaaaatcaccgtcacttgcaactctgctttttccaagcggtacctgaaataccttgtcaaaaagtacttgaagaaaaataacgtcagggattggcttagggtgattgcttccaacaaggacaggaatgtttacgaattgcgctacttcaacattgctgagaatgaagcagatgaagaagattaaattatggctattcaatgtcactttttcttcctttttagtctgccttcttgtttagaaccttatataatctatttcagttattaatgagtcttatatcctcatttctatatttattttttgttcctttatcagtaaaagaaaacattacttt

SEQ ID NO: 4977 - DNA, 479 bp, Gerbera hybrid cultivar
gaaaaagaaggcagcgaccttcgtgattgattgcgggaagcctgttgaggataagatcatggagatcgcgtcgcttgagaagtttcttcaggagagaatcaaggtcggcggtaaagctggtaatctcggcgattccgttaccattactcgtgaaaagaacaagatctccgtcaccgccgacagcaacttctccaaaaggtatctgaagtatttgaccaagaaatacttgaagaagcacaatgtgagagactggcttcgtgtgattgcatctaacaaagatcgcaacgtttacgagctacgttacttcaacattgctgagaacgagggcgaggaggaagactgagcagcgggtttgttttatgttttggttttgcatttttagacttattatatctcatcagcttactctacttcagactttgaaatattgttttgcagtagaatttgtggtttgtgctttcaaaaaaaaaaaaaaaaaa

SEQ ID NO: 4978 - DNA, 794 bp, Fraxinus spp
cggccgggggaaccagatagggtttctctaggcccaattcacgattattattataaccttaaccctaagtgatcgtctgctccatttcgcggctgctctatctcactaagcagaagaatctgcctgtgacttttactcgggaagaatttgattaaaactgaagaaaatgagtaaaggaggagcagcaggcggcgctgtgaagggagggaagaagaaggcatcgacgttcgtgattgactgctcaaagccggtggaggataagattatggacattgcttcactggaaaagttcctccaagaacgcatcaaggtcggcggaaagcccggtgccctcggtgactccgttactgtcacccgcgataagagcaagattaccgtcgttgctaacgagaccagcttttccaagcggtacttgaagtatttgacgaagaagtatctgaagaagaacaatgtgcgtgattggctgcgtgtgattgcttcgaacaaggatagaaatgtttatgaattgaggtacttcaacattgccgagaatgaggctgaggaagaagagtaatggaagagaagtcattatttatgtttcctgagtggattttagttttgcctagtgttgcatgtgttggacatcggtttcaattttgttttcggatcaaagggtttacatgtttcctattattgtttgagatgaaaaacaggatatatgctatataatggagtttaactatgattttggtgttcatgtgagtcgttgagattgtttgcaatgttgtaataacgtgaatgattatgatttactg

SEQ ID NO: 4979 - DNA, 644 bp, Fraxinus spp
ggaattcgccgttgctctcattccttttgttgtagaagaatttgattcaaagtgaacgaaaatgagtaaaggaggagcttcgactggcgcccagaagggcgggaagaagaaggcggcgacttttgttatcgattgctcgaagccggtagaggataagatcatggacattgcttcactcgaaaaattcctccaggagcgcatcaaggtcggaggaaagcccggtgcactcggagattccgtaactgtcatccgtgacaagaacaagatctccgttacagctaacgagactagcttttccaagaggtacttgaagtacctgacaaagaagtacctgaaaaagaacaatgtacgtgattggctccgagtgatcgcatctaacaaggatcggactgtctatgaattgaggtacttcaacattgctgagaatgaggctgaggaggaagagtaacgatgcaaatcagagtttttctcctaagatttatataccctttcatcgcctagtggattttatttgtttccagaattccgtctgttaagacatttttactgtattgtagtttcgaattttttctactttcgattggaaaacgcccatgagcttttgctattttagggtgaaaatgaattaatgacaaaagtttttt

SEQ ID NO: 4980 - DNA, 600 bp, Phalaenopsis aphrodite
cgaacgggaagcagcgccggggctaagggcgggaagaagaaaggctcgacctttgtcatcgattgttcgaagccagtggaggacaagatcatggacatcgcttcactcgagaagttccttctggagcggatcaaggtcgcttctcttggaggcaaagctggtacgttgggagatgttgtacgggttacgcgagagaagagtaagatcacggttacttctgaaggatccttttccaagagatatttaaagtatttgacgaagaagtacctgaagaaacacaacgttcgggattggcttcgagtcatcgcctccaacaaagaccggaatgtttatgagctgcgctacttcaacattgctgagaacgagggcgaggaggaggattaaaatcttacttccaggcatttgctgttctatttctctgcttcttttttgggattggaccttgagaaacttgcaatgttctttttgatttgctgttatttatctttgagaagtatttttttttcccttaagttggaagaaacttgtagatttgattcatgaatgtagtttgtttcagcacatatatacatatttcaaaatgtcatgcaacatgaaatt

SEQ ID NO: 4981 - DNA, 571 bp, Cleome gynandra
ataatacacgcggcgagaagtgaaccacttgtctactccttcgtactacagtaggggcagaagacgtaaacgatgagtcgtggaggggcagcgacgacggcggcggcgaaggccggaaagaagaaggcgacggtctttgtcatcgactgttcgaagcctgtggaggataagatcatggacatcgctactctggagaagttcttccaggagaggatcaaggtcggcggtaaacccgctgctctcggagacgcagtcaccattactcgtgataagaacaaaatcactgtcacggccgacactaacttctccaaaagataccttaaatacttgactaagaaatacttgaagaagtacaatgttcgtgattggctacgtgtaattgcgtcgaacaaggataggaacgtttatgaattacggtacttcaacattgctgagaacgatggtgaagaggaagattgaaggaaccccccagctccccttctttagagattgctctttgtttatttttttactgtcagttgtctgaagttattgagatccttttcaatgttaaacccaatttattaacaga

SEQ ID NO: 4982 - DNA, 584 bp, Ipomoea nil
aattttctccccgcgaattccaagcaccgtgaagggtttacacggagaaaatgagcaaagttagcagcggagctggggccaccaagggtgggaagaagaagggatcgacgttcgtgattgactgttcgaagcccgtggacgataaaatcatggatatcgcttcactggagaagtttctccaggagcgcatcaaggtcggcggaaagccgggagcgctcggagactccgtcacggtcacccgcgacaagaccaaaatcaccgtcacggcagactccaacttttccaagaggtatttgaaatacttgacaaagaagtatctaaagaagaacaatgtgcgtgattggctgcgtgttatatcttcgaacaaggatagaagtgtctacgaattgaggtacttcaacatagctgagaatgattcaggggatgacgaagagtaagggggtggataactctttattttctagatatcattgatttcttagttcagagtgctcattttctcttaattgatattgattgtgttgaagaacatcttttacaatatgtttttgaagcagagagtaattgcaatatttggcatagaa

SEQ ID NO: 4983 - DNA, 493 bp, Fagopyrum esculentum
cccatccaagttctttcctgtttcaaacaccgtaaagctctccgggaatcgtaggcgattaggaattagatcggacgttgaaaatgagcagaggtgcggctgccggagttgccaagggcaaaaagaagagctctacattcacgatagattgctcgaagccggtggaggataagatcatggacatcgcctcactggaaaaatttctccaggagaggatcaaggttggcggaaaggccggtgctctcggtgatgctgtcaccgtctcccgtgataagaacaagcttaccgttacctccgacagtaacttttccaagcgatacttaaaatacttgaccaagaagtacttgaagaagcacaatgttagggattggcttcgtgtgattgcctcaaacaaggaccgcaatgtatacgagcttaggtacttcaatattgctgaaatgaggccgagaagaagattagccatttgaaaatatcttggtttcgttgatggctt

SEQ ID NO: 4984 - DNA, 562 bp, Vinca minor
cctctttgcatagagcaagtaatttttggaagctaagatgagcaaagggactacaggtggaggagtcctcaagggagggaagaagaaagtagcaatcttcgtgattgattgctctaaaccggtggaagataagattatggacatctcctcattggaaaagtaccttcaggagagaattaaggtgggcggaaagcccggtgctcttggagacttcgtcactgttacccgtgacaagactaagatcaccgtcacagctgattccaacttctctaagcggtatttgaagtacttgacaaagaaatatctgaaaaagaacaatgttcgtgactggcttcgagtaatttcatccaacaaggaccgaagcgtttatgaattaagatacttcaacattgctgagaatgaggctgaggaagaagactgataagttggttatatacattttgctggaatgcttaatgtgtacctttcatacatttagaatttcagttatcctttactaaaatttatcctggatacagatatgcaaattattcagaagttttggtacatcctaattgtttct

SEQ ID NO: 4985 - DNA, 947 bp, Setaria italica
atgggccatttcaatccgttaaactcagcggaacccaccaccaaaaaggaaggagtaggaagcccaaccgattacgagtgctccattactgggcccaataacgtggatcatcagaacccgcatcagccccgtctctcgtctcggaaaaccctagccgccacacctcacgacccacccgagcaccagccgagcggaggagagatggcgcgcggcgtggtggcggcgaagggcggcgcggccgcggggaagaagaaggggtcggtcaccttcacgatcgactgcaccaagcccgtggaggacaagatcatggagatcgcctcgctcgagaagttcctgcaggagcgcatcaaggtcgccggcggcaaggccgggagccttggcgactccgtcaccgtctcccgcgagaagaccaaggtcaccgtcacctccgacggccccttctccaagaggtacctgaagtacttgaccaagaagtacttgaagaagcacaatgtgcgggactggctacgcgtgattgcggccaacaaggaccgcaccgtgtatgagctccggtacttcaacattgccgagaatgagggcgaggaggaagattagagtgcattccacttatatcttagttttgagcttgttgaattttgatacttgtacccggtagtcatttgcacctatcttcccatgttatgctgtggtgaattttggatggttaatttgaagaatccttacatttgatcgcctcaatttttgtgcctactttgtgtctgcaagttatctgtgactggagaaaatgtcatgtttagaattcctccgacttcaagattgtactctgattgacgccaaaggtgatacagagaatattgcgttggtgtgaaaattatgagcggtacttattctgcttccttcccaccgtctgaagtctattgacattgtaccgtgcaagcatatcaaag

SEQ ID NO: 4986 - DNA, 820 bp, Saccharum officinarum
tgtagctggtgccctgcggcaccggtccggaatccccgggcgcgcccgggccttcccggcgcagccaccaccaccgaagcagcggcgcacgcggacaagccgagcgaggcggaggagaggagatggcgcgcggcgtggcggctgggtcgaagggcggcgctgccggcggcggcaagaagaagggctccgtcaccttcacgatcgactgcaccaagcccgtggaggacaagatcatggagatcgccacgctcgagaagttcctgcaggagcgcatcaaggtcgccggcggcaaggctggcaacctcggcgagggcgtcaccgtcacccgcgataagaccaaggtcaccgtcacctccgacgggcctttctccaagaggtacctgaagtacttgaccaagaagtacctgaagaagcacaatgtgcgtgactggctccgggttatcgcctcaaacaaggaccgcagcgtctatgagctccggtacttcaatattgctgagaacgagggtgaggaggaggattaaacgcacccaccttatctgtgtcttgtgaactttgtatgtgttggaacactcgtgctgtagccttttaaggggacgagttttgatgtttaaattggtcttctgatgtttttataagcgtgctggaacttctcatgtgatgcttagataatcgagtccaagaattgttgttcttgcttcagtctctgtaaggatgaccgtgggcagtgagtgtttatgagcgtctatcgaactgactatttagctgcaggtattcatgtatagaaatcattgccgatcggtgtggtaatgctaggttcgac

SEQ ID NO: 4987 - DNA, 345 bp, Scabiosa columbaria
gtcgtggaggtgccgccggtggtgctaaaggtggaaagaagaagggatcgacgttcacgatcgactgtggaaagccggtagaggataagattatggagatcgcttcacttgagaagttcctgcaggagaggattaaggtcggcggcaaagccggagctcttggtgattccgttaccgttactcgtgagaagagcaagatcactgttacttctgacagcaacttctctaaacggtacttgaagtacttaaccaagaagtatctgaagaagaacaatgttcgtgattggcttcgggtgatagcctcaaacaaggatcgtaatgtttatgagctcaggtatttcaata

SEQ ID NO: 4988 - DNA, 1031 bp, Zea mays
ccagccgcatcggcggcccctctcgtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaaagctatgttgtggacagaagtgtaacgtgccggatttcttgcatttcttagggctattttgagaaccctattttcttaaggggtttttatttttaagtgaaattagtttagtttttctttgagaaaaatagaaatcctttagggctgatttggtggatatggaattggagggaatcagagtccatatttaaatttgaatagggaggtgattcctcctccttcgttccctgtcccatcaaatcagccaggttagtttggaaactccataagcctatatttggataatttacacttcaatcccctcaccctatgcatagggtgaggggattgaagtgtaaattatctaaatataggcttatgaagtttccaaactagcctttaattgttttatgtatgctcgggggccaaa

SEQ ID NO: 4989 - DNA, 537 bp, Triticum aestivum
  misc_feature (490)..(490): n is a, c, g, or t
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattgggctacgcgtggttgctgccaacaaggaccgaaacgtctatgagctccgctacttcaacattgctgagaacgaaggcgaagaagaagattagattgcactacgcttatatttatattgaactcnttcattttgataccgtaccctaatttccaaatgtccaagttatggtg

SEQ ID NO: 4990 - DNA, 698 bp, Brachypodium distachyon
aaccctatcgtctccgcgcagccaccatcgaagctaactccggagagcaaagtcagagatggcgcgcggcgtagcggctgctaccaagggcggcgtggccgccgggaagaagaaggggtcggtctccttcgtgatcgactgcgccaagcccgtcgaggacaagatcatggagatcgcttcgctcgagaagttcctgcaggagcgcatcaaggtcgcaggcggcaaggccggcaacctcggcgactcggtcaccgtttcccgcgacaagagcaaggtcaccgtgacctccgacggggccttctccaagaggtacctgaagtacttgaccaagaagtacctgaagaaacacaatgtgcgagattggcttcgggtcatctcatcaaacaaagaccgcagcgtgtacgagctccggtacttcaacattgctgagaacgatggtgaggaggaagattagatgcactgccttgtttcaatctcttgtcaacttttggactcctcagagcacttacgctgtagtattccaagagaatgagttttgatgtttaattttctaccgatgtttttgattgtggtgaaactcctatgtgacggttagataatcatgttgaagatttgtcggttgtcacgcttgtagtttgagagcgatctgtgcttcttaagttgaattgaatgtgcagttcagtagtgctgtgtaagtg

SEQ ID NO: 4991 - DNA, 616 bp, Vigna unguiculata
gcttatcacagtcacgagggagacagtgtgcgtgttagagagaggtgcgaaaatgagcggagccaaggggaagaagaagggagcaagcttcgtgatcgattgcgcgaagccggtggaggacaagattatggacattgcttctctcgagaagtttcttcaagagaggattaaggtcggcggcaaggccggtgcactcggcgattccgttactgtcacacgggacaagaacaagatcaccgttacctccgacagcaacttctctaaaaggtatctgaaatatttgaccaagaagtacttgaaaaagcacaatgttagggattggcttcgggtgattgcatccaacaaggacaggaatgtctatgagttgagatatttcaacattgctgagaatgagggtgaagaggaagactgaagatccaattctctgtcttgagtcatttcccttaggattagtaattgtggagactctttttatcatgtgttgtttattgacttgttactggttgtttaaatattcctgtgtttaatttggaatcgactttgtgccttcatatgaagttttatactgattatttaagaggtttttattaaaatcagatgtttattttgggtacca

SEQ ID NO: 4992 - DNA, 583 bp, Festuca arundinacea
ggcacgaggaaccgaagcagacaccggaaagcaagcaaggcggctgcagagatggcgcgcggtgtggcagcggctaccaagggcggtgctggcgccgggaagaagaaggggtcggtcaccttcgtgatcgactgcaccaagcccgtcgacgacaagatcatggagatcgcgtcgctcgagaagttcctgcaggagcgcatcaaggtcgccggtggcaaggccggcaaccttggagactccgtcaccgtcgcccgcgacaagagcaaggtcaccgtcacctccgacggggccttctcgaagaggtacttgaagtacttgaccaagaaatacctgaagaagcacaatgtgcgtgactggcttcgggtgatttcatccaacaaggaccgaagcgtctacgagcttcggtacttcaacattgctgagaatgagggcgaggaggaggattagatgcaatgccttgtttctatctcttgtgaaactttgaacttgctggggcacttatgcagtagagttttgatgtttaattttccaccgatgttttgaattgtggtgactctgggtgatgtgataaccaagttgaaaa

SEQ ID NO: 4993 - DNA, 751 bp, Panicum virgatum
ccacgcgtccgcgtctctcgcggcgcagtcaccaccaccgaacccggcggcgcacgcggaggagcccagcgagaggcggaggaagaaggcgatggcgcgcggcgtggcggcgggggcgaagggcggcgcggccggcgggaagaagaagggctccgtcaccttcacgatcgactgcaccaagcccgtggaggacaagatcatggagatcgccacgctcgagaagttcctgcaggagcgcatcaaggtcgccggcggcaaggccggcaacctcggcgagggcgtcaccgtctcccgcgacaagaccaaggtcaccgtcacctccgaggggcctttctccaagaggtacctcaagtacttgaccaagaagtacctgaagaagcacaacgtgcgtgactggctccgggtcatcgcctcgaacaaggaccgcagcgtctatgagctacggtacttcaacattgccgagaatgagggtgaggaggaggattaggcgcactaccctatctatgtcttgtgaacttttggacgtgttggaacagtcttgctgtagcctttcaagggatgagttttgatgtttaaattggtgtcctgatgtgttttaagagtggcgaacttccatgtgatgcttagataatctgtgtccaaaaatgttggttcctgtgaaacatatcatcagcgatttatcgataggttgtcgctatgattgtctatcgaactgctatatcagtatggaaactcccattgtcaaattaag

SEQ ID NO: 4994 - DNA, 977 bp, Panicum virgatum
tctctcgcgcgcagccaccaccaccgaacccggcggcgcacgcggaggagcccagcgagaggcggaggaagaaggcgatggcgcgcggcgtggcggcgggggcgaagggcggcgcggccggcgggaagaagaagggctccgtcaccttcacgatcgactgcaccaagcccgtggaggacaagatcatggagatcgccacgctcgagaagttcctgcaggagcgcatcaaggtcgccggcggcaaggccggcaacctcggcgagggcgtcaccgtctcccgcgacaagaccaaggtcaccgtcacctccgaggggcctttctccaagaggtacctcaagtacttgaccaagaagtacctgaagaagcacaatgtgcgtgactggctccgggtcatcgcgtcgaacaaggaccgcagcgtctatgagctacggtacttcaacattgccgagaatgagggtgaggaggaggattaggcgcactaccttatctatgtcttgtgaacttttggacgtgttggaacagtcttgctgtagcctttcaagggatgagttttgatgtttaaattgatgtcctgatgtgtttgaagagtggttaacttccatgtgatgcttagataatctgagtccaaaaatgtttgttcttgcttgtctgtgaaacacatcatcagcgatttatcgttaggttgtcgctatgattgtctatcgaactggttatatcagtatggaaactccggttgtcaaattaagcgcatgtgatatttctgtcccgcttgctaacctggagcatactgcccatttgctggctgccctgccgtaactgctcaagccttttgtgtttttgttggtcgtgagatgagttaggacagccccatgtgagttgtaaccttgcggatgtaattcagcggcaattgattgccattgatgtaaccagacctgcaattgtattttgctacccaatactgtttaccttgtcccccc

SEQ ID NO: 4995 - DNA, 685 bp, Triticum aestivum
ccgaagcagactccggagagcgggcaaggcggagaccgagatggcgcgcggcgtggcggcggctaccaagggcggcgcgggcgccgggaagaagaaggggtcggtcaccttcgtgatcgactgcaccaagcccgtcgacgacaagatcatggagatcgcgtcgcttgagaagttcctgcaggagcgcatcaaggtcgccgggggcaaggccggcaacctcggggactccgtcaccgtcgcccgcgacaagagcaaggtcaccgtcacctccgacggggccttctccaagaggtacttgaagtacttgacgaagaagtacctgaagaagcacaacgtgcgtgactggcttcgggtgatttcatccaacaaggaccgcagcgtctacgagctccggtacttcaacattgctgagaacgagggcgaggaggaggactagatgtgcactgccttgtttctgtgccgtgtgaaactttgaacttgttggagcacttctgcagtagagttttgatgtttatgttttcacccctgttttgaattgtggccaggacgccatgtgatggatgcttagataaccaagctgaagaattgtccgttcttgttcttgtggtttatagaaatgttggtgagagtaaaaacctcggccgcgaccacgcgaagcacgagtgcggccgcctgcaggtcgacc

SEQ ID NO: 4996 - DNA, 630 bp, Triticum aestivum
cccgaagcagactccggagagcaggcaaggcgaggaccgagatggcgcgcggcgtggcggcggctaccaagggcggcgcgggcgccgggaagaagaaggggtcggtcaccttcgtgatcgactgcaccaagcccgtcgacgacaagatcatggagatcgcgtcgctcgagaagttcctgcaggagcgcatcaaggtcgccgggggcaaggccggcaacctcggggactccgtcaccgtcgcccgcgacaagagcaaggtcaccgtcacctccgacggagccttctcgaagaggtacttgaagtacttgacgaagaagtacctgaagaagcacaatgtgcgtgactggcttcgggtgatttcatccaacaaggaccgcagcgtctacgagctccggtacttcaacattgctgagaacgagggcgaggaggaggactaatatgcactgccatgcttctgtgtcgtgtgaaactttgaacttgttggagcactcctgcagtagagttttgatgtttatttttttcacccatgttttgaattgtggccaggacgacatgtgatggatgcttagataaccaagctgaagaattgtccgttcttgttcttgtggtttgtagaaatgttggtgagag

SEQ ID NO: 4997 - DNA, 660 bp, Utricularia gibba
tgccgtccgcgatcgacagagcgaagatgagtaaaggcgcggtggccggagcgaagggcgggaagaagaagagcgccacgttcatcatcgattgctcgaagccggtggaagataagatcatggaaattgcttctctcgagaagttcctccaggagaaaatcaaggtcggtggcaaaactggggctctcggtgaagctatcacgatctcccgtgagaaaaacaagatttccgtcaccgccgactccgctttctccaaaaggtatcttaagtacttgacaaagaagtacttgaagaagcataacgtgcgagactggcttcgggtgattgcgtcaaacaaagaccgcagtgtctatgaactccggtatttcaacattgccgagcaagaggcggaggaagaagattaaactgtgggtttgtgcttcagtttcttatccctttgtcagtccccaagtctttccatcgagattcttgatttcccagttatctccatgtcgtgaacaaatttcttaaggagttttcacactcctaacaaaaatgggctgtccttggaaaagatggcatttttccagattttcaggcaagcctgagtttttggggacgaggatttcaagcaggggcgttatgtgaaatctacgtactgtaggaatttggattttgaga

SEQ ID NO: 4998 - DNA, 558 bp, Antirrhinum majus
  misc_feature (532)..(532): n is a, c, g, or t
tcaagcaaaatgagtaaagcggttggagccaagggcgggaagaagaagggtgctaccttcgtcatcgattgtgccaagcctgccaaggataagatcatggagattgcttctctcgagaagttccttcaggagagaatcaaagtcggaggcaaagctggtgctctcggtgaatctgttaccgtttcacgtgacaagaacaaaatcaccgtcactgccgattctgacttctctaagaggtatctcaagtatttgacgaataaatacttgaagaagcacaatgttagagattggcttagggtgattgcttcaaacaaagaacggaatgtttatgaactgcgctacttcaacattgcagaacaagagggggaggaagaagaatagaaactcttaacatgttcttcttgctcaactgtttggcttggccgttttttggaccaatttgtttgtctatttgtccttttggaacttctgcatttttggcgaatatgatgatattgtgttgctctttttttatataattgaagttaatacntaagtaatagatctcttttaagtact

SEQ ID NO: 4999 - DNA, 706 bp, Solanum melongena
acgctcagaaaccctaaccattttctcttcgcattgctcttccaaaatcgccgcagcttctcaggtagggtatttttgtctgtaatcatcggagaagatgagtaaaggaagcagcggagtcaccaagggtgggaagaagaagggagccaccttcgtgatcgattgctcaaagcctgttgaggatagcatcatggaaatcgcctctttggagaagtttctgcaggagcgcatcaaggttggaggaaaggctggagctcttggtgactccgtgactgtcactcgtgacaaaaccaaaatcaccgtcacctccgagagcaccttctccaagaggtatttgaaatacttgaccaagaagtatctaaagaagaacagtgtccgtgattggctcagagttatttcctcaaacaaggaccgcaatgtctatgagttgaggtacttcaacattgctgacaatgaggctgaggaggaagaatgagatgctggaattggtcaatcctgatattacatcctttgttgaacattagttttgtagttctttattatctggaattgtttgccttctgagacgttttttacaattttgtcagtgaaacgagaacttagcacctaaatggggaatatgattagctatcttgtagttgatttatttcttctgcattgtgatgtttttggggtgagctatcatcaatcttctcccattgttttc

SEQ ID NO: 5000 - DNA, 661 bp, Solanum melongena
actactttaacagtcatcacttgcatacactcgcagtacgccgtcgagttttgtcctgtagccgaagagaaatagagagattgtgaagatgagccgagcagcagcagtagcagcgaagggtgggaagaagaggggtgcaaccttcgtcattgactgttcgaagccagtagatgacagtatcatggagattgcttctcttgacaagttccttcaggagagaattaaagttggtggaaaagctggtgctcttggggattccgttactgttactcgtgacaagaataagatcactgtcacctccaactccgctttttccaagaggtacctgaaataccttgtcaaaaagtacttgaagaaaaataacgtcagggattggcttagggtgattgcttccaacaaggacaggaatgtttacgaattgcgctacttcaacattgctgagaatgaagcagatgaagaagagtaaacagacattcagtgtctcgctttatcttcttcagatggtcgtcttgttcgagttgctactgagtcttgtcttctcatttctggattattgttttgcagtttgcttattagtaaaagagagctttacttcgatactttggtttgtttatctttgtggtcaactatgcaaaagtcatatatttatctgtattgcctt

SEQ ID NO: 5001 - DNA, 827 bp, Capsicum annuum
tcccccgggctgagggttgttggttaggctcatggggtactagattttggtgttggcttgacccgcagcctccaggtagtgtgtatttgtttgtgtaaatttaggagaagaagatgagtaaaggaagcagcggagccaccaagggtggaaagaagaagggagcaacttttgtgattgattgctcaaagcctgttgaggatagcatcatggaaattgcctctttggagaagtttctgcaggagcgtatcaaggttggaggaaaagccggagctcttggtgactcggtcactgttactcgtgacaaaaccaagatcactgtcaccactgagaccaatttctccaagcggtatttgaaatacttgactaagaagtatctaaagaagaacagtgtccgtgattggctccgagttatttcttccaacaaggaccgtaatgtttatgagttgaggtacttcaacattgctgacaatgacgccgaggaggaagaatgagtagctggaattggtcgatcttaatagagcacccgttgttgaactttagtttgtagttctcttatttctgatattatttgccttgtgagactttatttacaattttgtcagtgaaatcaaaaccttgcacttttgcccaactcaatggagaatattgtttgctatctttcagtcggtttatttcttccacattgtatgttttaggggtgaactaccatcaatctactcccattgttttccaaacattgtctgttttagagatttcatctgatcagaggtgcctgcagacttgcttgcacgatccctctctgccagaatataatttgccttatcagt

SEQ ID NO: 5002 - DNA, 802 bp, Podocarpus macrophillus
tatagtgattggcttcgaattagcagcggaggaaacgggcgggcagaaatggagcgtaggaggttccatgagaaaggcttggctgttttgtttagaggagagaagaggcagagttgaagaagcagaagcagaagcagaaatgggtccgcaggttgcgaagaagggaggaaatgcagctgccaaaggcggcaagaagaaggccaacaccttcaccatcgactgcggaaagcccgtggaagacaagatcatggacatcgcctcctttgagaagttcttacaggatcgcatcaaggtcggcggcaagactggcgttctcggcgacatcgtcaccatctctcgcgacaagaataagatctcagtaacgtctgagtccgccttttccaagaggtacttgaaatacttgacaaagaaatatttgaaaaagcataatgtgagagattggctgcgagtgatagcttcaaacaaagataggaatgtctatgagctacggtacttcaacatcgctgagaacgagggagaagatgaagattagattgaatcctgggaaatttatgttgcattgagaattaaggtagaaagctggcgttgcagagatttggggcattttcttaggaattgttacggtccatattttttgaatgttatttaagttctatgtcttaggacatcaattgtaatttggtgtggatgataccgaattttgtgctgttctaaattaaacttagcatgagtaagtgtaatggattatttgctgttattgtgaattttgctgatttagtccatatatgaaatacgaaaaaaa

SEQ ID NO: 5003 - DNA, 629 bp, Solanum tuberosum
tatttgaataacagcagaagagaaataagagtgtaaagatgagccgagcagcagcagcagcagcgaagggcgggaagaagaagggggcaagcttcgtcattgactgttctaagccagtggaggacagtatcatggagattggttctcttgacaagttccttcaagagagaattaaggttggtggaaaagctggtgctcttggagattccgtcactgtcagtcgtgataagaacaagatcaccgtcacttgcaactccactttctccaagaggtacctcaaataccttgtcaagaagtacttgaagaaaaataatgtcagggattggctaagggtgattgcttccaacaaggacaggaatgtttatgagttgcgctacttcaacattgctgagaatgaagcagatgaagaagattaaacatggccattcaacggccctttatctccttcttgagtcaaccttcttatttagaaccttatatcatatgtttgagttatcaatgagtctaatattctcacttctagattattgattttttgtgcccttatcagtaaaagaaaacattactttgatactttggtttgtttatctttggggtcaactttgcgcaagtcattaatttatctgtat

SEQ ID NO: 5004 - DNA, 607 bp, Solanum tuberosum
cagaagagaaataagagtgtaaagatgagccgagcagcagcagcagcagcgaagggcgggaagaagaagggggcaagcttcgtcattgactgttctaagccagtggaggacagtatcatggagattgcctctcttgacaagttccttcaagagagaattaaggttggtggaaaagctggtgctcttggagattccgtcattgtcagtcgtgataagaacaagatcaccgtcacttgcaactccactttctccaagaggtacctcaaataccttgtcaaaaagtacttgaagaaaaataacgttagggattggcttagggtgattgcttccaacaaggacaggaatgtttatgagttgcgctacttcaacattgccgagaatgaagcagatgaagaagattaaacatggctattcaatgaccctttatcttcttattttgaaccttatatcatctgtttgagttattaatgagttgtatcttctcatttctagattattgattttttgttcccttatcagtaaaagaaaacattactttgatactttggtttgttcatctttggggtcaactttttgcaagtcatcaatttctctgtattgccttttc

SEQ ID NO: 5005 - DNA, 774 bp, Solanum phureja
gggtcggggcgacgggtcaaataggaagaggaacgagggaaaaccctaattaaatataatcatccacttctatacactcgcagtcggccgccgtcgaatttctccctatttgaataacagcagaagagaaataagagtgtaaagatgagccgagcagcagcagcagcagcgaagggcgggaagaagaagggggcaagcttcgtcattgactgttctaagccagtggaggacagtatcatggagattggttctcttgacaagttccttcaagagagaattaaggttggtggaaaagctggtgctcttggagattccgtcactgtcagtcgtgataagaacaagatcaccgtcacttgcaactccactttctccaagaggtacctcaaataccttgtcaagaagtacttgaagaaaaataatgtcagggattggctaagggtgattgcttccaacaaggacaggaatgtttatgagttgcgctacttcaacattgctgagaatgaagcagatgaagaagattaaacatggccattcaacggccctttatcttcttatttagaaccttatatcatatgtttgagttatcaatgagtctaatattctcacttctagattattgattttttgtgcccttatcagtaaaagaaaacattactttgatactttggtttgtttatctttggggtcaactttgcgcaagtcattaatttatctgtatggcgttttctcctcttgatgatcacatgtaatttattgagttcatttgttgtctgc

SEQ ID NO: 5006 - DNA, 597 bp, Saccharum officinarum
gggcaagaagaaggggtcgtcgccttcacgatcgactgcaccaagcctgtggaggacaagatcatggagatcgcctcgctcgagaagttcctgcaggagcgcatcaaggtcggcggcggcaaggccggcagcctcggcgactccgtcaccatctcccgcgagaagaccaaggtcaccgtcacctctgacgggcccttctccaagaggtacctgaagtacttgaccaagaagtacttgaagaagcacaacgtgcgggattggctacgcgtgattgcagccaacaaggaccgcagtgtctatgagctccggtacttcaacatcgccgagaatgagggcgaggaagaagattagagtgcattacacttatatctagttttgaactcattgaattttgatacttgtaaccgtagttttgcaactgccctcatgttatgctgtggtgaattttggatggttaatttgaagaatccttacatttggctgcctcaacatcagagtgccctaccgagtctttatacaagttatgttgtgaacagagaagtgtaatgggcatgatttcttgcatttcttaatatttttatactctggttggggccc

SEQ ID NO: 5007 - DNA, 821 bp, Pinus pinaster
tttggaggcagatagataaacgaagaggagaggcgaaggcagaagagaggagagctgagtgaaggcagtgaaagagaaggaaggagagaaatgggtcctcaggtggcaggaggcaaaaagggaggggctgcgcccgtgaaggggaagaagaaggcctccaccttcgtcatcgactgcgggaagccagtggaagacaagatcatggacatcgcctccttcgagaagtttttgcaggatcggatcaaggtcggcggtaagactggtgttcttggtgacatcgtcactatcgctcgtgagaagaacaagatttcggtcacctctgagagcgccttctctaaaagatatttgaagtacttgacaaagaaatatttgaagaagcataatgtgagagattggctgcgagtgatagcttcaaataaggaccgcaatgtctatgaactacgctactttaatattgctgagaatgaggccgaagaagaagattagattgaacttttggttgtgttgcattgatgtccatgttaggtgggacacttgctattgggaaatttagagcattttcttggagaagatcgatgaaatttttgtgtcatttgaatctatgtgccttttttggcattctaatatattaataacattcatatattgtagaattttgtgaaaggataatggcagtattttgtccctagatacttccccggcacatgattttatatttaaatgaatttttttgttagcttgatgataaaagataagtgtttggtgtacaagggcattagtatggatttgcatgctctactacttttatgtcaaataagtac

SEQ ID NO: 5008 - DNA, 985 bp, Brassica juncea
tacgcggaggcgaacggaggcttgagtacgacggcgaagaatccggaggcggaggattggaaggcgatggtgggaaggtggggtagaggagaggaaaggacgccggagggagtgatcttcgtggagaagctagctgacgatgaaggagatgatgatcacggtggatacaacggtggagaaggtgcaacaagtgcttgggggatagtggcgcagggaagaggaacggattgtggaccggtttgctacctgttgaaaacgacccgggttgggtcgggtatggggacggtttgcacacatttttgcttggtgaaggtgaagagttttagggagacggctatgttacagttgaataactcttggttggtgcagactggtcaatgaatcaaagtataggtttaatggttccttatttatacagtggttaaaggctaagggattttgatggtgtagttattctctttgggttgaattataaaacccttattgatggtctttttttttgaaatgataattaacttcaaccaaaactagataagatctctcacaaaaaaagaaccaagataaatagtattgatagcagcaaaaagcagaaaccaaaacaacggaagaaacaggaaacaagagtagagctcttctagtcttcttcctctccctcgttctcagcaatgttgaagtacctcaactcatagaggttacggtccttgttggccgcaatcactctgagccaatccctcacattgtgcttcttcaagtacttctttgtcaagtacttgaggtacctcttggagaattgaccatcagaagtgacagtgatcttgttcttctcacgagtgattgtcgcaccggctttcccaccgactttgatcctctcttgcaggaacttctcgagggaagcaatctccatgatcttgtcatcgaccggcttcgagcaatcaattgagaaggacactcccttcttctttcccttggcaacggctgcacctcc

SEQ ID NO: 5009 - DNA, 875 bp, Pinus taeda
ggggagcgagaggtataaggattgttgctatacgaaaacctagtctctagtggtttggaggcagataaacggcgaggagagaagtcagaagagaggagagccgagtgaaggcagtgaaagagaaggaaggagagaaatgggtcctcaggtggcgggaggcaaaaagggaggggctgcgcctgtgaaggggaagaagaaggcctccaccttcgtcatcgactgcgggaagccagtggaagacaagatcatggacatcgcctccttcgagaagtttttgcaggatcggatcaaggtcggcggtaagactggtgttcttggtgacatcgtcactatctctcgtgaaaagaacaagatttcggtcacctccgagagcgccttctctaaaagatatttgaagtacttgacaaagaaatatttgaagaagcataatgtgagagattggctgcgagtgatagcttcaaataaggaccgcaatgtctatgaactacgctactttaatattgctgagaatgaggccgaagaagaagattagattgaacttttggttgtgttgcagtgatggcaatgttaggtgggacacttgctattgggaaatttagagcattttcttggagaagatcgatgaaattttgtgtcatttgaatctatgtgcctttttcggcactctaatatattaacatttttatattgtagaattttgtgaaaggataatggcagtattttgtccttagatacttccccggcacatgattttatatttaaatgaaattttttttgtagcttgatgataaaagataagtgtttggtgtacaagggcattagtgcggatttacatgctctactacttttatgtcaaataagtacaattttagccc

SEQ ID NO: 5010 - DNA, 754 bp, Pinus taeda
cggccggggggaagcgagaggtataagggaatgttactatacgaaaacctagtctctagtggtttggaggcagataaacggcgaggagaggagaagtcagaagagaggagagacgagtgaaggcagtgaaagagaaggaaggagagaaatgggtcctcaggtggcgggaggcaaaaagggaggggctgcgcctgtgaaggggaagaagaaggcctccaccttcgtcatcgactgcgggaagccagtggaagacaagatcatggacatcgcctccttcgagaagtttttgcaggatcggatcaaggtcggcggtaagactggtgttcttggtgacatcgtcactatctctcgtgagaagaacaagatttcggtcacctccgagagcgccttctctaaaagatatttgaagtacttgacaaagaaatatttgaagaagcataatgtgagagattggctgcgagtgatagcttcaaataaggaccgcaatgtctatgaactacgctactttaatattgctgagaatgaggccgaagaagaagattagattgaacttctggttgtgttgcattgatggcaatgttaggtgggacacttgctattggttgatttagagcattttcttggagaagatcgatgaaatttttgtgtcatttgaatctatgtgccttttttggcattctatatattaacatttttatattgtagaattttgtgaaaggataatggcagtattttgtccttagatattcccccg

SEQ ID NO: 5011 - DNA, 579 bp, Ambrosia trifida
ccaagggcggaaagaagaagcaatcgacgttcgtgattgattgcggtaagcctgtggaagataagataatggagattgcatcgcttgagaagtttctacaggagaggattaaggttggaggcaaagctggtaatcttggtgactctgttaccatttcacgtgaaaagaataagatctctgttactgctgatagtaatttctccaaaaggtatttgaagtatttgacaaagaagtatttgaagaaacacaatgtgagagattggcttcgagtgattgcgtctaacaaggaccgtaatgtgtacgagttgcgttacttcaacattgctgagaatgagggtgaagaggaagattgaattggcagttgagcttgttttgtgtttgttttttgtacctggttttctgtttttgtttatgttatatcagaattttgtttatggatctatgcagaactgtattgtagtggggttttaaagtttgagtgcacttgcactgatctggaaattacatctatggaatatgcatatcatcacaatttccttttgactcataattggatacttttaagttagcaaaaaagaa

SEQ ID NO: 5012 - DNA, 779 bp, Amborella trichopoda
  misc_feature (580)..(580): n is a, c, g, or t
gggtctggagaaacgatacagaaagagaggcgagagatcgtttgcagggagtagagagaaacgatacagaaagaaaggagagagaagatgagtggaaagggtgcttctgtccctaagggcaagaagaagacttcgacattcgtcatcgactgtgctaaaccagtcgaagacaagattatggacatagcttccttcgaaaagtttttgcaggatcgtataaaggttggagggaaaactggggttcttggtgaatccatcactattgctcgcgaaaagagcaagataagcgtcactgctgataccgctttctccaagaggtacttgaagtacctcacgaaaaaatacctcaaaaagcacaatgtgagggattggctccgagtcattgcatcaaacaaagaccgtaatgtctatgagcttaggtacttcaacattgccgagaatgaagctgaggaggaagactgatcctttctctctttttgtttcctcgatttcagtctagtttctttttttttattttttccattcggtttttgattttggtagagatatcaaactatttaatatgtccagatactggttnaggtacactagccaaatttcatccgggataagaagttggaatttaatcttttttggtttgaaatattggttatgcaaaacactcaaatagatactgatgtgcacactatttgatcatgctttgtgtccctctcccctttaatgtttttccttggcttgaccatacttcgagattttcagatattcaacacctgcttgct

SEQ ID NO: 5013 - DNA, 380 bp, Brassica juncea
tgttcaagagaagggaattgagaaaaatgagtcgtggaagtgcagcagttaccaagggaaagaagaagggagtttccttctccatcgactgctcgaagcccgtcgatgacaagatcatggagattgcttccctcgagaagttccttcaggagaggatcaaagtcggtggcaaagccggtgcactcggtgattccgtcacaatcacccgtgagaagaacaagatcactgtcacttccgatggccagttctccaagaggtatctcaagtacttgacgaagaagtatttgaagaagcacaacgtgagggattggctcagagtgattgcagccaacaaggaccgtaacctctacgagttgaggtacttcaacatcgctgagaac

SEQ ID NO: 5014 - DNA, 563 bp, Curcuma longa
ttcgatcgggaactgagtcgtggcagcggagggtcgacggccgcagccgggaagggcgggaagaagaaaggttccaccttcgtcatcgactgcgctaagccggtggatgacaagataatggacatcgcctccctggagaagttcctccaggagcgcatcaaggtgaacggaggcaaggccggtgctcttggtgacgccgtcaccgtcacccgtgacaagagcaagatcactgtcacctccgaagggcccttctccaagcgatacttgaagtacctaacgaagaagtttctgaagaaacacaatgtgcgcgattggctgcgagtcattgcttcgaacaaggaccgcaatgtttacgaactccggtattttaacattgcagagaacgaaggcgaggacgaagattaatctgccgtgttacctttcctcaaatttagaaggcttcttttgatactgttagtttaggcttaaacttgagtaagcttatctttgaatgaatgcttatatttcgatatgacacctcgatgtgtgagcttgtttaggtcaaaaatattctttctgatatt

SEQ ID NO: 5015 - DNA, 660 bp, Solanum lycopersicum
agggtcggggcgacgggtcaaataggaagaggaacgaggaaaaccctaattaaatataatcatccacttccatacactcgcagtcggccgccgtcgaatttctccctatttgaatagcagcagaagagaaatcaagagcgtaaagatgagccgagcagcagcagcagtgaagggcgggaagaagaagggggcaagcttcgtcatcgactgttcgaagccagtggaggacagtattatggagattgcttctcttgacaagttccttcaagagagaattaaggttggtggaaaagctggtgcacttggagattccgttactgtcactcgtgataagaataaaatcaccgtcacttgcaactccactttttccaagaggtacctcaaataccttgtcaaaaagtacttgaagaaaaacaacgttagggattggcttagggtgattgcttccaacaaggacaggaatgtttatgagttgcgctacttcaacattgccgagaatgaagcagatgaagaagattaaacatgtctagtcaatgtcccttttatcttcttattttgaaccttatatcatctgtttgagttattaatgagccgtatcttctcatttccagattattgattttttgtccccttatcagtaaaagaaaacgttactttgat

SEQ ID NO: 5016 - DNA, 599 bp, Antirrhinum majus
acattccaaaaatcagcgaagatgagtaaaagcgcagcagcagcgggagcgggagccaaaggcgggaagaagaagggagtgagcttcgtgatcgattgccagaagcctgttgaggataagatcatggagattgcttctctcgagaagtttttgcaggagaggatcaaagtcggcggtaaagccggcgctcttggtgattccgtcactatttcacgtgacaagaacaagatcaccgtcactgctgattctaccttctctaagaggtatctcaagtatttgaccaagaagtacttgaaaaagcacaatgtgagagattggcttcgggtgattgcttctaacaaagagaggaatgtctatgaactgcgctacttcaacattgccgaacaagaggcagaggaggaagactagaaattttagccaaatttttgttctttttttctcttcactcccaactgtgtcagaatcactttttggatcaatttatgtttgttataatgaccttatggaatttgtggtttatggatttgcatattttgtgaatcttatgttttatgcatcatatcttatataagttaagctattaaatctcttttttaatt

SEQ ID NO: 5017 - DNA, 738 bp, Eucalyptus grandis
ctcccatctccgccgcgcaccctgaaaccctagaatcaccagtgatttgaaccatcgaccggggagcgatgaggaaaggagggagcggcgcggcggcggcggcggcggcgggaggcgcgaagggcgggaagaagaagggggcgagcttcgtgatcgactgcgcgaagccggtggaggacaagatcatggacatcgcctccctcgagaagttcctccaggagcgcatcaaggtcgacggcaaggccggcgccctcggcgacgtcgtctccgtcgcccgcgacaagtccaagatcaccgtcacctccgactccaacttctccaagaggtacctcaagtacttgacaaagaagtacttgaagaagcacaatgtccgggattggcttcgggtgattgcttccaacaaggaccgcaatgtttatgagcttaggtacttcaacattgctgagaatgagggagaggaagaagattaagattccacatcgggtagttgttttctggttctatgtcctctctatgtcgtgagaacatttttgacgtcttagtttatatattcgcctagaattggttttgatgatctacatgtagacgaatcattcatcttttttgtttgtacgagtatgtctctctttgcaatgtgagttgaatgattctgtggaggggatctgcttctattcatcattttctggcggtaaatgtcatatgcgatcccgtgatcggtttggtgacggaattttctga

SEQ ID NO: 5018 - DNA, 573 bp, Olea europaea
tcagagtttgttgtggaagaatttgactgcaactgaagaaaatgagtaaaggagcagccggtgccgctgtgaagggagggaagaagaaggcatcgacgttcttgattgactgctcgaagccggtggaggataagatcatggacattgcttctctggaaaagttcctccaagaacgcatcaaggtcggcggcaagcccggtgccctcggtgactctgttactgtcactcgcgacaaaagcaagattaccgtagttgccaatgagaccagcttttcgaagcggtacttgaagtatttaacgaagaagtatctgaagaagaacaatgtgcgtgattggctgcgggtgattgcttcgaacaaggatagaaatgtttatgaattgaggtacttcaacattgctgagaatgaggctgaggaggaagagtaatggaagaacagttgttattcatatttcccgagttgatttttgttttggctagtgtttactgtgttggacatcagtttcaattttgtttggatgttcgctatataatggagtttaaccatcatctcggtactaatatgccgtaaacttc

SEQ ID NO: 5019 - DNA, 599 bp, Cleome spinosa
ggatcttcttcttctgttcgattagtcgagttttctgacgaaggaggtttcggcgacaatggctcgaggagcggcggcgatggcgacggcggcggggaagaagaagggatctaccttcgtgattgactgctcgaaaccagtggatgataaaatcatggatgttgcctctcttgagaagttccttcaggagcggatcaaggtcggtggaaagcccggcgctctcggcgacgccgtcactgttactcgcgacaagaccaagatcaccgttaccgccacctccgacttctccaagcggtacctcaagtacttgacgaagaagtatctgaagaagaacaacgtgcgcgactggcttcgtgtgatttcgtccaacaaagacagaaacgtctacgagctccgttacttcaacattgccgagaacgagggggaggaggaggaagactaagcttcttcttcttccgccattttcttctcccgttgccgcctccttaattatttagcctcagatttttctttttgctgtgaaaccttggctttgttttactgcaagttttggttgtctatttggtttttttcctgagtgctcaagatttcagatttgg

SEQ ID NO: 5020 - DNA, 624 bp, Pennisetum glaucum
agccgccacacctcacgacccacccggggcaccagccggtcggccgagcgaagggggcggagatggcgcgcggcgtggtgtcggcgaagggcggcggcgctgccgcggggaagaagaaggggtcggtctccttcacgatcgactgcaccaagcccgtggaggacaagatcatggagatcgcctcgctcgagaagttcctgcaggagcgcatcaaggtcgccggcggcaaggccgggagcctcggtgactccgtcaccgtctcccgcgagaagaccaaggtcaccgtcacctccgacggccccttctccaagaggtacctcaagtacttgaccaagaagtacctgaagaagcacaatgtgcgggattggctacgtgtgattgcggccaacaaggaccgcaccgtctatgagctccggtacttcaacattgccgagaatgagggcgaggaggaagattagagtgcattctacttatatcttagtttcgaacttgttgaattttgatacctgtacccgtagtcatttgcacctatattctcatgttatgccgtggtgaattttggatggttaatttgaagaatccttacatttggtcgcctcaaaaaaaaaaaaataaaaaagtact

SEQ ID NO: 5021 - DNA, 709 bp, Allium cepa
gcgcctaaagtgagctcagctggatccaaacccgcatcgaaagggccgaagaagaaggctaccaccttcgtcatcgactgcgcgaaaccggtcgaagacaagataatggacattgcatccctcgagaagtttcttcaggaaagaattaaagtagctggtggcaaagctggtgcttttggtgattctgttaccattaccagagataagagtaaagtttcagtcacttctgatggtcctttttctaaaaggtatttgaagtatctgacaaagaagtacctgaaaaagcacaatgtgcgagactggcttcgagtaatttcatcagacaaggatcgcaatgtttacgaactgcgatacttcaacattgcagaaaatgaagcagaggaagaagaatgatcgatatgcatctttttatgcaactttgttttatttttcagttcaaacaatatagaatgatcgggtgtgttttgaatcgcttagctttttttgtttgttgtcttgatcatctttggcatttcattaatgtaagactcgatttggtttgcaaacctattcttttttcagtgtaatttcgtaatctgccattgtgttttagcacctgccattgtgttttagcacgttcacttgtggttagtggttagggatgtcaatgcatacttgaaaaattcgaaattcgtcagcattgagaaagcggataaatatcgctatttgg

SEQ ID NO: 5022 - DNA, 684 bp, Hordeum vulgare
gccaccaccgaagcaggactccggagagcaggcgaggcgggagaccgagatggcgcgcggcgtgacggcggctaccaagggcggcgcgggcgccgggaagaagaaggggtcggtcaccttcgtgatcgactgcaccaagcccgtggacgataagatcatggagatcgcgtcgctcgagaagttcctgcaggagcgcatcaaggtcgccgggggcaaggccggcaacctcggcgattccgtcaccgtcgcccgcgacaagagcaaggtcaccgtcacttccgacggggccttctccaagaggtacttgaagtatttgacaaagaagtacctgaagaagcacaatgtgcgtgactggcttcgggtgatttcgtccaacaaggatcgcagcgtctacgagctccggtacttcaacattgctgagaatgagggtgaggaggaggattagatatgcactgtcttgtttctgtgtcgtgtgaaactttgaacttgttggagcacttctgcggtagagttttgatgtttatttttttcacccatgttttgaattgtggcgacgacgccatgtgatggatgcttagataaccaagctgaagaattgtccgttctcgttcttgtggtatgtagaaatgttgcagaggatatgcgtggcctagaaatgctgcaacacgcacattcttattatac

SEQ ID NO: 5023 - DNA, 628 bp, Triticum aestivum
ccgaagcagactccggagagcaggcaaggcggagaccgagatggcgcgcggcgtgccggcggctaccaagggcggcgcgggcgccgggaagaagaaggggtcggtcaccttcgtgatcgactgcaccaagcccgtcgacgacaagatcatggagatcgcgtcgctcgagaagttcctgcaggagcgcatcaaggtcgccggcggcaaggccggcaacctcggggactccgtcaccgtcgcccgcgacaagagcaaggtcaccgtcacctccgacggggccttctccaagaggtacttgaagtacttgacaaagaagtacctgaagaagcacaatgtgcgtgactggctccgggtgatttcatccaacaaggaccgcagtgtctatgagctccggtacttcaacattgccgagaacgagggcgaggaggaggattagatatgcactgccttgtttctgtgtcgtgtggaactttgaacttgttgagcacttttgcggtagagttttgatgtttatttttccaccgatgttttgaattgtggccaggacgccatgtgatggatgcttagataaccaacctaaagaattgtccgttctcgttcttgtggtttgtagaaatgttggtgagag

SEQ ID NO: 5024 - DNA, 461 bp, Glycine max
aaatcaatctcagacacatcacatatatcattttagcataatacatggcagatcttcaacaaaaactggatgctctgaagggtcttgttggtgtgctaaatagcatggatgagggtgaaactcacaacaatgcaacttcacccaataacccccataatcctactcctatgcctggaaggaatcactcaattggaaaatacaacaacagtggcactcagaagatcaaaggtctgagtaaccaaacgggcttcaccgaaggcaatgctaacggagccatcaactttggcagtttacatgcctaagtaaatcgatgtaccaagatcttgaaatacataaataataatgtgacgtatatattaaaataagagcttcacagtttgagtgtggctccaatattttcagcttttcattatatatcaatatatgacttcttagattaacatgcagaatacattagcttt

SEQ ID NO: 5025 - DNA, 1316 bp, Glycine max
aatttccgagcaatcgttcgccgtcgcttgaagctgctgctgctgctgccctttgtgaagtgtttgttctccgtcatctcgcgtcgttagttcattgaactcactgcattgagtggatttggtacaagttgagttcagaatggatgggcgacatcagaagcaaaaaaacaagtacagtataattgttcctacatataatgagcgtctcaacattggtctcattgtttacctcatcttcaagcaccttggggatgctgattttgaaattattattgtggacgatgggagtcctgatggtactcaggatgttgtaaaacaactgcagcaagtttatggagaagatcggattctgttaagagcacgccctaggaagttgggtttgggaactgcttatattcatggcatgaagcatgcatctggaaattttgttgtcatcatggatgctgatctatctcaccatccaaaatatttgccaaacttcattagaaagcagtcggagactggtgctgatatagttacagggactcgttatgttaaaggtggtggtgtgcatggatggaatcttatgcgtaagctaactagcaggggggcaaatgttcttgcacaaacacttttatggcctggtgtctcagatttgacaggatcttttagactttataggaaatcagtgcttgaagatatcattagttgctgtgttagtaaaggatatgtctttcaaatggaaatgatagtacgggcatccagaaaagggtaccatattgaagaggtcccaatcacatttgttgatagagtatttggaagttcaaagcttggtggatcagagattgttgaatacctaaagggcctagcttatctcttggtgacaacataaaaggataaatcataacaactcgatataccttacattttggggaagaaaaagagatataaattttgttgttcatttacttatatattgaggacatcaaatttactgctagaatctccgtaactttgccttttgaagttagcaggaagcatctgtatgattctctctgtttataactgtgtgaggctttacaatttttggttttgctgaacttgtaacttaagctgaggtcttcctacttttgtcccttttagttctattcgccaagacgccaaccaatacttgaccccttagatggaaatacaacttattggatctgtctctctctctctctcccctcttttatattggagatctcttgaacatgagaaatttttgggtaaacctgaaccatagtggggttttcagtgaataccatgccaccttactttggtggcaggcagtggtc

SEQ ID NO: 5026 - DNA, 1143 bp, Cajanus cajan
ccccttgatttctgaggaatatagttcgccgtcgcccgaagctgttgcccctcgtaaagtgtctgttgtctgtcatctcgcctcgttagttcatcgaactcactgcattgagtggatttggtccaaatggacgggcaacatcagaagcaaaaaaacaagtacagtataattgttcctacatataatgagcgtctcaacattggtctcattgtttacctcatcttcaagcaccttggggatgttgattttgaaattattgttgttgacgatgggagtcccgatggtactcaggatgttgtaaaacagctgcagcaagtttatggagaagatcgaattctgttaagagcacgacctaggaagctgggtttaggaactgcttatattcatggcatgaagcatgcatctggaaattttgttgtcatcatggatgctgatctatcacaccatcctaaatatttgccaagcttcattagaaagcagttggaaactggtgctgacatagttacagggactcgttatgttaaaggtggtggtgtgcatggatggaatcttatgcgcaaacttactagcaggggagcaaatgttcttgcacaaacacttttatggcctggtgtctcagatttgacaggatcttttagactttatagaaaatcagtccttgaagatatcattagttgctgtgttagtaagggatatgtctttcaaatggagatgatagtacgggcatccagaaaaggataccatattgaagaggttccaatcacatttgtcgatagagtatttggaagttcaaagcttggtggatcagagattgttgaatacctgaaaggcctagcatatcttttggtgactacataaaaagataaaacataacaacacagatatatgtcttacattttggggaaaagaaactagagataaattttgttgttcaattacctatttatttaggacactataacttgcattttgaatttaacaggaagcatcggtatggttctgtgtttataactgtaaaccgagaaaattaattgttttgattttgctgaacttttgagttatgttgaggttcttctttctagtttttgtgttttgtcccttctagtcgcctaagacgccaaccaatactttgacccttcttag

SEQ ID NO: 5027 - DNA, 928 bp, Trigonella foenum-graecum
aaaaaaaaagtttttgggaggagacattggtttcgccttctaatttccatcgatagcagtgggctgaaactgctgccgctggagcctggaagtgaagtgtgtgtttgttctccgcgatctcacattctgcgctcattttattacaatggatggggagcatcagaagcagaaaaataagtacagtataattgttcctacgtataatgagcgactcaacataagcctcattctttaccttatattcaagcaccttcaggatgttgattttgaagttattgttgtggacgatgggagtcctgatggcactcaggatattgtaaaacaactgcagcaggtttacggagaagaccggattttgttaagagcaagacctaggaagatgggtttaggaacggcttatattcacggcatgaagcatgcatctggcaattttgttgtcattatggatgctgatctatcacaccatccaaaatatttgccaggcttccttagaaagcagttggaaactggtgctgatatagttacagggactcgttatgttaaaggtggtggtgtgcatggatggaatcttatgcgcaaacttacaagcaggggagcaaatgttcttgcacaaacacttttatggcctggtgtctcagatttgacagggtctttcagactttataggaaatcagcgcttgaagatattattagttgctgtgttagtaagggatatgtatttcaaatggagatgattgtacgagcatcaagaaaagggtaccatattgaagaggttccaatcacttttgttgatagagtctatggaagttcaaagcttggtggatcggagattgttgaatacctgaaaggcctagtatatcttctggtgacaacataaaaagataaagggttatgctaacaagtgccctaatgattcaaaaaaggaaat

SEQ ID NO: 5028 - DNA, 996 bp, Arachis hypogaea
tagctgaattagctgccgctgcttggatcctaagactgacaaactcagcatcgggtggctttggtctccgttagagaatggatggactgaataagaatcaagcaaacaagtacagtataattgttcctacgtacaatgaacggctcaacattggtctcatagtttacctcatcttcaagcatcttaaggatgttgattttgaagttatcgttgtggatgatgggagtcctgatggtacccaagatatagtcatacaactgcagaaagtttatggagaagatcgaattcttttaagaccgagacctaagaagctgggtttaggaactgcttatattcatggcatgaagcatgcatctggaaattttgttgtcatcatggatgctgatctgtcacaccatccaaaatatttgccaagattcattagcaagcagatggaaactagagcagatatagttactggtactcgttatgttaaaggtggtggtgtgcacggatggaatcttatgcgcaaactaacaagcaggggagcaaatgttcttgctcaaacatttttatggcccggtgtctcagatttgacaggatcatttagactttataggaagtctgttcttgaagacatcattagttgctgtgttagtaagggatatgtctttcaaatggagatgatagtaagagcatccagaaaaggataccatattgaagaggttccaatcacatttgttgatagagtatttggaagttcaaaacttggtggatcggagattgttgaatacctgaaaggcctagcatatcttttggtgacaacataaaaagataaatcctccatgtgtcatttttttgtatgttttttttgtttgtttttgtggggggtggtggttatttatttacaaatattcaaataatgacataagcttcttggtagaatgttatcatttgtttctctaatttagtaggaagcatttgtatggttccatgtgtatacaatttttgtggtaa

SEQ ID NO: 5029 - DNA, 927 bp, Medicago truncatula
attataatgatggatgagaagcataatcaaaagaaaaacaaatacagtataatcgttcctatatataatgaacgactcaacattagcctcattctttaccttattttcaaacaccttccggatgttgattttgaagttattgttgtggatgatgggagtcctgatggtactcaagatgttgtaaaacaattgcaacaagtttatggagaagatcggattttgttaagagcgagacctaggaagatgggtttaggaactgcttatattcatggtatgaagcatgcatccggaaattttgttgtcattatggatgctgatctatcacaccatccaaaatatttgccaggcttcattagaaagcagttggaaactggtgctgatatagttacagggactcgatatgttaaaggtggtggtgtacatcgatggaatctaatgcgcaaactaacaagtaggggagcaaatgttcttgcacaaacacttttatggcctggtgtctcagatttgacagggtcttttagactttataggaaaacagtgcttgaagatatcattagttgctgtgttagtaagggatctgtctttcaaatggagatgatagttcgagcatccagaaaagggtaccatatcaaagaggttccaatcacgtttgttgatagagtatatggaagttcaaagcttggtgggtcagagattgttgaatacctaaaaggcctggtatatcttctgatgacaacataaaaagataaatgataacaactcatgtatgcattctagttttgcgaaaactcaagaggtgttgcagttcagtaacctgattattgaggacacatgtttgcctgatagaatctgcatagtttgtattttgagttttgtaggaagcacctacgttttttttggtggtggacacacctacattaaaactgt

SEQ ID NO: 5030 - DNA, 917 bp, Heritiera littoralis
gacaggcaggaaggaatcagcttagcgtttccgtcgaacaacgatttgctatagtcggggaaaaccagaattaagactgcccaaggtttagagagaagagaaaaatggagcagaagaataagtacagcataatagtaccaacttataacgagcgcctcaacattgctctcatcgtctatctcatcttcaaacatcttcgggatgtagattttgaaataattgttgtggatgatggaagccctgatggtactcaagaagttgtgaaacaactgcagaaactgtatggtgaagatcgtattctattgagaccaagacctaagaagcttggattgggaacggcttatattcatggtttgaagcatgcttctggaaattttgttgtaatcatggatgccgatctatcacatcatccaaaatatttaccaagcttcatcaagaaacagttggaaactggtgccagcatagttactggaacacggtatgttaaaggcggtggtgtgcatggatggaatctgatgcgcaagctaacaagtaggggagccaatgtttcttgcacagactcttttgtggcctggtgtatcggacttaactggatctttcaggctttataggaaatcagtgcttgaagatgtcattagctcctgtgttagcaagggatatgtatttcaaatggagatgattgttagggcatcaagaaaaggctaccacattgaagaggttccaataactttcgttgatagagtatttggaagttcaaagcttggtggatctgaaattgtagagtatctaaaaggccttgtatatcttttggtcacaacatgagctgattacaaatatggccaacgcaaggacatctttatctgtttgctagtggctggttgaaattcacggtgtacactctgcagcaaacatttttt

SEQ ID NO: 5031 - DNA, 1070 bp, Quercus alba
tcaaaaattgagaatctgattcagctgtctctcaccggagttgaattacgagttcatacagatactacaatagagtagagggtttttggaaaagaaagagagaatggaaatcaacaagaacaagtacagtataattgtccctacatacaacgaacgcctcaacattgctctcctcgtatacctcgtcttcaagcatctccgggatgtggattttgaaataattgttgtggatgatgggagtcctgatgggactcaagaagttgtaaaacagttacagcaggtgtatggtgaagaccgtattcttttgagagctagacctaggaagcttgggttaggaacggcttacgttcatggcctgaagcatgcatcaggaaattttgttgtgatcatggatgctgatctatctcaccatccaaagtacttgccaagcttcatcaggaaacagttggagactggtgcaagtatagttaccggaacccgctatgttaaaggtggtggtgtacatggatggaatcttatgcgcaagctaacaagtaggggagccaatgttctcgctcaaacacttctatggcctggtgtatcagatttgacaggatctttccggctttataggaaatcagttcttgaagatgtcattagttcctgtgtaagtaagggatatgtctttcaaatggaaatgattgttcgagcttctagaaaacgctaccatattgaagaggttccaattacatttgttgatcgagtatatggaagctcgaagcttggaggatctgaaattgttgaatatcttaaaggccttgcttatctgttggtcacaacataaagttaagcagaaatgagaagtcagtgataatctctttccattttgtgcacaagtcgtgtaaggttttttgatacagacagttgagattctcaatttagtctaacaaccaacattctcacattggctcttttgtttatgaattttgataggctttaatgatacagacaattaaaatatcttatttgagtctaagaacaaatattactacaaaaaaaaaaaaaaagttaattaatcgcggacacgcgag

SEQ ID NO: 5032 - DNA, 1167 bp, Populus trichocarpa
ccaaatcatcccttcgttcctcgatcgccaccaccacaccaccaccacggattcgtaccggaggacttttctccctctgtaaaattttgcgccttcttctaatctcagctctgctccaaaattagggtttacaatcagaacaaaaatggagaaagagaagaagaacaaatacagcataatagtgccaacgtacaacgagcgtctcaacattgcactcatcgtttatctcatcttcaaacacctccgggatgttgattttgaaattattatcgtggatgatgggagtcctgatggtactcaagaagttgttaaacagttacagcaagtatatggtgaagatcacattttgttaagacctagagcgaagaagcttggactaggcacggcttacattcatgggttgaagcatgcgtctgggaattttgttgtcatcatggatgctgatctatctcaccatccaaagtacttgccaagctttatcaagaaacagttggagactggtgcaagcatagttactgggacccgatatgttaagggtggaggcgtacatgggtggaatctaaggcgcaagctaactagtaggggagctaatgttcttgctcaaacacttctgtggcctggtgtatctgatctgacaggatctttcagactttataagaaatcagtgcttgaagatattatcagttctgtggttagcaagggatatgtctttcaaatggagatgattgttcgggcttccagaaaaggctaccatattgaggaggtcccgattaccttcgttgatagagtatttgggagttcaaagctaggaggatctgaaattgtcgaatatttgaaaggccttgcatatcttctagttacaacataagatacaacgctgtttacaaacactatcagttttgtacaccttgtgcacttctgcacttcctgttgcaatcttaatagccataatcatagttttttatacttgcaaaaatcgcaatccttcttagttctgtaaagatttgttgacttcttcctcgtactgtgataggttttggattcaaattagaattattatcatatcaactcttgtttgatgatttttgtcaaaattcaaggcataatcatcaccagcactgaacagatatattgctagaatttcaatgattttccccctttgatgca

SEQ ID NO: 5033 - DNA, 1161 bp, Theobroma cacao
ctgcttgcgaggcctgctatgactttcgcccaattgagtttacacagcgacctcgatcgaagcggcctgcttcgctcttggcccaattttaaggaagcatcgttgaaaaatcaaaaatgaaaaattaagaaggaaggcgaggggaaagagaatcagcttggtcttttgcgtcgaaaaacacttgctgttcccatagaaggagaaacgggggaggcagaaagagaaaaatggagcagaagaaggagaagaataagtacagcgtgatagtaccaacttataacgaacgcctcaacattgctctcatcgtctatctcatcttcaagcatcttcgggaggtagattttgaaataattgtggtggatgatgggagccctgatggtactcaagaagttgtgaaacaactgcagaaactgtatggtgaagatcgtatcctattaagacctagacctaagaagcttggattgggaactgcttacgtacatggtttgaagcatgcttctggaaattttgttgtaatcatggatgctgatctatcacatcatccaaaatatttgccaagcttcatcaagaaacagctggaaactgatgccagcatagttactggaacacggtatgttaaaggtgggggcgtgcatggatggaatctgatgcgcaagctaacaagtaggggagccaatgttcttgcacagacccttttgtggcctggtgtgtcggacttaacgggatctttcaggctttataggaaatcagtgcttgaagatgtcattagctcctgtgttagcaagggatatgtctttcaaatggagatgattgttagggcttcaagaaaaggctaccacattgaagaggttccaataacttttgttgatagagtatttggaagttcaaagctcggaggatctgaaattgtagagtatctaaaaggccttgcatatcttttggtcacaacatgacaccttcctacaaatatagccaacatgataacaagaagtgactgcttgagatttgcagtggtgactctgcacggtacacaatttttatggcttgctcttagaagttaccttatgtaacctgacttttgatggcaaatttggttgaagaactcaaaaagtattttacttagggaatgtttgtcactggaaatgaagaggcaaaagcttg

SEQ ID NO: 5034 - DNA, 1206 bp, Manihot esculenta
gacaccaacgacaacaataaagcagcgacatttgaagctgcgatctcccttcaacaacagcgaagcatgtgatctcccttcagcggcggcaccagcaacagcggcaatctcctttcgtttgaagcaggcgatctactaccaggcctctctggcgctgccggcaacggcgccgtctcaccagcaatagcggtagctcctcttgtagctaatccttgagtggccgttattagttatttctcacaattatctcctagataacaactaggagagagattttttggatttggctcctaggtggctcagtaatttcaagcatagaaacaacaagatttttttcccaaaaaaatttaagtggacaattccagagggttcaataatttccccaattcgaatccccataaatttgggagaggctgggttagttcagctcaagtaagtgcgatattggcttcagtgtcgagaaaaataacatggagcagaggaaggaggagaagaataagtacagtattataatcccaacctacaatgagcgcctcaacattgccctcatcgtctacctcatctttaagcatctcagggatgttgagttcgaaattattgttgttgatgatgggagtcctgatggtactcaagaagttgtaaagcaattgcagcaagtttatggtgaagatcacattttgttaagacctagaccgaagaagcttggtttaggaactgcttacatccatggtttgaagcatgcatctggaaatttcgttgtaatcatggatgctgatttatcccaccatccaaagtacttgccaagctttatcaagaaacagttggagactggtgcaagtatagtcactggaacccgatatgttcaaggtggcggcgtacatggttggaatcttatgcgcaagctgacgagtaggggagcaaatgttcttgcacaaacacttctgtggcctggtgtatctgatttgaccgggtctttccggctttataaaaaatcagtacttgaagatatcataagttcagttgttagcaaggggtatgtctttcaaatggagatgattgttcgggcttccagaaaaggttaccatattgaggaggttccaattacttttgttgacagagtttttggaagttcaaagcttggaggatctgagattgttgaatatctgaagggccttgtttatcttctggttacaacataagaggcaa

SEQ ID NO: 5035 - DNA, 1238 bp, Vitis vinifera
agaaaagcagtgaaagagaggatcggaaccgaggttttgatctgaaagtggagcgtagatggaggagcagcataagaatggcgggaacaagtatagcataatagtcccaacctacaacgagcgtctgaacatcgctcttatcgtcttcctcatcttcaagcatctccgggatgtcgactttgaaataattattgttgatgatgggagtccagatgggactcaagaaattgtgaaacaactgcagcaagtgtatggtgaagaccgcattctattaagagcaagacctaagaagcttggattagggacggcctactctcacggcttgaagcatgcatctggaaactttgttgtaatcatggatgctgatctatcacaccatccaaaatatttgccaagctttatcaagaaacagttggaaactggtgcaagtatagtaactgggacgcgttatgttaaaggtgggggtgtgcatggatggaatcttatgcgcaaactaaccagtaggggggccaatgttcttgcgcaaacacttctatggcctggcgtatcagacttgactggatctttccggctttataagaaatctgtgcttgaagaagtcatcagctcatgtgtcagtaagggatatgtcttccaaatggaaatcattgttcgggcttccagaaaaggctaccatattgaagaggttccaattacttttgttgatagattatttggaagttcaaagcttggaggatctgaaatcgtgggatatttgaaaggccttgcatatcttttggtcacaacataaagttccacagaagattattaccagctaaactatttttgtcccctttgtgcattattcatttgtttttgtagtgaattcttagtctccaattatatgagccaatctcggttctcagtcaagtttgcaatgaacattcctatcatcagccttatttttcttttcttttctactataattgaaaacccctgttcacagatctggttttttagtcgacactgagttttggccattttgtaacaacatttcaaatgtttatgaggttgtaattccttttcctccctagtgatgtaatctcgctgtccatggaccatgatggacttttggctatggaacttttgccttgaaccgatcatcatggtgatcatgatcacgatcacgataacttgatgggttatgaatgctcgatgatggactgcatgaattgaatgtgtcaattgggtcatttatt

SEQ ID NO: 5036 - DNA, 1169 bp, Vitis vinifera
gatctgaaagtggagcgtagatggaggagcagcataagaatggcgggaacaagtatagcataatagtcccaacctacaacgagcgtctgaacatcgctcttatcgtcttcctcatcttcaagcatctccgggatgtcgactttgaaataattattgttgatgatgggagtccagatgggactcaagaaattgtgaaacaactgcagcaagtgtatggtgaagaccgcattctattaagagcaagacctaagaagcttggattagggacggcctactctcacggcttgaagcatgcatctggaaactttgttgtaatcatggatgctgatctatcacaccatccaaaatatttgccaagctttatcaagaaacagttggaaactggtgcaagtatagtaactgggacgcgttatgttaaaggtgggggtgtgcatggatggaatcttatgcgcaaactaaccagtaggggggccaatgttcttgcgcaaacacttctatggcctggcgtatcagacttgactggatctttccggctttataagaaatctgtgcttgaagaagtcatcagctcatgtgtcagtaagggatatgtcttccaaatggaaatcattgttcgggcttccagaaaaggctaccatattgaagaggttccaattacttttgttgatagattatttggaagttcaaagcttggaggatctgaaatcgtgggatatttgaaaggccttgcatatcttttggtcacaacataaagttccacagaagattattaccagctaaactatttttgtcccctttgtgcattattcatttgtttttgtagtgaattcttagtctccaattatatgagccaatctcggttctcagtcaagtttgcaatgaacattcctatcatcagccttatttttcttttcttttctactataattgaaaacccctgttcacagatctggttttttagtcgacactgagttttggccattttgtaacaacatttcaaatgtttatgaggttgtaattccttttcctccctagtgatgtaatctcgctgtccatggaccatgatggacttttggctatggaacttttgccttgaaccgatcatcatggtgatcatgatcacgatcacgataacttgatgggttatgaatgctcgatgatggactgca

SEQ ID NO: 5037 - DNA, 1218 bp, Eucalyptus grandis
gccaccactttcggccggggggaataacccgacggcggagtcaaagccgcgctcgaggcagagatcgacgatctgaaagcatcttccgcgtcgttcgcgagagggatcaaagctcgaggtccgccgatcctgctcgtcaatggaggacgtccggccggaaggaggggccggcgacaagtacagcttgatagtgcccacctacaacgagcgcctcaacatcgccctcatcgtttacctcgtcttcaagcatctccgagatgtcgatttcgagatcatcatcgttgatgatggaagtccggatggtactcaagacattgttaaacagttgcagcaagtgtatggcgacgacaggattcttttaagagcaaggcctaggaagctcggtttaggaacggcttatcgtcatggtttgaagcatgcatctggcaattttgttgtgatcatggatgctgatttgtctcaccatcccaaatatttgccgagcttcatcaagaaacagcaggaaactggtgcgagcatagttaccgggactcggtacgttaaaggtgggggtgtgcatggatggaatcttatgcgtaaactcactagcaggggagccaatgtgctagctcagacatttctatggcctggagtatctgatttaactggatctttccgtctctatcggaaatcagttcttgaagatcttattaactcctgcgtcagcaagggctatgtgttccagatggagatgattgttagggcctctagaaaaggataccatattgaagaggttcctattacatttgttgacagagtatttggaagttcaaagctcgggggatctgaaatcgttgaatatctaaaaggccttgcatatctactggtcacaacataaatttgaagatcgtcttctttagcatcttagttcactaactttccgtgatacaaattagcaaaggtcatagacaaggtcttgcagcagttgctgctttatactctatcccgttgctggggttttttcaaggtgacgatgtatattttagatgggttactcaacagaagcatgtctttatggactaaacatgatgatgaaattgatgactgttggaagttgtgaccttaacaattgttttgggtccatgtattatgagcgtttatacagtacaaatttttcattggatacaaaaaaaaagaaagggaagattaccaacgctcttgcagtctgctttttcctta

SEQ ID NO: 5038 - DNA, 1002 bp, Sarracenia psittacina
ggggatttttgatgcttcttcgccggggctgcgcagagggctgacgaaagcgttcggaagggagctcaccgatccatcaccaatttctcattcagccgaaccaaattcgagttttttgtcttaaggttatggcaatggaggaacagcagcagaaaaaggagagaaacaagtacagtatcatcgtcccaacttacaacgagcgcctcaacattgccctaattgtctatctcgtcttcaagcacctcccggatgttgattttgaaatgataatagtggatgatggaagtcctgatggaactcaagatgttgtgaaaaagttgcaagaggtgtatggggaagatcgcattctgttgagagctagacctaagaagctcggattagggactgcttatgtacatggtttgaaacatgcttcaggcaattttgttgtaataatggatgctgacttgtcacaccatccgaagtacctgccaagctttatcaagaaacagagggagactggtgcaagtatagtgactggcacccggtatgtcaaaggtggaggtgtgcatggatggaatctcatgcgcaaattgactagtaggggagctaatgtccttgcacagactcttctttggccgggtgtatcagatttaactggatctttccgcctttataagaaactgtgcttgaagatgtaataagctcttgtgttagtaagggatacgtatttcagatggagattattgttagggcttcaagaaaaggttaccacattgaagaggttccaattacttttgttgatagggtatatggaagttcaaagcttggaggatcagaaattgtagaatatctcaagggtcttatgtatcttttggttaccacttgaagagggcacagagattgtcaacttttgtttttatttgttagaaattttgatgttgtcacacaaccgatgcactcaatctgatcagcaaacaatgtcatctctctttttgcctcgctatatctcactttttatat

SEQ ID NO: 5039 - DNA, 1149 bp, Euonymus alatus
gaggaaaaagaacgaacggtgtatttcggggtctctcaattagggaagaaggatcatggagaaagagaaaagggaagagaagaataagtatagtataatagtcccaacctataacgaacgcctcaatattgccctcctcgtttacctcatcttcaagcatctccgggaggtcgattttgaagttattgttgtcgatgatggaagtcctgatggtacacaagaagtggtagaacaattgcaacaagtttatggagaagatcacgttctattaagacctagacctaggaagctcggcctaggaacggcttacatccatggtttgaagcatgtgtctggaaatttcgttgtgatcatggatgctgatttatcccaccatccaaagtacttaccaagcttcatcaagaaacagttagagactgatgctgatatagttaccggaactcggtacgttaagggtggtggtgtacatggatggaatctcatgcgcaaattgacaagtagaggagccaatgttcttgcacacacgcttttatggcctggtgtatctgatttaactggatctttccggctttaccggaagtcggtacttgaagatgtcatcagttcctgtgtcagtaaaggatacgtctttcaaatggagatgattgtccgggcttctaggaagggctaccatattgaagaggttccaattacctttgttgatagagtgtttggaagttcgaagcttggaggatctgaaattgttgaatatctgaaaggactcgcatatctcctggtcacaacctgaagatacaacatcagtgaatatcacaccacctcttgtagcgtcgtcataccctaacttttactaaattaggttttaccgttatttttttcttaatattgattttttggtttagtgaaacctttgttgtcattgggggttcttcctcccaccatacagcctttcgagcatggacggtgtaggttccgatagatcggagagtttttctatcccacacaagcacaattgagagctccatctagttttaattgaggatttattatgatattttgtttggatcatcatttgttctctatatagattaagacagaacagcaaacaacgtgtaaattacttttggtcactgttatagcctatgttacacc

SEQ ID NO: 5040 - DNA, 874 bp, Aquilegia formosa
aataaaaagaaatggagaaggagaagaacaaatacagtataatcgttccgacttacaatgaaagactaaacatcgctcttcttgtatatctcatcttcaaacatctcaaggatgtcgacttcgaaataattgttgtggatgatggtagtcctgatgggacccaagaagttgtaaagcagttacagaaattgtatggggaagatcgaattctcttaagagctagacctaggaaacttggcttaggaactgcttatattcatggactaaagcatgcatccggaaattttgttgtgatcatggatgctgatttatcccaccatccgaagtacttgccaagcttcattaggaagcagattgaaactggtgcaaatatagtcactggcaccagatatgttagaggcggtggtgtacatggatggaaccttatgcgtaaactgacgagtagaggagctaatgtacttgctcaaacactcctatggcctggtgtatctgacttgactggatcctttcggctttaccagagatctgtccttgaggatgttattaactcctgtgttagtaagggatatgtcttccagatggaaatgattgttcgagcttctagaaaaggctgccatattgcagaggttccgataacttttgttgatagggtatacggaagttcaaagctcggaggatctgaaatagttgaatatttgaaagggcttgcttatttgttggtcacaacataaatgtaagaggaaataaacatacaaatttttctttggttggtaagaaatgcaattgctttttgtgaaattaaatccatggataagattgaattttaatacaattttgtgaaatactaatttactgccatcccccaagttttgtt

SEQ ID NO: 5041 - DNA, 1103 bp, Ricinus communis
gccaaacacaaggaccaggcaaacttgaacaagcaaaatatcaagcattctgaaggaaaaggcaaatcgattgtcattgaatcggaacaggattgatttggttgattctcgtcggtagggttcctaaaatcaagaagataataagatgggggagaaaaacaagtatagtttaataatcccaacttacaacgagcgcctcaacattgctctcatcgtttacctcatctttaagcatctccgggatgttgactttgaaattattgttgtggatgatgggagtcccgatggtactcaagaagttgttaagcagttacagcaactttacggtgaagatcgtgttttgttaaggcctagacccgagaagcttggtttaggaactgcttacattcatggtttaaagcatgcatctggaaactttgttgtgatcatggatgcggatctatctcaccatccaaagtacttgcctagctttatcgagaaacagtcggagactggtgccagtatagtcactggaacccggtatgttacaggtggcggtgtacatgggtggaaccttatgcgcaagctaacaagtaggggagcgaatgttcttgcacaaacgctgctgtggcctggtgtatctgatctgacagggtctttccggctttataagaaatcagtgcttgaagatatcataagctccgttgtgagtaaaggatacgtctttcaaatggagatgattgttcgggcttccagaaaaggctaccatattgaggaggttccaattacttttatcgatagagtttttggaagttcaaagctcggagggtctgagattgttgaatatctgaaaggccttgcatatcttctggtcacaacatgagagggcaacgccaatgaaaacaaaccattgttatacacttttttgaccttttcatttgaaccttgtataaagttgcaagtttttctaatcaattagtgtatttagtcatcttcatctttctatttcctatgatagttattccattattttctacgggactggcttttgttatttaatgatttacagatatattgagtgttggttttttttgtctgaattaagaagcaaaatcagtgttatg

SEQ ID NO: 5042 - DNA, 1192 bp, Citrus sinensis
ccacgcgtccgaaaaataaaaaaaaaacactcgagaaggggaaacaaaacgacgatctgagtcggtttgaataatttgatctctcgatttgaaatttaggttttgaaacaaattaggaataatatggaagagacgaacaagaacaagaacaaatacagtataattataccaacatacaacgaacgactcaacattgctctgatcgtttacctcatcttcaagcatcttcgggatgtagattttgaaataatcgtggtggatgatggaagtcctgatggtacacaagaagttgtaaaacaactgcagcaattatacggagaagatcgaattctgttgagacctagaccgaagaagcttggattaggaactgcttacattcatggtttgaaacatgcatcgggcagttttgttgtgattatggatgctgatttatcccaccatccaaagtacttgccaagcttcataaagaaacagttggagacaggtgcaagtattgtaactggaacccggtacgttagaagtggtggtgtgcatgggtggaatcttatgcgcaaactgactagtagaggagccaatgtccttgctcaaacacttttatggcctggtgtatcagatctcactggttctttccggctttataagaaatcagtgcttgaagatgtcattagttcctgtgtgagtaagggatatgtctttcaaatggagatgattgttcgtgcttgtagaaaggggtaccacattgaagaggttccaattacatttgttgacagagtatttggaagttcaaagcttggaggatctgaaattgtcgaatatcttaaaggccttctatatcttctcgtcacaacataagatgctataacttcactcttcaaggattaagctgttgatcacaagtcacgggatggttctcttatgatcatttcttcctccactgatgttgaaaaattatcacattatttcaagtctctgatctgccttttttttttttattttacctgatgctcttgagtcctagaattcaggtagcaaattatctggtagtcttacgaatgattactaacttaatgatggctgatgagagtcaatatggttttttcatatgagaaaatgaaattctttttcaagtctgattagcatcatcctgctcttttgaataggtaaatttaagccggcagggatgccttccttc

SEQ ID NO: 5043 - DNA, 5577 bp, Ricinus communis
atgacgtggcgtaacaatataagctatatctcagatcttgtaacagttggaaaacataaacggctacagcagagcataattgagaataagcttggagggagagagaagagtcatgaggcagagtggctaaatttggagaagaagatgttaggttctttaacactttttccggctcctgtttttggttctttagctaacaactctaaaagggctttcggaaacgattgccatattaccagacaaaagccgcttggactgattcataggtctcaatatttgcttggttgtcccaaagtctatttcctctcaagattcccagtaaataagacggtacagcatgtcctcactgcctcagcagttatgacagatgacagctcaacaaagacaaatattgatgaagacatggaaaatattggtcttttgagcactgatcctggtctggatcaatttaaagatcacttcagatatagagtgaaaagatttatagatcaaaaacagctaattgaaaagcatgaaggaggtcttgaggaattttcaaaaggttaccagaaatttggatttaatagagaagatggcagcattgtctaccgtgagtgggcccctgcagctcaggaagcacaagttattggggacttcaatggatggaatggttctaaccacaggatggaaaagaatgaatttggtgtttggagtatcagaatacctgattctgctggaaatccagcaattcctcacaattcaagggtcaaattccgattcaagcatggcaatggagcttgggttgatcgaattccagcttggattagatatgctactgtggacccctcaagttttggagcaccatatgatggtgtctactgggatcctcctgcttcagaaaggtatcagtttaagtaccctcggcctccaaaacccagggccccacgcatatacgaggctcatgtaggaatgagtagttcagaaccccgtgttaattcataccgagaatttgccgacgatgtcttgccccatatacaggcaaataattataacacagtccagttaatggctgtcatggagcattcttactatggatcatttgggtatcatgttaccaacttttttgctgtaagcagtagatctggaactcctgaggatctcaaatatttaattgacaaagcccacagcttgggtttacgtgtcttaatggatgttgttcacagccatgcaagtaacaatgttactgatggtctcaatggctttgatgttgggcaaagctctcaggattcctattttcacactgcagatcgaggctaccataaattatgggacagccggctctttaattatgctaattgggaagttcttcgctttcttctgtccaatttaagatggtggcttgaggagtacaaatttgacggttttcgatttgatggagtaacttcaatgttatatcatcaccatggaatcaacatggggttttcagggaattatattgagtatttcagtgaggcaactgatgttgacgctgttgtttatttgatgcttgccaattctctgattcacaacctcttgccagatgccactgtgattgccgaagatgtttctggcatgcctggacttagttgttctgtctctgaggggggaattggttttgactatcgcctagcgatggccatccctgacaaatggattgattacttgaaaaacaagactgatgaagagtggtcaatgggagatatttcatggagcttaactaataggagatacacagagaaatgtgttgcttatgctgagagtcatgaccaagccattgtgggtgacaagacaatcgccttcttactgatggatacagaaatgtattctgggatgtcttgcttgacagatgctccacctactgttgaacgagggatagcacttcataagatgattcatcttttaacaatggcattaggaggtgagggctaccttaattttatgggaaatgagtttggccatcccgagtggattgacttcccaagagaaggcaatggatggagttatgataagtgcagacgccaatggaatttagttgacaccgaacacttgagatataagttcatgaatgcatttgataaagctatgaacttgcttgatgaaaagcattcgttcctttcatcaacgaagcagattgtaagcagcacaaatgaagaagataaggctattgtctttgagcgtggggatctggtttttgtgtttaattttcatccagagaatacatatgatgggtacaaggttgggtgtgacttgccagggaagtataaagttgcattggatagtgatgcttgggaattcggtggacagggaagagtgggccatgatgtagaccattttacgtctcctgaaggaatacctggagtgccggaaacaaatttcaacaatcgtcctaactccttcaaagtactctccccacctcaaacatgtgtggcttactatagagttcaagaaagccaagagagtaacaacagcatcaatccaggggccaggaatgagatatcaacagccgacgatgtgccaaagctgagggatattgaagtaggtatgaagcagacattagcagcagatactggagcaaagcggggtgatttggaagaagttgtcaatcagacattagcatcagatgctgcaactatgctggaggtcttcaaagaacctgctgatgataaggatactgaagaacctactgtttctgttaagaaaggaaattcaaaagcacaagagatttgaggaagggaagtcagatgactgagcatctgactattaagatcactttgttttgcatacatcaatatgctgttattttaaacatggggtccaaggatggaaagtttattagggttttaaattaggagcagattttgtatggtctgcacatggtctgcacataaagtaggctgttgtacatagttgggagtgctgttaaataagtttcatgtaaaagatcctctgcaaaatccctgtagaactagatagataaataaaacataataaacccttcagctgcgtgatttaatttgaaggaacaatttctgaaaataaggactgaaatctcacaaaagccaacagacgattaatcacaccaattttaggctttcagtgccgctggccctgcttatttttattagtaataacgctgctaaaagttgattgaatcaggtcctttgtgtcgctaaaactgcgtctactgtgaaatgccgctgcaaatgcggcatgacagttcgtcgctatatagtgatagtgtcacgactgccaaacttgaaatcataatgtccaactagctcttggatcaagttcagcccaaacgcacaggtttcctgaaaaaggcccaatttcagcctatgcgagcgtatctttgtcaagagtggcctaaactcaagacttctaaatctcgatctcgtcgccaaacacaaggaccaggcaaacttgaacaagcaaaatatcaagcattctgaaggaaaaggcaaatcgattgtcattgaatcggaacaggattgatttggttgattctcgtcggtagggttcctaaaatcaagaagataataagatgggggagaaaaacaagtatagtttaataatcccaacttacaacgagcgcctcaacattgctctcatcgtttacctcatctttaagcatctccgggatgttgactttgaaattattgttgtggatgatgggagtcccgatggtactcaagaagttgttaagcagttacagcaactttacggtgaagatcgtgttttgttaaggcctagacccgagaagcttggtttaggaactgcttacattcatggtttaaagcatgcatctggaaactttgttgtgatcatggatgcggatctatctcaccatccaaagtacttgcctagctttatcgagaaacagtcggagactggtgccagtatagtcactggaacccggtatgttacaggtggcggtgtacatgggtggaaccttatgcgcaagctaacaagtaggggagcgaatgttcttgcacaaacgctgctgtggcctggtgtatctgatctgacagggtctttccggctttataagaaatcagtgcttgaagatatcataagctccgttgtgagtaaaggatacgtctttcaaatggagatgattgttcgggcttccagaaaaggctaccatattgaggaggttccaattacttttatcgatagagtttttggaagttcaaagctcggagggtctgagattgttgaatatctgaaaggccttgcatatcttctggtcacaacatgagagggcaacgccaatgaaaacaaaccattgttatacacttttttgaccttttcatttgaaccttgtataaagttgcaagtttttctaatcaattagtgtatttagtcatcttcatctttctatttcctatgatagttattccattattttctacgggactggcttttgttatttaatgatttacagatatattgagtgttggttttttttgtctgaattaagaagcaaaatcagtgttatgtcaattgcatatcaatgggaccatgaaggattatttgaacagaatttgttacttagattataattgaaaccaatcttcaagaaatattaaccatggtttatactgtttgattgagaaagattacaacttcccaacacacaagccaattgatgaacttctccatatctctcacggactgaaaaataaacatcagatatgcaaactatttaccagagatcgtcaaagttcaagtattttcttaaaaccataaagtcaataacaaaaccacaaaatgcgaaaggaatcccgttattcctaaatccaaaaataaaaaaggagagatttctaaaacattcagactttcctaacccttcgagccccaactttcttttcatttgcaagaacagatttctcataattgacaggcaaaggaggcttcttattctccttactcaaacttctcaaagaatacctagggatctcactgctctccacagagtaagcagcagacactgattttctcaaactttgaagctttttagtatcccttttcttagaagattcaatatttactccgagattgtgcggagttttcactccttcttcacctgtctccccagtctttctcttcagtctctcatttctcctcgcagagtaaacatcataaaaccttcctctctcaaataaaggacttgagttagcacttaaacttttcctttcccctgcatttgttgcattttcttttccaaattcgtcctgcaccatccttgctagagcccttaactcccaggatatggagcgatactccggccggagatccaattcttccatgtctggaccaggatttagcttctgagacttgattaaagaacctgataaattcaaagattgcaactttcgcttacagcccaaaaaacgaaaacagtcataaggaaaagaaaacaagattaacccacctggaggagattgcaaagaagtggtagtggtggatcggagcacacgaccgggacggacccggattggagatttagccaagggaggcttacggtcgtacttcatttttgacattgaaaagctc

SEQ ID NO: 5044 - DNA, 792 bp, Cirsium arvense
gatcgatctccaatggcggaaaaccagaataagaacaacaagtatagcataatcgttccaacttacaacgaacgactcaatatcgctctcatcgtcttcctcgtcttcaagcatattccgaatgtcgactttgaaataataatcgtggacgatggaagtcctgacggaactcaagatattgtaaaacagttgcagcaagtctatggtgaagatcgcattctattaagagctaggcctaggaagcttggattagggactgcttacattcatggtctaaagcacgcttcaggaaattttgtcgtaattatggatgccgatctatcacaccatccaaagtacctcccacagtttataaaaaagcaaatggagacgggtgccagtattgttactggaactcgatatgtaagaggtgggggcgtgcacggttggactttgatgcgtaaattgacaagtagaggggcgaatgttcttgcacatacgcttctttggcctggtgtatcagatttaacaggctcgtttcgtctttacaagaaatctgtgcttgaggacattataagttcttgtgtgagtaagggatatgttttccagatggagatgattgtccgagcgtcaagaaaaggataccatatcgaagaggttccgatcactttcgtagacagagtttatggaagttcaaagcttggtggatcggaaatagtggagtatctgaaaggtctcgtgtatcttcttgttactacatgaagaacaaacgaaggtaaccaaccgaaagttggttcttatttctatttgtac

SEQ ID NO: 5045 - DNA, 1177 bp, Citrus clementina
aaaaattaaaaaaaaaaactcgagaaggggaaacaaaacgacgatctgagtcggtttgaataatttgatctctcgatttgaaatttaggttttgaaacaaattaggaataatatggaagagacgaacaagaacaagaacaaatacagtataattataccaacatacaacgaacgactcaacattgctctgatcgtttacctcatcttcaagcatcttcgggatgtagattttgaaataatcgtggtggatgatggaagtcctgatggtacacaagaagttgtaaaacaactgcagcaattatacggagaagatcgaattctgttgagacctagaccgaagaagcttggattaggaactgcttacattcatggtttgaaacatgcatcgggcagttttgttgtgattatggatgctgatttatcccaccatccaaagtacttgccgagcttcataaagaaacagttggagacaggtgcaagtattgtaactggaacccggtacgttagaagtggtggtgtgcatgggtggaatcttatgcgcaaactgactagtagaggagccaatgtccttgctcaaacacttttatggcctggtgtatcagatctcactggttctttccggctttataagaaatcagtgcttgaagatgtcattagttcctgtgtgagtaagggatatgtctttcaaatggagatgattgttcgtgcttgtagaaaggggtaccacattgaagaggttccaattacatttgttgacagagtatttggaagttcaaagcttggaggatctgaaattgtcgaatatcttaaaggccttctatatcttctcatcacaacataagatgctataacttcactcttcaaggattaagctgttgatcacaagtcacgggatggttctcttatgatcatttcttcctccactgatgttgaaaaaattatcacattatttcaagtctctgatctgcccttttttttattttacctgatgctcttgagtcctagaattcaggtagcaaattatctggtagtcttacgaatgattactaacttaatgatggctgatgagagtcaatatggttttttcatatgagagattgaagttctttttcgagtctgatttgcatcatcctgctctttgatataggtaattataagcggcatgcatgcgttcttc

SEQ ID NO: 5046 - DNA, 1177 bp, Citrus sinensis
aaaaattaaaaaaaaaaactcgagaaggggaaacaaaacgacgatctgagtcggtttgaataatttgatctctcgatttgaaatttaggttttgaaacaaattaggaataatatggaagagacgaacaagaacaagaacaaatacagtataattataccaacatacaacgaacgactcaacattgctctgatcgtttacctcatcttcaagcatcttcgggatgtagattttgaaataatcgtggtggatgatggaagtcctgatggtacccaagaagttgtaaaacaactgcagcaattatacggagaagatcgaattctgttgagacctagaccgaagaagcttggattaggaactgcttacattcatggtttgaaacatgcatcgggcagttttgttgtgattatggatgctgatttatcccaccatccaaagtacttgccgagcttcataaagaaacagttggagacaggtgcaagtattgtaactggaacccggtacgttagaagtggtggtgtgcatgggtggaatcttatgcgcaaactgactagtagaggagccaatgtccttgctcaaacacttttatggcctggtgtatcagatctcactggttctttccggctttataagaaatcagtgcttgaagatgtcattagttcctgtgtgagtaagggatatgtctttcaaatggagatgattgttcgtgcttgtagaaaggggtaccacattgaagaggttccaattacatttgttgacagagtatttggaagttcaaagcttggaggatctgaaattgtcgaatatcttaaaggccttctatatcttctcatcacaacataagatgctataacttcactcttcaaggattaagctgttgatcacaagtcacgggatggttctcttatgatcatttcttcctccactgatgttgaaaaaattatcacattatttcaagtctctgatctgcccttttttttattttacctgatgctcttgagtcctagaattcaggtagcaaattatctggtagtcttacgaatgattactaacttaatgatggctgatgagagtcaatatggttttttcatatgagagattgaagttctttttcgagtctgatttgcatcatcctgctctttgatataggtaattataagcggcatgcatgcgttcttc

SEQ ID NO: 5047 - DNA, 1180 bp, Gossypium hirsutum
aaaacgaaaatcaaatgaaaaacagtattgaagacgaactctttcgaccaagaattcttgctgccataatcggagaaacggcattaaaattggttaaggttttgaagagaagacgaaaatggatgctgccaagaacaagtacagtataatagtaccaacgtataatgagcgcctcaacattgctctcatcgtctatctcatcttcaaacatctccgggatgtagattttgaaataattgttgtggatgatgggagcccagatggtactcaagaagttgtgaaaaagctgcagactctgtatggtgaagatcgaattttattgagacctagacctaagaagcttggattgggaacggcttatatacatggtttgaagcatgcctctggaaattttgttgtaatcatggatgctgatctatcacatcatccaaaatacttgccaagcttcatcaagaaacagctggaaactggtgccagcatagttactggaacacgatatgtcaaaggcggtggtgtgcatggatggaatctgattcgcaagctaacaagtaggggagccaatgttcttgctcagactcttttgtggcctggtgtatcggacttaaccggatccttcaggctttataagaaatcagtgcttgaagatgtcatttcctcctgcgttagcaagggatacgtatttcaaatggagatgattgttagggcttcaagaaaaggctatcacatagaagaggttccaataacttttgttgatagagtatttggaagttcaaagcttgggggatccgaaattgtagagtatctaaaaggccttgtgtaccttttgatgactacatagaccttgctacatatagttcatcgcaagaagtaactggcgatccaagacagagactctgcggcaaacaactttttctgcatcttcttagaagttactggctttagatggcaatcttttcctttcttttttctttttgagtattttggttaacaatatttactgaggaatgtttgatgaaatgaaatggggaaagctaatctttgcactttacagattttaggatggaaagttaagtttaaaaacagaatgtgtgtttctatgatctttggaaaaaaactatccttgtaaagaaaattttaataacatttgcattactacttcaaaaaaaaagtaccgactgcg

SEQ ID NO: 5048 - DNA, 1266 bp, Populus trichocarpa
caaccagaccacgaacccagagctttcctccgtccctcgatcatcacaaagttcacaaccttggactcttaccggaagactctttccctcgtacttcaatatttccttcaaaatttctgaaaaattagggttcacgatcgaaacaaaaatggagaagaacaacagatacagtataatagtcccaacgtacaacgagcgtctcaacattgcactcatcgtttatctcatctttaaacatctccaggatgttgagttcgaaattatcgttgtggatgatgggagtcctgatggtactcaagaagttgtaaaacagttacagaaagtatatggcgaagatcgcattttgttaagacctagagcgaagaagcttggattaggcacggcttacattcatgggttgaagcatgcgtctgggaattttgttgtcatcatggatgctgatctatctcaccatccaaagtacttgccaagctttatcaagaagcagttggaaactggtgcgagcatagttactggaactcggtatgttaaagggggaggtgtacatgggtggaatctgatgcgcaagctaactagtaggggagctaatgttcttgctcaaacacttctgtggcctggtgtatctgatttgacaggatctttcaggctttataagaaatcagtgctcgaagatatcatcagttctgtggttagcaagggatatgtctttcaaatggagatgattgttcgggcgtccagaaaaggctaccaaattgaagaggttccaattaccttcgttgatagagtatttgggagttcaaagctaggaggttctgaaattgttgaatatttgaaaggccttgcatatcttctggttacaacatgagaagcaacgctgtttttatcaacatgatcggttttgtaacaccttgctcgcgcgcacttgcacacgatccttcttaattttgcaaagatttgttggcttgtttcctcatacagaaataggtttggattcaaagtagaattgttatcacattagctcttgttttttgggagttgtttgatttaaatatacacatatgctaacttttttgtcaatattcaagggaagaaattgccagtatttaacagatttattgcaagaaactcctttttttccttttagatttatgtatgttcctccgtggttgctaaaatctcgaccagctaccgtatttattcccaaaatccatgtcatggtcgtgggtattgaggctcatgctactttgaattgtgataggaaaaatg

SEQ ID NO: 5049 - DNA, 1338 bp, Fragaria vesca
agatttagattgaatttgagaaaaaaattgaagaatggagaagacgaagaacaagtacagtatcatagtcccaacctacaacgagcgcctcaacatcgccctcctcgtctacctcgtcttcaagcatctccgggatgttgactttgagataatcattgtagacgatggatcgcctgacgggactcagctggtggttcagcaattgcaggacctctacggtcaggatcgcatcctgttgagagctagaccgaggaagcttgggttgggaacggcttacattcatggattgaagcatgcctctggggattttgttgtgataatggatgcggatttgtcgcatcatccaaagtatttgccaagcttcatcaagaaacagttggagactaatgctagtatagttactggaacccgttatgttaaaggtgggggtgtacatgggtggaatcttatgcgcaaactaactagtaggggagccaatgtacttgcacagacgcttttatggcctggtgtatcagacttgacaggatctttcaggctttataaaaaatcagctcttgaagatatcattagttcatgtgtcagcaagggatatgtatttcagatggaaatgatagttcgggcttctagaaaaggctaccatattgaagaggttccaatcacttttgttgacagagtatatggaatttcaaagctcggtggttctgaaattgttgaatatctgaaaggccttgcatatcttcttgttacaacatgagatgcattactacacagttcactgccatcagcattcatactgagagcatttgtaaacgttttgagttacttctatcccgttgggttatgacttggatattgaaactcaattaaggccatcttaaatggttttcatagttatatatgagttgctagtgatagatctttgaaagtacacctcgtgctcctgtgctccattgttatagcgcatacaaaagagcaaatatgtcgatgatcttgctaattagaaccaagaacgtgaagaaatcccgggcttcagcaaacagctatttgattaccatcatcagtatcattagactccattgaaacaaaacacaacacaacacaaactgaagagatcttttgatgtagatgttagtgtaaacatgaaaagattcaagattgttgagttaaggaatttcgcaccacgaaaacagagcgatctccctctaaccagtatcgttcctgcggcgtcaagtaccccgccgtagtattgagcaatgtgtgatccagatcaagcaccaagtgaagcttcttgagtagcagcaactccttagttataagacccagtaagtaacccagcaa

SEQ ID NO: 5050 - DNA, 896 bp, Helianthus annuus
gtttgaaatcgagaattgaagtagaattagggttttggatggcagaagaagaagagaagaacaagtatagcataatcgtccctacttacaacgaacgactcaacatcgctctcattgtcttcctcgtcttcaagcacattccggatgttgactttgaaataataatcgttgatgatggaagtcccgatggaactcaagatatcgtcaaacagttgcagcaagtctatggcgatgatcgcattctattaagagctaggcccaaaaagctcggattagggactgcctacattcatggtctgaagcatgcttcgggaaattttgttgtaatcatggatgctgatctgtcacaccatccaaagtaccttccacactttataaagaaacaaatcgaaacgcgtgcggatattgttactgggacccgttatgtaaaaggtggtggtgtgcatggttggaccctgatgcgcaaattgacaagtagaggggctaatgttcttgcacatactcttctttggcctggtgtatcagacttgacgggctccttccgtctttacaagaaatctgtgcttgaagacattataagctcgtgtgtgagcaaaggatatgttttccagatggagatgattgtccgggcttcaagaaaaggataccatattgaagaggtcccgataacttttgttgaccgagtttatggaagttccaagcttggtggatcagaaatagtcgagtatttaaagggtcttgtgtaccttctcgttactacatagtatagtcgactttatggaagttctcgatatctaattgctttgatgcatgtgttcatttgccttgataagtcattataatagctttgttagtcacttattggaatataacatattttaatgcctttttttctt

SEQ ID NO: 5051 - DNA, 1218 bp, Cannabis sativa
ttccaaaaccattctgaggagccaattacacgccgtgatcgctcagccactgacccgccgtcgccgccaccaaacacgaccgccgcccgaagaggacaacaacaccatcaagcgaccaacacgatcacgatctgtgtgtgtgagagagagagcaagtggagattctagggttggatttcaatggagattggcgataatccaaaaaataaatacagcataattgtcccaacctacaacgagcgcctcaacattgccctcattgtctacctcatcttcaagcatcttagggatgtggactttgaagtgattgtcgtcgacgatggtagtcctgatggtactcaagaaatcgtcaagcaattgcagaaggtttatggcgaggaacgaattttgttaagaccgagaccaaagaagcttgggttagggacggcttatattcacggtctgaaacacgctaccggtaattttgttgtgattatggatgctgatttatctcaccatccaaagtatttgcctagcttcatcaagaaacaatcggagactggtgctagtatagttaccggaacccgttacgttaagggtggtggcgtccacggatggaccctaatgcgcaaactaacgagtcggggagcaaatgtccttgcacaaacacttctatggccaggtgtatccgatctaacaggatcttttcggctttatcgaaaatcggtgcttgaagatgttattagctcgtgtgttagcaagggatatgtgtttcaaatggagatgatagttcgggcttctaggaaaggctatcatattgaagaggtgccaattacattcgttgatagagtgtatggaacttcaaagcttggaggatctgaaatcgttgaatacctcaaaggacttgtctatcttcttttcactacatagaaaatcccttcattttaacctttttttttggatctttcactaaccagttgtgtttgaatttatattttggtaaaaggctttttcgagttgtatgaaagatttaactttttttagactatcaaaatgttagtattgatacgaatattaaatgaatatttaagatatacatgaagaaaaaattaaaataggaaatatgagtttcataagattgtgtgatttgtcattaattgaatggttgcatattaatcattgttaaatatattaaaactttttattgtaattaaaccatgaaacatttttctaagtaaa

SEQ ID NO: 5052 - DNA, 1160 bp, Cannabis sativa
aaccattctgaggagccaattacacgccgtgatcgctcagccactgacccgccgtcgccgccaccaaacacgaccgccgcccgaagaggacaacaacaccatcaagcgaccaacacgatcacgcattgagaagaacaatttgtggtttgcaaagtggactcactctcagtattgattagtaagtatctgtgtgtgtgagagagagagcaagtggagattctagggttggatttcaatggagattggcgataatccaaaaaataaatacagcataattgtcccaacctacaacgagcgcctcaacattgccctcattgtgtacctcattttcaagcatcttcgggatgtggactttgaagtgattgtcgtcgacgatggtagtcctgatggtactcaagaaatcgttaagcaattgcagaaggtttacggcgaggaacgaattttgttaagaccgagaccaaagaagcttggcttagggacggcttatattcacggtctgaaacacgctaccggtaattttgttgtgattatggatgctgatttatctcaccatccaaagtatttgcctagcttcatcaagaaacaatcggagactggtgctagtatagttaccggaacccgttacgttaagggtggtggcgtccacggatggaccctaatgcgcaaactaacgagtcggggagcaaatgtccttgcacaaacacttctatggccaggtgtatccgatctaacgggatcttttcggctttatcgaaaatcggtgcttgaagatgttattagctcgtgtgttagcaagggatatgtgtttcaaatggagatgatagttcgggcttctaggaaaggctatcatattgaagaggtgccaattacattcgttgatagagtgtatggaacttcaaagcttggaggatctgaaatcgttgaatacctcaaaggacttgtctatcttcttttcactacatagaaaatcccttcattttaacctttttttttggatctttcactaaccagttgtgtttgaatttatattttggtaaaaggctttttcgagttgtatgaaagatttaattttttttagactatcaaaatgatgttagtattgatacggatgaatatttaagataaacaaatgaatgaagaaaaaattaaaattggaaata

SEQ ID NO: 5053 - DNA, 872 bp, Cirsium arvense
caagtatagcataatcgttccaacttacaacgaacgactcaacatcgctcttatcgtcttcctcgtcttcaagcatattccggatgttgactttgaaataataatcgtggacgatggaagtcctgacggaactcaagacattgtaaaacagttgcagcaagtctatggtgaagatcgcattctattaagagcaaggcctaggaagcttggattagggactgcttacattcatggtctaaagcacgcttcaggaaattttgtcgtaatcatggatgccgatctatcacaccatccaaagtaccttccacaatttataaagaaacaaatggagacgggtgccagtattgttacgggaactcgatatgtaagaggtgggggcgtgcatggttggaccttgatgcggaaattgacaagtagaggggcgaatgtccttgcacatacgcttctttggcctggtgtatcagacttgacgggctcgtttcgtctttacaagaaatctgtgcttgaggacattataagttcttgtgtgagtaagggatatgttttccagatggagatgattgtccgagcgtcaagaaaaggataccatatcgaagaggttccgatcactttcgtagacagagtttatggaagttcgaagcttggtggatcggaaatagtggagtatctgaaaggtctcgtgtatcttcttgttactacatgaagaacaaacgaaggtaccaaccgaaagttggttcttatttctatttgacaagatgattcgattcgactgatagctcttgaccaaatagccatttttatatgagtaaaaactttctttttttatatatttattgtacttgatctggattttggctgctttttactgtaac

SEQ ID NO: 5054 - DNA, 888 bp, Tripterygium wilfordii
ctcatgtcaaaaggtgaattcttctaggaaaagaacgaacgggagatttcggcgtctctcgattagggaagaaagatcatggagcaagagaagagtgaagagaagattaagtacagtataatagtcccaacctataacgaacgcctcaatattgccctcctcgtttacctcatcttcaagcatctccgggaggtggattttgaagttattgttgtcgatgatggaagtcctgatggtacgcaagaagtagtaaaacaattgcaacaagtttatggagaagatcacatcctattaagacctagacctaggaagctcgggctaggaacggcttacatccatggtttgaagcacgtgtctggaaatttcgttgtgatcatggatgctgatttatcccaccatccaaagtacctgccaaatttcatcaagaaacagttagagactgatgctgatatagttactggaactcggtacgttaagggtggtggtgtacatggatggaatctcatgcgcaaattgacaagtagaggagccaatgttcttgcgcacacgcttttatggcctggtgtatctgatttaactggatcttttcggctttaccgaaagtcagtacttgaagatgtcatcagttcctgtgtcagtaaaggatacgtctttcaaatggagatgattgtcagggcttctaggaagggctaccatattgaagaggttccaattacctttgttgatagagtatttggaacttcgaagcttggaggatctgaaattgttgaatatctgaaaggactcttatatcttctggtcacaacctgaagatgcagcatttgtgaatgttacaccgtctctcgtagtgttataccctaatttttactaaattaggtttcaccatta

SEQ ID NO: 5055 - DNA, 1136 bp, Citrullus lanatus
gaaactactacgacttttgatcgtcggagtttttgtctattcagcgtgcatcgctgcgcccagaatctagagggagcaaatcgaaattgccgtcgatcacgttccagttgatttcgcgatcgttaatcatacgaattcctggttgaagagtagtctctaagcgtttacgtaatcgaattcatggcggagccggagaaggagaggaataagtacagtttaattgtcccaacctacaacgagcgcctcaatattgctcttctcgtctacctcattttcaagcacctcccggatgttgattttgaaataatagtcgttgatgatggaagtcctgatggtactcaagaagttgtgaaacagttgcaatgggtgtatggtgaagatcggatcctattgagagccagacctaggaagcttggattaggaacggcttactgtcatggtctcaagcatgcaactggtaattttgttgttataatggatgctgacttatctcaccatccaaaatatttacccagcttcattcagaaacagttacaaactggtgccgatatagttacaggaacccgatatgtgaaaggtggcggtgtacatggatggaatcttatgcgcaaactaacaagtagaggagctaatgttcttgcccaaacacttttatggcctggtgtatcagatttaactggatctttccggctctacaagaaatcagtgcttgaagatatcattagttcagttgttagcaagggatatgtcttccaaatggagatgattgttcgtgctacaagaaaaggttatcacattgaagaggttccaattacatttgttgatagattgtttggaacttccaagcttggaggatctgaaattgtagagtatttgaaaggtctgttgtaccttctggtcaccacatgatacatcaaacagtgaattgattgccaggtaaacttcttgtttgatcttcaaccctttgccaatttctctttaggtactcaccacccccaggctttttgtgtaaatttgagatgaatgcttaggaaatattttcacaattagtagttttcccgtaatttcccttcaaatcgcaactgggagcatagatggattatggtagcataatcatagctcaggcattggatttc

SEQ ID NO: 5056 - DNA, 907 bp, Antirrhinum majus
gaccaatggaagaaaaagagcagaagaagaacaagtacagcataatagttcctacgtacaacgaacgcctcaacattggcctcatcatttatctaatcttcaagcacttaacgaatgtaaattttgaaataatagtggtcgatgatggtagtccagatggaactcaggagatcgtcaaacagcttcagcaagtatatggggaagatcgtattttgttgagacccagggctaagaagcttggattaggaactgcttatatgcatggtttgaagcatgcgtcaggaaattttgtcgtgataatggatgctgatttatcgcaccatcccaaatacctgccaagctttatcaagaaacagatggagacaggtgcaagcatagttactggtactcgatatgttaaaggaggcggtgtgcatgggtggaatctgatgcgtaaattgacaagcagaggagcaaatgttctggcgcatacccttctctggcccggtgtatctgacttaactggatcatttcggctttacaagaaatctgtgcttgaagatgttataagctcatgtgtcagcaaggggtacgtcttccagatggagatgattgttagggcctcaagaaagggttatcacattgaagaggttccaatcacctttgtcgatagagtttatggaacctcaaagttagggggatcagaaatagttgagtatttgaagggacttctgtaccttctggttacaacctgaaatactgggatgatcacagtaatctctttgcattttgcttttcattagttaatggtcgcaatgttaattgcaacctagaaagaacattgcctgtttctcttagctgcattggttccataaacgtgccgtattaaacgaagaatacacttccttatggtgagctcttttagccg

SEQ ID NO: 5057 - DNA, 935 bp, Solanum melongena
agatcaaaacgatgggggagaagaacaagtacagtataattatacccacctacaatgaacgactcaatattgctctaatcgtctaccttgttttcaagcatctcacggatgttgattttgaaataatagtagtggatgatggaagtccagatggcacacaggatattgtcaaacaattgcagaaagtatatggagaagatcgtattttattgagacctcgacctcggaaacttggtctaggaactgcatatattcatggtttgaagcatgcctcaggaaattttgttgttattatggatgcggatctttctcaccatccaaaatacctgccaagatttatcaagaaacaaatggagacaggtgccaatatagttactggaactcgatatgtttctagtggtggtgtccacggatggagccttatgcgcaaattgacgagtaggggagcaaatgtccttgcacagacactactttggccgggtgtatcagacttaactggatcattccggctttaccagaagtctgcactagaagacatcataagctcttgtgtcagtaaaggatatgtttttcagatggagatgattgttcgggcttcaagaaaaggttaccacattgaagaggttccaattactttcgttgatagagtatttggaagctccaagctgggaggatctgaaatagtggagtatctaaaaggccttctgtatcttctggttacaacttgatatggataacaagctgcatgaccagagaatccaaagatttacattgtttagcaacctgtgacattctgaagacttgaactaggaccacataacaaattcttttttgcttcagcttatgtgaccaaaattttgaatgaatgaactattatgtattggaaatagtgttactgaagtaattttcaatgcaactttggcttattttgtgcg

SEQ ID NO: 5058 - DNA, 1036 bp, Tropaeolum majus
gaagaagagtctgcatgaattggatctgtactcaaagtctgaaatcgaagttgatcgaagaaagcttcaacgatttcaatcaattaagaatcatagacttagggtttttgattcatggaggaaaataaagagaggaacaagtacagtataatagttcctacttacaatgagcgtctcaatatcgcccttatcgtctacctcattttcaaacacctgagggattttgattttgagataattgttgtggatgatgggagtcctgatggtacacaagaaattgtaatgcaactacagaaattgtatggggaagaacgtattctgttaagacctagagctaaaaagcttggattaggaacggcttatatacatggtttgaagcatgcatctggtaattttgttgtaatcatggatgctgacctttcacaccatccaaagtacttgccaagcttcatcatgaaacaggcagagactggtgcaagtatagtgactggaacccggtatgttcaaggtgggggtgtacatggatggaatcttatgcggaaactaacaagtagaggagccaatgttctcgcacagacacttttatggcctggtgtatcagatttaactggatcattccgactttacaagaaatcagtgcttgaagatatcatcagctcctgtgtgagtaagggatatgtctttcagatggagatgattgtccgagcatccagaaaaggttatcatatagaagaggttccaattacattcgttgatagagtatttggaagttcaaagcttggaggatcagaaattgtagaatatctaaaaggtcttgcatatcttatggtcacaacataagatctagaggaatacatcttaactttgttcaaccatatctgattttaaggattttgtttttgtcaactaagtctaactatatatacatttgcatagaggaaaaagggaaatgttccttataattgctcattcgtgcatactttacgttgataaccttactcttcccactttacctataatatcatcaaatattttt

SEQ ID NO: 5059 - DNA, 1054 bp, Triphysaria pusilla
gaaacacaaaattaaatatcaaaatctagggttttaattggtgtttgatcggaattcaatggaagcgaaagaggataagaacaaatatagcataattgttcccacctacaatgaacgcctcaacatcgctctcatcgtttacctcattttcaagcatctccggaatgtcgattttgaaataataatagttgatgatgggagtccagatgggactcaggagatcgttaaacagctgcagcaagtatatggggaagatcgtattttgttgagaccaaggcctaagaagcttggcttggggacggcttacatacatgggctgaagcatgtgagtggaagttttgttgtgataatggatgctgatttgtcgcaccatccaaaatacctaccaagctttatcaaaaaacagaaagacacaggtgcaagcatagttactggaacccgatatgttaaagatggaggggtacatgggtggaatcttatgcgtaaactgacaagcagaggagcaaatgtccttgcacagacacttctctggccaggtgtatcggacttaactggatcattcaggctttacaagaaatcggtgcttgaagatgtcataagctcgtgtgtgagtaagggatatgttttccagatggaaatgatagttagagcctcaagaaagggttatcgtattgaagaggttccaatcacttttgtcgatagagtatacggaagctcaaaactgggaggatctgaaatcgtggagtatctcaagggacttttgtaccttctggttacgacttaaagatcgagtatccatgtggtcgattgtgatagcctctacacactttgtcaagtttttttttttcacttttaaaattatatatcagaagttcaaatgtgtacctaacctattcactaatctgaaatagaaacaaaacagttcaacatgctgttcttgctttgtcttcttgttacatcaactcaaaggctcccttgtaaactgacaatgtgattattgtttttccatcaaatatattgacactgattgttggtaaaaaaaaaaaaaaaaaaa

SEQ ID NO: 5060 - DNA, 830 bp, Lotus japonicus
ggagaggatccatattcacggtttgcagttccattgcagattagcttcagatccaccgtcgtagccgtcgaagtccgattgcgttgaaggccaggattggattagaatggatgagcagcatcagaaggataaagacaagtacagtataattgttcctacatataatgagcgcctcaacattggtcttattgtttacctcctcttcaagcatcttagggatgttgattttgaaattattgttgtggatgatgggagcccggatggtactcaggatgttgtaaaacaactgcagaaggtgtatggagaagatcggattctgctaagagcaagacctaggaaactgggtttaggaacggcttatattcatggcatgaagcatgcatctggaaattttgttgtcattatggatgctgatctgtcacaccatccaaaatacttgccaagcttcattagaaagcagaaggaaactggtgctgatatagttacaggaactcgttatgttaaaggtggcggtgtgcatggatggactcttatgcgcaaattaacaagtaggggggcaaatgttcttgcacaaacacttctatggcctggtgtctcagatttgacgggatcttttagactttataggaaatcagctcttgaagatatcattagtcgttgtgttaccaagggatatgtctttcaaatggagatgatagtacgagcatccagaaaaggtaccatattgaagagttccaatcacgtttgttgatagagtatatggaagtcaagcttgtggatcagagattgtcatacctgaaagcgtagtatatcttttggtgacacataaa

SEQ ID NO: 5061 - DNA, 889 bp, Flaveria ramosissima
atctgcaaatggcgaataagaacaagtatagcataatcgtccctacttacaacgaacgtctcaacatcgctctcatcgtcttcctcgtcttcaagcatatgccggatgttgactttgaaataataatcgtggatgatggtagtcctgatggaactcaagatattgtcaaacagttacagagagtctatggagatgaccggattctactaagagctagacccaggaagctcggtttaggtactgcttacattcatggtctaaagcatgcttcaggaaattttattgtaatcatggatgctgatctgtcacaccatccgaaatacctgccacactttataaagaaacaaatggaaacgggtgctgatattgttactgggacccgttatgtaagaggtgggggtgttcatggttggaccctaatgcgcaaattgacaagtagaggagcgaatgttcttgcccatacacttctttggcctggtgtatcagatttgactggctcgtttcgtctttacaaaaagtccgtgcttgaagacattataagctcttgtgtgagcaaaggatatgttttccaaatggagatgattgtccgagcttcaagaaaaggataccatatcgaagaggttccaataacctttgttgaccgggtttatggaagctccaagcttggcggatcagaaatagtcgagtatttgaagggtcttgtataccttcttttcaccacgtaaatataagattaatttcatatatatcattctaagagttcagaatttcatacatatctttctaaacttcacaatctcatattaatcgttcaaaacactcaaaatatcatattcttctgtttcatagtaaatcaaagaaaacaacattttgaccataaatcatcttt

SEQ ID NO: 5062 - DNA, 942 bp, Humulus lupulus
gaaaaagagaaaagaagataaccaggtcgggtcgggacgaccccttccccgctcgcccgctttgtaccccggttaaaccggatcggagtcgccccgctcgaccggtatttttttgccatctcttggcggctttcgtgcgcagagaacatagaactggaagttgaagaagccgcagagagaaactgagattctagggtttggtttcaatggaggttggtgatacgccaaaaaataaatacagcataattgtcccaacctacaacgagcgcctcaacatcgccctcatcgtctacctcatcttcaagcatcttcgggatgtggactttgaagtgatcgtcgtcgacgatgggagcccagatggtactcaagaaattgttaagcaattacagaaggtttatggtgaggatcgaattttgttaagaccgagaccgaagaagctcgggttagggaccgcttatattcacggtctgaaacatgccactggtaattttgttgtaattatggatgctgatttatctcaccatccaaagtatttgcccagcatcatcaagaaacaattggagactggtgctagtatagttactggaacccgttatgttaaaggtgggggtgtccatggatggaccctcatgcgcaaactaacaagccggggagcaaatgtccttgcacaaacacttctatggcctggtgtatctgatttgacgggatcttttcggctttatcgaaaatcagtgcttgaagatgttattagctcatgtgttagcaagggatatgtctttcagatggagatgatagttcgggcttctagaaaaggctaccatattgaagaggtaccaattacattcgttgatagagtatatggaacttcaaagcttggagggtctgaaatagttgaatatctcaaaggtcttgtgtatcttctgtgtactacataaaaatgca

SEQ ID NO: 5063 - DNA, 1050 bp, Lippia dulcis
ggaatcactttgggagaatttctagggtttttgatcgatcaggaatccaatggaagctaaagatgagaaggacaagtacagtataattattcccacctacaatgaacgcctcaacatcgctctcatcgtttaccttattttcaagcatctttcgaatgtaaattttgaaataatagtagtggacgacgggagtccagatggaactcaggatattgtcaaacaactacagcaagtatatggcgaagatcgtattttgctgagacctagagctaagaagcttggcttagggacggcttacatccatggcctgaagcatgcgactggaaattttgtcgtgataatggatgcagatttatctcaccatccgaagtaccttccaagctttatcaagaaacagatggagacaggtgcaagcatagttactggaactcgttatgttaaaggtggtggggtccatgggtggaatctgatgcgtaaattgacgagcagaggtgcaaatgttctcgcacacacacttctctggccaggagtatcagacttaactggatcattccggctttacaagaaatctgtgcttgaagatgttataagctcgtgcgtcagtaaaggttatgttttccaaatggagatgatagttagagcctcaagaaagggttaccacattgaagaggtaccaattacttttgtcgatcgtgtatacgggagctcgaagctgggaggatccgaaatagtagagtatctgaagggactattgtatcttctggttacaacttaaaagagttccagagcttcttttgatcatagaaagttacagataaacccatttcttcaaactaactaagaaacaaaacaaattggattctgctggtgatttttcatctctgtatcagttcgtagatttcatcggttttatttatatgtaataaaacttttacaccaaaaggacagttggtccggcaggatgaagtgctagattcgttaagcaacttacaatgttcaaattctgcacttatggatggagtaattgagttggggattggttccttccta

SEQ ID NO: 5064 - DNA, 950 bp, Valeriana officinalis
tcagatcccgacgacctacctagatttgagaaattagggtattgatccgatgggcgaagaggaagcggagaaaaacaagtacagcataataatccccacttacaacgaacgtctcaacatcgctctcatcgtttatctcctcttcaagcatcttaaccaggatgttgactttgaaattatagttgtggatgacggaagtcctgatggaactcaagatataatcaaacagttgcagcgggtttatggtgaaaatcgcattctattaagagcaagaccgaggaagcttggattaggcactgcttacattcatggtttgaagcatgcatctggaaattttgtggttataatggatgctgatttgtcacaccatcccaagtacctgccgagcttcatcaagaaacagatggagacgaatgcaagtattgtaacaggaacgcgttatgtaaaaggaggtggagtccatggttggaatctgatgcgcaaattgacaagtagaggagcaaatgtgcttgcacatacacttctttggcctggtgtttctgacctaactggatctttccggctgtataagaagagtgtgcttgaagacgtaataagttgttgtgttagcaagggatatgtgtttcagatggagatgattgttcgtgcttcaagaaaaggctacaatattgaagaggttccgattacctttgttgacagagtgtatggaagttcaaagttgggaggatcagaaatagtggagtatttgaaaggcctcgtctatcttctacttactacttgaaattcatcttcattatagattctttaagctgactctaaatgtactttgttctagttgaaaaaactacagacgactgctgcccttttataataatcattcatcatgtctagctaattactttttcttatcaaacttgtaccaaactatcgattgttataaatgggagatg

SEQ ID NO: 5065 - DNA, 1222 bp, Mimulus guttatus
gtgattggagggtggagtttgccaattctaaaatttcatggtgcaaattgctaatcgctgtcattgttggggtgcaaaacgcaattcacccatttcttcactatacaattctattcagctgattaattattaattaaataattcaggagcagcaattgaaggagcatttctagggctttaatggcgtcgatcagcaattcaatggaagcgaaagaggacgacgacaacaacaaatacagcataattgtgcccacctacaatgaacgcctcaacatcgctctcatcgtttacctcattttcaagcatctccagaatgtaaattttgaaataatagtagtggatgatgggagtccagatggaactcaggagattgtcaaacagctacagcaagtatacggggaagatcgtattttgttgagacccagagcgaagaagcttggcttgggaacggcttacatacatggtctgaagcatgcgactggaaattttgttgtgataatggatgctgatttatctcaccatccgaaatacctgccaagctttatcaagaaacagatagagacaggtgcaagcatagttactggaactcgatatgttagtggtggtggggtccacgggtggaatttgatgcgtaaattaacgagcagaggagcgaatgttcttgcacaaacacttctctggccaggtgtatcagacttaactggatcattcaggctgtacaaaaaatctgtgcttgaagatgttataagctcgtgtgtgagtaagggatatgttttccagatggagatgattgttcgagcctctagaaagggttaccacattgaagaggttccaattacttttgtcgatagagtatacggaagctcaaaacttggaggatcggaaattgtggagtatctcaagggacttttgtaccttcttgttacaacttaaaacggaacagaattgatcgattgtgataatcaactctttgcattttacagagctttctcgattataggagtacgaattttgcagagcttttttgtgactatacaagtttaaatgaacagataatttatactctccaatatgaatccagcttttgtgtgtgttttatcttcttctgctacagtttttagataatttatgttgttcgaaagtgttcttgcaaattgtcgtctgattacatggcaaagtttttacatcacatatgtaatatgtttaaagatcatacattgtg

SEQ ID NO: 5066 - DNA, 1003 bp, Solanum tuberosum
atcaggcagaggacgagacagaacgcagaaaattttgagatcaaaaaatgggggagaagaacaagtacagtataattatacctacctacaatgaacgcctcaatattgctctcatcatctacctcgtcttcaagcatctcacggatgttgatttcgaaataatagtagtggatgatggaagtccagatggcacacaggatattgtcaaacaattgcagaaagtatatggagaagatcgtattttattgagacctcgacctcggaaacttggtctaggcactgcatatattcatggtttgaagcatgcctcaggcaattttgttgttattatggatgcggatctttctcaccatccaaaatacctgccaagatttatcaagaaacaaatggagacaggtgccaatatagttactggaactcgatatgtttctagtggtggtgtccacggatggaaccttatgcgcaaattgacaagtaggggagccaatgtccttgcacagacactactttggccaggtgtatcagacttaactggatccttccggctgtaccagaagtctgcactagaagacatcataagctcttgtgtcagtaaaggatatgtttttcagatggagatgattgttagggcttcaagaaaaggttaccggattgaagaggttccaattactttcgttgatagagtatttggaagttctaagcttggaggatctgaaatagtggagtatctaaagggccttctgtatcttctggttacaacttgatatggataacaagctgcatgaccagagaatccaaagacgcgtgttgtttagcaacctgtgacattctgaagacttgaactaggcccatataacaaattcttttttcgttttgcttcagcttatgtaaccaaaattttgatgaatgagctattatgtattggaaatagtgttactggagtaattttcaatgctactttggtttattttgtggatgatgctttccattattggctaataca

SEQ ID NO: 5067 - DNA, 1035 bp, Solanum phureja
aattttgagatcaaaaaatgggggagaagaacaagtacagtataattatacctacctacaatgaacgcctcaatattgctctcatcatctacctcgtcttcaagcatctcacggatgttgatttcgaaataatagtagtggatgatggaagtccagatggcacacaggatattgtcaaacaattgcagaaagtatatggagaagatcgtattttattgagacctcgacctcggaaacttggtctaggcactgcatatattcatggtttgaagcatgcctcaggcaattttgttgttattatggatgcggatctttctcaccatccaaaatacctgccaagatttatcaagaaacaaatggagacaggtgccaatatagttactggaactcgatatgtttctagtggtggtgtccacggatggaaccttatgcgcaaattgacaagtaggggagccaatgtccttgcacagacactactttggccgggtgtatcagacttaactggatccttccggctgtaccagaagtctgcactagaagacatcataagctcttgtgtcagtaaaggatatgtttttcagatggagatgattgttagggcttcaagaaaaggttaccggattgaagaggttccaattactttcgttgatagagtatttggaagttccaagctgggaggatctgaaatagtggagtatctaaagggccttctgtatcttctggttacaacttgatatggataacaagctgcatgaccagagaatccgaagacttgagttgtttagcaacctgtgacattctgaagacttgaactaggaccatataacaaattcttttttctatttgcttcagcttatgtaaccaaaattttgatgaatgagctattatgtattggaaatagtgttactggagtaattttcaatgctactttggtttattttgtggatgatgccttccattattggctaatacacttgtgcaagttatctgtgattttaacttgcattttccagcttatataaatgtctacttctg

SEQ ID NO: 5068 - DNA, 1146 bp, Amsonia hubrichtii
gttgttgatagggagaaggggggagaattggggtgaccgaggaacacggagccgggccagcctgtatcatcttcttccccttctcgccctttgctttgaaccttatgggtagtttgacgggttttttcctttttggatgcagatcggaaatggcagaagatcaaaaagaagaacaagtatagcataatcatccccacctacaacgagcgcctcaatattgctctcatcgtttatctcgtcttcaagcatctctcagatgttgattttgagatcattgttgtcgatgatggaagtccggatggaactcaagatattgtaaaacaattgcaacaggtgtatggagaggatcgcatactgttgagggctagaccgaagaagcttggtttagggacggcttacattcatggtctgaagcatgcctcaggcaattttgttgttatcatggatgccgatctatctcaccatccaaagtacctaccaagctttatcaagaaacagatagagacaggagcagatatagttactggaactcgatatgtaaaaggtggtggtgtgcatgggtggaacctaatgcgtaaattgacaagcaggggagcaaacgtccttgctcagacgcttctctggcctggtgtatcagacctaaccggatctttccgcctttataggaaaactgtccttgaagatgtcatcagttcggttgtcagtaaaggctatgtttttcagatggagatgattgttcgtgctacaagaaaaggtttgcacattcaagaggttccaattacatttgtggatcgagtatatggaacgtcaaagttgggaggatctgaaatagtggaatacctcaagggtctcctttaccttcttgtcacaacttagatggcgtgaccacgcttcataatcattttgggaagcagccatttttgctcggtttagaagctaaggtgatgcaaattatatactcctggaatgacaaggaaacaaaaacacatcagttttggcttttatttgatttcacttgtaccaatgaccggaatctgttcgggcaatagcacatatcaaatcactgctttttatatgtaggccaaagctagaactggttttgactaattcgacaaggattgtacctgtacattaattaatcggtta

SEQ ID NO: 5069 - DNA, 919 bp, Euphorbia peplus
aaaggtgaaagctttttctggatcaagcaatcaaaacagagctgtagcaaattagggatttagaaattgaaaatagagatcatggaggaggagaagaaactgataaatcccactgacaaatacagcatcataattcctacttataacgagcgactcaacattgcactcatcgtctacctcatctttaagcatctcagggatgttgacttcgaaattattgttgtggatgatgggagtcctgatggtactcaggaaattgtgaagcagttgcagcaagtttatggtgaagatcgcattttgttaagacctagaccaagaaagcttggcttaggtacggcttatgttcatggcctgaagcatgcatcgggaaattttgttgtcataatggatgctgatctatctcaccatccaaaatacttgccaagctttatcaaaaagcaaaaagagactaatgcaagtatagtaactggaacacggtatgtgaaaggaggtggtgtacatgggtggaatctcatgcggaagttaacaagtaggggagcaaatgttcttgcacacacacttttgtggcccggtgtatccgacttgacaggatctttccggctttacaagaaatctgcgcttgaagatataataagctctgttgttagtaaaggatacgttttccaaatggagatgattgttcgagcttccagaaaaggctaccatatcgaggaggtgccaattacgtttgttgatagagtgtttggaagttcaaaacttggaggatccgaaatcgttgaatatctcaaaggtctcttgtatcttctggttacaacataaaacatgaccgagctggatttgaaccagcatagacatattgccaacaaatctacagtccgtccccattaacccctcgggcatcgacccaaatattgtatac

SEQ ID NO: 5070 - DNA, 1036 bp, Solanum lycopersicum
aattttgagatcaacaaaatgggggagaagaacaagtacagtataattatacctacctacaatgaacgtctcaatattgctctcatcatctacctcgtcttcaagcatctcacggatgttgattttgaaataatagtagtggatgatggaagtccagatggcacacaggatattgtcaaacaattgcagaaagtatatggagaagatcgtattttattaagacctcgacctcggaaacttggtctaggcactgcgtatattcatggtttgaagcatgcctcaggcaattttgttgttattatggatgcggatctttctcaccatccaaaatacctgccaagatttatcaagaaacaaatggagacaggtgccaatatagttactggaactcgatatgtttctagtggtggtgtccacggatggaaccttatgcgcaaattgacgagcaggggagccaatgtccttgcacagacactactttggccgggtgtatcagacttaactggatccttccggctgtaccagaagtctgcactagaagacatcataagctcttgtgtcagtaaaggatatgtttttcagatggagatgattgttagggcttcaagaaaaggttaccgcattgaagaggttccaattactttcgttgatagagtatttggaagttctaagcttggaggatctgaaatagtggagtatctaaagggccttctgtatcttctggttacaacttgatatgtttaacaagctgcatgaccagagaatctgaagacttgagttgtttagcaacctgtgacattctgaagacttgaactaggaccatataacaaattctttttctttttgcttcagctgatgtaaccaaaattttgatgaatgagctattatgtattggaaagagtgttgctgaagtaatttccaatgctactttggtttattttgtggatgatgctttccatttttggataatacacttgttcaagttatctgtgaatattaacttgcattttccagcttatataaatgtctacttctg

SEQ ID NO: 5071 - DNA, 801 bp, Flaveria ramosissima
gtatagcataatcgtccctacttacaacgaacgtctcaacatcgctctcatcgtcttcctcgtcttcaagcatttaccagatgttgactttgaaataataatcgtggatgatggtagtcctgatggaactcaagatattgttaaacagttacagagggtctatggagatgaccggattctactaagagctagacccaggaagcttggattaggtactgcttacattcatggtctaaagcatgcttcaggaaattttgttgtaatcatggatgctgatttgtcacaccatccgaagtacctcccacactttataaagaaacaaatggaaacgggtgctgatatagttactgggacccgttatgtaagaggtgggggtgttcatggttggaccctaatgcgcaaattgacaagtagaggggcgaacgttcttgcacatacacttctttggcctggcgtatcagatttaacaggctcatttcgtctttacaaaaagtccgtgcttgaagacattataagctcttgtgtgagcaaaggatatgttttccaaatggagatgattgtccgagcttcaagaaaaggataccatattgaagaggttccaataacctttgtcgaccgggtttatggaagctccaagcttggcggatcagaaatagtcgagtatttgaagggtcttgtataccttcttttcaccacgtaaacataggattaatttcatatataatcattctaagagttctaaaatttctatacatatctttctaaacttcacaattctcacattaatcgttacaaaacact

SEQ ID NO: 5072 - DNA, 1022 bp, Malus domestica
aataacttttccttcctgttttcccttacggcgatgcggctgagatcgaattgaaaatcggcgaacgagaaattgagcgaaaaatggagacgaagaacaagtacagcatcatagtcccgacctacaacgagcgcctcaacatcgccctcctcgtctacctcgtcttcaagcatctccgggatgttgactttgagataatcgtcgttgacgatggaagccccgacggcactcaggagattgttgaacagttgcagcaagtctacggtcacgatcgcatcctgttgagagctagagctaagaagcttgggttaggaacggcttatattcatggtttgaagcatgcttccgggaactttgttgtgatcatggacgcagatttatcacatcacccaaagtatttgccaagcttcatcaagaaacagctggaaactggtgcaagtatagttactggaactcgttatgtcagaggtggcggggtccatgggtggaatcttatgcgcaaactaacaagtagaggagccaatgttcttgcacaaacactactatggcctggtgtatcagatttgactggatcatttcggctttacaggaaaacagtgcttgaagatatcattagttcctgtgtcagcaagggctacgtctttcagatggagatgatagttcgtgcttctagaaaaggataccatatcgaagaggttccaatcagttttgttgacagggtatatggaatttcaaagctcggaggatctgaaattgtcgaatatctgaaaggcctcgtctatcttctcgttacaacatgagatgcataaattacggctcgtattcacctttttatccgcttttgcacccaacatgtaaacgtttaaagttacatttagcttttttttcataaattctaactgatttagaaccattttgaaccgagggaaccataggaaccatataaacttgttcatatatgttcgtttgtttgtactttgtggttgcttcttgtaaatgctcgagaagtagacccgtcgcaa

SEQ ID NO: 5073 - DNA, 909 bp, Malus domestica
cgaattccgttgctgtcgtgttttcccttacggcgatgcggctgagatcgaattgaaaatcggcgaacgagaaattgagcgaaaaatggagacgaagaacaagtacagcatcatagtcccgacctacaacgagcgcctcaacatcgccctcctcgtctacctcgtcttcaagcatctccgggatgttgactttgagataatcgtcgttgacgatggaagccccgacggcactcaggagattgttgaacagttgcagcaagtctacggtcacgatcgcatcctgttgagagctagagctaagaagcttgggttaggaacggcttatattcatggtttgaagcatgcttccgggaactttgttgtgatcatggacgcagatttatcacatcacccaaagtatttgccaagcttcatcaagaaacagctggaaactggtgcaagtatagttactggaactcgttatgtcagaggtggcggggtccatgggtggaatcttatgcgcaaactaacaagtagaggagccaatgttcttgcacaaacactactatggcctggtgtatcagatttgactggatcatttcggctttacaggaaaacagtgcttgaagatatcattagttcctgtgtcagcaagggctacgtctttcagatggagatgatagttcgtgcttctagaaaaggataccatatcgaagaggttccaatcagttttgttgacagggtatatggaatttcaaagctcggaggatctgaaattgtcgaatatctgaaaggcctcgtctatcttctcgttacaacatgagatgcataaattacggctcgtattcacctttttatccgcttttgcacccaacatgtaaacgtttaaagttacatttagcttttttttcataaattctaactgattta

SEQ ID NO: 5074 - DNA, 960 bp, Capsicum annuum
gcacgaggacataagtacagtataataataccaacctacaatgaacgtctcaatattgctctcatcatttacctcgtcttcaaacatctctcggatgttgatttcgaaataatagtagtggatgatggcagtccagacggcacgcaggatattgtcaaacaattgcagaaagtatatggagaagatcgtattttattaagacctcgacctcggaaacttggtctaggcactgcatatattcatggtttgaagcatgcctcgggcaattttgttgttattatggatgctgatctttctcaccatccaaaatacctgccaagatttatcaagaaacaaatggagacaggtgccaatatagttactggaacccgatatgtttctagtggtggtgtccacggatggaacctgatgcgcaaattgacaagtaggggagcaaatgtccttgcacagacactactttggccgggtgtatcagacttaactggatccttccggctttaccagaagtctgcactagaagacatcataagctcttgtgttagtaaagggtatgtttttcagatggaaatgattgttcgggcgtcaagaaaaggttaccacattgaagaggttccaattacttttgtcgatagagtatttggaagttccaagctgggaggatctgaaatagtggagtatctgaagggccttctgtatcttctggttacaacttgatatggatagtccgcagatttacattgcttagcaacctgtgacattctgaagacttaaactaggaccatataaaaaattcttttttctttatgaccacaattttgatgaatgagctattatgtattggaaactggaaagagtgttactgaagtaattttcgaagctctctgttatccattgatttcaacatctgtgaattaacttgcgttttccagcttctataaatatctgcctcttgttgaatta

SEQ ID NO: 5075 - DNA, 1012 bp, Tragopogon dubius
gcggggagacgacaacccactaataccaaacgggtcctgttaggttacgttttcgggtctcctgatcaccgttagtaaacctcgatttgtatttcaaacttcaaattaagacttggagttttagggtttttgatctgcaaatggcggaacagcagaagaacaagtatagtattatagtaccaacttacaacgaacgactcaacatcgctctcatcgtctacctcgtcttcaagcatattccggacattaactttgaaataataattgtggacgatggtagtcctgatggaactcaagatattgtgaagcagttgcagaaagtctatggtgatgatcgcattctattaagacctaggcccaggaagctcggattagggactgcatacattcatggtctgaaacatgcttccggaaattttgtcataatcatggatgctgatctgtcacaccatccaaagtatcttccacagtttataaagaaacagatagaaacaggtgcgagtattgttactgggactcggtatgtaagcggtggtggtgtgcatggttggactctgatgcgtaaattgacaagtaggggcgcgaatgtacttgcacatacgcttctttggcctggtgtatcggacttgacagggtcatttcgtctttataaaaaatcggtgcttgaagacattataagctcttgtgtgagcaaagggtatgttttccaaatggagatgattgttcgtgcatcaagaaaaggttatcatatcgaagaggttccgatcacatttgttgatagagtttatggaagttcaaagcttggtggatccgaaatagtggagtatttgaagggcctcgtgtatcttctccttacaacataaaaaacaaaaacgtgtgatacgaaaatagtcattttatctataacatttttatgagaaacaaattctttttatacaacgtatgtgtacttgagggtatatttgtcaattttgtgcattgcacatgagggtatatttatcaatttacttac

SEQ ID NO: 5076 - DNA, 1319 bp, Ambrosia trifida
ggggacgggatgggtattcggccttgtatgctcatccctaccctaccctacccaacccctacccgttcccgttcggctttcctaccgtggtaattaacattgatggcaggtaccctgtttgaatgttgacttccaagtttagggaaatacagcgcatcccgtgaacaccaaacgatttatttaaaacattaatcgatttagggttttggatctggaaatggagaataagaacaagtataataagtatagcataatcatcccaacttacaacgaacgtctcaacatcgctctcatcgtcttcctcgtcttcaagcatataccggatgttgactttgaaataatagtcgtggatgatggtagtcctgatggaactcaagatattgtcaaacagttgcagcaagtctatggagatgaccgaattttattaagagctagacccaagaagcttggattagggactgcttacattcatggtctgaagcatgcttcaggaaattttgttgtaatcatggatgctgatctctcacaccatccaaagtacctcccacactttataaagaaacaagtggaaacgggtgctgatattgttactgggacacggtatgtacgaggtgggggtgttcatggctggaccctgatgcgcaaattgacaagtaggggggcgaacgttcttgcgcatacacttctttggcccggtgtatcagatttgacgggctcgttccgtctttacaaaaaatctgtgcttgaagacattataagctcttgtgtgagcaaaggctatgtttttcaaatggagatgattgtccgagcttcaagaaaaggatatcatatcaaagaggttccaataacctttgttgaccgagtttatggaagttccaagctaggcggatcagaaatagtcgagtatttgaagggtctcgtttaccttctgttcaccacgtaaacaagaaagaaataatttcatatatatctttccaaaagttataactttcaggcatgttcttctagatttcataacctcatatttacccgttcaaaacactcaaaatatcatatttatccatctcatagtgaataaaataaaaatcagttactttatctatcctgtgcagtggggtgttatgagtagagttaccgattttgttttattaactatgatgcggcgataaatggtatatttttagtgtttttgagcgtgtaagtatgttatgaaattttatagatatatatgaaatatcgaactttttaatgcatatacatatgaatttccctacaaaacaacatatgctagatattattcaaacattttaatctcacag

SEQ ID NO: 5077 - DNA, 871 bp, Ipomoea nil
gaatcgtatgatcgcaaaaaaatggagaagaagaccaagttcagtataattgttccaacctacaatgaacgcctcaacatcgccctcatcgtttaccttgttttcaaacatctccaggatgttgattttgaagttatagttgtggatgatggaagtcctgatgggactcaagatattgtcaaacaattgcagcgggtgtacggagaagatcgcattcttttgaggcctcgacctgcaaaacttggtttaggtactgcatatattcatggtttgaagtatgtttctggagattttgttgtcattatggatgcagatctatcccaccatccaaaatacctgccaagatttataaagaaacaaatggagacaggtgcagatattgtcactgggactcgctatgttaagggtggtggtgtccatggatggaatctcatgcgcaaattgacaagtagaggagcaaacgtccttgcacagacacttctttggccgggtgtatcagacttaactggatcatttcggctttaccggaaatcagtgcttgaagacattataagttcatgtgtgagtaaaggctatgtttttcaaatggagatgatagtccgtgcttccaggaaacgttatcacattgaagaggttcctattacttttgttgatcgagtatttggcagttccaagctgggaggatcagaaatagttgagtatcttaagggccttgtttatcttttgtttacaacttgataccacacaagtcagatagaattttcagtctgaccacatctgatataactttgagagttgacagtttcaactagtttgaaatgtctcataggaaaattgttgttgggattttcaactgatatttgagtaattt

SEQ ID NO: 5078 - DNA, 1433 bp, Ambrosia trifida
actttcctaccgtcgtaattaacattagctagctacctgtttgaatcttgacttccaagttgaggcagcgcaaccagtcaacaccaaacgggttacgtttcggttatttaaaaggaaactttaatcgatcgatcgatcgataattgaagatttagggttttggatctgcaaatggagaataagaacaagtataccatcatcatcccaacttacaacgaacgtctcaacatcgctctcatcgtcttcctcgtcttcaaacatatcccggatgttgactttgaaataatagtcgtggatgatggtagtcctgatggaactcaagatattgtcaaacagttgcagcaagtctatggagatgaccgcattctattaagagctagacccaagaagcttggattagggactgcttacattcatggtctgaagcatgcttcaggaaattttgttgtaatcatggatgctgatctctcacaccatccaaagtacctcccacactttataaagaaacaagtggaaacgggtgctgatattgttactgggacacggtatgtaagaggtggcggtgttcatggctggaccctgatgcgcaaattgacaagtaggggggcgaacgttcttgcgcatacacttctttggcctggtgtatcagatttgacgggctcgttccgtctttacaaaaaatctgtgcttgaagacattataagctcttgtgtgagcaaaggctatgtttttcaaatggagatgattgtccgagcttcaagaaaaggatatcatatcgaagaggttccaataacctttgttgaccgagtttatggaagctccaagctaggcggatcagaaatagttgagtatctgaagggtctcgtttaccttcttttcaccacgtaaacaatatggaaataatttcatatatatctttccaaaagttaaaactttcagacatatacttctagatttcataacctcatacttaaccgttcaaaacactcaaaatatcatatttatccatctgatagtaaacaaaataaaatcagttactttatttaccctgtgcaatggggtgttatgagtagagtaactgattttgttttattaactatgatgatgatgatatggataactggtatatttttagtgtctttgagcgtgtaagtatgctgtttatgaaattttgttagatatatatgaaataccgaactttttaatgcatatacatatgaattcccctcaaaacaagattcgctagatgtcgttcaacactttaatctccacaggaagatgacttgatacatggcttgtgctttcgtaactgtgcaaatagccgttttatggcgtttactttgagaacagttttgttccatacttgaatttggcttcttttactgtgagcaacaattcttttatttttttataacgattgctacaaaaaagaa

SEQ ID NO: 5079 - DNA, 746 bp, Arnica chamissonis
gtatagcataatcgtcccaacttacaacgaacgactcaacatcgctctcatcgtcttcctcgtcttcaagcatataccggatgttgactttgaaataataatcgtggatgatggtagtcctgatggaactcaagatattgtcaaacagttgcagcaagtctatggagatgaccgcattctactaagagctagacccaggaagcttggattagggactgcttacattcatggtctgaagcatgcttcgggaaattttgttgtaatcatggatgctgatctgtcgcaccatccaaagtatctcccacactttataaagaaacaaatggaaatgggtgctgatattgttactgggacccgttatgtaagaggtgggggtgttcatggttggaccctgatgcgcaaattgacaagtagaggggcgaatgttcttgcacatacacttctttggcccggtgtatcagatttgacgggctcgtttcgtctttacaagaaatctgtgcttgaagacattataagctcttgtgtgagcaaaggatatgtctttcaaatggagatgattgtccgcgcctcaagaaaaggataccatatcgaagaggttccaataacctttgttgaccgagtttatggaagttccaagcttggcggatcagaaatagtcgagtatttgaagggactcgtataccttcttttcaccacgtaagcatcataggattaatttcatatatatccttctaaaagttcaaaat

SEQ ID NO: 5080 - DNA, 1111 bp, Lippia dulcis
ttgattgaagggtgaaattcatcaattgggggcatttctagggtttatgcggtgttgatcgggaattattcaatggaagccaaagcggatgagaacaagtatagcataatcatccccacctacaatgagcgcctcaacatcgcgctcatcgtttacctcatcttcaagcatctcccgaatgtgaattttgagatcatagtggttgatgacgggagtccagatggaactcaggacatagtcaaacagctgcaggaagtatatggggaagatcgcatcctattgagacctagagcaaagaagcttggcttaggaacggcctacgtgcacggtttgaaacacgcaactggaaattttgttgtcataatggatgcagacttatcacaccatccgaagtacctgccaagctttatcaagaagcagatggagacaggttcgagcatagttactggaactaggtatgtaaaaggtggcggggttcatgggtggaacctgatgcgcaaattgacgagcaggggagccaacgtccttgcacaaacatttctttggccaggcgtatccgacttgactggatcattcaggctttacaaaaaatctgtgcttgaagatattataagctcctgtgtcagtaaggggtacgttttccagatggagatgatagttagagcttcaagaaagggttatcacattgaagaggtcccaatcacattcgtagaccgagtatatggaagctcgaaactggggggatcggaaatagtggagtatctcaagggacttctataccttttggttacaacatgaagatgcattttggagagttttctgcttacagaaagttaaaaaggcatagactcttttacattaacttcattttgactgtaacttcataatatgtttgaaatcttccttaaaagaattctttatagagtgtggtttttcatatggctgctgccgcctcctccggctgttgaacttggtggcgtccgccctcttatttgcagactcgatcaactgtaacaccatgatcatatgcatatgtgaaagttcagggcagtactatttgttggaacaataattttgtcaaatactaatagaaattttaattaaaaaagaa

SEQ ID NO: 5081 - DNA, 1043 bp, Fagopyrum esculentum
ggtaaaaagaaggccatttggattatcagacagaacactgaaggtcgatttgattgagaaatcactacgaagaatggaaaagcaggaggagagaaacaagtacagtataattgttcccacctacaacgaacggctcaatattgctcttattgtctaccttatcttcaaacatctgagggaatatgatttcgaagtcataattgttgatgatgggagtcctgatggaacccaagatgttattaagcaattacagctggtctatggtgaagatcgcatattactgagagcacggccaaagaagcttggtttaggaactgcatatgttcatggattgaagcatgcatctggaaattttgtagtaattatggatgctgatctttcacaccatccaaagtacttaccaggcttcatcaagaagcagatagagacaggcgctagtatagttacaggaactcggtatgttaagggtggtggtgttcatggatggactctaatgcgtaagctgaccagtaggggagccaatgtgttagctcaaactcttctttggcctggagtatcagacttgactggttctttccgtctttataggaaatctgtgcttgaagatctcatcagctcctgtgtaagtaaaggctatgtgtttcagatggaaattattgttcgagctacaaggaaaggctaccatattgaagaggtcccaatcacctttgttgacagagtatatggtacctcaaagctgggaggttcagaaatcgttcaatatctgaaaggtctggtgcatctcttgatcacgacatgaatccagaagattgaggctgacgacttcctttcttagttcaagtttaggaatgcatcttactttatcattgtaccacaatcagatggtagaaccattttattttgctaggcataaaattgaaagatttatagtttgctggaactttgtcagttttgcagtttagcagaggttctcgtttttttggctgcaaactattgtgtacatttggacagctgtatctatatgccatcaacactcatctgaa

SEQ ID NO: 5082 - DNA, 917 bp, Cichorium intybus
ccgctgatataaatgggacttttcgggtcacgtatcgagtctcctcgatcctcattactaaacagagattttcccatgtttcgaactgcaaatcgagaattggaatcgtcgggtttttgatctgcaaatggcggagcagcagaataagaacaagtatagtataatagtgccaacttacaacgaacgactcaacatcgctctcatcgtctacctcgtcttcaagcatattccggacattaactttgaaataataattgtggacgatggtagccctgatggaactcaagatattgtgaaacagttacagcatgtctatggagaggatcgtgttctattaagacccaggcccaggaagcttggattagggactgcttacattcatggtctgaaacatgctacaggaaattttgtcataatcatggatgctgatctgtcacaccatccaaagtatcttccacagttcataaagaaacaaatagagacaggtgcgagtattgttaccgggacccgctatgtgacaggtggcggcgtgcacggttggacacttatgcgaaaattgacaagtagaggggcgaatgttcttgcacatacgcttctttggcctggtgtatccgacttgacagggtcgtttcgtctttataaaaaaactgtgcttgaagacattataagctcgtgtgtgagcaaagggtatgtttttcaaatggagatgattgttcgagcatcaagaaaaggataccatattgaagaggttcctatcacttttgttgatagagtttatggaagctcaaagcttggtgggtcggaaatagtggagtacttgaaaggccttgtgtatcttctctttacaacataaaaaatgtaggtgaaataccattcatacgattctaaaacaatcaaatagccttttattttataac

SEQ ID NO: 5083 - DNA, 1167 bp, Cucumis sativus
atcgaagttgccgtcgatcactttccagttgattccgcgattgttgatcatacggcttcctggtttaagagtcgtctctaagcttttgcgtaatcgaattcatggcggagccggagaaggagagggacaagtacagtttgattgtcccaacctacaacgagcgcatcaatattgctctcctcgtctacctcattttcaagcacctcccggatgttgattttgaaataattgttgttgatgatggaagtccggatggtactcaagaagttgtgaaacagttgcaagggctatatggtgaagatcggatcctattgagagccagacctaggaagcttggattaggaacggcttactgtcatggtctcaagcatgcaactggtaattatgttgttataatggatgctgacttatctcaccatccaaaatatttacccagcttcattcagaaacagttacaaactggtgccgatatagttacaggaacccgatatgtgaaaggtggcggtgtacatggatggaatcttatgcgaaaactaacaagtagaggagctaatgttcttgcccaaacacttttatggcctggtgtatcagatttaactggatctttccggctctacaagaaatcagtgctagaagatatcatcacttcagttgttagcaagggatacgtcttccaaatggagatgattgttcgagctacaagaaaaggttatcacattgaagaggttccaattacgtttgttgatagagtgtttggaacttccaagcttggaggatccgaaattgtagagtatttgaaaggtctattgtaccttctggtcaccacatgatcagacattaaacagtgaatttgatttatcggcaggtaaacttcttgtttgatttcaaccctttgcccatttctggttaagtacccaccaccccccaggccttttttttgtgtaaatttgagattatttcttaggaagtattttcataactattagttttccccctaatttcccttcaaatagtaactgtcatagattgattttgattatggtatagcattatctcatagctcaggtattggctttcctgtctcatttacttcctcccaatataaattgtacaacatttcatttacaaacatcggtgattggtatatgaattcaaagttcaatttac

SEQ ID NO: 5084 - DNA, 1069 bp, Taraxacum officinale
ttcgggtttctccgtaccctgttgaccggacgtcaaaaccagacggcaacgactgtcgactaataccaaacgggtcttgccggatcacatttcgggtctccttgattatcaatcgtaaacaaaaccttttccctatttctcaactgcaagtccataattgaagatttagggtttttgatctgaaaatgtcgcaacagcggaattcgaacttgtatagcataatagtgccaacttacaacgaacgactcaacatcgctctcatcgtctacctcgtcttcaagcatattccggacattaactttgaaataataattgtggacgatggtagtccagatggaactcaagatattgtcaagcaattacagaaagtctatggtgatgatcgcattctattaagacccagacccaaaaagcttggattagggactgcatacattcatggtctgaaacatgcttctggaaattttgtcataatcatggatgctgacctgtcacaccacccaaagtatcttccacagttcataaagaaacaaatagagacaggtgcaagtattgtcaccgggacccgctatgtgacaggtggcggtgtccatggttggaccctaatgcgcaaattaacaagtagaggggcgaatgttcttgcacatacgcttctttggccaggtgtatctgacctcacagggtcatttcggctttacaagaaatctgtgcttgaagatattataagctcttgtgtgagtaaagggtatgtttttcaaatggagatgattgttcgagcatcaagaaaaggataccatattgaagaggttccaattacgtttgttgacagagtttatggaagttcgaagcttggtggatctgaaatagtggagtacttgaagggacttgtgtatcttctcgttacaacataaaggatgtatgtgaattgaatccgttattttatagcgtttttctgagaaactattccatttgatacaatgtacgtgtgcttgattttgctttcggttatttgagtttgaagcacatctgtttcctacggatttcctatcaattaaagttttttattttt

SEQ ID NO: 5085 - DNA, 1135 bp, Setaria italica
cgacaaggagggtcagggtcacttccgcggctactcgctccaccgctcccggccgttgattagtccccctgcggagcgctcgcctgagcgggagagatccgccgctgggtccgtccgagccgtcaatggaggcggcggcgggcagcaagcgcgcgtacagcatcatcgtgcccacctacaacgagcgcctcaacgtcgccctcatcgtctacctcatcttcaagcacctcccggatgtgaactttgagatcattattgtggatgatggtagtccagatggaactcaagacattgtaaaacaattgcagcaagtgtatggtgaagatcgtgttttactgcgagctaggcctaggaagctaggacttggtaccgcatatttgcatggattaaagcatgcctcaggggaatttgttgttatcatggatgcggacctatctcaccatccaaagtacttgccaagctttattaggaaacaaaaggaaactggtgctgacgttgtaaccggcacacgttatgttaagaatggtggtgttcatggttggaatctcatgcgcaagctaactagcagaggggcaaatgttcttgcacagacgttactacagcctggagcttcagacttaactggatcgtttaggctatataaacgagatgtcctggaagatttaatctcctcatgtgtcagcaagggctatgtgttccagatggagatgattgttagggctaccaggaaaggttaccacattgaagaggttccaataacgtttgtcgacagagtgtttggaatttcgaaacttggtggatctgagatagttgaatatttgaaaggcctcgtgtatctgttgctcacaacataattgaagatgtactgcaggcgtctaacttcttgggtaaaaccatgttacagagaattttgctgatgtgtaactgcagcttgagctgcatatcactacttatgtctccaacttgcaaatggattattgtacacaagtcttggtttatcagtgcattatttcacacaacatggtggcccctcctctctgtcgagtttcagtacttctttgttaaatggtttatcattatgatgtggaatgctttgcctccgttattttacagtgcaggcacatgtatgtgtctg

SEQ ID NO: 5086 - DNA, 1263 bp, Setaria italica
acggcctcgttcatctcgccgcctcgtcggtcctctgcaacggcggctgcggcgacaaggagggtcagggtcacttccgcggctactcgctccaccgctcccggccgttgattagtccccctgcggagcgctcgcctgagcgggagagatccgccgctgggtccgtccgagccgtcaatggaggcggcggcgggcagcaagcgcgcgtacagcatcatcgtgcccacctacaacgagcgcctcaacgtcgccctcatcgtctacctcatcttcaagcacctcccggatgtgaactttgagatcattattgtggatgatggtagtccagatggaactcaagacattgtaaaacaattgcagcaagtgtatggtgaagatcgtgttttactgcgagctaggcctaggaagctaggacttggtaccgcatatttgcatggattaaagcatgcctcaggggaatttgttgttatcatggatgcggacctatctcaccatccaaagtacttgccaagctttattaggaaacaaaaggaaactggtgctgacgttgtaaccggcacacgttatgttaagaatggtggtgttcatggttggaatctcatgcgcaagctaactagcagaggggcaaatgttcttgcacagacgttactacagcctggagcttcagacttaactggatcgtttaggctatataaacgagatgtcctggaagatttaatctcctcatgtgtcagcaagggctatgtgttccagatggagatgattgttagggctaccaggaaaggttaccacattgaagaggttccaataacgtttgtcgacagagtgtttggaatttcgaaacttggtggatctgagatagttgaatatttgaaaggcctcgtgtatctgttgctcacaacataattgaagatgtactgcaggcgtctaacttcttgggtaaaaccatgttacagagaattttgctgatgtgtaactgcagcttgagctgcatatcactacttatgtctccaacttgcaaatggattattgtacacaagtcttggtttatcagtgcattatttcacacaacatggtggcccctcctctctgtcgagtttcagtacttctttgttaaatggtttatcattatgatgtggaatgctttgcctccgttattttacagtgcaggcacatgtatgtgtctgcggaacttttgctgaatgtgttgttcctatgctattcatcttgtatctgattttcattaacgaagtaaacaaattt

SEQ ID NO: 5087 - DNA, 1157 bp, Orobanche aegyptiaca
tccggaccatcaatcaccgtgtccccttcaatttcgcgtaaatcaggtgatcattaacagagaaatgttgaacaaaaattaagaagaaagaaaacacaatccagttgcgagcatttgtagggttttaatgattttgatgatgaattcaatggaagccaaggagaagaacaaatacagcgtaattgttcccacctacaatgaacgcctcaacattgctctcatcgtttaccttatttccaagcatcttcaggatgtagattttgaaataattattgtggacgatgggagtccagatggaacccaggagattgttcaacagctgcagcgagtatatgggcaagatcgtattttgttgagacctagacctaagaagcttggcttgggtacggcgtacatgcatgggcttaagcacgcgaatggaaattttgttgtgataatggatgcggatttgtcgcaccatccaaagtacctgccaagctttatcaaaaaacagatggagacaggtgcaagcataattactggaacccgatatgttcatggtggaggagtgcatgggtggaatcttatgcgtaaattgacgagcaggggagcgaatgtccttgcacaaacgcttctctggccaggtgtatcggatttaactggttcattcaggctttacaagaaatctgtgcttcaagatgtcataagctcatgtgtgagtaagggttatgttttccagatggagatgatagttagagcctcaagaaagggttaccacattgaagaggttccaatcacttttgtggatagagtatacggaagctcgaaactcggagggtcagaaattgtggaatatcttaaggggcttttgtaccttctgcttacaacttaaacatccagcatcaaagtggtcaatcttgatacttcttcacatttcttcggtgcagaagttcgaatgattatctaacatattcccaaatctaatatataaacaaagacgagtggacatggtgttattgttttatcttatctggaaattgtaatcgcttccctgttacttgaatgcaaagacttgttcgttggtagagtttatgtgcagtttgtagatttacatcttcaactttatcgggcttggccacatgccaacattcgtatttttgtcagaattatcgtggttg

SEQ ID NO: 5088 - DNA, 883 bp, Nicotiana tabacum
  misc_feature (157)..(157): n is a, c, g, or t
  misc_feature (182)..(182): n is a, c, g, or t
ggccattacggccgggggatctgaaagaattacaatcaaaaaatggagcagaagaagaacaagtacagtataattgtacccacctacaacgaacgcctcaacattgctctcgtcatttacctcgtctttaagcatctcccggatgttgatttcgaantaattgtagtggatgatggaagtcnagatggcacacaggatattgtcaaacaattgcagaaagtatatggagaagatcatattttattgagacctcgagctcggaaacttggtttaggcactgcatatattcatggtttgaagcatgcctcaggcaattttgttgtcattatggatgcggatctttctcaccatccaaaatacctgccaagatttatcaagaaacaaatggagacaggtgccagtatagttactggaactcgatatgttactggtggtggtgtccacggatggaaccttatgcgcaaattgacaagtaggggagcaaatgtccttgcacagacattactttggccgggtgtatcagacttaactggatccttccggctgtaccagaaatctgcactagaagacatcataagctcttgtgtaagtaaaggatatgtttttcagatggagatgattgttcgggcttcaagaaaaggttaccgcattgaagaggttccaattacttttgtcgatagagtatttggaagttccaagctgggaggatctgaaatagtggagtacctgaagggccttctgtatcttctggttacaacttgatatggatagcaagctgtgacaatctaaagacttgaactaggaccatttaacatattctttttctttttgcttcagcttaggtgacaaaatttttgattaatgagctattatgtgttggaaa

SEQ ID NO: 5089 - DNA, 910 bp, Eutrema halophilum
aattctccggctgctatggcggaagagaaggagacgaaaggagggaaaaagtacaagtatagcataatcgttcctacatacaacgagcgcctcaatatcgctcttatagtctacctcatcttcaagcatctccgggatgttgattttgagataatagttgtggatgatgggagccctgatggcacacaagaaattgtcaagcaactgcagcaattgtatggtgaagaccgcatacttttaagagctagagccaaaaagcttggcttaggaactgcatatatccatggtttgaagcatgctacgggtgatttcgttgtaatcatggatgctgatctttcacatcatccgaagtatttgccaagtttcatcaagaaacagttagagacaaatgcaagtatagtaaccggtacacggtatgtaaaaggtggtggtgtacacgggtggaatcttatgcggaaactcacaagcaggggagcaaatgtactagctcaaacacttttatggcctggtgtttctgatttaactggatcattccggctatacaagaaatcagtgcttgaagatgtgattagctcatgtgtgagtaaaggctatgtctttcagatggagatgatcgttcgtgctaccagaaaaggataccatattgaagaggtaccgatcacttttgtggatagagtatttggaacgtcgaagctgggaggatctgaaatagtggaatatctaaaaggcctcgtctatcttctgctcacgacttaagagatagacaccaacatgagtctcatcatactcttctatagaaacttcactttagctttgactttgagagagttgcatcttccaaagactgaaagttcactttatagacgatgttcgttttcaatgccgagttgagatattttacacttgataa

SEQ ID NO: 5090 - DNA, 974 bp, Artemisia annua
attgattgattgatcaaatcaaaataaaatcataaaatggctgaacaagaacaaaatgataataagaagaataagtacagtataataatcccaacttacaatgaacgtctcaacatcgcattaatcgtcttcttagtcttcaaacacattccggatgttgactttgaaataatagtcgtggatgatggtagtcctgatggaacccaagatattgtcaaacagttgcagcaagtctatggtgaagatcgcattttattaagagctaggcccaagaagcttggattagggactgcttacattcatggtctgaaacatgcttcgggaaattttgttgtaatcatggatgctgatctgtcacatcatccgaagtaccttccacattttataaaaaaacagatcaagacgggtgctgatattgtcacgggaactcgttacgtaagaggtgggggtgtgcatggttggactttaatgcgcaaattgacaagtagaggggctaatgttttagcacatacacttctttggcctggtgtttcagacttaacaggctctttccgtctttataagaaatctgtacttgaagacattataagctcttgtgtgagcaaaggatatgttttccagatggagatgattgttcgagcttcaagaaaaggataccgtatcgaagaggttcctatcacttttgtggatagagtttatggaagttccaagcttggtggatctgaaatagtcgagtatctaaagggactcgtgtatcttctcataacaacataaagaatgtcagccacacaccattcaatactttcataggtgctgcttttcgtttccgtttgacaaggtgactcaaatctctgaccaaccaaatagccaatttataacatttttcatgagaatattcgttctatattatgtatccgtgatttagattcagcatttttatttttatcttttaagtgtgaatgcatttgcttttt

SEQ ID NO: 5091 - DNA, 1104 bp, Eutrema parvulum
taacattaatgtattttagtccttacttttctgtacagagtcacagacgacggtcgatttcacatagctgatcggcaaattaagacgaaggaaggtcgctccgtttgcaaaactcagggttatcatcggagaaaaaggttcagcttctatggcggaagagaaggagaaaaagtacaagtatagcataatcgttcctacctacaacgagcgcctcaatatcgctcttatagtctacctcattttcaagcatctccgggatgttgattttgagatcattgttgtggatgatgggagtcctgatggcacacaagaaattgtcaagcaactgcagcacttgtatggtgaagaccgcatacttttaagagctagagccaagaagcttggcttaggaactgcatatatccatggtttgaagcatgctacgggtgatttcgtcgtaatcatggatgctgatctttcacatcatccaaagtatttgccaagtttcatcaagaagcaattagagacaaatgcaagtatagtaaccggtacacgatatgtaaaaggtggtggtgtacacgggtggaatcttatgaggaaactcacaagtagaggagcaaatgtgctggctcaaacacttttatggcctggtgtatctgatttaaccggatcatttcggctatacaagaaatcggtgcttgaagacgtgattagctcatgtgtgagtaaaggctatgtctttcaaatggagatgattgttcgtgctaccagaaaaagataccatattgaagaggtaccgatcacttttgtggatagagtctttggaacttcgaagctgggaggatctgaaatagtggaatatctaaaaggacttgtctatcttcttctgacgacttgagagacacactaagcaactcaattacacatgagttttctcttcatactcttctttagtcattttggcatcatagcttctcttaacacttctactctgaccatcatggttgttagaaacttcactttagcttgacttcagagagttgcatcttcaaaagactcgaaagttcacatcatagacgttgtttttcttttaatgctgagttgagatatcttacatttgctaaa

SEQ ID NO: 5092 - DNA, 977 bp, Raphanus sativus
  misc_feature (16)..(16): n is a, c, g, or t
  misc_feature (948)..(948): n is a, c, g, or t
acagacgacggtgganttttcacaggcggataaaggaagctctctccgtttgtaaaagttaggttttttttggggatcgggtgatatggcggaggagaaggagaagaacaagtatagcataatcattcccacgtacaacgagcgcctcaatatcgctcttattgtctacctcattttcaagcatctccgggatgttgattttgagataattgttgtggatgatgggagtcctgacggcactcaagaaattgtcaagcaactgcaggacttgtatggtgaagaccgcattcttttaagagctagagccaagaagcttggtttgggaactgcatatatccatggtttgaagcatgctacaggtgatttcgttgttatcatggatgctgatctttcacatcatccaaagtatttgccaagtttcatcaagaaacaactagagacgaatgcaagcatagtgacaggtacacgatatgtaaaaggaggtggtgtacacgggtggaaccttatgcggaaactcacaagcagaggagcaaatgtgctagctcacacacttttatggcctggtgtatctgatttaaccggatcatttaggctatacaagaaatcggtgcttgaagacgtgatatgctcatgcgtgagcaaaggttatgtctttcagatggaaatgatcgtccgtgctaccagaaaaggataccatattgaagaggtaccgatcacatttgtggatagagtctttggaacttcgaagctgggaggatctgaaatagtggaatatctaaaaggactcgtctatcttcttctcacgacttaagaccaagcacagctcaacaacacatgaatctctctttatactctcgttcgtctcttaaacacttgaactctgatcatttcctgttagaaacttcactttaccttttgactagagaaagagacagagttgtgcatccntcaaagactcaaaaaaagttcataccatc

SEQ ID NO: 5093 - DNA, 1321 bp, Sorghum bicolor
aggcctaaacccattcacacgcatgcccatggggacttgagcccggccatcctgccttcgtctcgccggcttcgtcctcccccctctgcaacggcggctgtgggctgggggcctgcggcgacgacggtcagctgcgagccactcgttccgcctgtcccagcgacccagcctgtggtgaggctcctacggagcgctcgcctgaggagaagcgagagatccggagctgtgtccagtcggccgtccatggaggcggcggcgggccgcaagcgcgcgtacagcatcatcgtgcccacgtacaacgagcgcctcaacgtcgccctcatcgtctacctcatcttcaagcacctcccggatgtgaactttgagatcattattgtggatgatggtagtccagatggaactcaggacattgtaaaacaactgcagcaagtatatggtgaagattttgttctactgcgagctaggccaaggaagctaggacttggtactgcatatttacatggattaaagcatgcctcaggggaatttgtcattatcatggatgcagacctatctcaccatccaaaatacttgccaagctttattaggaaacaaaaggaaactggggctgacattgtaactggcacacggtatgttaagaatggtggtgtccatggttggaatctcatgcgcaagctgactagcagaggtgcaaatgttcttgcacaaacgttactacagcctggagcttcagatttaaccggatcatttaggctatataagcgagatgtcctggaagacttaatctcctcatgtgtcagcaagggctacgtgttccagatggagatgattgttagggctactaggaaaggttatcacattgaagaggttccaataacatttgtcgacagagtatttggaatttcaaaacttggtgggtccgagatagttgaatatttgaaaggccttgtttatctgctgctcacaacatgattgaagatatgtagtaggcttctggtttgtgggtacaaccgtgttatagagaattttactgatgtgttattattgcagcttgagctgtatatcagtacaattacgcatgtttctagtgggtggattattgtactcaagtcttgctttctctgtacattttctcacacaacatagcgcccctcctttctgttgacttccagtgcttcttttaactgtttgtaattctgtcattgtgtggcatcaccccccttgttttctgaagggaaccggctgtatgtgtctacatagaaactgttgctggatgtgttgttcctggtctactcatcatctagcaggatctggttctcat

SEQ ID NO: 5094 - DNA, 1258 bp, Sorghum bicolor
ggggacttgagcccggccatcctgccttcgtctcgccggcttcgtcctcccccctctgcaacggcggctgtgggctgggggcctgcggcgacgacggtcagctgcgagccactcgttccgcctgtcccagcgacccagcctgtggtgaggctcctacggagcgctcgcctgaggagaagcgagagatccggagctgtgtccagtcggccgtccatggaggcggcggcgggccgcaagcgcgcgtacagcatcatcgtgcccacgtacaacgagcgcctcaacgtcgccctcatcgtctacctcatcttcaagcacctcccggatgtgaactttgagatcattattgtggatgatggtagtccagatggaactcaggacattgtaaaacaactgcagcaagtatatggtgaagattttgttctactgcgagctaggccaaggaagctaggacttggtactgcatatttacatggattaaagcatgcctcaggggaatttgtcattatcatggatgcagacctatctcaccatccaaaatacttgccaagctttattaggaaacaaaaggaaactggggctgacattgtaactggcacacggtatgttaagaatggtggtgtccatggttggaatctcatgcgcaagctgactagcagaggtgcaaatgttcttgcacaaacgttactacagcctggagcttcagatttaaccggatcatttaggctatataagcgagatgtcctggaagacttaatctcctcatgtgtcagcaagggctacgtgttccagatggagatgattgttagggctactaggaaaggttatcacattgaagaggttccaataacatttgtcgacagagtatttggaatttcaaaacttggtgggtccgagatagttgaatatttgaaaggccttgtttatctgctgctcacaacatgattgaagatatgtagtaggcttctggtttgtgggtacaaccgtgttatagagaattttactgatgtgttattattgcagcttgagctgtatatcagtacaattacgcatgtttctagtgggtggattattgtactcaagtcttgctttctctgtacattttctcacacaacatagcgcccctcctttctgttgacttccagtgcttcttttaactgtttgtaattctgtcattgtgtggcatcaccccccttgttttctgaagggaaccggctgtatgtgtctacatagaaactgttgctggatgtgttgttcctgg

SEQ ID NO: 5095 - DNA, 1088 bp, Saccharum officinarum
ctcgccggcttcgtcctcctctgcaacggcggctgcgggctgcgggctgcgagcgacgacggtcagttgcggagccacttgttcccgacctagcgacccagcgacccagcgaggctccgacggagcgctcgctcgaggagaagggagagatccggtgctgtgtccagtcggccgtccatggaggcggcggcgggccgcaagcgcgcgtacagcatcatcgtgcccacctacaacgagcgcctcaacgtcgccctcatcgtctacctcatcttcaagcacctcccggatgtgaactttgagatcattattgtggatgatggtagtccagatggaactcaggacattgtaaaacaactgcagcaagtatatggtgaagattttgttctactgcgagctaggccaaggaagctaggacttggtactgcatatttacatggattaaagcatgcctcaggggaatttgtcgttatcatggatgcagacctatctcaccatccaaaatacttgccaagctttattaggaaacaaaaggaaactggagctgacgttgtaactggcacacggtatgttaagaatggtggtgtccatggttggaatctcatgcgcaagctgactagcagaggtgcaaatgttcttgcacaaacgttactacagcctggagcttcagatttaaccggatcatttaggctatataagcgagatgtcctggaagacttaatctcctcatgtgtcagcaagggctacgtgttccagatggagatgattgttagggctactaggaaaggttatcacattgaagaggttccaataacatttgtcgacagagtatttggaatttcaaaacttggtgggtccgagatagttgaatatttgaaaggccttgtttatctgctgctcacaacatgattgaagatatgtagtaggcttctggtttgtgggtacaaccgtattatagagaattttactaatgtgttattattgcagcttgagttgtatatcagtacaatcacgcatgtttccagtgaatggattattgtacccaagtcctggtttctctgtacattttttcacacaacatagtgcccctc

SEQ ID NO: 5096 - DNA, 1109 bp, Panicum virgatum
cgccgcctcgtcggtcctctgcaacggcggctgcggcgacaaggagcttcagggtcatatccgcagcccctcgcccaccggtaccagcctgtggttagcacccgactcgacagagcgctcgcctgagggaggagagatccgccgctgggtccagccggccgacaatggaggcggcggcggccggcaagcgcgcgtacagcatcatcgtgcccacctacaacgagcgcctcaacgtcgccctcatcgtctacctcatcttcaagcacctcccggatgtgaactttgagatcattattgtggatgatggtagtccagatggaactcaggacattgtaaaacaactgcagcaagtatatggtgaagatcgtgttttactgcgagctaggccaaggaagctaggacttggtaccgcatatttacatggattaaagcatgcctcaggggaattcgttattatcatggatgcggacctatctcaccatccaaagtatttgccaagctttattaggaagcaaaaggaaactggtgctgatgttgtaactggcacacgttatgttaagaatggtggtgtccatggttggaatctcatgcgcaagctaactagcagaggagcaaatgttcttgcacaaacgttactacagcctggagcttcagatttaaccggatcgtttaggctatataagcgagatgtactggaagatttaatctcctcatgcgtcagcaagggctatgtgttccagatggagatgattgttagggctactaggaaaggttatcacatcgaagaggtcccaataacgtttgtcgacagagtcttcggaatttcaaaacttggtgggtccgagatagttgagtatttgaaaggcctcgtgtatctgttgctcacaacataattgatgatgtactgtaggcatctaacttcgtgagtaaaaccgtgtaacagagaatttttatgatgtgtcactgcagtttgagttgcatatcactacttacctctccaacttgcgaatggattattgtatacaaggcttggtttgtcagtacattatttcacacaagtgtccccaatgatttataattctgatgtggaatacaaatttgtcccgtag

SEQ ID NO: 5097 - DNA, 1156 bp, Panicum virgatum
gacatgtgattggacttgggcctgggcgtcctagcgatagccaaatcgttcgttcgccgctccggcgaagtctgcacgtcctcgttcatctcgccgcacgccgcctcgtcggtcctcttcaacggcggcttcggcggcgaggaggatcagggtcatatccgcagccactcgctccaccggcaccagcctctgcttagcccccaactgagcgctcgcgtgagggggtgagaattgagatccatctggatccagtcggccgtcaatggaagcggcggcgggcggcaagcgcgcgtacagcatcatcgtgcccacctacaacgagcgcctcaacgtcgccctcatcgtgtacctcatcttcaagcacctcccagatgtgaactttgagatcattatcgtggatgatggtagtccagatggaactcaagatattgtaaaacaattgcaggaagtgtatggtgaagatcgtgtcttactgcgagctaggccaaggaagctaggacttggtactgcatatttacatggattaaagcatgcctcgggggagtttgttgttatcatggatgcggacctatctcaccatccaaagtatttgccaagctttattaggaagcaaaaggaaactggtgctgatgttgtaactggcacacgttatgttaagaatggtggtgtccatggttggaatctcatgcgcaagctaactagcagaggagcaaatgttcttgcacaaacgttactacagcctggagcttcagatttaactggatcgtttaggctatataaacgagatgtactggaagatttaatctcctcatgtgtcagcaagggctatgtgttccagatggagatgattgttagggctactaggaaaggttatcatatcgaagaggtcccaataacgtttgtcgacagagtctttggaatttcaaaacttggtgggtccgagatagttgaatatttgaaaggcctcgtgtatctgttgctcacgacataattgtagatgtactgtaggcatctcgtgggtaaaaccgtgtaacagagaattgttatgatgtatcactgcagcttgagttgcatatcactacttactccaacttgcgaatgtattattgtatacaagtcttggtttgtcggtgcattatttcgcacaagcatcccc

SEQ ID NO: 5098 - DNA, 1080 bp, Hordeum vulgare
aacttgactgcccggagcgcttccagttttgtcaccggccggcgacgggagaatagatcgggctcgccaatctctcgccggcttccctccgtccctgcccaaaggcggctgcggcgtcagatcgcgcaccgagaagagttgatctgctccgctcggtggacgcgggcctgcggcagcggcggcgatggagaagggaggggaggcgggcggcggcaggccggagtacagcatcatcgtgcccacctacaacgagcgcctcaacgtcgccctcatcgtctacctcatcttcaagcacctcccggatgccaagttcgaaatcattattgtggatgatggaagccctgatggaactcaagacattgtaaagcagctgcagcaagtatatggtgaagaccgtgttctactgcgagctagaccaaggaagctagggcttggcactgcatatatgcatggattgaagcatgcttcaggggagttcgttgttataatggatgcggatctatctcatcatccaaagtatttgccaagtttcatcaggaagcaaaaggaaaccggtgctgacattgtaactggcacgcgttatgttagcaatggtggtgtccatggttggaatcttatgcggaagttgactagcaggggagcaaatgttctggcacaaacgttactacggcccggagcttctgatctgactgggtcgtttaggctatataagcgaagtgttttggaggatgtcatctcctcctgcgtcagcaagggctatgtattccaaatggagatgattgtcagggctactaggaaaggttatcacattgaagaggtcccaatcacttttgtcgacagggtcttcggaatctcaaagcttggtggatctgaaattgttggatacttgaaaggccttgtgtatctgttgctcacaacatagggcgaaaagacacagtagatgaatgactgtcataggacaaactcttgttgagattgatttttcttatgttgttaagcttgcgttgtataaatttgttaacattttcagacttacaattgaattctgtacacaagttttagtgtgtgggtatccttatg

SEQ ID NO: 5099 - DNA, 1071 bp, Triticum aestivum
cagttttgacaccggccggcgacgggaaatcggcctcgccaatctcgccggcttccctccgtccctgcccaactgcggctgcggcgtcagatcgcgcaccgagaagagttgatctgccggcgctgatctgctctgctcggtggagacgatggagaagggaggggaggcgggcggcggcaggccggagtacagcatcatcgtgcccacctacaacgagcgcctcaacgtcgccctcatcgtctacctcatcttcaagcacctcccggatgccaagttcgaaatcattattgtggatgatggaagccccgatggaactcaagacattgtaaagcagttgcagcaagtatatggcgaagatcgtgttctactgcgagctagaccaaggaagctaggacttggtactgcatatatgcatggattaaagcatgcctcaggggagttcgttgttataatggatgcagatctatctcatcatccaaagtatttgccaagcttcatcaggaagcaaaaggaaaccggtgctgacattgtaactggcacccgttatgttagcaacggtggtgtccatggttggaatcttatgcgtaagttgaccagcaggggagcaaatgttctggcacagacgttgctacagcccggagcttctgatctgactgggtcgtttaggctatataagcgaagtgttttggaggatgtcatctcctcctgcgtcagcaagggctatgtattccaaatggagatgattgtcagggctactaggaaaggttatcacattgaagaggtcccaatcactttcgtcgacagggtcttcggaatctcaaagctcggtggatccgaaattgttggatatttgaaaggccttgtgtatctgttgctcacaacatagggcgaaaagacactagatgcatgactgttataggacaaactcttgttagagtgatttttcttatgttttcacagcttgagctgcataattctgctaacgttttcagacctacaattgaattatatacactagttttggtctgtgagtatccatatatgaattgtgtcctgtgactaaaaaaaaaa

SEQ ID NO: 5100 - DNA, 1053 bp, Solanum lycopersicum
gaactgaaaaaaacttcaattttgagatcaacaaaatgggggagaagaacaagtacagtataattatacctacctacaatgaacgtctcaatattgctctcatcatctacctcgtcttcaagcatctcacggatgttgattttgaaataatagtagtggatgatggaagtccagatggcacacaggatattgtcaaacaattgcagaaagtatatggagaagatcgtattttattaagacctcgacctcggaaacttggtctaggcactgcgtatattcatggtttgaagcatgcctcaggcaattttgttgttattatggatgcggatctttctcaccatccaaaatacctgccaagatttatcaagaaacaaatggagacaggtgccaatatagttactggaactcgatatgtttctagtggtggtgtccacggatggaaccttatgcgcaaattgacgagcaggggagccaatgtccttgcacagacactactttggccgggtgtatcagacttaactggatccttccggctgtaccagaagtctgcactagaagacatcataagctcttgtgtcagtaaaggatatgtttttcagatggagatgattgttagggcttcaagaaaaggttaccgcattgaagaggttccaattactttcgttgatagagtatttggaagttctaagcttggaggatctgaaatagtggagtatctaaagggccttctgtatcttctggttacaacttgatatgtttaacaagctgcatgaccagagaatctgaagacttgagttgttttgcaacctgtgacattctgaagacttgaactaggaccatataacaaattctttttctttttgcttcagctgatgtaaccaaaactttgatgaatgagctattatgtattggaaagagtgttgctgaagtaatttccaatgctactttggtttattttgtggatgatgctttccatttttggataatacacttgttcaagttatctgtgaatattaacttgcattttccagcttatataaatgtctacttctg

SEQ ID NO: 5101 - DNA, 973 bp, Arabidopsis lyrata
agacgaaggaaccaccgttgcgaaaactcgccggaagatatggcggaccagatggagcccaaaggagagaagaagtacaagtatagcataatcattcctacatacaacgagcgcctcaacatcgctatcatagtctacctgattttcaagcatctccgggacgttgattttgagataattgttgtggatgatgggagtcctgatggcacacaggaaattgtcaagcaactgcagcaattgtatggtgaagaccgtatccttttaagagctagagccaagaagcttggtctgggaactgcatatattcatggtttgaagcatgctacgggtgatttcgtcgtaatcatggatgctgatctttcacatcatccaaaatacttaccaagtttcatcaagaaacaactagagacaaatgcaagtatagtaaccggtacacgatatgtaaaaggtggtggtgtacacgggtggaatcttatgcggaaactcactagtagaggagcaaatgtgctagctcaaacacttttatggcccggtgtatcggatttaacaggatcattccggctatacaagaaatcggtgcttgaagacgtgattagctcatgtgtgagtaaagggtatgtctttcagatggaaatgattgttcgtgcaaccagaaaaggataccatattgaagaggtaccgatcacttttgttgacagagtttttggaacttcgaagctcggaggatctgaaatagtggaatatctaaaaggccttgtctatcttctgctcacgacttagagacaccaagcaactcaacaacacatgtgtctctcgttataattctcttaacatttgaactctgatcatgtcttttagaaacttcactttagcttttttgacttccgagagttacatcttttgagactcaaaagttcatattacagacgttgttcattttgaatactgagttgagatatcttacatttgataa

SEQ ID NO: 5102 - DNA, 797 bp, Centaurea maculosa
  misc_feature (35)..(35): n is a, c, g, or t
  misc_feature (104)..(104): n is a, c, g, or t
  misc_feature (200)..(200): n is a, c, g, or t
  misc_feature (233)..(233): n is a, c, g, or t
  misc_feature (253)..(254): n is a, c, g, or t
  misc_feature (262)..(262): n is a, c, g, or t
  misc_feature (297)..(297): n is a, c, g, or t
  misc_feature (323)..(323): n is a, c, g, or t
  misc_feature (338)..(338): n is a, c, g, or t
  misc_feature (386)..(386): n is a, c, g, or t
  misc_feature (413)..(413): n is a, c, g, or t
  misc_feature (422)..(422): n is a, c, g, or t
  misc_feature (446)..(446): n is a, c, g, or t
  misc_feature (455)..(455): n is a, c, g, or t
  misc_feature (485)..(485): n is a, c, g, or t
  misc_feature (487)..(487): n is a, c, g, or t
  misc_feature (510)..(510): n is a, c, g, or t
  misc_feature (575)..(575): n is a, c, g, or t
  misc_feature (581)..(581): n is a, c, g, or t
  misc_feature (590)..(590): n is a, c, g, or t
  misc_feature (593)..(593): n is a, c, g, or t
  misc_feature (632)..(632): n is a, c, g, or t
  misc_feature (635)..(635): n is a, c, g, or t
  misc_feature (654)..(654): n is a, c, g, or t
  misc_feature (656)..(656): n is a, c, g, or t
  misc_feature (680)..(681): n is a, c, g, or t
  misc_feature (694)..(694): n is a, c, g, or t
  misc_feature (716)..(716): n is a, c, g, or t
  misc_feature (740)..(740): n is a, c, g, or t
  misc_feature (751)..(751): n is a, c, g, or t
  misc_feature (756)..(756): n is a, c, g, or t
  misc_feature (764)..(764): n is a, c, g, or t
  misc_feature (769)..(769): n is a, c, g, or t
  misc_feature (771)..(771): n is a, c, g, or t
  misc_feature (775)..(775): n is a, c, g, or t
gagaagggggaagttttagggtttttgatcgatcnccaatggcggaaaagcagaataagaacaagtatagcataatcgttccaacttacaacgaacgactcaanatcgctctcatcgtcttcctcgtcttcaagcatattccggatgttgactttgaaataataatcgtggacgatggaagtcctgacggaactcaaganattgtaaaacagttgcagcaagtctatggtgangatcgcattctattaagagnnaggcctangaagcttggattagggactgcttacattcatggtntaaagcacgcttcaggaaattttgtngtaatcatggatgcngatctatcacaccatccaaagtaccttccacaatttataaagaaacanatggagacgggtgccagtattgttacnggaactcgntatgtaagaggtgggggcgtgcanggttggacnttgatgcggaaattgacaagtagaggggcnantgtccttgcacatacgcttcttnggcctggtgtatcagacttgacgggctcgtttcgtctttacaagaaatctgtgcttgaggacatnataagntcttgtgtnagnaagggatatgttttccagatggagatgattgtccgagcntcnagaaaaggataccatatcnangaggttccgatcactttcgtaganngagtttatggaanttcgaagcttggtggatcgganatagtggagtatctgaaaggtctngtatatcttcntgttnctacatanagacnantgangggtacccaccgaaaaattggt

SEQ ID NO: 5103 - DNA, 1028 bp, Lactuca sativa
gcggggatgacaggacgtcaaaaccgacggcaactgccaacacaaaacgggttttgtcgggttacgcttcgggtcttcctgattatcattagcaaacaaacctctttccgtatttcaactgaaatccagaatcagagatttagggcttttgaattttgatctgaaaatgtcgcaaccgcggaataccaacttgtatagtataatagtgccaacttacaacgaacgactcaacatcgctctcatcgtctacctcgtcttcaagcatattccggacattaactttgaaataatcattgtggatgatggtagtcctgatggaactcaagatattgtcaagcaattacagcaagtctatggtgaagatcgcattctattaaaacccaggcccaaaaagctcggattagggactgcttacattcatggtctgaaacatgcttctggaaactttgtcataatcatggatgctgatctgtcacaccatccaaagtatcttccacagtttataaagaaacaaatggagacaggggcgagtattgtcactgggacccgctatgtgacaggtggcggtgtgcatggttggacacttatgcgcaaattgacaagtagaggcgcgaatgttcttgcacatacccttctttggcctggtgtatctgacttgacagggtcatttcgtctttataaaaaatctgtgcttgaagacattataaggtcttgtgtgagcaaagggtatgtttttcaaatggagatgattgttagagcatcaagaaaaggataccttattgaagaggttccgattacttttgttgatagagtttatggaagttcaaagcttggtggatcagaaatagtggagtacttgaagggtcttgtgtatcttctgtttacaacataaagaaaataggctaaaatactattctatatgatagataatcacacaggaattgcttcttgattcttatttctaattgataagtacatttgactcatatcccttgctttccttaacaattgaatacccattttgtagc

SEQ ID NO: 5104 - DNA, 1947 bp, Flaveria ramosissima
agagaaacacacgatcgatcacaaacgcgtgaaaagcaagcccaaagctctcagctgaacactgtagcatcttttctgtcgtcaaaaaggttttgttctcttcggctgctgtagtgggttgcatctctgatcattaatatgagtcttggtggtccttctatgggttctggtggtagaaccggaagaagggcatttgagtttggaaagacatatgtggtaaaacctaaagacaaacacctggctaccattgtgtggttgcatgggcttggtgacaatggctcgagttgggctcagcttttggagactcttcctcttccaaatatcaaatggatatgccctacttctccttctcaacccttgacattgtttggcggattcccttcaaatgcatggtgtgacgtgagtgacctgtctgaagatgcaaaacaagacgtagagggacttgatgcttcagctgcacatgttttgagtctactttcgaccgagcctgcagatgtcaaaattggtataggaggcttcagtatgggctcggcacttgctttgtactgtgcaacttgctttgcccatggaaaacttgggaatggcgattctttttcaacccgtttggatgcagtggttggcctaagtggctggcttccatgtgcaaaggatgtaactaacaaggtagaaggtgatgaagctgcagctcgagcatcatccttgcctattttgctttgtcatggcaaaggtgatgatgtggttctcttccgctatggtgacaagtcagctgagaaactaacttcagccggctttaaaaacttgaccttcaaagtttatgactcgctcggccattacacgatgcctgaagagatggatgatgtctgtgcgtggctaacttcaaaattagagctcaagaacgagccctaataccatcgaacagcaacgaaagatatgcaaaatctaccaaacaatatattctggtgtgaattatgaattttctgaatggtaaacttttactgtagaaaatacaaatcacagatctcgcatattgcatcagtcaatctgtgtaattaaaaacattcagtggtctgggttttatgaattcatggtgtattgaatctgtaactgtaactgtgtggcataattaaaccatagtcattgaatgtattgaatactacaaaaaataatacaatcaagtaataacataaacaatcaacaaccaagtgatcaatgtgaaatcccaatcaaatgaaacttctataaacataactatgtagtaaagagaaggtacactagaccctttaaatactcgactatttctgatccaccaagcttcgaacttccataaactcggtcaacaaaagtaatcgggacctcttcgatgtggtatccttttctagaggcccgcacaatcatctccatttgaaaaacatatcctttgcttacacacgagcttataatgtcttcaagcacagatttcttgtaaagacgaaatgagcctgtcaagtctgatacaccaggccaaagaagagtatgtgcaagaacattagcccctctacttgtcaatttgcgcatcagggtccaaccatgcacacccccaccttttacataacgggtccagtaacaatatccgcacccgtttcaatttgtgtctttataaagtgtggaaggtactttgggtggtgcgacagatcagcatccatgattacaacaaaatttcccgaagcatgcttcaaaccatgaacgtaagcggtccctaatccaagcttcttgggcctagctcttaatagaatgcggtcatcaccatagacttgctgcaactgttcgacgatatcttgagttccatcaggactaccatcatccacgactattatttcaaagtccacatccggtatatgtttgaagacaaggaagacgatgagagcgatgttgagtcgttcgttgtaagttggtacgattatgctatac

SEQ ID NO: 5105 - DNA, 976 bp, Amorphophallus konjac
gcctgcggccgccgctcctctgcagccgcctccggtttccctcctacgcgggtctgctcgccgccgcccccgctcgccatcctcctccggatgtctggttccctaaaagcagaggagcaggtgaagtagttggagtgggatggaggctccggagcgaacactggagagggagaagaaagggagcaagtatagcatcatcattccaacttataacgagcgcctaaacatcgccctcattacctacctcatcttcaagcatctcaggaatgtagattttgagatcattgttgtggatgatgggagtcctgatggaactcaagatgttgtcatgcaactgcagcaagtctatggggaagatcgcattctattaagaggaagaccgaggaagcttggtctaggaactgcatatcgtcatggtctgaagcatgcatctggtgattttgttgtgataatggatgctgatttatctcaccatccaaaatacttgccaaccttcatcaggaaacagatagagacaggtgcgagtattgtcacgggcacccgttatgttagaggtgggggtgtacatggatggaaccttatgagaaagcttacaagcaggggggcaaatgtacttgcacaaacgctgttatggcctggggtatctgacttgactgggtctttccgactctacaggaaatccgtcctcgaagatgtgattaattcatgttttagcaaagggtatgtatttcagatggagatgattgttagggcgtcaaggaaaggttatcacattgaagaggtccctataaccttcgttgacagggtgtatggcagttcaaagttaggaggatcggagattgttgaatatctaaaaggcctcgtctatctactgttcacaacataacttgaagttctcagtaaatttgtctcgaatcatggatgtcaactatttactagtggaatgctagggttcctaacaatcaattcaagacag

SEQ ID NO: 5106 - DNA, 1077 bp, Brassica napus
ctactaggcggattaagacgacgaagaaagctctctccgtagtaaaagttaggcttttgatcggctgctatggcggaggagaaggagaggaaaggagagaagaagtataagtatagcgtaatcgttcctacgtacaacgagcgcctcaacattgctcttatagtctacctcattttcaagcatctccgggatgttgattttgagataattgttgtggatgatgggagtcctgatggcactcaagaaattgtcaagcaactgcaggacttgtatggtgaagaccgcattcttttaagagctagagccaagaagcttggtttgggaacggcatatatccatggtttgaagcatgctacaggtgatttcgttgtaatcatggatgctgatctttcacatcatccaaagtatttgccaagtttcatcaagaaacaactagagacgaatgcaagtatagtgactggtacacgatatgtaaaaggtggtggtgtgcacgggtggaaccttatgcggaaactcacaagcagaggagcaaatgtgctagctcaaacactattatggcctggcgtatttgatttaaccggatcattcaggctatacaagaaatcggtgcttgaagacgtgataagctcatgtgtgagtaaaggttatgtcttccagatggaaatgatagttcgtgcgaccagaaaaggataccatattgaagaggtaccaatcacatttgtggatagagtctttggaacttcgaagctgggaggatccgaaatagtggaatatctaaaaggactcgtctatcttcttctcacgacttaagagatgacaccaaccacagctcaacaacacatgaatctcttttagtatttatactctccttaacactagaactctgatcatgtcttttaaaaattctcgttacctttgaaaatcaaataaaacaaagagaagcatgtaaagaaaaagactttttccaactacttactaatagtttaagtagttacaatcaaaaatcaatgacttcgaagtcatgcttcttcgagtgaaaactctgtacgtttataaataagaaaaaaagttgtgaat

SEQ ID NO: 5107 - DNA, 1027 bp, Arabidopsis thaliana
gtacagacgacggctgatttcacgggttaagacgaaggaaccaccgttaccaaaactcgccggaagagatggcggacgagatggagaccaaaggagagaagaagtacaagtatagcataatcattcctacctacaacgagcgcctcaacatcgctatcatagtctacctgattttcaagcatctccgggacgttgattttgagataattgttgtggatgatgggagtcctgatggcacacaggaaattgtcaagcaactgcagcaattgtatggtgaagaccgtatccttttaagagctagagccaagaagcttggtttgggaactgcatatattcatggtttgaagcatgctacgggtgatttcgtcgtgatcatggatgctgatctttcacatcatccaaaatacttaccaagtttcatcaagaaacaactagagacaaatgcaagtatagtaactggtacacgatatgtaaaaggtggtggtgtacacgggtggaatcttatgcggaaactcactagtagaggagcaaatgtgctagctcaaacacttttatggcctggtgtatctgatttaacaggatcattccggctatacaagaaatcggcgcttgaagacgtgattagctcatgtgtgagtaaagggtatgtctttcagatggaaatgattgttcgtgcaaccagaaaaggataccatattgaagaggtaccgatcacttttgttgacagagtctttggaacttcgaaactcggaggatctgaaatagtggaatatctaaaaggcctcgtctatctcctgcttacaacttaagacacaccaagcaactcaacaacacacgagtctctctttatactcttcatttgttccattgcttcatagatttctcttaacagttgaactctgatcatgtcgtttagaaacttcacttactttgacttcagagagtcgcatcttttaagactcaaaagttcatattatagacattgttgattttgaatgttgagttgagatatcttacatttcataaa

SEQ ID NO: 5108 - DNA, 1086 bp, Brassica rapa
aacattaattgagtactttagactttacttttccgtacagagagtcacagagacgacggttgatttcacggagagccgatcggggaggttaagacgacgaaggaagctcgcgttattgatcgggtgctatggcggaccagaatgagacgaaaggagaggagggaaagcacaagtatagcataatcgttcctacctacaacgagcgcctcaatatcgctctcatcgtctacctcattttcaagcatctccgggatgttgattttgagataattgttgttgatgatgggagtcctgatggcactcaagaaatcgtcaagcaacttcagcatttgtatggtgaagaccgcattcttctaagagctagagccaagaagctcggtttgggaactgcgtatatccatggtttgaagcatgctacaggtgatttcgttgtgatcatggatgctgatctttcacatcatccaaagtatttgccaagtttcatcaagaaacaactagagacaaatgcaagtatagtaacgggtacacgatatgtgaaaggtggtggtgtacacgggtggaatcttatgcgtaaactcacaagcagaggagcaaatgtgctagctcaaacccttttgtggcctggtgtatctgatttaaccggatccttccggctatacaagaaatcagtgcttgaggacgtgataagttcatgtgtgagtaaaggttatgtttttcagatggagatgattgttcgtgctaccagaaaaggataccatatcgaagaggtgccgatcacttttgtggatagagtctttggaacttcgaagctgggaggatctgaaatagtggaatatctaaaagggcttgtctatcttctcctgacgacttaaagagacaccaagcagctcaacacacacatgaatctttctttatactcgtcacttaacacctgaactctgatccatgtcttttagaacttcactttagctttgactacggagacatagttttgcttctttcaaagactcgaaacgttcgtttcgaatgctctattctctctaccataggtgatgggcttatcttatggtaatgggctttactgtt

SEQ ID NO: 5109 - DNA, 997 bp, Brassica napus
agactttacttttccgtacagagagtcacagagacgacggttgatttcacggagagccgatcggggaggttaagacgacgaaggaagctcgcgttattgatcgggtgctatggcggaccagaatgagacgaaaggagaggagggaaagcacaagtatagcataatcgttcctacctacaacgagcgcctcaatatcgctctcatcgtctacctcattttcaagcatctccgggatgttgattttgagataattgttgttgatgatgggagtcctgatggcactcaagaaatcgtcaagcaacttcagcatttgtatggtgaagaccgcattcttctaagagctagagccaagaagctcggtttgggaactgcgtatatccatggtttgaagcatgctacaggtgatttcgttgtgatcatggatgctgatctttcacatcatccaaagtatttgccaagtttcatcaagaaacaactagagacaaatgcaagtatagtaacgggtacacgatatgtgaaaggtggtggtgtacacgggtggaatcttatgcgtaaactcacaagcagaggagcaaatgtgctagctcaaacccttttgtggcctggtgtatctgatttaaccggatccttccggctatacaagaaatcagtgcttgaggacgtgataagttcatgtgtgagtaaaggttatgtttttcagatggagatgattgttcgtgctaccagaaaaggataccatatcgaagaggtgccgatcacttttgtggatagagtctttggaacttcgaagctgggaggatctgaaatagtggaatatctaaaagggcttgtctatcttctcctgacgacttaaagagacaccaagcagctcaacacacacatgaatctttctttatactcgtcacttaacacctgaactctgatccatgtctttagttttgcttctttcaaagactcgaaacgttcgtttcgaatgctctattctctctaccatagg

SEQ ID NO: 5110 - DNA, 949 bp, Brassica napus
tgatcgggtgctatggcggaccagaatgagacgaaaggagaggagggaaagcacaagtatagcataatcgttcctacctacaacgagcgcctcaatatcgctctcatcgtctacctcattttcaagcatctccgggatgttgattttgagataattgttgttgatgatgggagtcctgatggcactcaagaaatcgtcaagcaacttcagcatttgtatggtgaagaccgcattcttctaagagctagagccaagaagctcggtttgggaactgcgtatatccatggtttgaagcatgctacaggtgatttcgttgtgatcatggatgctgatctttcacatcatccaaagtatttgccaagtttcatcaagaaacaactagagacaaatgcaagtatagtaacgggtacacgatatgtgaaaggtggtggtgtacacgggtggaatcttatgcgtaaactcacaagcagaggagcaaatgtgctagctcaaacccttttgtggcctggtgtatctgatttaaccggatccttccggctatacaagaaatcagtgcttgaggacgtgataagttcatgtgtgagtaaaggttatgtttttcagatggagatgattgttcgtgctaccagaaaaggataccatatcgaagaggtgccgatcacttttgtggatagagtctttggaacttcgaagctgggaggatctgaaatagtggaatatctaaaagggcttgtctatcttctcctgacgacttaaagagacaccaagcagctcaacacacacatgaatctttctttatactcgtcacttaacacctgaactctgatccatgtctttagttttgcttctttcaaagactcgaaacgttcgtttcgaatgctctattctctctaccataggtgatgggcttatcttatggtaatgggctttactgtttgacaactctaca

SEQ ID NO: 5111 - DNA, 1033 bp, Pennisetum glaucum
cggggccgtcaatggaggcggcggcgggcggcaagcgcacgtacagcatcattgtgcccacctacaacgagcgcctcaacgtggccctcatcgtctacctcctcttcaagcacctccgggatgtgaactttgagatcattattgtggatgatggtagtccagatggaactcaagacattgtaaaacaattgcagcaagtatatggtgaagatcgtgttttactgcgagctaggccaaggaagctaggacttggtaccgcatatttacatggattaaagtatgcctcaggggaatttgttgttatcatggatgcggacctatctcaccatccaaagtacttgccaagctttattaggaagcaaaaggaaactggtgctgatgttgtaactggcacacgttatgttaagaatggtggtgtccatggttggaatctcatgcgcaagctaactagcagaggagcgaatgttcttgcacagactttactacaacctggagcttcagatttgactggatcgttcaggctatataagcgagatgtcctggaagatttaatatccttatgcgttagcaagggctatgtgttccaaatggaaatgattgttagggctactaggaaaggttaccacattgaagaggttccaataacgtttgtcgacagagtctttggaatttcaaaacttggtggatccgagatagtcggatatttgaaaggactcgtgcatctgttgctgacaacatgattgaagatttaccgtaggcatccactttgtgagtaaaatcgtgttacagataattttgctgacacgtcactgcagcagaagtttcgtatcactacttatgtttgcaacttgtgaatggatcatcgcaagtctcggtttgtcagtgcattatttcagacaacatgatgcccccgcctttctatcgagtttcagtacttttgttaaatggtttattttttcgacgtggaatgcaaatgtttgctatattttgtggctttgcatccgttatttttacagcggtatgaacagttgct

SEQ ID NO: 5112 - DNA, 1237 bp, Oryza sativa
aatggaccttgcggtggcgaagcaactcctcgacgagacttcacgccggccgccctgctcgtcgtcgccggcggcatctgcggcgcgcgcgcgtcatcctcatccccagctaagtggcctcaccgtcaccgagcgcccgcgtcggatcgcgtgcgggagagagcggggggcggagagatctggtgcgaggtcgagtcggggcgccggcgatggcggacgacgcgggcggcggcaggcgcgagtacagcatcatcgtgcccacctacaacgagcgcctcaacgtcgccctcatcgtctacctcatcttcaagcacctgccggatgtcaactttgaaatcatagttgtggatgatggaagccctgatggaactcaagacattgtaaagcagttgcagcaaatatatggtgaaaaccgtgttctgctgcgagctagaccgaggaagctaggacttggtactgcatatttacatggactaaagcatgcctctggggacttcgttgttatcatggatgctgacctatctcaccatccgaagtacttgccaagcttcattaggaagcaaaaggaaactggtgctgatgttgtaactggcacccgttatgttcagaacggtggtgtccatggttggaatctcatgcgcaagttgactagcaggggagcaaatgttctagcacaaacattactacagcctggagcttctgatttgactggatcattcaggctatataaacggaatgtcctagaagatttaatctcctcgtgtgtcagcaagggatatgttttccaaatggaaatgattgttagggctaccaggaaaggttatcacattgaagaggttccaataacttttgtcgatagggtttttggaacttcaaaacttggtggatctgagatagttgagtatctgaaaggccttgtttatctgctgctcactacatagggaaaaaaccgctaggcgcttaactgtatcagacacaactcgtgatagaggaacttcaatttgttatatctacagttttgagttgcgtgaattactgattttctgacttgccagtgggttctcgtacagtgtatttggtgtgtaagtacactttcatgagcaagggcaagaacacaattgtaccatctatatatgaactgcagagaaagctttgggtacggttgcttgtgttctacactttttttaggtaaacctcaaagaggactgggagcaactgttttcattgaagaagaaga

SEQ ID NO: 5113 - DNA, 746 bp, Guizotia abyssinica
aatctacgattgaagatttagggtttttgatctgcgaatggcggaacggcacaagtatagcataatcgtcccaacttacaacgaacggctcaacatcgctctgatcgtcttcctcgtcttcaaacacataccggatgttgactttgaaataataattgtggatgatggtagtcctgatggaactcaagatattgtcaaacagttgcagcaagtctatggagaagaccgcattctactaagagctagaccgaggaagcttggattagggactgcttacattcatggtctgaagcatgcttcaggaaattttgttgtaatcatggatgctgatctgtcacaccatccaaagtacctcccacactttataaagaaacaaatggaaacaggtgctgatattgttactgggacccgttatgtaagaggtgggggtgttcatggttggaccctgatgcgcaagttgacaagtagaggggcaaatgttcttgcacatacacttctttggcccggtgtatcagatttgacgggctcatttcgtctttacaagaaatctgtgcttgaagacattataagctcttgtgtgagcaaaggatatgttttttcaatggagatgattgtccgagcttcaagaaaggatatcatatcgaagaagttcaataaactttgtcgacagagtttatggaagttccagcttggtggatcagaatagtcgagtatttgaaggtctcgtgtaccttctttcacacgta

SEQ ID NO: 5114 - DNA, 1057 bp, Hordeum vulgare
cggcacgaggctggcccggtaggctgcttcgctagcacgctctccctctgccgccggacctcctcttgccgcgcggcggtcctctcctctcggccccagctctctcccccgtccgcgaaagcgacaatcagctgcggcggcccgaatccagggtggggcagatctgctgcgctgctctggtcggtcggctatgaagaatggagcggaggcgggcggcggcaggccggagtacagcatcatcgtgcccacctacaacgagcgcctcatcgtcgccctcatcgtctacctcatcttcaagcacctgcctgattccaagttcgaaattattattgtggatgatggaagccctgatgacactcaagacgttgtaaagcaattgcagcaattatatggtgaagatcgtgttctactgcgagctagaccaaggaagctaggacttggtactgcatatatgcatggactaaagcatgcctcaggggagttcgttgttataatggatgcagatctatctcatcatccaaaatatttgccaagcttcatcaggaagcaaaaggaaaccggcgctgacattgtaactggcacccgttatgttagcaacggtagtgtccatggttggaatcttatgcgtaagttgactagcaggggagcgaacgtcttagcacagacgttgctacgacccggagcttctgatctgactggatcatttaggctatataagcgaagtgttttggaggatgttatctccagctgcgtcagcaagggttatgtattccaaatggagatgattgtcagggctactaggaaaggttatcacatcgaagaggtcccgataacttttgtcgacagggtcttcggaatctcaaagcttggtggatccgaaattgttggatatttgaaaggccttgtgtatctgttgctcacaacataggggagacaacatggtagatgcttgaccgactcctgttagagtgtttttcctcttatgttgtcacagcttgagttgcataaattttgctaacattctcagatttacaattgaattatgtatagttttcac

SEQ ID NO: 5115 - DNA, 997 bp, Cucurbita pepo
cttcggagagctcatcgctgcgcccagaatctagaagggagcggaatcaaagtttccgtcgatcaccttgcagttgatttcgcgatcgttgactataggaattcttggttgaagagcaatctctaagcgtatacgtgatccgattcatggcggagcaggagaaagagaggaataagtacagtttaattgtcccaacctacaacgagcgcctcaatattgctcttcttgtttacctcattttcaagcacctcccggatgttgattttgaagtaattgtcgttgatgatggaagtcctgatggtactcaagaagttgtgaaagagttgcaaggggtatatggtgaagatcgcattctattgagagccagacctaggaagcttggcttaggaacggcttactgtcacggtctcaagcatgcaactggcaattttgttgttataatggatgctgatttatcccaccatcccaaatatttaccaagcttcattcggaaacagttacaaacaggtgctgatatagttacaggcacccgatatgtgaaaggtggcggtgtgcatggatggaatcttatgcgcaaactaacaagtagaggagctaatgttcttgcccaaacacttttatggcccggtgtatcagatttaactggatctttccggctctacaagaaatctgtgcttgaagatatcattagttcagttgttagcaagggatatgtctttcaaatggagatgattgttcgagctacaagaaaaggctatcacattgaagaggttccaataacctttgttgatagagtgtttggaatttccaagcttggaggatctgaaatagtagagtatttgaaaggtctgttgtacctttggtcaccacatgatacacaaaatagtgaaatttattgagttactaccaggtaagcttcttgtttgatttctggttaggtacccaccacctccaggtcttttgatgtaaacttgagatgattatttcctaagtttac

SEQ ID NO: 5116 - DNA, 742 bp, Helianthus annuus
ggcggggattcaatttgaatcgagtattagggtttttgatctgcaaatggcgaacaagtatagcataatcgtcccaacttacaacgaacgcctcaacatcgctctcatcgtcttcctcgtcttcaagcatataccagatgttgactttgaaataataatcgtggatgatggtagtcctgatggaactcaagatattgtcaaacagttgcagcaagtctatggagatgaccgcattctactaagagctagacccaagaagcttggattagggactgcttacatttatggtctgaagcacgcttcaggaaattttgttgttatcatggatgctgatctgtcacaccatccaaagtacctcccacactttataaagaaacaagtggaaacgggtgctgatattgttactgggacccggtatgtaaaaggtggaggtgttcatggctggaccctgatgcgcaaattgacaagtagaggggcgaatgttcttgcacatacacttctttggcccggtgtatcagatttgacgggctcgttccgtctttacaaaaagtctgtgcttgaagacattataagctcttgcgtgagcaaaggatatgtttttcaaatggagatgattgtccgagcttcaagaaaaggatatcatatcgaagaggttccaataacctttgtcgaccgtgtttatggaagttccaagcttggcggatcagaaatagtcgagtatttgaagggtctcgtttacctt

SEQ ID NO: 5117 - DNA, 1161 bp, Gossypium hirsutum
gtcagcattgtagctcaattatgggagtccggctatgagattaaccgagttggtaccttctcggttgaagcgacctgctttgttcctatgccttagcccaatttcaaggtagtctagcaagcaaaagtcagcatcccgattcatcgttgaaaaattcaaatgagaaatgagtcagcgaaacaaaagaacacacagaaataaagatttaggccaaggtatttacacagaagaagaaaaaatggagcagaagaacaagtacagcataatagtacctacttacaacgagcgcctcaacattgctctcatcgtctatctcatcttcaaacatctccgggatgtagattttgaaataattgttgtggatgatgggagccctgatggtactcaggaagttgtgaaacaactgcagaaactgtatggtgaagatcgtattctattgagacctagacctaagaagcttggattgggaacagcttacattcacggtttgaagcatgcttctggaaattttgttgtaatcatggatgctgatctgtcacatcatccaaaatatttgccatgcttcatcaagaagcagtctgaaactggtgccagcatagttaccggaacacgatatgtcaaaggtggtggcgtgcatggatggaatctgatgcgcaagctaacaagtaggggagccaatgttcttgcacaaactcttttgtggcctggtgtatcagacttaactggctctttcaggctttataagaaatcagtgcttgaagatgtcattagctcctgtgttagcaagggatatgtatttcaaatggagatgattgttagggcttcaagaaaaggttatcacattgaagaggttccaataacttttgttgatagagtgttcggaagttcaaagcttggtggatctgaaattatagagtatcttaaaggcctttcatatcttttggtcacaacatgagccctgagattggctgagtaagctttgcagcgaacaatttttatggcttagttcttactagttcctttgtaacctgactttttgatggctaatttagttggtattttgctactggattgaagatgttattcaatggaattgaagatgcaaaacctagggcgggattgcattttacaggcttaacaacaaaaagaaaaaagtaccga

SEQ ID NO: 5118 - DNA, 998 bp, Fraxinus spp
cggccggggggactgacccgaaaagagaagttggaaacaggtacccgtattggcttaatatggatctcggttgtgattcaacctaacccattccgggaggaacgacgggaaatcacagtgaaatggaaaatcagcaatcggagaagagttctgcaaagtatagcataatagtgcctacctacaatgaacgcctcaacatcgctctcattgtttacctcatcttcaagcatctttcggatgttgactttgaaataatagtagtggatgatgggagtcctgatggaactcaggatattgtcaaacaattgcagcaagtatatggagaagatcgcattctgttgagacccagacccaagaagcttggcttagggactgcttacatgcatggtctgaagcatgcctctggcaattttgttgttataatggatgctgatttatcacaccatccaaaatacctgccgagcttcatcaagaaacagatggaaacgggtgcgagcatagtcactggaactcgttatgttaaaggtggcggtgtgcatgggtggaatcttatgcgtaaattgacgagcagaggggcaaatgtccttgcacagacttttctttggccaggtgtatcagacttaactggatcgttccgtctttatcgtaaatccgtgcttgaagatgtaataagctcttgtgtgagtaaagggtatgttttccagatggagatgattgttcgggcttcaagaaagggttaccacatagaagaggttccaataacttttgttgatagagtatgtggaagctcaaagctgggagatcagaaatagttgaatatttgaagggacttctgtaccttctcgttacaacttgaaaatgaattagaaagttagtcgtatctacgtatagattctactaatttgacagctgtactatttatacgttaaaagttataacgagtacaagtaatctactactatagtagtttacacttcgtaactatacaacattagtag

SEQ ID NO: 5119 - DNA, 1241 bp, Phalaenopsis aphrodite
gtagagagcaacgaaggaaagaaggtaaagaagttaaaaaaaaacaatttacggattttacagaaaccacagacgactagaagctaggacgtcgtgactggagttcacgacgggaagagcttttgtatttctacgttcatcgatctttttccactgatcaccgccaaatcctcttgccgtcttagttctttcactggaatcggtttctcatttctctcgaatggagctctagtccgccccgtcattcgcagcaaattatgatactggactgccctagcatttccaatcgttttcttcagacctaattgtttggagctttttggtcgaagatggaaaatagtaacaaatacagcatcatcatacccacctacaacgagcgcctcaacatcgcactgcttgtgtacctcgtcttcaaacacctccgggaattcaattttgaagtcataattgttgatgatggcagtcctgatggtactcaagacattgtaaaacaactgcagcaactatatggcaaagagcgcattctattaagagcaagaccagagaagcttggtctaggaactgcctattgtcatgggctgaagcatgcaactggagattttgttataatcatggatgcagatctgtcccatcatccaaaatatttacctagtttcatcaggaagcaaacagaaactggcgccagtatagttactggaacccgctatgttagagggggcggtgttcatggctggaatcttatgcgcaaattgactagcagaggagctaatgtattggcgcagacatttttatggcctggtgtgtcagatcttactggatcctttaggctttataagaaatctgttcttgaagatgtcttgggctccgtcgtaagtaaaggatatgtatttcagatggagattattgtccgagccagcaggaaaggctatcatattgaagaagttccaataacatttgtggacagagtttatggaacttccaaactgggaggatctgaaatagttgaatacctcaaaggcctcatttacttgcttttcacaacataatttagaggataattgaaggaatgctgccagattatttttttcttactggtatatacttctttcccctgattaattttgtattattcagtcgtaaaactcttgcacgttgaactgtttttggttttgttgcatacgtttaatggtcactagcatgaaaaattagtctgttgtagttgttgtcaaattacttttttc

SEQ ID NO: 5120 - DNA, 1256 bp, Brachypodium distachyon
ctctgcacgaacacgagctcccgtcccgatctgcacgagcacgaggccggcgagccgtctctcttctctcttctctctgcctctgccctgcccccacccgtctctctactcccctctgcacgatctgcacgagcacgcgtcgctggcggagacttccgcacccgcgcccgctgttccccaagctggacgcatcggcggtgacctcctcggcggcggagatttccggcgaggcggcgatatttgggatgggggagaaggagatggagcacacggtcgatcgtctcaaccggccggcatacagcatcatcgtgcccacctacaatgagcggctcaacgtcgccatcatcgtctacctcatcttcaagcacctcccggataccaactttgaaataattattgtggatgatggaagccctgatggaactcaagacattataaagcagctggagcaactatacggcgaagatcgtgttctactccgagcaagaccaaagaagctaggacttggtactgcgtatctacatggattaaaacatgccacgggtgactttgttgttataatggatgctgatctatctcatcatccaaagtacttgccaagcttcattaggaagcaaaaggaaaccggcgctgacattgtaaccggcacacgttatgttaacaacggtggtgtccatggttggaatctcatgcgcaaattaactagcaggggagcaaatgttctagcacaaacattactacagcctggagcttccgatttgactggatcatttaggctatataagcgaagtgttttggaagatttgatctcctcatgcgtcagcaagggatatgtattccaaatggagatgattgttagggctactagaaaaaattatcacattgaagaggtcccaataacttttgtggacagggtctttggaatttcaaagcttggtggatccgaaatagttggatatttgaaaggcctcgtgtatctgctggtgacaacttagtggaaagactaatgccaaaaggagacatgggaaagatagagtagataatgcatgactgttataggacaactctataacattgctaatgcttccagacctattattgaatcagtacacaagttatgttttattactatccttctgaattgtgtggctgcttgtgttttctgccacatatatcttgcctgagatgatcgtccagagaattcatgcttcaagttgagtaaactatgattggatatcaatgaaaagcaagcggcc

SEQ ID NO: 5121 - DNA, 721 bp, Cynara scolymus
cgggaacgacggctcacatcgccctcatcgtcttcctcgtcttcaagcatataccggatgttgactttgaaataataattgtggatgatggtagtcctgatggaactcaagatattgtcaaacagttgcaacaagtgtatggtgacgatcgcattctattaagagctaggcctaggaagcttggattagggactgcttacattcatggtctgaagcatgcttcaggaaattttgtcataatcatggatgccgatctatcacaccatccaaagtaccttccacactttattaagaaacagatggagacaggtgccagtattgttactggaactcggtatgtaagaggtgggggcgtgcatggttggactttgatgcgcaaattgacaagtcgaggggcgaatgtccttgcacatacgcttctttggcctggtgtatcagacttgacaggctcgtttcgtctttacaagaaatccgtgcttgaggacattataagctcctgtgtgagcaagggatacgttttccagatggagatgattgtccgagcatcaagaaaaggataccatatcgaagaggttccgatcacttttgtagacagagtttatggaagttcgaagcttggtggatcagaaatagtggaatatctgaagggtctcgtgtatctcctcgttaccacgtaaaggaagaaggtacccaccatttgatcatcaaaccagcattgctt

SEQ ID NO: 5122 - DNA, 645 bp, Pisum sativum
gagcagaaaaacaagtacagtataattgttcctacgtatgacgagcgactcaacataagcctcattatttaccttatattcaagcaccttccggattttgactttgaagttactgttgtggacgacgggagtcctgatggtactcaggatattgtaaaacaactgcagcaggtttacggagaagatcggattctgttacgagcgagacctaggaagatgggtttaggaacggcctatattcatggcatgaagcatgcatctggaaattttgttgtcattatggatgccgatctatcacaccatccaaaatatttgcccggcttccttaggaagcaattggaaacgggtgctgatatagttacagggactcgttatgttaaagacggtggagtgcatggatggaatcttatgcgcaaactaactagcagaggagcaaatgttcttgcacaaacacttttatggcccggtgtctcagatttgacagggtcgtttagactttataagaaatcagtgctcgaagatatcattagctgctgtgttagtaagggatatgtctttcaaatggagatgatagtaagagcatcgcgaaaagggtaccatatcgaagaggtgccaatcacgtttgttgatagagtatatggaagt

SEQ ID NO: 5123 - DNA, 751 bp, Sciadopitys verticillata
ttcggaagaaatgggtagcgagggagattcgtctaagtataagtacagcatattgatccctacatataacgagcgtctcaatattgctctggtcacctacctcatcttcaagcacctcagtggcatcaattttgagattattgttattgatgatgctagtcctgatgggactcaagaaattgtgcaacagttgcaaaaagtttacggggaagaccgcatactgctgagaccaagaccgggcaaactgggtttaggaactgcatatatgcatggcctcaagcatgcctcaggagattttgttgttattatggatgcagatctttctcaccatccaaagtatttgccaagtttcataagaaagcagatagagactagtgctgatattgtcactgggacacgctatgtaatgggaggaggcgtgcatggttggaatcttatgcgtaaactcacaagccggggagcaaatgtgcttgcacaaacactcttatggcctggtgtttctgatttaactggatcatttcgactttacaggaaacctgcacttgaggaccttattaagtcctgcgtcagcaaaggatatgtttttcagatggagatgattgttcgggcttctcgaaaacagtaccacattgaagaggtacccattacttttgttgatcgggtttatggcagctccaaacttggaggatctgagatagttcagtatctgaaagggcttgtttatcttttctaaccacataatggacttttg

SEQ ID NO: 5124 - DNA, 1042 bp, Sequoia sempervirens
gccctctctatatctgcctacgcaaatttcgtttggacaaatcaatcagcagtttcattatcaattatagcgcaatcagcaaaggtgtgtcaattggaggagtattttcacttctgtgaagggaagttctctgcataggcattgtttgctctggagatccattttgaaaaagattaacagattattttgtgggagaaatgggtaaagagggagacccatcatcttacaagtacagcatattaatccctacatataatgagcgtctcaacattgctcttgtcacctacctcatcttcaagcatctcagtggcatcaattttgagattattgttgttgatgatgcgagtcctgatggtactcaagaagttgtgcaacagttgcaaaaagtttatggggaagaccacatactactgagaccacggaagggaaaactggtttaggaactgcatatgtgcatggtctaaagcatgcttcaggagaatttgttgtcataatggatgcagatctttctcaccatccgaagtatttgccaagtttcataaaaaagcagatagagactggtgccgatattgttactgggacacgctatgtaaaaggaggaggtgtacatggttggaatcttatgcgtaaactaacaagccgaggagcaaatgtgcttgcacaaacactcttatggccaggcgtttctgatttaactggttcatttcgtctttacaggaaacctgtacttgatgaacttattaagacctgtgtcagtaaaggatatgtttttcagatggagatgattgtccgggcttcaaggaaacattacaacattgaagaggtgcctattacttttgttgaccgggtctttggcagctccaaactagggggttctgaaatagttcaatatctgaaagggcttgtttatctgtttctaaccacttaatggaattttgttgattctaaaatttatgttgaataatggctgtacttttcttgccaatctagattctctgattagtcacattaaatatagtggaagatataattttaattcttt

SEQ ID NO: 5125 - DNA, 1173 bp, Prunus persica
attgctgatgaattagaacgagtgaatgagaaattgagaatggagaagaacaagtacagcatcatagtcccaacctataacgaacgcctcaacattgccctcctcgtctacctcatcttcaagcatctccgggacgttgactttgagataatcatcgttgacgatggaagcccggatggtactcagcaggttgttgagcaattgcagcaactctatggtgaagatcggattctgttgagagctagagctaagaagcttggattaggaacggcttacattcatggtttgaagcatgcgtctgggaattttgttgtgatcatggacgcggatttatcacaccatccaaagtatttgccaagcttcatcaagaaacagttggaaactggtgcaagtatagttactggaactcgttatgtcaaaggtgggggtgtacatgggtggaatcttatgcgcaaattaacaagtagaggagccaatgttctggcacaaacacttctatggcctggtgtatcagatttgaccggatcttttcggctttacaggaaatcagtgcttgaagatatcatcagttcctgtgtcagcaagggctatgtctttcagatggagatgatagttcgagcttctagaaaaggctaccatattgaagaggttccaatcagctttgttgatagggtatatggaatttcaaagcttggaggatctgaaattgttgaatatctgaaaggccttgcctatcttctcgttacaacccagctcttccacttcacaaaactcttcatgaactgccggaaaaaattgccggaactcagcatggtgggaatactctaatcacgtgcagtgctacgtgctgtcacctgatggaatttgctaaccataataaaatagtgatagcataagggagttaagaggagagatcgtggttaaagcgtagacttgattggcaacagagtgagcagtcgacacaagcaagctttgcatttgggttggttgggaaatatatctggcatgactcactgtctctccaatctcatttgaccatgctttgttcatgttcacccttccgacattgttgacgcagtttaagtctaggccaaatggtgtgatttgaagagacaaaaatgtaaagtttcatgatagagatgctaattaggacgtgtttatgaggctcttcac

SEQ ID NO: 5126 - DNA, 1456 bp, Pinus taeda
ggggatctttctttgtttctgtttcaagtaaatgagagaagcgacgaaaacttcaaattttcggagcgacagacgaaaagggacaaggctgaacgcattgattgcccccggaatcatttaggcggtgggaggtttcagagatggagagacagcgaggctcttcgtcctcttcgctgaagtacagcatattgatccccacttacaacgagcgtctcaatattgctctggtgacctacctcatctttaaacacctcagtgatatcaatttcgagattattgtcattgatgatgctagtcccgatagaactcaagaagttgtgaaacaattgcagcgtgtttatggtgaaagccgcatactactgagaccaaggcaaggcaaacttgggctaggaactgcatatgtgcatggcctcaagtatgcatcaggagatttcgtcatcattatggatgcggatctctcccaccatccaaagtatttgccaagtttcataagaaagcagatagagacaagtgctgatattgttactgggacacgctatgttaaagggggaggtgtacatggttggaaccttatgcgtaaactcacgagccggggggcaaatgtccttgcacaaactctactgtggcctggtgtttctgatttaactggatcatttcgactttataggaaatctgtactcgaggaccttattaaggcctgtgtaagtaaaggatatgtctttcagatggagatgattgttcgggcttctcggaaacattatcacattgaagaggtacccattacttttgttgatagagtttatggcatctcaaagcttggaggatctgaaatagttcagtatctgaaaggtcttgtttatctgtttctaacgacgtgatgtgattttgtttagctgtaaatgggcactttttaggttgaaggataggcatgcattttttgtgaacccagattttgtgcttggtttccttaaatatgtcaggcaaaaagttttcttttaactggtcattgtcagaatggaaaatgagtgctagaaacatgtgtacattatgaaatattgctagattcgatttaaaagaaatggcaaaggccatagatgatccagtgtgtcttagtgcaaacaacaaaaatatcctaatagaataagcaaagactcgctggacaatatacaaaaagagagcttactacagaggatggaccaatatagaattcattaagaggttggaaacaaatgaggaaaataaagcctttgtagggactatcaatgaagtatgcaatggactacaatatttatttatactgtttggaagaattctttgttatcttatttgaacttccgttgggagttcaacttccaaagttatttgcatttgcacacaagccagaatttccagctaggaattgtattaaaggaattctagctgtatttttttgttccgagtactttattatgagtta

SEQ ID NO: 5127 - DNA, 1255 bp, Picea glauca
aaatttttcgagagacagactacaagggacgaggctcaacaccttgactgacaccgaaatcattttggcggacggagattacagagatggagagaccgcgaggttcttcattgtcttcgcccaagtacagcatacttatccccacttacaacgagcgtctcaatattgctctggtgacctacctcatcttcaagcacctcagtgatatcaattttgagattattgtcattgatgatgccagtcccgatggaactcaagaagttgtgaaacaattgcagcatgtttatggtgaaagccgcatactactgagaccaaggcacggcaaacttgggctaggaactgcatatgtgcatggcctcaagtatgcatcgggagattttgtcatcattatggatgcagatctctcccaccatccaaaatatttgccaagtttcataagaaagcagatagagactagtgctgatattgttactgggacacgttatgttaaaggaggaggtgtacatggttggaaccttatgcgtaaactcacgagccggggggcaaatgtccttgcacaaactctactgtggcctggtgtttctgatttaactggatcatttcggctttataggaaaactgtactcgaggaccttattaaggcctgcgtaagtaaaggatatgtctttcagatggagatgattgttcgggcttctcggaaacattaccacattgaagaggtacccataacttttgttgatagagtttatggcatctcgaagcttggaggatctgagatagttcagtatctgaaaggtcttgtttatctgtttctaaccacatgatggatatttgttaagctgtaaatgggcactttttaggatgaatgacagtcatgcatttttcatgaacccagattttgtgcttggtttccttgaatgtcaggcaaaacaatttcttttatttaactggtcattgtcagagtggaaaatgagaaacagaaacgttcgtacattatgaaattttgttagatttggtttgaaagaaatggtaaaggccatagatgacacagtgtgccttactgcgatcaacaaaaatattctaatagaagaaacaaagactcactggacaatcaacaaagacagagcttactacgttggagctatatagaattcattaagaagttggaaacaaatgagaaaaataaagctttttgtaggaactatcaatgaagtgtccaatggaatacaatatttatactgtttggaagaaaaaa

SEQ ID NO: 5128 - DNA, 768 bp, Cirsium arvense
cttcttggtctcctttgatcatcatcattaataaacctgtatctgattctgaatttccaagttaaaatcgaaattgggagtttagggtttttgatctgcaaatggcggaaaaccagaataagaacaagtatagtataatcgtcccaacttacaacgaacgactcaacatcgctctcatcgtcttcctcgtcttcaagcatataccggatgttgactttgaaataataatcgtggatgatggtagtccagatggaactcaagatatcgtcaaacagttgcagcaagtctatggtgacgatcgcattctattaagagctaggcctaggaagcttggattagggactgcttatattcatggtctgaagcatgcttcaggaaattttgttgttatcatggatgccgatctatcacaccatccaaagtaccttccacactttattaagaaacaaatggagacaggtgccagtattgttaccggaactcggtatgtaagaggtgggggcgttcatggttggactttgatgcgcaaattaacaagtagaggggcgaatgtccttgcacatacgcttctttggcctggtgtatcagacttaacaggctcgtttcgtctttacaagaaatctgtgcttgaaaacatcataagctcttgtgtgagcaagggatatgttttccagatggagatgattgtccgagcgtcaagaaagggataccacatcgaagaggttccgatcacattcgtagacagagtttatggaagttcgaagcttg

SEQ ID NO: 5129 - DNA, 717 bp, Rosa hybrid cultivar
aagcgcgccactgagcttaatggagaagacgaagaacagtacagtatcatagtcccaacctataacgagcgcctcaacatcgccctcctcgtctacctcgtcgtcaagcatctccgggatgttgactttgagatcatcattgttgacgatggatcccctgacggtactcagcaggtggttcagcaattgcaggagctgtacggtcacgatcgcatcctgttgagagctagagctaagaagcttgggttgggaacggcttacattcatggattgaagcatgcatctggcaattttgttgtgataatggatgcagatttgtcacatcatccaaagtatttgccaagcttcatcaagaaacagttggagactgatgctactatagttactggaacccgttatgtcaaaggtgggggtgtacatgggtggaatcttatgcgcaaactaacaagtaggggggccaatgtacttgcacagacgcttttatggcctggcgtatcagacttgacaggatctttccggctttatagaaaatcagctcttggaagatatcatttagttcctgtgtcagcaagggatatgttttttcagatggaaatgatacttcgggccctctacaaaaggctaccatatcgaagaggttccattcacttttgttgacagagtttatggaattttcaaagctcggaggttctgaaattcgtcccaatatctgaaaag

SEQ ID NO: 5130 - DNA, 855 bp, Pseudotsuga menziesii
acctcgactgcctcgaaattatttggcgcgagagattgcggagatggagagagaggcagcttcttcatgcgcttcgctcaagtacaagtacagcatacttattcccacttacaacgagcgtctcaatatttctctggtgacctacctcatcttcaagcacctcggtgatatcaattttgagattattatcattgatgatgccagtcctgatggaactcaagaagtggtgaaacaattgcagaatgtttatggccaaagccgcatactactgagaccaaggcaaggcaaacttgggctaggaactgcatatgtgcatggcctcaggttcgcctcaggagattttatcatcattatggatgcagatctctcccatcacccaaagtatttgccaagtttcttaagaaagcagatagagactagtgctgatattgttaccgggacacgttatgttaaaggaggaggtgtacatggttggaaccttatgcgtaagctcacgagccggggagcaaatgtccttgcacaaactctactgtggcctggtgtttctgatttaactggatcatttcgactttataggaaatctgtactcgaggaccttattaaggcctgtgtaagtaaaggatatgtctttcagatggagatgattgttcgggcttctcggaaacattaccacattgaagaggtacccattacttttgttgatagagtttatggcatctcgaagcttggaggatctgagatagttcagtatctgaaaggtcttgtttatctgtttctaaccacatgatggaatttccttgagctgtcaattggcactttttaggttggatggcagttgcgtttttttcacgaacc

SEQ ID NO: 5131 - DNA, 1005 bp, Glycine max
ggctttttgaaaatcgaaaggacaaaataaaaagaacagagattagttagtaagtactacagtacaagactagaaaggggagtgtgagttgtatacgcgtattgagccaactttataaggaaagcaattcgcttgcgcttcacatattgtgcggcaactgtctcatcacatctcgcgaatccaagccgaaggggaagggggtttgataaaggttgacattgaaatttgaagccatggttcttgactccattctgacatctcctcgtctcaagtctccatctttcaggagacagtttaaaaaggatgaactgggtagttggtccacacttttccagaggcatcgcttcctcttatctgctcttgttctgctaactctcctctgcactgtttatctttactttgctgtcactttaggggctagtggcacctgttctggtttgactggagcgcagaaagcttcatgccatatggagcttgttaaggattctgtggccaagggtaaactgaaaattctttgatatttcaaaatataattacagggaatattctttctttatttttgcctgagtataggtgacgtgatgaaatccaaatatagtctccggctactgtatcaatcagtgtgactgtgatatgtatacatactattatttatcttggtatttttgagccaaaatgtagaatatatgtagaaagcaatttcttagatacattatgttaattttagtgattgcttcattgacatgaaattttgggcatcttaattgcaaaatgaagtttgagactctgcttatgtataaaattatggccggctcaaagcctcatatttgttatatttgtctgatggtctaatacggcctgccctggggacccccccctttttttttttttaatttttgattctgaatttatattgtattatgtattgctattggtcattggggttaatctaaataattatcgcaatgagtgatactgtttgatcactgcttgcggtatatgatc

SEQ ID NO: 5132 - DNA, 1057 bp, Vigna unguiculata
acaagagagtagttgttagacttgaatgggcggtgcccaaaaagtgttcccaaatcaatacatgtatcaatgtctttcaacaaaaaaatcggcaactggacctgctaatttcaacctaacaaataaaaagtaaaaaacctatgtttgtgtgactttttgaaaatccaaaggacaaattagaattattggaaaagaaaatagagattagtaggataagaagagtgtgagttgtatacgcgtattttaggcacctttatagttgttctggagttgtatatataagaagaggaaatggcgtgcgattcacacattattttgcaaattctgcggcaactgtcttatctcatctcctctcttctctcaaatccaaggcacctcttctaagctgaaggggaaagcttcagggatttggaaaggttgatattgaagccatggttcttgactccatactgtcttctcctcgactgaagtctccctctttcaggaggcagtttacaaaggatgaactgggtagttggtccacacttgtgcagaggcatcgcttcctcttatctgctcttgttctgctaactcttctctgtactgtttatctttactttgctgttactttgggggccagcggcacctgttctggtttgactggagctcagaaagcttcttgccatatggaacttgttaaggattctgtggccaagggtaaactgaaaattctttgatatttcaaaatataattataatggaatatttttttttcttgactttttcccgagtataggtgacatgaaatccaattacggtctccggctgcagtattagtgtggttgatatgtatacatactatttatcttggtatttgtgagtcaaaatgtagaatacatgtagaaagcaatttcttagatatgttatatgttgattttagtaattgctttattgacctaaactttagggcatcgtagttggtaaatgaagtttgaaactgcgtatgcgtgaattatggccggctcgaaccctcatatttgttatatttgactgaattcatattaaattttgttagtca

SEQ ID NO: 5133 - DNA, 539 bp, Phaseolus coccineus
gtgtgagttgtatatgcgtatttgagctacctttatagttagttcttctggcgttgtatatataagaagaggaattggcgtgcgattcacacattattttgcaaattctgcggcaactgtctcatctcttctcgcaaatccaaggcacctcatctaaggtgaagggaaggattcaagagtttggaaaaggttgatattgaagccatggttcttgactccatactgtcttctcctcgactgaagtctccctctttcaggaggcagtttacaaaggatgaactgggtagttggtccacacttgtccagaggcatcgcttcctcttatctgctcttgttctgctaactcttctctgtactgtttatcatttactttgctgtcactttagggcccagtgccacctgttctgggttgaccggagctcagaaagcttcttgccatatggaacttgttaaggattccgtggccaagggtaaactgaaaattctttgatatttcaaaatataattatactggaatattttttctttgactttgtccg

SEQ ID NO: 5134 - DNA, 304 bp, Glycine max
ccatggttattgactccattctgacatctcctcgtctcaactctccatctttcaggaggcagtttaaaaaggatgaactgggtagttggtccacacttttccagaggcatcgcttccttttatctactcttgttctgataactctcctctgcactatttatctttactttgctgtcactttaggggctagtggcacctgttctggtttgactggagcgcagaaaacttcatgccatatggagcttgttaaggattctgtggccaagggtaaactgaaaattctttgatatttcaaaatataatt

SEQ ID NO: 5135 - DNA, 304 bp, Glycine max
ccatggttattgactccattctgacatctcctcgtctcaagtctccatctttcaggaggcagtttaaaaaggatgaactgggtagttggtccacacttttccaaaggcatcacttcctcttatctactcttgttctgctaactctcctctacactatttatctttactttgctgtcactttaggggctagtggcacctgttctggtttgagtggagcgcagaaagcttcatgccatatggagcttgttaaggattctgtggccaagggtaaactgaaaattctttgatatttcaaaatataatt

SEQ ID NO: 5136 - DNA, 468 bp, Glycyrrhiza uralensis
gggctcgcattaccgatggatagatagacacagtcgcattccattctctcatattcccaatcgaagctacagttttgtttctcttcaaccccaagccaagccaaggagaggggaactgaactgaactgaacggcaggcttcgggtgggcaggagaagattcaaggttgttgtaggagccatggttcttgacaccattctgtcttctcctcgtatgaggtccccatctttcaggaggcagtttactaaggatgagctgggtagttggtcaacactcgtccagaggcatcgcttcctcttatctgctcttgttctcctaactctcctctgtactgtttatctttattttgctgtcactttagggtccagtggctcatgttctgggatgactggagcacagaaagcttcatgccacatggagcttgttaaggattctatggccaagggtaaactgaaaattctttgatatc

SEQ ID NO: 5137 - DNA, 623 bp, Cajanus cajan
ccaagtttataaggaaagcattttgtgtggcaagtgtgtcttctcatctttgtttgcgcgaatccaaggccaaggagagaaggcttcaggggtttgaaaaaggttgatattgaagtcatggttcttgactccattctgtcttctcctcgtctgaggtctccatctctcaggaggcagtttgcaaaggatgaactgggtagttggtccacacttgtccagaggcatcgcttcctcttatctgcacttgttctgctagctattctttgcactgtttatctttactttgctgtcactttagggtctagtggcacttgttctggtttgactggagcgcagaaagcttcatgccatatggagcttgttaaagattctatggccaagggtaaactgaaaattctttgatatttcaaaatataactataatggaatatttcttcttcattttttcttttgcccgagtatagatgacatgaagtccaaatatagtctccggctacaccaatagtgtgactgtgatatgtatacatactatttatctcggtatttgtgaggcaaaatgtagaatacatgtagaaagcaatttcttagatacattatgataattttagtcattgcttcattga

SEQ ID NO: 5138 - DNA, 652 bp, Trigonella foenum-graecum
gttgacattcacatcagtcttttgggcggcgagagatcaatctacgttcccgaccgaccgtccgtcgcattccatatccctttcttcttccctgcgcctgtttgttttttccatccaaaccaacacatcaatccaccgttttttcaacccaaccaaacacatcgcaacgcaacttaggcttcaagtgatcagaagaaggttattgtagaagccatggttctcgacagcattctgtctactacttctcctcgtttgaggtctccatctttcaggagacctaaggatgtacttggtagttggtcaacactttaccagaggcatcgcttcctcttatccgctcttgtgctacttactatcctctgtaccgtttatctttactttgctattactttagggtccagtggcacctgttctgggttgagtggagcacagaaagcttcatgccatatggagcttgttaaggattctcttaatggcaaactgaaatttctttaatatttcaagtattattattattattattattattattattattggaattttttgttgctaatccctccaccccagcataggtgacatgaagtccaaatatagtcattggtcacaatatctctgtgaaatatcaacagagtttatctcagtaattttt

SEQ ID NO: 5139 - DNA, 822 bp, Medicago truncatula
aacgcgtattgagacggaaggcctttttatctatctactcagcaagcggtgattaatttgattcattcatttcattaattgacatcgacatcaaaccgttggtcggcgaacgaacgaatcaagtgtttcgttcccgaccctccgtcgcagcattccatatccttttcttattcgctgcgcttctttggttttcccattcaaacaacgcaactctaggctttaggtggacaaaagaaggtttgttgtagaagccatggttcttgacagcattttgtcttcgtctcctcgtttgaagtctccatctttcaggagacctaaggatggacttggtagttgggcgacactttaccagaggcatcgcttcctcttatccgctcttgtgctccttactatcctgtgtactgtttatctttacttcgctatcactttagggtccaatggctcctgttctgggttgagtggagcacaaaaagcttcatgtcatatggagcttgttaaggattctctttccaatggcaaactgaaatttctttaataattcaaataatattattattggaatttttgttgctaatccctccaccccaaatataggtgacattaagtccaaatatagtcattggtcattatctgtgtgagatgtatacagagtttatctcagtaattttttaatgtatgatatgggcagcaagccatttcttagatatattatgttaattttgatggctggttatattttggagaattgtacaagtttgcatgtatctattgtttatgggctattccgaattcccaaacctcatttttcatattttttagata

SEQ ID NO: 5140 - DNA, 716 bp, Medicago truncatula
ggcccgcaaaataacagacgacaaaccatccatccatccatccagcgcatcatccaccaccaccacatacactctctctatatatatatattacacgtcattctccctctcccctcttccgccgccggcaatctctctctctaggctttaggtggacaaaagaaggtttgttgtagaagccatggttcttgatagcattttgtcttcgtctcctcgtttgaagtctccatctttcaggagacctaaggatggacttggtagttggacgacactttaccagaggcatcgcttcctcttatccgctcttgtgctccttactatcctgtgtactgtttatctttacttcgctatcactttagggtccaatggctcctgttctgggttgagtggagcacaaaaagcttcatgtcatatggagcttgttaaggattctctttccaatggcaaactgaaatttctttaataattcaaataatattattattggaatttttgttgctaatccctccaccccaaatataggtgacattaagtccaaatatagtcattggtcattatctgtgtgagatgtatacagagtttatctcaataattttttaatgtatgatatgggcagcaagccatttcttagatatattatgttaattttgatggctggttatattttggagaattgtacaagtttgcatgtatctattgtttatggggctattccg

SEQ ID NO: 5141 - DNA, 719 bp, Lotus japonicus
gggtttgtgtgtgtcttgatcgatctcatcccctttcccacattctgcagcaactctctttcacgttacctgccacccgaagccaccgccaccgccaccgccaccgccaccgtttgcttctcttcccggaaccaaatcgcaggcagcgtaggcttcaggcggggtgaagaaagttgttgtagaagccatggttcttgacaccattctgtcttctcctcggttgaggtctccatctttcaagaggcagtttgcaaaggttgaactgggtaattggtccacactggtccagaggcatcgcttcctcttatccactcttgttctcctgaccatcctctgttttgtttatctctattttgctgtcactatagggtccaatggctcttgttctgggttgactggggcacagaaagcttcatgccacatggagcttgttaaggattctatagccaaggggaaactgagaatgctttgatttttcaaacataactaaaatggaatttttgttcttgattttccctgaatataggtgaaattaaatccaaatatatagaccttgtctacattatttatttgtgtgatgtttatacatgcggtttatcttagtatttgttgatgtacaatagtgtagaaagtaatttttagattcatcaagttaagtttgatggttgctcacttgtagctgatgaagcttaatttggctaatctcctaaacctcatat

SEQ ID NO: 5142 - DNA, 1234 bp, Glycine max
gcactgaaaaaaagtgaaaaggctgttacacacactgccaccaaagaggcctttttcctccattttgacgtgccccaaatcagagttttttctttccacacacacacactggtggttgagtggttcttctcaaaatgggtgagaaagatgatgattttgggttgagtttgagtttgagtttggggagagtgaaccaacaacaacaacaccctcctcctttgaatcacatgcaccagcctcaacaactacaacctgttcccatgaatcacaataagactctctttggtgatttgtctcagttaccagaccggagctccgaaatgatacgaggaatcgacgtcaattcggcggcggagtgcgacggcgtttcctcgccgaacagcgctgtctcgagcgtgagcggcggcgacggcaagcagagcgagagggacgacgataataatgctgccgccgtggccggtgagaggacctcgtgctcgcgagggagcgacgatgacgacggtggtggcagcgatgcctcgaggaagaagctgaggctgacgaaagaacagtccatggtgttggaagaaacgttcaaggagcatagcacgctgaatccgaaacggaagcaagcgttggcagaggagttgaatctgaagcccagacaagtagaggtgtggtttcagaacagaagagcaaggaccaagttgaagcaaactgaagtggattgtgaatacttaaagagatgctatgagaatttaactgaagagaatagaaggttgcacaaggaggtccaagagcttagggcattgaaattatccccacaaatgtacatgcatatgaaccctcccaccactcttacaatatgcccttcttgtgagcgtactcactcctttgcatcctcctccactgccaccatccactcggcggtggcggccacatcgagcaatcgcaaactgttcggcacaaacatccggctgcccgtgtccttcaacactcggccatttgaaggcccaattcctcggccataattggttgaggcctgaggacaatgtgatatttataatgatgtctagacatttttaattactagacatgtatgcatggaaaaaaaatcaaattgcaacggaacaccaatttgtggtttttgttaggaatcaaggatatgagtttggacttggttaagtcttcagtgaagggttgttctattttgtgtatgctataagttatagctagtcaacttcaggatttgtgt

SEQ ID NO: 5143 - DNA, 1602 bp, Glycine max
atataagcttgtcagcattacagagaaaaagagagagagagaaagaaaagtaatggcaatggcaacgatggaagagattccacaaagcccagaagcgaagttggggatgcgagtggaggatctttgggacgttcaggaggcacagttgagtcccaccgagaagctcaacgcttgttttgaaagcatccctgtctctgcttttcctttggatccttcaaacacagaaattgagattaaatcagacgccaccctagcagatgctgttaagatattggcaggacacaacgttttcagcgcgcctgtggtggatgttgaggcgcctgaagacgctagttggattgacagatacatcggaattgttgagtttgctggaattgttgtatggattttgcatcagtctgaacctacgtctccgaggactccgtccactccatccagtgcaagggctattgcagctgcagctaatggagcggcttttgctctagaacttgaagccttaggccttggatctgctgcaacaactgcagggaacttttttgaggatctcacttcttctgaactttataagaataccaaggttcgtgatatttcagggacattccgctgggccccgtttcttgctttagagagatcaaactcatttctaaccatgctcttgctgctttctaagtacaagatgaagagtgttcctgtgttggatttaggctctggtgcaattgataacattattacacaatctgctgtgattcatatgctggcagaatgcgctggacttcagtggttcgaaagttggggaaccaagaaactatctgaagttggtcttcccctggtgacaggaaatcaaatcatcaaggtttatgaggatgaaccagtcctccaagcatttaaagtaatgaggaaaaaaagggtcggaggggttcctgtaatcgaaagagagaccaaaaaagcagttggtaatataagtttgcgagacgttcaattcttgctaactgcaccagaaatctatcatgattatagaggtattacagtaaaagacttcctaactgaggttagaagctacttggagaagaataaaaatgcatccccaatgttaaatgaatatgtcacatgcaaaaaggactgtacaatcaaagagttgattcaactacttgatcaagagaagattcacagggtctatgtggtggacgatgatggggatttgcaaggactaatcacactaagagatatcatctcaaggctagtacacgaaccgcgtggctattttggtgatttctttgatggtgttctaccgctgcctgcaaacagcagagtttaacaggcaaggttacaagggagaataacctgctggtgcagcttttttttttttaaaaaaagaaaaatttaagtaaaaagggaaaaaaaaaatacaaatagatcaatgcgcttctcttcagggttgaagacgtgtgcttgggtctttgtataacgagtaggcaatttgcaagttaattgcatccgttttattaagtgttagagtgagatttgtgtgtactgtaaattctggtggaagtgtaagtaaccataagttttgttaacttttgaaatgtaatttcttttctcttc

SEQ ID NO: 5144 - DNA, 1573 bp, Cajanus cajan
gaagacagtgatggcaatggaaacaatgggagagagtccacgaagcccagaagccaagttggggatgcgagtgggggatttgtgggatattcaggaatctcagctaagtcctacggagaaactcaacgcttgttttgaaagcatccctgtttctgcttttcctttgtctccttcaaaccaagaggttgagataaaatcagacgcgacccttgctgaagccgttaagattctggcacaacacaacgttttcagcgcacctgtggtggatgttgatgcgtgtgaagatgccagttggatggacagatacatcggaattgttgagtttgctggaattgttgtgtggattttgcatcagtctgaacctacatctcctaggagtccatctactccatccagtgcaaaggctattgcagctgcagctaatggagcgaattttgcaatggaacttgaagccttaggcctaggatctgctgcaacaacttcaggaaacttttttgaggatctcacttcttctgaactttataagaataccaaggttggtgatatttcagggacattccgctgggccccatttcttgctttagagaaatcaaactcattcctaactatgctcttgctgctttctaaatacaagatgaagagtgtgcctgtgttggatttaggctctggtagaattgataacatcattacacaatctgctgtgattcatatgctggcagaatgtgctggacttcattggtttgagagttggggaacaaagaaactatctgaagttggtcttcccctggtgaaaggaaatcatatcatcaaggtttatgaggatgaacctgttcttcaagcatttaaaataatgaggaaaaagagggttggaggggtgcctgtaatagaaagagatagccaaaggacagttggtaatataagcttgcgagatgttcaattcttgctaaatgcaccagaaatatatcatgattatagagctattacagtaaaggactttctgactgccgttagaagccacttggaggagaatacaaaagcacacccaatgttaactgaatttgttacatgcaaagaggactgtacaatcaaagaattgattcaactgcttgatcaagagaagattcacagggtctatgtggtggacgatgaaggagatttgcaaggactaatcacactaagagatatcatctcaaggctagtacatgaaccacgtggctactttggtgatttctttgatggtgttctaccgctacctgcaaacacgagagtttaacaggcaaggactcaagggagaataacctgctggtgcagctagttttttttttttttaaataaatttttaagttgagagggaaaagaattacaaataaatctatgtgcttctcttcagggttgaagacgtgtacttgggtgtttgtataacgtgtaggcagtttgcaaagttacttgcatccgttttatgaagtgtgagtgagattgtgtgtatgtaaattctggtgtaagtgtaagtaaccataaattttagtaaaatagtattttcctttcttcttctgaatgtgtttttagtttagac

SEQ ID NO: 5145 - DNA, 1702 bp, Medicago truncatula
atgcagttacacagagagagaaaagaagagggagtaatggcaatggctacaatgagagagatgccaaggagccctgaagccaaacttgggatgagagttgaagatctatgggatgttcaagaggcacaattaagtcctaatgacaaacttaatgcttgttttgaaagcatacctgtttctgcttttcctttgcctgctaaaaaccaagaaattgaaataaaatcagatgctaccttggctgaagctgtgaaaatactagcacgtcacaatattctgagtgcacctgttgtggatgttgatgcacctgaagatgctacttggattgatagatacatcggaatagttgagtttgctggaattgttgtatggattttgcatcagtctgagcctccatcccccaggagtccatccactccaactagcgcaagtgctattgcagccgcagcaaacggaaatacttttgcccgagaactcgaagccttaggcctcggatctgcagcgacaacttctggaaacttttttgaggatcttacttcttctgaactttataagaacacgaaggttcaagatatttcaggaacatttcgatgggctccgtttcttgctttggagagatcaaactcatttctaaccatgctcttgttgctttctaagtacaaaatgaagagtgttcctgtggtagacttgggttctggtacaattgataacatcatcacacaacccgccgtgattcatatgttggcagaatgtgccggacttcaatggttcgaaagttggggaaccaaggaactatctgatgttggtcttccccttgtgacaccaaaacagatcatcaaggtttatgaggatgaaccagtccttcaagcatttaaagagatgaggaaaaagagggttggaggggtgcctgtaatcaaaagaggtggcaccacggcagttggtaatataagcttgcgagatgttcaattcttgctaactgctccagaaatctatcatgattatagaactattacagtgaaggacttcctgacctccgttagaagctacttagagaagaataaaaacgcattcccaatgtcaagtgaattcattacatgcaaaagggactgtacagtgaaagagttgattcaattgcttgacaaagagcaaattcacagggtctatgttgtggatgatgatgggaaccttgaaggactaatcacactaagagatatcatctcaaggctagtacatgaaccccacggctattttggtgatttctttgatggtgttctccctctacctgctaacagcagggtttaacagacaaggcatcaagaaagaataacttgctcttgcagagattttttgtttttgtttttgtttttgaaataattcttcagaggaaaagtaaaaaatatgtatttatcttcaggttgaagatgtgtacctaggtctttgtaatgtgtaggcagtttgcaagttacttgcacctgttttaactaattttagaatgggacttttatgtactgtaaattctggtgtaaccgtaagttctgtcaaattttgggttgttttcgttgtcttcgattcgtgtttctgttcaccttattatgactagagcgacacgtgtctatccacatttttcttttgtattttgtttttttatgtattataaaatatgtttacttcagtttaataaatttatgtgtttttcactttaaaa

SEQ ID NO: 5146 - DNA, 1451 bp, Trigonella foenum-graecum
aaagaaagaaaaaatagaatagaatagagagatcttataacattgtcaccattttgcagttacatagagaaaaagaagagaataatggcaatggctacaatgtcaagagagatgccaaggagcccagaagccaaacttgggatgagagtggaagatctatgggatgttcaagagccacaattaagtcctactgaaaaacttaatgcttgttttgaaagcatacctgtttctgcttttcctttgccaccttcaaaccaagaaattgaaataaaatcagatgctaccttagctgaggctgtgaaaatactggcacgtcacaatattctgagtgcacctgtggtggatgttgatgcacctgaagatgctagttggattgatagatacatcggaatagttgagtttgctggaattgttgtatggattttgtatcagtcagaacctccatctcctaggagtccatccactccaaccagtgcaagtgctattgcagctgcggcaaacggaaataattttgctcgtgaacttgaagccttaggcctcggatctgctgcaacaacttcaggaaactttttcgaggatcttacttcttctgaactttataagaacaccaaggttcaagatatttcagggacattccgatgggctccgtttcttgctttggagagatcaaactcatttttaaccatgctcttgctgctttccaagtacaagatgaagagtgtacctgtggtagacttaggtgctggtagaattgataacattatcacacaagccgccgtgattcatatgttggcagaatgtgccggacttcaatggttcgaaaggtggggagccaaggaactatctgatgttggtcttccccttgtgacaccagaacagatcatcaagatttatgaggatgaaccagtccttcaggcttttaaagagatgaggaaaaagagggttggaggggtgcctgtaatcgaaagaggtggcaccgcggcagttggtaatataagcttgcgagatgttcatttcttgctaactgccccagaaatttatcatgattatagaactattactgtgaaggacttcctgacctccgttagaagctacttagagaagaataaaactgcattcccaatgtcaagtgaattcattacatgcaaaagggactgtacagtcaaagagttgattcaattgcttgacaaagagaagattcatagggtctatgtcgtggacgatgatgggaatcttgaaggactaatcacactgagagatatcatctcaaggctagtacatgagcctcatggctattttggtgatttctttgatggtgttctccctctacctgctaacagcagggtttaacagaacaaggcatcaagaaagaataaacttgctcttgcagcgtatttttttgttttatttaacgtaacaactctcaaattacaactgtttgatcggtttac

SEQ ID NO: 5147 - DNA, 1691 bp, Phaseolus coccineus
gacaatgagacattacgtgtacaacaaacacttcatcgcacaatatctactctcatcgtgttcctccacgttttcccattttcccaagtcaacgaactgagttccaagttttcaaatcaagcggtggtgatctttggtgtataggaagtagcttgtgaagtgttggattctgtgttcttctgttcagctatttatggggatgtgtaaagattagttttttagcattggtgttagaggaagaaagagtgagagttatggtgacaatggaagagagtccacggagtccagaggcgaaggtggggttgagagtggaggatctatgggacgttcaggagcctcagctgagtcctgatgagaagctcaatgcttgctttgagagcatccctgtctctgccttccctctacctccttcaaatcaagaaattgagataaaatcagataccactctagcagaagcagtgaaaatgcttgcacaacacaacattctcagtgcacctgtggtggatgtagatgcacctgaagatgctagttggatcgacagatatataggaatagtcgagtttgctggaattgttgtatggattctgcatcagtctgaacccacatctcctaggagtccatccagtggatctgctattgcggctgctgtggatggaataacttctgcttttgaacatgaagccttaggccttgaatctgccatgacaacttcaggaaatttttttgaggatctgacttcttctcaactttataagaatacaaaggttcgtgacatttcagggtcattccgctgggccccctttctcgctttggagagatcaaactcatttttgaccatgcttttgctgctttccaagtacaagatgaagagtgttcctgttgtagacttaggtgctggtcgaattcaaaacattattacacagtcttctgtaattcacatgttggcagaatgtgctggtcttcagtggtttgagagttggggaaccaagaagctatctcaagttggtcttcccatcgtggcaccaaatcatattataaaggtttatgaagatgaaccagtgcttcaagcatttaaactgatgaggaaaaagaggattggggggttgcctgtgatggaaaggggtggcagcagggcaattggtaacataagcctgcaagatgttcaattcctcctaactgctccagaaatctaccatgactatagatctattacagcaaaagacttcctgacagccgttagaagctacttagagaagcatgaagggacctttacaatgtcaagtgaactgattacatgcaataaggattgcacaatcaaagaactgattcaactgcttgaccatgagaagattcatagggtctacgttgttgacaatgatgggaatctggaaggactgatcacgctgagagatatcatctcaaggctagtgcatgagccccgtggctattttggtgatttctttgatggggttctcccgatgcctccaaacagcagggtttgacatgcatcaaggaagaatgacttctaatgcatcagtaacaaattgatctgtttcccatcaaaactgacgacaagacctttgtaacagcaacactttgaaagtttcttgctcttttgagttaggtgaaactgtgaaattgtgtaaattctgacgtaataatcgggagttttggtcacatttttttcttct

SEQ ID NO: 5148 - DNA, 1590 bp, Cajanus cajan
agtattgagtgttcttcacttcagttatttatgtgaatgtgtgtagaaagaagggatcataacttgttgtcagagcgtgttatggtgagaatgggagagagtccaaagagtccagaggctaagctggggttgcgagtagaggatctatgggatgttcaagagccacagctgagtcctgatgagaaactcaatgcttgctttgagagcatccctgtctctgccttcccttcacccccttcaaatcaagaagttgagataaaatcagatgccaccctagccgaggcagtaaaaatacttgcacaacataacatccttagtgcacctgtggtggatgtagatgcacccgaagatgctagttggattgacagatatataggaatagttgagtttgctggaattgttgtatggattctgcatcagtctgaaccgacatctcccaggagtccatccagtggagctgcagttaatggaataacttctactcaagaacatgaagcattaggccttgaatctgcggcgaaaacttcaggaaatttctttgaggatctgacttcttctcaactttataagaatacaaaggttcgtgacatttcagggtcattccgttgggctccatttcttgctttggagagatcaaactcatttttgaccatgcttttgctgctttccaagtacaagatgaagagtgttcctgtggtggacttaggtgcaggtcgaattgacaacattattacgcagtctgctgtaattcacatgttggcagaatgtgctggtcttcactggtttgagagttggggaaccaagaaactgtctgatgttggtcttcccatggtgacaccaaatcatatcatcaaggtttatgaagatgaaccagtgcttcaagcatttaaactgatgaggaaaaagagaattggagggttgccagtgatggaaaggggtggcagcagggcaattggtaacataagtctgcaagatgttcaattcctcctaactgctcctgaaatctaccatgatcatagatctattacagcaaaagactttctgatagccgtcagaagctacttagaaaagcatgaaggggtctctcctatgtcaggtgacctgattacatgcaacaaggattgcacgatcaaagaactgattcaactgcttgaccatgagaagattcatcgagtctacgttgctgacaatgatgggaatcttgaagggctgatcacactcagagatatcatctcaaggctagtacacgagccccgtggctattttggtgatttctttgatggggttctccccatgcctccaaacagcagggtttgacatgcatccaggaagaataacttctaatccatcagtaactaattgaagtgtctcattggggctgagaacaatatcttggggggtctttgtaacataagcggtttgcacttttcaagttagttctcgtttaaacttgggtgaaactgtaaaaagtgaaattttgtgtaatttttgatgtaataatcggggagtttcggtccttttgagcaagttgatccgtaatcaaactatgttttgagatactactcagcaatttagaaccaataattcgta

SEQ ID NO: 5149 - DNA, 1542 bp, Glycine max
gggtccttctcttcagttatttatggggatgtgtaaagagaaaaggaattctaaataacttgccagcattggcgttagagagagagttattatggtgactatggaagagagtccaaggagcccagaggcgaagctggggttgcgagtggaggatttatgggacattcaagaaccacagctaagtcctgatgagaagctcaatgcttgctttgaaagcatccctgtctctgccttccctccacctccttcaaatcaagaagttgagataaaatcagatgccaccctagccgaggcagtaaaactacttgcagaacacagcattctcagtgcacctgtggtggatgtagatgcacccgaagatgctagttggattgacagatatataggaatagttgagtttgctggaattgttgtttggattctgcatcagtctgaacccacatctcctaggagtccatccagtggagctgctaatacggctgcagttactggagtagcttatgaagcattaggccttgaatctgctgcgacaacttcaggcaattttttcgaggatctgacttcttctcagctatataagaataccaaggttcgtgacatttcagggtcattccgttgggccccatttctcgctttggagagatcaaactcatttttgaccatgcttttgctgctttccaagtacaagatgaagagtattcctgtggtggacttgggtgctggtcgaattgacaacattattacacagtcttctgtaattcacatgttggcagaatgtgctggtcttcagtggtttgagagttggggaaccaagaaactttctgaagttggtcttcccatggtgacaccaaatcatattatcaaggtttatgaggatgaaccagtgcttcaagcatttaaactgatgaggaaaaagaggattggagggttgccagtgatggaaaggggtggcagcagggcaattggtaacataagcctgcaagatgttcaattcctcctaactgctcctgaaatctaccatgattatagatctattacagcaaaagacttcctgacagccgttagaagctacttagagaagcatgaaggggcctttccaatgtcaggtgacctgattacatgcaataagaattgcacaatcaaagaattgattcaactgcttgaccatgagaagaatcatagggtctacgttgctgacaatgaagggaatctagaaggactaatcacactaagagatatcatatcaaggctagtacatgaaccccgtggctattttggcgatttctttgatggggttctcccgatgcctccaaacagcagggtttgacatgcatccaggaagaataacttctattccatcagtaacaaattgatgtgtgtttctcataagagctgacaacaagatcttagggcctttgtaacaagcacttagtactttgcaaattactagctctcgtattaatgtaggtgaaactgtgaaatgtgaaattttgtgtaaatttttacataataatcgggagttttggttgcatttttcttttg

SEQ ID NO: 5150 - DNA, 642 bp, Glycine max
gtaatctcttcacagaagaaaaaagagaagaagatgggtttgaagaacaacatggtggtgctaaaggtgtgtttggtgctacttttccttgtggggggtactactagtgccagcttgaggctgagtgagcttggcctgctcatgaaaagtgatcatcatcaacactcaaatgatgatgactcttcaaaaccatgctgtgatcaatgcgcatgcacaaagtcaaaccctcctcaatgccgctgttcagatatgaggctgaattcgtgccattcagcttgcaaatcttgtatttgcgcattatcgtatcctgcacagtgtttttgtgttgacataacggatttctgctatgaaccttgcaagcccagtgaggatgacaaggaaaactactaatgaacaagtgttatgcatgtaagctctctctccaatgggcaaagccccctttaggctttgtttgttatgtaaggaatgactaaataaacatggaataaaacttcctctcttttcgtggcccataatttgctttctgcaaatctgggtcttctttattccaatgttaattaatttggccaattttatagtttttcgtttgcatttggttctatgatttcaggatttataaataaaaaaatgtataagttaacc

SEQ ID NO: 5151 - DNA, 408 bp, Triticum aestivum
  misc_feature (341)..(341): n is a, c, g, or t
aagaagatgggtttgaagaacaacatggtggtgctaaaggtgtgtttggtgctacttttccttgtggggggtactactagtgccagcttgaggctgagtgagcttggcctgctcatgaaaagtgatcatcatcaacactcaaatgatgatgagtcttcaaaaccatgctgtgatcaatgcgcatgcacaaagtcaaaccctcctcaatgccgctgttcagatatgaggctgaattcgtgccattcagcttgcaaatcttgtatttgcgcattatcgtatcctgcacaagtgtttttgtgttgacataaccgatttctgctatgaaccttgcaagcccaatngaggatgacaaggaaaactactaatgaaacaaagtgttatgcaagttaagctctctctccaatggac

SEQ ID NO: 5152 - DNA, 396 bp, Brassica napus
tagtagttacgcgggaatgtgactaacggtcgtccgggaaggcatcctatgaatccggcgaacatggcctctacaggggtgttgagattgaccggttctaacgctccgagctctgctccgggctctgctccaggctctgctccagggtctgctcaagggccgaccactcctggtgcgtcgaccactccaggacaggcgggaggtccagggaacgcggggtcgatgtcgaccagcgtaaatttcggggttaattttggaattttggttatgttggctactattttcatcttttgagtatgatttcatcatctttacatttacttttttttttgctcaataatggagacatatactgttgtttatctttttagctttagagtcatttaactctttttt

SEQ ID NO: 5153 - DNA, 374 bp, Brassica napus
tacgcgggaatgtgactaacggtcgtccgggagtgcatcctatgactccggcgaacgtggcctctacacgggtgttgagattgaccggttctgatgctccgagctctgctccgggctctgctccgggctctgctccgggctctgctccaggctctgttccagggtctgctcaagggccgaccactcctggtgcctcgaccactccaggacaggcgggaggtccagagaacgcgggttcgatgtcgaccagcgtaaatttcggggttaattttggaattttggttatgttggctactattttcatcttttgagtatgatttcatcatttttacattactttttttttgcataataatggagacatactgtttgtt

SEQ ID NO: 5154 - DNA, 900 bp, Raphanus sativus
  misc_feature (398)..(398): n is a, c, g, or t
  misc_feature (487)..(487): n is a, c, g, or t
  misc_feature (503)..(503): n is a, c, g, or t
  misc_feature (536)..(536): n is a, c, g, or t
  misc_feature (586)..(586): n is a, c, g, or t
ggacaacaccaccacacaccagaaactcaactcagccatggcttctaactcatctcttcttctcatcttagccgttgcttgcttgatctcacctgcgatctcgcagacttgctctacgcagaacatactctcagccgacagaactcccttcgcgaattgcctggaccttccctcactagattcctacctccactacacatacaatgcaaccaactcatctctctccgtcgctttcgtcgccactccgtctcgctccgacggctgggttgcttgggctatcaacccgacggcgactggaatgagcggttctcaggcgttcctcgcttacagtcccagagccggcgcgcctcctgtcgtgaacacgtacaacatcagtggctacgtcctcaacgaaggtngactcgccttcgacttctggaacctacgcgccgaaaccatgaccggcaacaggatcgtgattcgcacgacggttagtgttccggagggngccgacagcgtgaacnaggtgtggcagatcggcgggaatgtgaccgacngtcgtcctatggtgcatcctttcaatccggcgaacttggcctctagagcngtgttgagattcgccggctctgacgctccgagctcagctccaggctcagctccggggtctgctccaggctcttctccaggctctgtccctggctctgctcaggggccgaccactcctggtgcctccaccactcctggacaggcggctggtccaaggaacgcgggttcgatgacgaccagcgtaaatttcggggtcaattttggaattttggttatgttggctacagtcctcatcttctgagtatgatttcattatcttttttacattactttttgtatgcgcaataatggagattcatactgttttactttcta

SEQ ID NO: 5155 - DNA, 1016 bp, Raphanus sativus
  misc_feature (164)..(164): n is a, c, g, or t
  misc_feature (688)..(688): n is a, c, g, or t
  misc_feature (929)..(929): n is a, c, g, or t
  misc_feature (962)..(962): n is a, c, g, or t
ggacaacaccaccacacaccagaaactcaacttagccatggcttcaaactcttctcttcttctcatcttagccgttgcttgcttgttctcacctgcgatctcgcagaattgctcaacgcagaacatactctcagccgacagaactcccttcgcgaattgcctgnaccttccctcactagattcctacctccactacacatacaatgcaaccaactcatctctctccgtcgctttcgtcgccactccgtctcgctccgacggctgggtcgcctgggctatcaacccgacgatgaccggaatgaacggttctcaggccttcctcgcctacagtcccggagccggcgcggctcccgtcgtgagatcgtacaacatcagcggctacgtcctcaacgaagggagactcgccttcgagttctggaacctacgcgccgaatccatggccggcaacatgatcgtgattcgcacgtcggttaaggttccgccgggagccgagagcgtgaaccaggtgtggcagatcggcgggaatgtgaccagcggtcgtcctatggtgcatcctttcaatccggcgaacttggcctctagaggggtgttgagatttgtcggctctgacgctccgagctcagctccggggtctgctccggggtctgttcctggctctgctcaggggccgaccactcctggtgcctcnaccactcctggacaggcggctggtccaaggagcgcgggttcgatgacgagtagcgtaaatttcggggtcaattttggaattttggttatgttggctacagtcttcatcttctgagtatgatttcattatctttttacattactttttgtatccgcaataatggagattcatactgttttactttctagtcttagagtcatttactcttttttgttttccacctatctcctcacccacattnttctgagttgttattggattgtatggaccattntatttttattatcatcttgtctgcttcaaataactgcctttgcagccccgtcca

SEQ ID NO: 5156 - DNA, 776 bp, Raphanus sativus
atcgcttacagagcgtacgatctggaaggcaagacggtgggaacagtgggagctggtaggatcgggaagctgttgctgcagaggctgaagccgttcgggtgcaacttgttgtaccacgacaggctccagatgggacccgagatggagaaagaaactggcgctaagtatgttgagagtcttggtgagatgctccctaaatgcgacgttgtagtcgtcaacacccctcttacggagaagacaagagggatgttcaacagagagttgatagggaaaatgaagaaaggcgttttgattgtaaacaacgcgagaggagccatcatggataggcaagcggtggttgaggcggtggagagcggacacatcggagggtacagcggagacgtgtgggacccgcagccagctcctaaagaccatccatggcgttacatgcctaaccaagccatgactccccacatctctggcaccaccattgatgcacagctacgatatgcggcggggacgaaagatatgttggagaagtattttaagggagaggacttccctgctcagaactacatcgttaaggacggtgaacttgctcctcagtacaggtaagcttgtttccaactctatcaagtcttgttgtatccgaaggacaaaagcttacggtctattaaataaattccactcctttgtccatttgaagactttgtaataaaaccaacaagacatatatgtaacgttactatgtcatgacatttatcttgagtctatcttatgaggatttgatgatgcga

SEQ ID NO: 5157 - DNA, 1446 bp, Oryza sativa
ccatcgagtcggctgcactgatcgattccatcactctctctctctcgcctgctcgcggttgcctgtgcgttcgtctcgcgatttctcctcctcctcctgggatcatggcgatgtggagggcggcggcggggcatcttctcggccgcgcgctcggctccagggccgcgcacacatcagcaggcagcaagaagatcgtgggtgtgttctacaagggcggcgagtacgccgacaagaatcccaacttcgtcggctgcgtggagggcgctctcggcatccgcgaatggcttgagtccaaggggcatcactacattgtcaccgacgacaaggaggggctaaacagcgagctggagaagcacattgaggatatgcatgtcttgatcaccacccctttccacccagcctatgttagcgcagaaaggatcaagaaggcaaagaacctcgagctgcttctcacagctgggattgggtcagatcatattgatctgccagcagctgctgcagcaggtttaactgtggcagaggttaccggaagtaacactgtgtcggtggcagaagatgagctcatgcgcattttgattttgctcaggaacttcttgcccgggtatcagcaggttgttcatggtgaatggaatgttgctggcattgcctatagggcttatgatcttgaaggaaaaactgtggggactgttggggctggtcgtattggcaggctcttacttcagcgtcttaagccctttaactgcaacctgctgtaccatgacagacttaaaattgacccagaacttgagaaagaaattggggccaaatatgaagaggatctcgatgctatgcttccaaagtgtgatgtcattgtgatcaatacacctcttacagagaaaacaagaggtatgtttaataaagaaagaattgcaaagatgaagaaaggtgtaatcattgtgaataatgctcgaggagcaatcatggatacccaggcggttgcagacgcttgctctagtggtcaagttgcaggatatggtggtgatgtctggttcccccaaccagcaccaaaggatcacccatggcgatacatgcctaatcatgccatgacccctcatatctctgggactacaattgatgcacagctgagatacgcagcaggagtgaaggacatgctggacaggtacttcaaaggggaagacttcccggtgcagaactacatcgtcaaggaaggtcagctcgcgagccagtaccagtaataacccttccttgtgtgttgggtgtccatcctgtggccaccttcccgcagtgaagggaaacagagattcggataggaaccaaaacaccttgtgttgttgttgttgcctgagtgttccctgagaaactattggacaccggaaataatggatgcctgccatggcaaccatggctccgaagaataaaaagccctcggattaaacagttcagttc

SEQ ID NO: 5158 - DNA, 1383 bp, Hordeum vulgare
cccctgcctcgtccgccgttccccgtgaggtgattggcagattgcttcttcctccgccgggatccctccgtctccatggccgcgatgtggagggccgccgcgaggcagctcgtcgaccgggcggtcggatccagggccgcgcacacgtctgcaggcagcaagaagatcgtcggcgtgttctaccaggccggcgagtacgccgacaagaaccccaacttcgtcggctgcgtcgagggtgccctcggcatacgcgactggctcgagtccaaggggcaccactacattgtcaccgacgacaaggaggggttgaacagcgagctggagaagcacattgaagacatgcatgtcctgataaccaccccattccacccagcctatgttactgcagagaggatcaagaaggcaaagaacctcgagctgcttctcacagctgggattggctcggaccatattgatttgccagctgctgctgctgcaggcttgactgtggcagaggtcactggaagtaacaccgtctctgtggcagaagatgagctcatgcgcatcttgattctgctcaggaacttcttgcctggctatcaacaggtcgttaaaggtgaatggaatgttgcaggcattgcccatagggcttatgatcttgagggaaagaccgtcggaactgtcggggcaggtcgtattggcaggctcttacttcagcgcctgaagcccttcaactgcaacctgctctaccatgacagacttcagatcaacccagagcttgagaaagaaattggggcgaaatttgaagaggacctggatgctatgcttccaaagtgtgatgtcgttgtgatcaacacacctcttactgagaaaactagaggcatgttcaacaaagaaaagattgcgaagatgaagaaaggtgtaatcattgtgaataacgctcggggcgcaatcatggatacccaggctgttgctgatgcttgctccagcggtcacattgctggatacggaggtgatgtctggttcccccaacccgcacccaaggatcacccatggcgctacatgcctaatcacgcaatgacccctcacatctctgggactacaattgatgcacagctgaggtacgcggctggagtgaaggacatgttggataggtacttcaagggcgaggagttccccgtggagaactacatcgtcaaggaaggcgagctcgccagccagtacaagtagtaacccaacccctccgacgctgcatggtaacatatttgaactctgaagcgaggcgtgagagaagaaaccattgtgttgttgtatgagcgttctctgagaacggaaataatggatgtctgcctgggggtgcaaccatggcagtgaataaaaagctctgggacgaggttatctgat

SEQ ID NO: 5159 - DNA, 1369 bp, Avena sativa
gtgcaagccctttatctctctcttcctctgctcgtgatttctccgccgggatccgtccatggcgatgttgagggccgtcgggaggcagctcgtcgaccgggcggtcggatccagggccgcgcacacatctgcaggcagcaagaagatcgtgggtgtgttctaccaggccggcgagtacgccgacaagaaccccaacttcgtcggatgcgtcgagggtgccctcggcatacgggactggctggaatccaagggacataactacattgtcacggacgacaaggaggggttgaacagcgaactggagaagcacatcgaagacatgcacgtcctgataaccaccccgttccacccagcctatgttactgcagagaggatcaagaaggcaaagaaccttgagctgcttctcactgctggaattggctcagatcatattgatttgccagctgctgctgctgcgggcttgactgttgcagaagttactggaagtaacaccgtctctgtggcagaagatgagctcatgcgcatcttgattctgctcaggaacttcttgcctggctatcaacaggtcgttcaaggtgaatggaatgttgcaggaatcgcccatagagcttatgatcttgagggaaagactgtcggaactgtcggagctggtcgaattggcaggctcttacttcagcgtcttaagcccttcaactgcaacctgctctaccatgacaggcttcagattaaccctgagcttgagaaagaaattggtgccaaatttgaagaggacctggatgctatgcttccaaagtgtgatgtcattgtgatcaacacgcctcttactgagaaaaccagaggcatgttcaataaagagaagattgcaaagatgaagaaaggtgtaatcatcgtgaataacgctcgtggagcaatcatggacacccaggcagttgctgatgcttgttccaccggtcatgttgctggatatggaggcgatgtctggttcccccaaccagcacccaaggagcacccgtggcgctacatgcctaatcacgcaatgacccctcacatctctgggactacaatcgatgcacagctaaggtacgcggcgggagtgaaggacatgctggacaggtacttcaagggtgaggacttccccgtggagaactacatcgtcaaggaaggtgagctcgccagccagtacaagtagagtaaaccaaccctcggcgctgcatggtgacattacctgaagtgcgagagaagagaaacaaaccattctgttgttgtatgagcgttctcttgagaacgggaatgaataatggatgcctgcctgtggattgcaaccatggcagtgaataaaaagttttaggatcagattatctgagtaatg

SEQ ID NO: 5160 - DNA, 1053 bp, Sorghum bicolor
gccagcccgttacccatatatagccgcagtcactcctgtagttattcctcttcctcttccgcctcgctctcactcctgctcttcctggccgtgcggttccttctccctgatccttctttggcttcgcggttcatggcgatgtggagggccgccgctaggcagctggtcgaccgggcgctcggttcaagcgccgcacacacgtctgcaggcagcaagaaaatcgttggggtgttctacaaggccggggagtatgccgacaagaaccccaacttcgtcggctgcgtcgagggagcactcggcatccgcggctggctcgagtcgcagggccatcagtacattgtcaccgatgacaaggagggccccaactgtgaactggagaagcacattgaagacatgcatgtcctgattaccacccctttccacccagcttatgtcactgcagagaggataaagaaggcaaagaatcttgagcttcttctcactgctggaatcggctctgatcatattgatcttccagcagcggctgctgcaggcttaactgtggctgaggtcactggaagtaacaccgtctctgttgcagaagatgagctcttgcgcattctgattctgctcaggaacttcttgcctgggtaccaacaggtagttcaaggtgaatggaacgtagcaggcattgcccacagagcttatgatcttgaaggaaaaactgttgggactgttggggctggtcgtataggcaggctcttgcttcagcgtcttaagccctttaactgcaacctgctttaccatgacagacttcagattgacccagagcttgagaaagaaattggggccaaatttgaggaggacctggatgctatgcttccgaagtgtgatgtgattgtgatcaacacacctcttacggagaaaacaagaggcatgtttaacaaagagaggattgcaaagatgaagaaaggtgtaattattgtgaataatgctcgaggagcaatcatggatactcaagcagtcgcagatgcatgttctagcggccacattgctggtacttactgcattaat

SEQ ID NO: 5161 - DNA, 1358 bp, Panicum virgatum
gaggcagctggtcgaccgggtgctcggcgcaagggccgcgcacacgtctgcagtcagcaagaagatcgtgggggtgttctacaaggccggcgagtacgccgacaagaaccccaacttcgtcggatgcgtcgagggggcactcggcatccgcaactggctcgagtcacagggccatcgctacattgtcaccgatgacaaggagggccccaacagtgaactggagaagcacattgaagacatgcatgtcctgattaccaccccgttccacccagcttatgttactgcagagaggattaaaaaggcaaagaaccttgagcttcttctcacggctggaattggctccgatcatatcgatttgccagcagccgctgctgcaggcttaacggtagcagaggttactggaagtaacaccgtctccgtggcggaagatgagctcttgcgcattctgattctggtcagaaacttcttgcctgggtatcaacaggtggttcagggagagtggaacgtcgcaggcattgctcacagagcttatgatcttgaaggaaaaactgttggaactgttggggccggtcggatcggcaggctcttgcttcagcgtcttaagcccttcaactgcaacctgctttaccatgacagacttcagatcgacccagagcttgagaaagaaattggtgccaagtttgaagaggacctggatgctatgcttccaaagtgtgatgtggttgtgatcaacaccccacttaccgagaaaacaagaggcatgtttaacaaagagaggatcgcaaagatgaagaaaggtgtaattgtcgtgaataatgctcgaggagcaatcatggatactcaggcagttgcagacgcttgttccagtggtcacattgctgggtacggtggtgatgtgtggttcccccagccagcaccgaaggatcacccctggcgctacatgcctaaccatgccatgaccccccacatatctgggactacaattgatgctcagctgcggtatgccgagggtgtgagggacatgctggacaggtacttcaagggtgaggacttccccgcgcaaaactacatcgtcaaggaaggccagctcgcaagccagtaccagtgatcgcgcacgccataggccagagctgtatccttcttttctgtgagattttgcgaggaagaaactgttgttccatcgctgtatgagtagaagttgttgtcacagggacatgtgggccgccggaaataaacaagcgaaagagatgccttcctggcattgcatcgtggagatgaataaatatttcttgcctctcatcgtactagactgggaacgtctgttaaccctaccattttataaacactttttcctggag

SEQ ID NO: 5162 - DNA, 1389 bp, Triticum aestivum
ccacgcgtccgcccacgcgtccgcgcctcccctcttttcctcgctcgccgttccccgtgaagtgattggcagattgcttctccctccgccgggatctctccgtccccatggccgcgatgtgtagggccgccgcgaggcagctcgtcgaccgggccgtcggatccagggccgcgcacacgtctgcaggcagcaagaagatcgtgggcgtgttctaccaggctggcgagtacgccgacaagaaccccaacttcgtcggctgcgttgagggcgccctcggcatacgcgactggctcgagtccaaggggcatcactacattgtcaccgacgacaaggagggcttgaacagcgagctggagaagcacattgaagacatgcatgttctgataaccaccccattccacccagcctatgttactgccgagaggatcaagaaggcaaagaacctcgagctgcttctcacagctgggattggctcggaccatattgatttgccagctgctgctgctgcaggcttgacagtggctgaggttactggaagtaacactgtctctgtggcagaagatgagctcatgcgcatcttgattctgctcaggaacttcttgcctggctatcaacaggttgttaaaggtgaatggaatgttgcaggcattgcccatagggcttatgatcttgaggggaagaccgtcggaactgtcggggcaggtcgtattggcaggctcttacttcagcgccttaagcccttcaactgcaacctgctctaccatgacagacttcagatcaacccagagcttgagaaagaaattggggcgaaatttgaagaggacctggatgctatgcttccaaagtgtgatgtcattgtgatcaacacacctcttactgagaaaactagaggcatgttcaacaaagaaaagattgcaaagatgaagaaaggtgtaatcatcgtgaataacgctcggggagcaatcatggatacccaggcagttgctgatgcttgctccagcggtcacattgctggatatggaggtgatgtctggttcccccaacccgcacccaaggatcacccatggcgctacatgcctaatcacgcaatgacccctcacatctctggaactacaattgatgcacagctgaggtacgcggctggagtgaaggacatgttggataggtacttcaagggcgaggacttccccgcggagaactacatcgtcaaggaaggcgagctggccagccagtacaagtagaggtagtaacccaaccctcggcgctgcatggtaacatatctgaagcgaggtgcgagagaacaaaccattgtgttgttgtatgagtgttctcatagaacggaaataatggatgtctgcctgggattgcgaccatggcagtgaataaaaa

SEQ ID NO: 5163 - DNA, 1357 bp, Triticum aestivum
ctcccctcttttcctcgctcgccgttccccgtgaagtgattggcagattgcttctccctccgccgggatctctccgtccccatggccgcgatgtgtagggccgccgcgaggcagctcgtcgaccgggccgtcggatccagggccgcgcacacgtccgcgggcagcaagaagatcgtgggcgtgttctaccaggccggcgagtacgccgacaagaaccccaacttcgtcggctgtgttgagggcgccctcggcatacgcgactggctcgagtccaaggggcatcactacattgtcaccgacgacaaggaggggttgaacagcgagctggagaagcacattgaagacatgcatgttctgataaccaccccattccacccagcctatgttactgcagagaggatcaagaaggcaaagaacctcgagctgcttctcacagctgggattggctcggaccatattgatttgccagctgctgctgctgcaggcttgacagtggctgaggttactggaagtaacactgtctctgtggcagaagatgagctcatgcgcatcttgattctgctcaggaacttcttgcctggctatcaacaggtcgttaaaggtgaatggaatgttgcaggcattgcccatagggcttatgatcttgaggggaagaccgtcggaactgtcggggcaggtcgtattggcaggctcttacttcagcgccttaagcccttcaactgcaacctgctctaccatgacagacttcagattaacccagagcttgagaaagaaattggggcgaaatttgaagaggacctggatgctatgcttccaaagtgtgatgtcattgtgatcaacacacctcttactgagaaaactagaggcatgttcaacaaagaaaagattgcaaagatgaagaaaggtgtaatcatcgtgaataacgctcggggagcaatcatggatacccaggcagttgctgatgcttgctccagcggtcacattgctggatatggaggtgatgtctggttcccccaacccgcacccaaggatcacccatggcgctacatgcctaatcatgcaatgacccctcacatctctgggactacaattgatgcacagctgaggtacgcggctggagtgaaggacatgttggataggtacttcaagggcgaggacttccccgcggagaactacatcgtcaaggaaggcgagctcgccagccagtacaagtagtaacccaaccctcggcgctgcatggtaacatatctgaagcgaggtgcgagagaagaaaccattgtgttgttgtatgagtgttctctgagaacggaaataatggatgtctgcgtggggttgcgaccatgccaatgaataaaaa

SEQ ID NO: 5164 - DNA, 1596 bp, Avena sativa
cgtcgtcatcagtctcatctctttcgtgcaagcgctttatctctctcttcctctgctcgtgatttctccgccgggatccgtccatggcgatgttgagggccgtcgggaggcagctcgtcgaccgggcggtcggatccagggccgcgcacacatctgcaggcagcaagaagatcgtgggtgtgttctaccaggccggcgagtacgccgacaagaaccccaacttcgtcggatgcgtcgagggcgccctcggcatacgggactggctggaatccaagggacataactacattgtcacggacgacaaggaggggttgaacagcgaactggagaagcacatcgaagacatgcacgtcctgataaccaccccgttccacccagcctatgttactgcagagaggatcaagaaggcaaagaaccttgagctgcttctcactgctggaattggctcagatcatattgatttgccagctgctgctgctgcgggcttgactgttgcagaagttactggaagtaacaccgtctctgtggcagaagacgagctcatgcgcatcttgattctgctcaggaacttcttgcctggctatcaacaggtcgttcaaggtgaatggaatgttgcaggaatcgcccatagagcttatgatcttgagggaaagactgtcggaactgtcggggctggtcgaattggcaggctcttacttcagcgtcttaagcccttcaactgcaacctgctctaccatgacagacttcagattaaccctgagcttgagaaagaaattggtgccaaatttgaagaggacctggatgctatgcttccaaagtgtgatgtcattgtgatcaacacgcctcttactgagaaaaccagaggcatgttcaataaagagaagattgcaaagatgaagaaaggtgtaatcatcgtgaataacgctcgtggagcaatcatggacacccaggcagttgctgatgcttgttccagcggtcatgttgctggatatggaggcgatgtctggttcccccaaccagcacccaaggagcacccgtggcgctacatgcctaatcacgcaatgacccctcacatctctgggactacaatcgatgcacagctgaggtacgcggcgggagtgaaggacatgttggacaggtacttcaagggcgaggacttccccgcggagaactacatcgtcaaggaaggcgagctcgccagccagtacaagtagagtaaaccaaccctcggcgctgcatggtgacattacctgaagtgcgagagaagagaaacaaaccattctgttgttgtatgagcgttctcttgagaacgggaatgaataatggatgcctgcctgggggttgcgaccatggcagtgaataaaaagctttaggatcagattatctgagtaatgtgctgtgtgtactgctggtgtcgtgtcttgagtaatgtgttgtgtgtattgctggtgtcgtgtcttcgacgtgtggaatgtcttaggaggtttacatgtcggtttacagcataaactaaacgatacgagattgcgagcagagcagaagtatagacaccaggtacaggtaggctgggtggaacggggtggttatcaggacgtg

SEQ ID NO: 5165 - DNA, 550 bp, Beta vulgaris
  misc_feature (511)..(511): n is a, c, g, or t
cccacgcgtccgcactgctggaattggttcggacccattgatctgaaggctgcagcagcggctggtctaactgttgcagaggtaactggaagcaatgttgtctccgttgcagaagatgagttgatgaggattctcattctcgtcagaaactttgtgcctggataccagcaagctattaatggggagtggaatgttgctggtattgcttaccgagcttatgaccttgagggcaagaccattggcactgttggtgcaggaagaattggcaagcttttgcttcagaggttgaagccttttaactgtaatcttctctatcatgatcgtatccagatggacccagaattagaaaatcagacaggagccaagtatgaggaggatcttgtgaagatgcttggcaaatgtgatgtagttgtcatcaacactcctcttactgagaaaaccaaaggaatgttcaacaaagagctgattgcaaagatgaaaaagggagtgctaattgtaaacaatgctcgangagcaattatggatacccaagctgttgttgatgcttgct

SEQ ID NO: 5166 - DNA, 973 bp, Ananas comosus
gaactcgagaagcatatatccgacatgcacgttctcataaccactcccttccatccagcctacgtcacggctgagagaataaagcaggcaaagaacctccagctccttcttaccgccggcatcggctccgaccacattgacataaatgctgctgccgatgctggattaactgtcgcggaagtcactgggagtaacgtggtatcagtagcagaagacgagctgctgagggttctgattctcatgcgcaacttcttacctgggtaccatcaggttattaatggcgagtggaatgtcgcggctatagcatatagagcgtatgatctcgagggtaagactgtcggaactgttggagctgggcgaatcgggaagcttctgctgcagcggctaaagccgtttggctgcaatttgctctatcatgataggattaagatagaccctgggctagagaaggagattggtgcaaaatttgaggaggatttagatgcaatgctaccgaagtgtgatgtagtcgtgatcaacacccctcttaccgagaaaacaagaggcctggtcaacaaagagaggattgcgaagatgaagaagggtgtgatcatcgtgaacaatgcgcgaggagcgatcatggatactcaagcagtcgtagatgcttgtaacagtggacatattgcaggctacggtggtgatgtgtggaatccacaaccagcacctaaggatcatccatggcgatacatgcctaaccacgcgatgacgcctcacatttctgggactaccattgatggccagctgaggtacgcagcaggagtcaaagacatgctggataggtacttcaaaggggaggatttcccggcacagaactacatagtcaaggaagggaaactcgcgagccagtaccagtgatcagatcacatctgcacgcgttcctctgctgctgcttttccattgaactgcgagtgggttgttcttaaccttcgataaa

SEQ ID NO: 5167 - DNA, 1423 bp, Cenchrus ciliaris
  misc_feature (409)..(409): n is a, c, g, or t
  misc_feature (472)..(472): n is a, c, g, or t
  misc_feature (972)..(973): n is a, c, g, or t
  misc_feature (981)..(981): n is a, c, g, or t
  misc_feature (1008)..(1010): n is a, c, g, or t
ctctcctccactgtccttggttcttcttcccctctccttgcgcgaatccatggcgatgtggagggcggccgcgaggcagctggtcgaccgggccatcggttcaagggccgcgcacacatctgccggcagcaagaagatcgtgggggtgttctacaaggccggcgagtacgccgacaagaaccccaactttgtcggatgcgtcgagggagcacttggcatccgcaactggctcgaatcgcagggccatcactacattgtcaccgatgataaggagggccccaactgtgaactggagaagcacattgaagacatgcatgtcctgattaccaccccgttccacccagcttatgttactgcagagaggattaagaaggcaaagaaccttgagcttcttctcacggctggaatnggctccgatcatatcgatttgccagcagccgcggctgcaggcttaactgtggcagaggttacnggaagtaacaccgtctctgtggccgaagatgagctcttgcgcattctcattctggtcaggaacttcttgcctgggtatcaacaggtggttcagggtgagtggaacgtcgcaggcattgcccacagagcttatgatcttgaaggaaaaactgttggaactgtcggggccggtcgtatcggcaggctcttgcttcagcgtcttaagcccttcaactgcaacctgctttaccatgacagactaaagatcgacccagagcttgagaaagaaattggggccaagtttgaagaggacctggatgctatgcttccaaagtgcgatgttattgtaatcaacacacctctcaccgagaaaacaagaggtatgtttaacaaagagaggattgcaaagatgaagaaaggagtaataatagtgaataatgctcgaggtgcaatcatggatactcaggcagttgcagacgcttgttccagtggtcacattgctgggtacggtggtgatgtggnntcccccanccggcaccgaaggatcatccctggcgnnncatgcaaaaaaaagccatgacccctcacatctctgggactacaattgatgctcagctgcgatatgcggagggtgtgaaggacatgctgaacaggtacttcaaaggcgaagacttcccagtgcagaactacatcgtcaaggaaggccagcttgccagccagtatcagtgatatatcccatttcctgaagagattgcgaggaagaaatctgaaacctgtcatcttataagacctgtcagccattggaaataaattaaagcatcgcgtcgtggagatttttaaatggggtatgtcctgtcatcgtaagcttgttctcggcaggaacatctgtgtaacactactggggttggtgctattcccttctgtttaaaaaaaacattttttttccaccggaaaggaacatttgttttttcca

SEQ ID NO: 5168 - DNA, 328 bp, Brassica juncea
tacaaccaagtcgtgaatggcgagtggaacgtggcaggcattgcttatagagcgtatgatctggaaggcaagacggtgggaactgtgggagctggtagaatcgggaagcttttgctacagcggttgaagccgttcgggtgcaacttgttgtaccatgacaggctccagatgggaccggagatggagaaggaaactggtgctaagtatgttgagagtcttgatgagatgcttcctaaatgcgacgttgtagtcgtcaacacccctctcactgagaagacaagagggatgttcaataaagagatgatagggaaaaaaaaaaaaaaaaaaa

SEQ ID NO: 5169 - DNA, 665 bp, Momordica charantia
tggagaagcacattgaagacaggcatgtcctgataccaccccgttccacccagcttatgttactgcagagaggattaagaaggcaaagaaccttgagcttcttctcacggctggaatcggctctgatcatatggatgtgccagcagccgctgctgcaggcttaactgtggcagaggttactggaagtaacaccgtctctgtggcagaagatgagctcttgcgcattctcattctgctcaggaacttcttgcctgggtatcaacaggtggttcagggtgagtggaacgtcgcaggcattgcccacagagcttatgatcttgaaggaaaaactgttggaactgtcggggccggtcgtatcggcaggctcttgcttcagcgtcttaagcccttcaactgcaacctgctttaccatgacagactaaagatcgacccagagcttgagaaagaaattggggccaagtttgaagaggacctggatgctatgcttccaaagtgtgatgttattgtgatcaacacacctctcaccgagaaaacaagaggcatgtttaacaaagagaggattgcaaaggtgaagaaaggtgtaataatagtgaataatgctcgaggtgcaatcatggatactcaggcagttgcagacgcttgttccagtggtcacattgctgggt

SEQ ID NO: 5170 - DNA, 1486 bp, Panicum virgatum
gtctgtcggccggcgtcactccccccctccttccctgctccgccgccgggtggctcctctccctctccttccgccgcggatccatggcgatgtggagggccgccgcgaggcagctggtcgaccgggcgctcggcgcaagggccgcgcacacgtctgcaggcagcaagaagatcgtgggggtgttctacaaggctggcgagtacttcgacaagaaccccaacttcgtcggatgcgtcgagggggcactcggcatccgcagctggctcgaatcacagggccatcactacattgtcactgatgacaaggagggccccaacagcgaactggagaggcacattgaagacatgcatgtcctgattaccaccccgttccacccagcttatgttactgcagagaggattaagaaggcaaagaaccttgagcttcttctcacggctggaatcggctccgatcatatcgatttgccagcagccgctgctgcaggcttaaccgtagcagaggttactggaagtaacaccgtctccgtggcagaagatgagctcttgcgcattctgattctggtcagaaacttcttgcctgggtatcaacaggtggttcaaggagagtggaatgtcgcaggcattgcccacagagcttatgatcttgaaggaaaaactgttggaactgttggggccggtcggatcggcaggctcttgcttcagcgtcttaagcccttcaactgcaacctgctttaccatgaccgacttaagatcgacccagagcttgagaaagaaattggtgccaagtttgaagaggacctggatgctatgcttccaaagtgtgatgtgatcgtgatcaacacaccacttaccgagaaaacaagaggcatgtttaacaaagagaggatcgcaaagatgaagaaaggtgtaattgttgtgaataatgctcgaggagcaatcatggatactcaggcagttgcagacgcttgttccagtggtcacattgctgggtatggtggtgatgtgtggttcccccagccagcaccaaaggatcacccatggcgctacatgcctaaccatgccatgaccccccacatctctgggactacaattgatgctcagctgcggtatgccgagggtgtgcgggacatgctggacaggtacttcaagggtgaggacttccccgtgcaaaactacatcgtcaaggaaggccagctcgcaagccaataccagtgatcgcgcacaccataggccagagctgtatccttttctttcctctggtgagaattgcgaggagaaactgttgttccatcgctgtatgtgtgtagaagttctcacggagacctgtcggccaccggaaataaacaagatatgcctttgctggcattgcatcgtggaaataaactagactttgtggttagtctcgtgggaacgtcgttaaccctgccattttatgaacactttttcctggagaaaatcatatatgttttgagttccggtggatatgt

SEQ ID NO: 5171 - DNA, 2736 bp, Cannabis sativa
caggcttctgctggcagcaaaaagattgttggggtattctacaaagccaatgattatgctaagctcaaccccaattttgtgggctgcgcagagggagccttgggtatccgggactggctagaatcacaaggtcatcaatacattgtcactgatgacaaagaaggacctggctgtgaacttgagaaacatattcatgatctggaagttctcataactactcctttccaccctgcttatgtaacggctgaaaggattaagagggcaaagaatttgaagcttgttcttactgctggaattggttccgaccatgttgatttgaatgcagctgctgctgctggattaacagttgctgaggtgacaggaagtaatacggtttcggtggctgaggatgagctcatgagaattctcattcttgtccggaacttcatacctggtcatcatcaggttatcaatggggattggaatgttgctggtattgcttacagagcttatgatctggaagggaaaacggtgggaactgttggtgctggacgtattggcaagcttttacttcaacgattaaagcctttcaactgtaatttgttgtatcatgacagactcaagatggaacctgaattggagaaggaaattggggctaagtttgaggaggatcttgatgccatgcttcccaaatgtgacatagtcgtcatcaacatgcctcttactgacaaaacacggggaatgtttgacaaagaaaaaattgcaaagtgtaagaagggagtcctgtttgttaacaatgctcggggtgcaattatggatacgcaagcagttgttgatgcttgttccagtggacacattgcaggctacagtggtgatgtttggtatccacaaccagctcctaaggaccatccatggcgttatatgccaaaccaagctatgactccccatatttctggcactacaattgacgcacagttgcgatatgcggatggagtgaaggatatgctcaataggtacttcaagggagaagatttcccagcacaaaactacattgtcaaggaaggtgaactggccagccagtaccgatgatttggatccgcggaatctgagtctacttgtttttgagtctcttcactgctgacataataataagaaaaacagagtgatcatctgataatctctacgttcttgaagatccacaatgttgtgttagtaataagactcatctcattatgaggatggtgtcaatagatttctgtagtttcgcttttgaagtgtttcgagtctagtttctgcattgagattatgctttgtcagtatgtggaagactccaatgacaattatgaatagacgttttctatgcttgaatgaatttacaagtctattacttactttacatgttaagtatgtgttgtgttgtgtttgctttactttgtttttttcctactacactgagaggaaggaaacaactgttcttgaactaaacttgcaatcatcatagaatttatgatgagaaagaatgagcatgaaatcctgaaatatctaacaacgacagcattttttagatccgctttgacatttgttatctacaaacaagtaacgacaacttacctaaacaacagtatattagtgtaaacgacaacaaattaaagagaattaacagtgagctaaacagggtaatcaaaatcaacactctaaaccagagaagtagaagaagatacaacattcacagctctgctattccattatgaatcattgtctataacaactcggtacacattgatttaagtatctttattttgttgaaggaattgtagatccttcatttgcaattgaacagcttctttggacaagatctttggctccggaacgtttaaatcaccgccttgagctattctttctgccttgtcttttataatcttctgtatctcagttttctgtacggttggaaaaactgaaatgagcattacattgagaagattctcatcctcttcctctatagggcctttcccaaaacagcaaacataaatggcttcaagtgatttctcaactcgagcctccatggggatcgttgttgcgccaccctttgactttgcccgtttctgcattacaacacatttatttattctcagtgagaaaggaaccatttttcaaaataacttaaagtctatgcatctttttaattgttcttgtgttgaaaagaaattgcagtcctcaaatggaatttcccaataatagtaagtattaatcattaacaaacctctctggcctcattcatcatggctaagaaagtctcttcctcaaactcaatatcatttgaaatccgaatcctagctgctccttccaaaatctcctcagattttaagagaccagctcccacggctgctaaccaacagcatagaagaacatacaaaggctcccctgcctaaccaaaatccaaactcaaatcaaacaccataaatagttcatctaaagtactccaaaaaacccaacaagaatgtcctaataattattagtggagtagactagctactacatcagaagtgtgtttatggctttttttgtggagaaaaattgttttaaattatgattgtttaagctattatgctacaattataacatgctaattggtaagaatcattagttttatctcaaaaacaatgtctaactatctccaatagagtaactcgtgatccggtcttataatgtgttttactatctccaatgagtagtgtaaaatttaactcaaaacataaa

SEQ ID NO: 5172 - DNA, 1454 bp, Phalaenopsis aphrodite
gggcgtgttctataaggggaacgagtatgcagcgaagaaccctaatttttggggacggtggagagggctttgggaatcagagagtggttggaaagtcaaggccaccagtacattgttactgatgataaagatggacctaattccgaacttgagaagcacattcctgacctccatgttctaatcaccacccccttccacccggcatacgtcaccgccgaacgaatcaaaaaagccaaaaacctccaactcctcctaaccgccggcatcggctccgaccacattgatctcaaagccgccgccgacgcgaagctcaccgttgccgaagtcaccggaagcaatgttgtgtccgtcgccgaagacgagctcatgagaattctcattctcgttcgaaacttcgttcctggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcgactgaagatcgatccggagttggagaaggagatcggagcgaagtttgaggaagatcttgatgtcatgcttcccaaatgtgatgttgttgtgatcaatacacctcttactgagaagacaaagggattgtttgataaggaaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaaccaggccatgactcctcatgtttcaggcacaaccattgatggccaactgaggtatgcggctggggtgaaggacatgcttgacaaatacttcaaaggagaagactttcctcagcagaactatattgtgaaggaaggcaaacttgcaagccagtacctgtgaatctgtgattttcactctctactcggtctgaggggcagctgccttattatatgattatataaataaccctttgctggtggagttagtctggtctctgtattttctcttgtttgatgctttgagtgtgggtgtgaagtagtttctatggtgtttaatgcaaataaaattctagaaattgttggggtgttattgcctatattactttttatttagtttttgcaatagtatattataggaaaatttgcatagatggtaatatccgttatatccatcaagattgtcaattctaatccagtgattagtgcttcatattctgcttcgttgtttgtacacggctctgtcagatgatagaagaatctcaacatgcatatctctgaaaaattcagacaggtgatattttttatgtggtatgaaag

SEQ ID NO: 5173 - DNA, 1158 bp, Phalaenopsis aphrodite
gggacggtggagagggctttgggaatcagagagtggttggaaagtcaaggccaccagtacattgttactgatgataaagatggacccaattccgaacttgagaagcacattcctgacctccatgttctaatcaccacccccttccacccggcatacgtcaccgccgaacgaatcaaaaaagccaaaaacctccaactcctcttaactgccggcatcggctccgatcacattgatctcaaagccgccgccgacgcgaagctcaccgtcgccgaagtcaccggaagcaatgtcgtgtccgtcgccgaagacgagctcatgagaattctcattctcgttcgaaacttcgttcccggttatcaacaggtcatcaatggcgattggaacgtagccgcaatctcttatcgggcttacgacctcgaaggcaagaccgtcggaaccgtcggcgccggccgaataggaaagcttttgctgcagcggttgaagccgtttaattgcaatctcctctatcacgatcggttgaagatcgatccagagttggagaaggagattggagcgaagtttgaggaagatcttgatgtcatgcttcccaaatgtgatgttgttgtgatcaatacacctcttactgagaagacaaagggattgtttgataaggaaagaatttcaaagttgaagaagggagttcttattgttaataatgctagaggagctattatggatactcaggcagtagtggatgcttgcaacagtggacatattgcaggctacagtggtgatgtgtggaatccacagccagctccaaaagatcacccatggagatacatgccaaaccaggccatgactcctcatgtttcaggcacaaccattgatggccaactgaggtatgcggctggggtgaaggacatgcttgacaaatacttcaaaggagaagactttcctcagcagaactatattgtgaaggaaggcaaacttgcaagccagtacctgtgaatctgtgattttgactttctactcggtctgaggggcagctgccttattatatgattatctaaataaccctttgctggtggagttagtctggtctctgtattttctcttgtttgatgctttgagtgtgggtgtgaagtaatttctatggtgtttaatgcaaataaatttcta

SEQ ID NO: 5174 - DNA, 1259 bp, Zingiber officinale
  misc_feature (348)..(348): n is a, c, g, or t
  misc_feature (1225)..(1228): n is a, c, g, or t
cgccctttgacaaagaaggccctaattgcgagttagagaaacactttcacgacatgcatgttttgatcacgactcccttccatccggtttacgtgactgcggagaagataaagacagccaaaaacctgcaacttcttctgaccgctggggttggctcggaccacatcgatctgaaagcggcagccgacgcaggaatcaatgtagtagaaatcagcggaagcaatgctgtcttggtggcagaggatgaattgatgcgaattctcatcctcgtccggaacttcttgcctggttatcatcaggtgatcgacggtgactggaacgtcgcaggcatcgcgcacagggcttacnatcttgagggtaagactgtcggcattatcggggcggggcgcatcgggaagcttttgcttcagcgtctgaagcctttcaactgcaatctgctttaccatgaccgcctcatgatttcacctgaactggagaaagagacaggagctaagtttgaggaagatcttgatgaaattctcccaaagtgcgacgtcgtcgtcataaacacgcctcttaccgagaaaaccagaggaatgtttgataaggagaggatcgggaagttgaagaagggagttctcatcgtgaataatgctcgagctgctatcatggacacccaagcagtcgtagatgcttgctctagtgggcacattgcaggttcatatgataactatccgatccgttgaaaaaatgaatcagatcagaagatttaattttttttattttattgctaaataaatgaatccatccatcttgctctgaccattcaggttatagtggcgacgtttggaatccccagccagctcccagagatcatccatggcggtacatgccaaaccacgcaatgactccccatgtatctggcaccaccattaacagccaagtaggttttcttggcagtttcttcggccacgtacattcaatttgcttcttcttccttggaaaattttgttggacttgatgattaattaacatggttaaattatctaaattgtgcagctgagatatgcggatggagtgaaagacacactcgataagtacttcaaaggagaggaatttccagctcaaaactacattgtcaaggagggaaagcttgcgagccaataccaatgaaacgaatgatgacctctcttttatatatcttctcagttcaagaatgtttgcatgttgagttatggagtttctnnnnctagtaatacaataagaggagatgattgtgc

SEQ ID NO: 5175 - DNA, 931 bp, Zea mays
cgactaaatgatttctgtaactgttttcagaactggagaagcacattgaagacatgcatgtcctgattaccaccccattccacccagcttatgtcactgcagagaggataaagaaggcgaagaatcttgagcttcttctcacggcaggaatcggctccgatcatattgatcttccagcagctgctgctgcgggcttaactgtggctgaggtcactggaagcaacactgtctctgtggcagaagatgagctcttgcgcattctgattctgctcaggaacttcttgcctgggtaccaataggtagttcaaggcgaatggaacgtagcaggcattgcccacagagcttatgatcttgaaggaaaaactgttgggactgttggagctggtcgtattggcaggctcttgcttcagcgtcttaagccctttaactgcaacctactttaccatgacagacttcagattgacccagagcttgagaaagaaattggggccaaatttgaggaggacctggatgctatgcttccaaagtttgatgtgattgtgatcaacacacctcttacggagaaaacaagaggcatgtttaacaaagagaggattgcaaagatgaagaaaggtgtaattgttgtgaataatgctcgaggagcaatcatggatgctcgagcagtcgtagatgcatgttctagcggtcacattgctggatatggtggtgatgtgtggttcccacagccagcaccaaaggatcacccctggcgctacatgcctaaccatgccatgacccctcacatctctaggactacaattgatgcgcaggtgcggtatgcggatggtgtgagggacatgctggataggtatttcaagggcgaggacttcccggtgcagaactacatcgtcaaggaaggccagctcgccagtcagtacaagtgaccgcgcga

SEQ ID NO: 5176 - DNA, 1721 bp, Zea mays
atggaaacaagtcgtactagccgtgatggggcccgatcgacaccagcagccggcggatgggatcgctgccccgctctcgccgtcgttgccccattggtggaggcacggcttcgatcccctgcaatttatgtggtacaagtaagggttttgtgtgagaaggcgaatgagattctaatggaggaaagaaatgttcagtgttctgacgttctgtcatacaacgtagcggtatgtaacgtatctgcccgccgtctcgctgggcctgatgatcttcacgacctggcctcgcctgaggccgtagtatctagcaattggatccatgatctgtattctaggaagctgttggtccgatatgcattcagaaaaaaagaaaaggaagggttacagacttcaagggatgtatattgcttggaatgcacggcaaaaatgcacagagactgtcataaaactgaactggagaagcacattgaagacatgcatgtcctgattaccaccccattccacccagcttatgtcactgcagagaggataaagaaggcgaagaatcttgagcttcttctcacggcaggaatcggctccgatcatattgatcttccagcagctgctgctgcgggcttaactgtggctgaggtcactggaagcaacactgtctctgtggcagaagatgagctcttgcgcattctgattctgctcaggaacttcttgcctgggtaccaacaggtagttcaaggcgaatggaacgtagcaggcattgcccacaaagcttatgatcttgaaggaaaaactgttgggactgttggggctggtcgtattggcaggctcttgcttcagcgtcttaagccctttaactgcaacctactttaccatgatagacttcagattgacccagagcttgagaaagaaattggggccaaatttgaggaggacctggatgctatgcttccaaagtgtgatgtgattgtgatcaacacacctcttacggagaaaacaagaggcatgtttaacaaagagaggattgcaaagatgaagaaaggtgtaattgttgtgaataatgctcgaggagcaatcatggatgctcgagcagtcgcagatgcatgttctagcggtcacattgctggatatggtggtgatgtgtggttcccacagccagcaccaaaggatcacccctggcgctacatgcctaaccatgccatgacccctcacatctctgggactacaattgatgagcagctgcggtatgcggatggtgtgagggacatgctggataggtatttcaagggcgaggacttcccggtgcagaactacatcgtcaaggaaggccagctcgccagtcagtaccagtgaccgcgcgagatgttgctgtgctgtgtaggcttttctggtgagaagttgcgaggaagaaactcctgttgcgtacttgtgttactgtatgagtagctctgagaaatctgtcagcggccacctgtaataaaagaatgccttgctggtatctcaccgtggagatcaataagtcccttttttccttctctgttcactgaactgcatgcactgtcttttttcggctgcgacaacgcaaatggcaacgaactgcatgcgttatgccatttgtcacatgtttggttcaacacgcacgtggtaatgaaatcaggttgcactgtaaccagagatgggatcagagtgcctccggcggggtaacctgttttcaaagagagaaaaaacctaat

SEQ ID NO: 5177 - DNA, 1039 bp, Petunia hybrida
aataataataattctactttcttcatttcttaagtaaaattcaatggctatgagacgtgtggcttctaaagcagctcatgcttttgcttcttcttcatctttagtttttactagaggacttcaggctccccctggtagcaacaagattgttggtgtattctacaaagcgaacgaatatgctgaaatgaaccccaacttcttggggtgtgcagaaaatgccttagggatacgtgaatggttagaatctaaaggtcatcagtacattagtcactcctgacaaagatggacctgattgtgagcttgagaaacatattcctgatctccatgtgttgattactaccccttttcatcctgcctatgtgacggctgaaaggatcaagaaggcgaaaaatctaaaacttctgctgacagctggaattggatcagatcacgttgatctgaaagcagcagctgctgcagggttgacagtagccgaggtcactgggagcaatgtggtctcggttgcggaagatgagctaatgcgaatcttaattctagtccgaaatttcctgcctggacaccatcaggttattaatggggattggaatgttgctggtattgcatacagagcttatgatctggaaggcaagactgttggaactgttggtgcaggacgtattggtaagcttttactccaaagattgaagccatttaactgtaatctactttatcatgatcgtctgaagatggatgcggaaatggagaatcaaactggggcaaagtttgaggaagatcttgataagatgctctcaaaatgtgacatagtggtcattaatacgcctctcacggagaaaacaaaagggatgtttgataaagaaagaattgcaaagttgaaaaagggagttctaattgtaaacaatgcccgaggagctataatggacactcaagcagttgtcgatgcttgcaacagtggtcacattgcagggtacagtggagatgtttggtacccacaaccagctcccaaggaccatccatggcgatacatgccaaaccaagctat

SEQ ID NO: 5178 - DNA, 1210 bp, Triticum aestivum
ggccgcgcatatgtctgcaggcggcaagaagatcgtcggcgtgttctaccaggccggcgagtacgccgacaagaaccccgacttcgttggctgtgtcgagggcgccctcggcatacgcgactggctggaatccaatggacatcactacatcgtcacagacgacaaggaggaactgaacagcgagctggagaagcacattgaagacatgcatgttctgataaccaccccgttccacccagcctatgttactgcagagcggatcaagaaggcaaagaacctcgagttggttctcacagctgggattggctcagaccatattgatttgctagctgctgctgctgctggtttgactgtggcagaggtcaccggaagtaacaccgtctctgtggcagaagatcagctgatgcgcatcttgattctgctcaggaacttcctgcctggctatcaacaggttgtcaaaggtgaatggaatgttgcaggcattgcccacagagcttatgatcttgagggaaaaaccgtcggaactgtcggggctggtcgtattggcaggctcttacttcagcgccttaagcccttcaactgcaacatgctctaccatgacagaattcggatcaacccagagcttgagaaagaaattggggcaaaatttgaggaggacctggatgtgatgcttccaaagtgtgatgtcattgtgatcaacacacctcttactgagaaaactagaggcatgttcaataaagaaaagattgcgaagatgaagaaaggtgtaatcatcgtgaataacgctcggggagcaatcatggatacccaggcagttgctgatgcttgctccaacggttatattgccggatatggaggtgatgtctggttcccccaacccgcacccaaggatcacccatggcgctacatgcctaatcacgcaatgacccctcacacctctgggactacaattgatgcacagctgaggtacgcgtctggtgtgaaggacatgttggataggtacttcaagggcgaggacttccccgcagagaactacatcgtcaaggaaggcgagctcgccagccagtacaagtagtaacccccctcggcgttgcatggtaacatatctgaagcgaggtgcgagagaagaaaccattatgttgttatatgagtgttttgtgagaacggaaataatggatgtctggattgcaaccatggcaatgaataaaaa

SEQ ID NO: 5179 - DNA, 590 bp, Brassica juncea
gtctcactcctaaacaccgcgatgttcagacgctttgctctatgcttacctataaactgggctatccggagattttaaaaggatttcctctgactccatacattacgagatatcttcctccatttgatgagtttgaagtggaccattgtgatcttcctacagggaaatcgacgatttttccggccatacccgggccttcggtttatctggttatagaaggaacagggaaactgcaaaccggttcatctcaattgttggttaaccgaggagatgttttgtttgttccggctcataacgagattcaggtaacaggagaaagtgatgtgataaagctttacagagctggagtcagcagcagattcttccagacactctagccaaagtataaatacatttatacatttgtttctttatttctacatataaccatagggatcaatgcgctgatgtgatcatagtatatcttggtccatgttctttattttcccaatggcctactgcgtattaaggttttaacgagttgttatattttattaacttctgttctttcactttataaccgaatttatatgtaaaatgatttaaaaacg

SEQ ID NO: 5180 - DNA, 740 bp, Brassica rapa
  misc_feature (683)..(683): n is a, c, g, or t
  misc_feature (717)..(717): n is a, c, g, or t
  misc_feature (735)..(735): n is a, c, g, or t
actatctgagaaggagaagttagtttggaactagagaaacagtatccaggtgacgtaggcgtgatctcagctttcttttttaactacgtcaagcttaatcccggagaggctttgtatttggatgcggaccagccacacgcttacatctccggcgactgtgtcgagtgtatggcggcttcagacaacgttgttagagctggtctcactcctaaacaccgcgatgttcagacgctatgctctatgcttacctataaactgggctacccggagattttgaaaggatttcctctgactccatacattacaagatatcttcccccatttgatgaatttgaagtggaccattgtgatcttcctacagggaaatcgacgatttttccggccatacccgggccttcggtttatctggttatagaaggaacagggaaactgcaaaccggttcatctcaattgttggttaaccgaggagatgttttgtttgttccggctcataacgagattcaggtaacaggagaaagtgatgtgataaagctttacagagctggagtcagcagcagattcttccagacactctagccaaagtataaatacatttatacatttgtttctttatttctacatataaccatagggatcaatgcgctgatgtgatcatagtatatcttggtccatgttctttatantggccaatggcctactgcgtattaaggttttaancgagttgttatattttantaaaa

SEQ ID NO: 5181 - DNA, 1493 bp, Brassica napus
acagttacttgttttattcttgggtcacacagaataactagaagcgggtaggtgtctgtgtctacttaatggtttacacgagccatgcatggagccagccaagaaagagaggaatggatcggatcaccatgttcctcctggcagctactctcgctgctgtgagatgcggctgtgatgctaattactccagaaacgatttccctcgcgacttcgctttcggatccggcacttctgcttatcagtgggaaggagcttataatgaagatgggaaaaagcctagcgtctgggatacttatgttcactctcgtaacttagataatggagacataacttgtgatgggtatcacaagtacaaggaagatgtgcagctgatggtggaaactggcttagatgcattcagattctccatctcttggtctaggcttatacccaatggaagaggtcctgttaacccaaaaggtctacagttctacaagaacttcatacatgaacttgtatcccacggaattgaaccacatgttacactgtaccattacgaccatccccagtctctggaagatgagtatggaggatggctcaaccgcaaaattatcaaagactttactgcttacgcagatgtttgcttcagagagtttgggaaccacgtcaaactctggacgacgatcaatgaggctaatatattcactattggaggttacgacggtgggggcacaccacctggtcgttgttccacatgctcgtcaggcaactcttccactgaaccatacatcgtagcacataacttgctgcttgcgcacgcctctgcttcaaggctatacaagcaaaagtacaaggatacgcaaggaggttctgtaggcttcagcatatttgcaataggatttagaccttctacaaactccaatgatgatgaattggcaattcaaagattcaaagatttcttcttcgcctggatgcttgggccacttacatatggagactatccggatggaatgaaaagaaaaattggaacaaggctgcctgttttctcagaggaagaatcagaactagttaaaggctcatctgactttgtaggagtcattcactatcttgctgcttctgtctcagactcccaatccaaaccttttcttccaggagactccaaattctttgcagacatgggcgtattattgacttacgttgggaatttcactgcctttgagtatgaaattgctccatgggctatggaaggtgtgctggaatatataaagcagagctatggcaatcctcctgtctacattcttgagaatggtaaaccgatgaagcaagatttgcagctgcagcaggaggacacaccaaggattgagttcgtacacgcttacatgggtgctgtcctcaaagccgttaggaatggatcagacacgagaggctacttcgtgtggtcatttatggacctgtatgagttactgagtggataacgaagtaatagttttggaatttactctgtgaatttcagt

SEQ ID NO: 5182 - DNA, 1431 bp, Brassica napus
gcgaaatccaccacctcttctttcggcttctccgtcagaaacgatcgacgactctgtcgatcatcacggcgtgtcctccgtgttctccgtcagacgagcactcgaaatccaccgagaggacatcatgatttggatgctgattaccgtcagctctcccaccaaactctctcttcaattcttctattttagatgctgtgaagaggcagatgactaagaacgatgaaaagcatcaaaaggaaggagagttacttgtgctgcttacagatggtagaaagctaatgggaacactctgttctttttgatcaattgagaagaagaggaagcccgtctctaagatgcggctgcgttgctaattacaccagagacgatttccctcatgacttcacttttggatctggaacttctgcttatcagtgggaaggagcttatgatgaagacgggaaaaagcctagcgtctgggacacttacgttcactctcgtaacatggagaatggagacaaagcttgtgatgggtatcacaagtacaaggaagatgtgcagctgatggttgaaactggcttagaggcattcagattctccatctcttggtctaggcttatacccaatggaagaggttctgttaacccaaagggtttacagttctacaagaatttcatccttgaacttgtatcccatggaattgaaccacatgttacactgtaccattacgatcatcctcagcaactcgaggatgaatatggaggatggctcaaccgcagaattataaaagactttacagcttatgcagatgtttgcttcagagagtttgggaaacacgtaaaattctggaccacaataaacgaggctaatatattcactgtaggaggttacgacggtgggaatacaccgcctggtcgttgttctacctgcttgtcaggcaactcatcgactgaaccatatatcgtagcccataacttgcttcttgcccacgcctctgcttcaaggctatacaaacaaaagtacaagaatacacaaggaggttctgtaggatttagcatatttgcaataggatttagacctagtacaaactccaaggatgatgaaatggcaatccaaagattcaaagatttcttcttcgggtggatgctggggcctcttacatatggagactatccagagggaatgaaaagaatagtaggaacaagactgccagttttcacaaaggaagaatcagaacaagtcaaaggctcctctgactttgtaggagtcattcactatcttgctgcttctatctcaaacgcccaatcccaaccttctcttccaggggactctgctttttttacagacataggcgcgtctttgacatactctggtaacttctcagctttcgagtatgaagttgctccatgggctatggaagtggtcctggaatatataaagcagagctatggc

SEQ ID NO: 5183 - DNA, 1569 bp, Eutrema parvulum
ggagccaaagtggaagacaggaaaatgtctgtgcttaatatttttctgactgttgctctgctctctttatgctgctgcgatgctttcaccaggaacgatttccctcatgacttcgctttcggatccggcacttctgcttatcagtgggaaggagcttttgaggaagacggcaaaaatcctagcgtctgggatacttacgtccactctcgtaacatggataatggagacatagcttgtgatgggtatcacaagtacaaggaagatgtgcagctgatggttgaaactggcttagatgcattcagattctccatctcttggcctcggcttatacccaatggaagaggtcctgttaacccaaaaggtctacagttctacaagaacttcatcaacgaacttgtaaccaatgggattgaaccacatgttacactctaccactacgatcatcctcagtgtctcgaggatgaatatggaggatggctcaaccgcagaattatcaaagacttcactgcttatgcagatgtttgcttcagagagtttgggaaccaagtcaaactctggaccacgatcaacgaggctaatatattcgctattggaggttacgacggtgggggtacaccgcctggtcattgttctacctgctcattggggaactcttcaactgaaccatatatcgtaggccataacttgctgcttgcacacgcctctgtttcaagactatataaccagaagtacaaggatatgcaaggaggttctgtaggctttagcttatttgcaataggatttactccttctacaagctccaagaacgatgcaattgctgttcaaagattcaaagatttctacttcggctggatgcttggtcctcttacatttggagactatcctgatggaatgaaaagaatcgttggatccagactgccagttttcacagagaaagaatcagaactagttaaaggctcgtctgactttgtaggagtcattcactatcttgcggcttctgtcgcaaatatcgaatcagaaccttctcttccagtagactcgagtttcaccgcagacacgggcgtatcattgacttactatgggaatttcacaactttcgattatgaagttgctccatgggctatggaagttgtcttggagtatataaagcagagctatggcaatcctcctgtctacattcttgagaatggtaaaccgatgaagcaagatttgcagctgcaagagaaggacacaccaaggattgagtttgtacatgcttatatgggtgctgtgctcaaagccgttaggaatggatcagacacgagaggctacttcgtatggtcgcttatggatttgtatgagttattaagcggatacgagtttagttttggattgtactctgtgaatttcagcgatcctcaacgcaagagatctcccaaactctctgctcattggtactctgctttcctcaagagcaacaccacttttcttgggtcccaagtgatcacacagttgcagagcaatacgtcttcttcagctgcttcctcctagcagtgttgtatttttaatatttgtttctgatatgtatac

SEQ ID NO: 5184 - DNA, 1345 bp, Brassica oleracea
  misc_feature (535)..(535): n is a, c, g, or t
  misc_feature (1293)..(1293): n is a, c, g, or t
  misc_feature (1312)..(1313): n is a, c, g, or t
  misc_feature (1321)..(1321): n is a, c, g, or t
ggagatatggcgtaggagaaggcgtgccatcgtccctgcattgcatatgaagtatgtagcagctatgatcagtttgtttggagaagcttcagataggctttgtcagaagcttgattccgctgcatctacaggagaagaagtagagatggaatcactcttctctcgtttgacgcttgatattatcggcaaggcggtttttaattacgactttgactccttaaccaatgataccggtgtgatcgaggcagtttacactgttctaagagaagctgaagatcgaagtgtttcacctattcctgtttgggacataccaatctggaaagatatttccccacgtcagaggaaagttgctacttctctcaagttgatcaatgacacactcaatgatttgatcgcaacgtgcaagagaatggtagaagaagaggagcttcagtttcacgaggagtacatgaacgaaagagatccaagcatccttcactttctcttggcttcaggagacgatgtatctagcaagcagctacgtgatgacttgatnacaatgcttatagctggacatgaaacatcagctgcggttttaacatggaccttttatcttcttacaacgaatcccaaagtagtggccaaacttcaagaagaggttgattctgttattggagatagattcccaaccttagaagatgtgaagaagctgaaatacactacccgagtcatgaatgagtcattgagattatatccacaaccaccagtactgattcgtcgttccctagagaacgataagcttggaccgtatcccataaaaagaggagaggatatcttcatttctgtttggaatctacatcgaagtccccttcattgggatgacgctgaagagttcaatccagagagatggcctcttgatggaccaaacccaaatgagacaaaccagaacttcagttacttgccgtttggtggaggcccgcggaaatgcataggcgacatgtttgcttcatttgagaatgtggtagcaatcgcaatgcttattcgaagatttaactttcagactgcaccaggagctcctccggtaaaaatgaccacaggagctacaatacacactacagaaggactgaaattgactgtaacaaagagaacaccacctctctctgttcctatccttccagtggaagctcctcgagatgaagtttcctctgctctgtcttgagtcttcttcatctttgcaaaactgaagaaataaacaagctcaaagaagaccaagaagaagaacaacaacaaatgcttctgattgtttctctgcantatattatgcagacaagtnnaatgtaangaaaattattcttcttcaaaaaag

SEQ ID NO: 5185 - DNA, 1079 bp, Raphanus sativus
gcagagaaaagttgctacttctctcaagttgatcaatgacacactcaatgatttgatcgcaacgtgcaagagaatggtagaggaagaggagcttcagtttcacgaggagtatatgaacgaaagagatccaagcatccttcactttcttttggcttcaggagacgatgtctctagcaagcagctacgtgatgatttgatgacaatgcttattgctggacatgaaacatcagctgcggttttaacttggaccttttatcttctaacaacgaatcccaatgtagtggccaaacttcaagaagaggttgattctgttattggagatagattcccaaccttagaagatatgaagaagctgaaatacactacccgagttatgaatgagtcattgagattatatccacaaccacgagtactgatccgtcgttctctagagaacgatacgcttggaccctatcccatcaaaagaaatgaggatatcttcatatctgtttggaatctacatcgaagtcctcttcattgggatgacgcagaagagtttaatccagagagatggcctcttgatggaccaaacccaaatgagacaaaccaaaacttcagttacttaccgtttggtggaggaccaaggaaatgcataggcgacatgtttgcttcgtttgagaatgtggtagcaatcgcaatgcttattcgaagatttaactttcagactgcaccaggagctcctccggtgaagatgactacaggagctacaatacatactacagaaggactgaaattgactgtaacaaagagaacaccacctctctctgttcctatccttccaatggaagctcctcgagatgaagtttcctctgctctctcttgagtcctcatcttctgattgtttctccgcgttatattatgcagacaagtagaatgtaaagaaaattatattattctttgaaaaaagatatacaaatttcaaatatttttctaggacataaacacgaagctttgattttacgtcaatgaagtgataatcatcgagagtgtatacttccatcatcgaagttgtttatgatctaggaaaaatctcttctgca

SEQ ID NO: 5186 - DNA, 1286 bp, Brassica napus
tgggacgggcccccctcgagacctcttctctcgtttgacgcttgatattatcggcaaggcggtttttattacgactttgactccttaccaatgataccggtgtgatcgaggcagtttacactgttctaagagaagctgaagatagaagtgtttcacctattcctgtttgggacataccaatctggaaagatatttccccacgtcagaggaaagttgctacttctctcaagttgatcaatgacacactcaatgatttgatcgcaacgtgcaagagaatggtagaagaagaggagcttcagtttcacgaggagtacatgaacgaaagagatccaagcatccttcactttctcttggcttcaggagacgatgtatctagcaagcagctacgtgatgacttgatgacaatgcttatagctggacatgaaacatcagctgcggttttaacatggaccttttatcttcttacaacgaatcccaaagtagtggccaaacttcaagaagaggttgattctgttattggagatagattcccaaccttagaagatatgaagaagctgaaatacactacccgagtcatgaatgagtcattgagattatatccacaaccaccagtactgattcgtcgttccctagagaacgataagcttggaccgtatcccataaaaagaggagaggatatcttcatttctgtttggaatctacatcgaagtccccttcattgggatgatgcggaagagttcaatccagagagatggcctcttgatggaccaaacccaaatgagacaaaccaaaacttcagttacttgccgtttggtggaggaccgcggaaatgcataggcgacatgtttgcttcatttgagaatgtggtagcaatcgcaatgcttattcgaagatttaactttcagactgcaccaggagctcctccggtaaaaatgaccacaggagctacaatacacactacagaaggactgaaattgactgtaacaaagagaacaccacctctctctgttcctatccttccaatggaagctcctcgagatgaagtttcctctgctctgtcttgagtcttcttcatctttgcaaaactgaagaaataaacaagctcaaagaagaccaagaagaagaacaacaacaaatgcttctaattgtttctctgcattatattatgcagacaagtagaatgtaaagaaaattattattctttgaaaaaagatatacaagtttcaaatattttctaggacatacacacgaagtctcggattacatcaatgaatgaagtgatgatc

SEQ ID NO: 5187 - DNA, 2020 bp, Theobroma cacao
attcgttggcagcttaatgaattatggctgctactccagcttatcctcctcttcaacttcatttaaccaaacccaaatcagcagcattccctttaaaacattatgggacatctaagtttggaatagtgaaatgtgggtcatcgtctaacgggagagagcctgactcagtcgacaatggtgttaaaagtatcgaacttttgcgtgaagagaaacgccgggctgagttgtctgctaggattgcttccggagaattcactgttcagaaatctggttttccttctctattgaggaatggtttatcgaaactaggtgttcctattgaggttcttgaatttttatttaaatgggttgatgatggtggagattatcctaagattccagaggcgaaagggaccattaaggccatccggagtgaggccttctttctacctttatatgagctgtatctcacttatggtgggatgttcaggctaaccattggaccaaagtcctttttgattgtatctgatccttccattgctaagcatatattgagggacaactcgaagtcttattcaaagggtgtattagcagaaattttggaatttgtcatgggcaagggactcattccagctgatgctgagatatggcgcgttagaagacgtgctatagtcccagcactgcatcaaaagtatgtagcagctatgattagcctttttggacaagctactgagaggctttgccagaaactagatgatgccgcaactgatggggaagatgtagaaatggaatcacttttctcccatttgacgttggacattattggaaaggcagtctttaattacgattttgattcattaacaaatgataccggaatagttgaggctgtttacactgttttgcgggaagcagaagatcgaagtgtctcaccaattccaacctgggagatccctatttggaaagacatttcaccacaacaaaggaaggtcgcagaagcgctcaaattgattaatgatgtacttgatgatctaattgcgacatgcaagaggatggtggaagaagaagagctacagtttcatgaggagtacatgaatgaacaagatcctagtattcttcacttcctgctggcatcgggagatgatgtttctagtaagcaactccgtgatgatctaatgacactgcttatagctgggcatgaaacatcagctgctgttttgacatggaccttctatcttttatcaaaggaacctactgttgtatccaagctccaggatgaggttgactctgttctaggcgatcgatttccaacaataggtgacatgaagaaactcaagtatactactagagttattaatgaatctttgaggctctacccgcagccacctgtcttaattcgtcgttctcttgaggatgatgtgcttggaaagtacccgataaaaaggggtgaagatatttttatctctgtttggaatctgcatcatagtccaagtctctgggaagatcctgagaagttcaatcctgaaagatggcctttagatggaccgaatcctaatgaaacaaaccaaaatttctgttacttgccctttggtggaggacctcggaaatgtgtaggagacatgtttgcatcttttgagaatgttgtagcagttgcaatgcttgttcgacgatttaactttcaaatggcgcttggagctcctccggttgagatgactactggagcaactatccacacaacaggggggctgaagatgacagttacacgaagaatacagcccccaattatccctgaactagacatgcagggattaaagatggaagcatctgccagaaattctgaagaagagacccaacttggtgagaaaggtgaagtttctcaagctcattcataactaggatagattgctacatttagcttcattacacaacgcatatgtatcatggggaagtaatgttggaggacagaaacactgggagaaattaagtatgcttccccttcagttgctgtttaatgctatcagaataatcaattactttataactt

SEQ ID NO: 5188 - DNA, 3037 bp, Eucalyptus grandis
gtatcatattaaataaattacaaatttaggacaatgagtatttgtgccattttctcatcggctaatcacgaggggttaaaagacaaaggcagtaacgcaaggagtaggaggagtatctcaaacgtcttgccttcggagattccaacgtttggctcttagcgtttgaaggccgcctttttccgttgcattatctctctctctctctctctctcttaagcacttgaggactctcatttctcagcaaaagacagcgcgcttcaccccctcctgaaggacagaaggagcttctttcccggtttaatggccactaatttcctccctctccagtccccatcctccatttctactctgcctaatttccagaccaagcttcgcaccacccgtttcagacaacccgcttctgctaaactgaagggtaactacagatgggcgacggccatcgcttgcgcttcttcgaacggcagagagcctgagtctgtggacgaccgtggggtgaagagcgctgagcagttgctcgaagaaaaacggcgcgccgagctgtctgctcggattgctgctggcgaattcaccatcgagcgatcggggtgagtgaagatttctcgttcaattgcggctttgttagaatttagtgaagagaagcaagaattttgatgggtttagcttgtcccccatggaaattgttcatctgggtgtgttcactgggagacatgtttcctgctttggctgatattatgcaaattgtgacagtctaatggtctgcttagataccaatgaagaagaaagttcacatctaggtttccacttggcgttaaagttattgccagctaatctgggtcatcttcagttttttgccagaataatcatgtgtttgatttctagtagtcttgttcatgtacgggagatgtatattgtgctaaagagagaagatacagaacatttgaccacccctgtttcaagacatccaaagattgcattgaagcaaagtagacatagagatctttgttcttttttcctgagtaaaggaataactcatctacttaagaagcagaccaatccagtgtcaagccaaacttatggtacttaaaggcgttgagcagtgatattctcagatttgctgggaggaggataagaaacagattacaactactacaattgttatgggagtactttaagaattggctttatttacaagcacccaatatatctttgctgattatgacttttgttcccccttcgtcctgagtccccctctggataaagttttccatctcaggtgaggaatggcttgtcgaaggtgggtgttcctcccgaagttttggattttttctttcaatggtttgattccagtaaagaccatccaaaaattccagaggcaaaaggtgcaattaaggccattcagaatgaggcgttcttcatccccttgtatgaactttatctcacatatggcggcattttcaggttgacctttggtcccaagtcctttttaatagtttctgacccatcaattgcaaagcatatattgaaggacaactcaaaagcttattcaaagggtattctagcagaaattctagagtttgtcatgggaaagggacttataccggcagatggggaagtatggcgagtacgtagacgtactatagtccctgccttgcatcagaagtatgtagcagctatgattaacttgtttggacaaactacccaaagactttgcgataagcttgatattgctgcttctgaaagggaagatgtagagatggagtcactcttctcccggttgacattggatgtcattggaaaggcagtctttaactatgattttgattcattgacaaatgacaccggaataattgaggctgtgtatactgtgctgcgggaagcagaagatcgaagcgtttcacctatcccattctgggaaattcctatatggaaagatatctcaccaaagcaaaagaaggtcaatgaagctttgaagttggtcaatgatgcccttaacgatttgatagcaatatgcaagaggatggtagatgaggaggacttgcagtttcatgaggaatacatgaacgaagaggaccctagtatccttcacttcctcttggcatcgggagatgatgtttcaagtaagcaactcagagatgacctgatgacgatgctgatagctggacacgaaacatctgctgctgtgctaacttggactttttatcttctatcaaaggagcctactgtcatgtccaagctccaaaacgaggttgattctgtgcttggcgaccgaataccaaccatcgaggacatgaaaaaactcaagtatacaactcgagttatcaatgaatcaatgaggctctacccacagccacctgtcttgattcgtcgatctcttgagaacgatttccttgggaagtacccaataaaaaggggtgaagatatctttatttctgtctggaacctgcatcgaagtccacatcactggattgatgcagacaagttcaatcctgaaagatggccactagatggacctaatccaaatgaaaccaatcaaaatttcagttacttgccctttggcggtggacctaggaaatgtgtaggggacatgttcgcgtcctttgagatggtagttgcggtggcaatgcttgtccggcgattcaactttcaaatggctcttggagcacctgcagtaaaaatgaccacaggagcaacaatccacactactgaaggattgaagatgactgttacacgaaggctacaacccccaattgtccctacattagagatgccactgcttcaagtggaaaattccgcaagtagttctcaaggtgattcggtgttgagtcagaaaggtgaagttacatctgcccattcttgaactgattgggcgttttgctgcatcattcatggtgatttatctttgggaaatgcattccctttgagtgtaatatacttttccccttatcagcatttcggggaacatgtatatgtacattgagaacagttacagtctctgagaagtaaattggattgcgtatccaagttcatgtgtccctat

SEQ ID NO: 5189 - DNA, 2614 bp, Cannabis sativa
tccaaccattttttttgaaacaatccaaccattttcaagtactgtatctatgatctgttcgaagaaaaaaattcaacaaattagccttgacattaaaaatttagctttctttctatgcttgaatcattaaaaaagctgtctttacaatgaaagattgaacatttgaagcttatgtagtgttttttctacctaaaaacaacagagccacaaaactgtctgatccaaaaatccaccacgtgttgaccttctcaagtatcaaactgtgaaaactattcaagattccaaaatctgttttttagtggaccagaaaaccttattattattattttttttaactgtctttgaattatcattatcatcatcatcaaacatctgaggctttagttaattttctttcatttaaggtgtttcattattcaccaccttcttcttcaatggcttccaacatttttctacttcactcacctccttcttttcatactactagactcagacccacttcctcatacccaattggattaagaagtagtaataataatcataaagggttgtctgtaattacatgttcatcttcaaatggaagagaacctgactcagtcaagaagaagaagcgtgaggagctctctgctaggattgctgctggagatttcactgtaaatcaatctggttttccatctcaagtgaagaatggtttgtcaaagttgggagttcctaaagagacattggaattcttttttagttgggttgattccaatggagattatcccaaagttccagaagcaaaagggtctgttagagctgttcaaagtgaggccttttttattcctttgtatgagcttttcattacatatggtggaatttttagattgacttttggaccaaagtcatttttgatagtgtctgatccttccattgctaaacatatacttagagataattcaaaggcttattcaaagggtattttagccgaaatcttagagtttgtaatggggaaaggacttatcccagctgatggagaaatatggcgtgttcgtcggcgtactattgttcctgcattgcatctcaagtatgtagcagctatgatcaatctctttggacaagctacagataagctttgtcagaagctagatgctgctgcaaatgatggggaagatgttgagatggaatcgctcttttctcgtttgacattggatatcatcggcaaggcactctttaattatgatttcgattctttgactaatgataccgggatagttgaggctgtttacactgtcctgagagaagcagaggatcgaagtatctcgcctattccattttgggagatcccaatatggaaggacatatcgccgaggcaaaggaaggtttctacagctctcaaattaatcaacgacacgcttgataatcttattgcaatatgcaagaggatggttgatgaagaagagctgcaattccacgaggaatacatgaacgaaaaggatcctagtattcttcacttcctcttagcctctggagatgacgtttcgagcaagcaacttcgcgatgatttgatgacaatgcttatagcggggcatgaaacttcagctgcggttttaacatggacattttatcttttatccaaggagcctcgggttgtagctaagctccaagaagaggttgattcggttctaggtgatcgatatccaaccattgatgacatgaagaaactcaagtattcgactcgagtgatcaatgaatcccttcggctttaccctcaaccaccggtgctaatccgtcgctctattgaaaatgacacactcggtcaataccctataaaaagaggagaggacatatttatttcggtatggaatctacatcgcagcccaaatcattgggagaatgcagacaagttcatacccgaaagatggcctttagatggacctaatccaaacgagactaatcaaggttttagttatttgcccttcggaggagggccccgaaaatgtgtcggtgacatgttcgctacctatgagactgtagtggcgctcgctatgcttgttcgaagatttaacttccaaatggcagttggagcccccgaagtaaaaatgacaaccggagcaacaattcacacaaccgacggattaaacatgacggtgactagaagagtaaaaccgccaatagtgcctacattggagacacaagcaatgaatttggattcatcatcgtcgtcatcagcagcagccggtgttatcgggaacgatccattagttggtcagaccggttaagtttattcttttgtacattcatggtgaagctagctccccaagctacatacacattacttgtagaataatacaatgtgacattattacaaaaagggaaatcaattcaagaaaagaaagaaaaaagagttaattgaaaatgtcaatgttggttctttcttaatttctctataaacacatattttagctaataataaagtgaagtaacaatacttaactaaacttttagaatagattatgaaatgaaggtgttccaaataataatagtagctcagtcccgagtgtctaccgttatacctacaatgatcggatgtactattgttgttcataataaaaaagaatattttcccatttat

SEQ ID NO: 5190 - DNA, 2515 bp, Malus domestica
atgcatgtgttttgggtcgggtcgggttgggtgagtgagaagataccgaatccccgacgcaaacggattttagttggcgggtacgtaactgctaactcagccaaaagatactccctcacgaacttgagagctagaaaacgaccacgtttggcccctgcattatcatcatcttcttcttcctcctccttccctctcttcctcaaccgccgatccccgacggctgagggccacatttggcccctgcattatcatcatcttcttcttcctaaaccgccaatccccgacggctgagggccaccgccaatggcggccgccgccaccattcctcttctgcagttcgtccccgccaaaaccttccaggccaagcaccactccaacaggctccgaccaaccaaacagagaggaagttttggtttgtctatgattacatgcgcgtcttctaatggaagagagcctgattctgccgacggcggcgtcaagagcgtggaacgtttgctggaaaagaagcggcgcgccgagctctctgctcggatttcttcaggagagttcactgtggagaaatctggttttccatctcaattgaagagtggtttgtcgaaggttggtgttcctactgggctactagatttcttgttcagctgggctgatgcacctgaaaactatccaaaaattccggaggcaaaaggagcgatcagtgccattcaaagtgaggcctttttcgtcccgctgtttgaactttacctcacatatggtggaatttacaggctgacatttggaccaaagtcctttttgatagtttctgatcccgcgattgccaaacatatattaagagaaaattcaaaggcttattcaaagggaatcttggctgaaattctagaatttgttatggggactggactcattcccgcagacggtgaaatatggcgcgttcgacgacgtgctatagttcccgcattgcatcagaagtatgtaacagctatgattaatctcttcggagaagctacagacaggctttgccggaagctagatgccgctgcatctgatggggaagatgtagagatggagtcgcttttctcccgtttgacactggacatcattggcaaggcactttttaattatgattttgattcgttaacaaatgacactgggatcgtcgaggctgtgtacactgtcttgagagaagcagaagatcgtagtgttgcaccaataccattatgggagatcccaatatggaaagacatttcaccacgacaaagaaaagtcgcaacagccctcaaattaattaatactacactggatgatttgatagcaatttgcaagagaatggtagacgaagaagagctacagtttcatgaggagtacatgaatgaacaagatcctagtattctccatttccttttggcatctggtgatgatgtctctagcaagcaactccgtgatgacttgatgacaatgctaatagctgggcatgaaacatcagctgcagtcttaacgtggaccttttatcttctttccacggagcctggggtcatggccaagctccaagaggaggctgattccgttctgggagatagatttccaaccattgatgatatgaagaaactcaagtatgcaactcgagtgattaacgaatccttgaggctttacccacaaccacctgtgttaattcgtcgttcactggaggatgacaagcttggagactaccctattaaaaggaatgaggatatatttatttgcatttggaatctgcatcgcagtccaaaacaatgggacgacgcagataagtttaaccctgaaagatggccattagacggacccaatccaaacgaaacaaaccaaaattttcgttacttgccctttggcggaggaccacggaaatgcttaggtgacatgtttgcaacgttcgagactgtagtagcactttcaatgcttgttcgaagatttaactttcaaatggcactcggcgctcctgaggtcaagatgacaacgggagccaccattcatacgacggaagggttgaagatgacagtcagtaggaggataaaacctccgattgttcccacattggagatgcctgcatttgaagtggataagcccgtcggtgtcccaaaaggggattctttagttagtcagaaaggtgaggtttcttctgctcatccttgatccttgattatcgcagtcgagctacatgattctaaatggctgagatttatgttctgatgtgtttgatgtgcttcggttaaatcttctgttcgacgacgtcaggtttgtagtaggtaatgctgtaaattaaggggggtgtattcaattaggattttgagggaatttaattcttttaatgaatccaggggtattcaatctggattttaagtgattctctaaaattcaatgtgtattcaatcaggattttaaggtagtttatttaaatcattagaaatttagatgtattcaattagaattttaaagaagtttataacattccaggtgtattcaattaaaattaaaatttaaagaa

SEQ ID NO: 5191 - DNA, 1899 bp, Ricinus communis
atggctgccaattttgctctccttcaagtcccatcatccatctctgctaagcaccattgtttgcaaactaagtttcaagttagaagagttaaacccatcaacctatcttcattccctcctacccaaaatggtgtgttggggaagcgtaaatttgctgttatttcatgtgcttcctcaaagggaagagagcctgagtcagaggaagatccagtcaagagtgtagagaggattcttgaagagaaacgacgagctgaattgtctgctaagattgcttctggagagttcactgtacagcaatctggctttccatctatattgaggaatggtttgtcaaaactgggggttccaaatgaaactttggaattcctattcaaatgggtcgatgctggtgaaggttatcctaagattccagaggcaaaaggagcaattagtgccattagaagtgaggctttcttcatacccttgtatgagctttacctcacttatggtggaatttttagattaacttttggacctaagtcctttctgattgtttctgatccttctattgcgaaacatatacttagagacaattcaaaggcttattcaaagggtatcttggctgaaattctagattttgtcatggggaaaggactcatcccagctgatggagaaatatggcgtgtcagacgacgtgctatagtcccagctttccatcagaagtatgtagcagccatgattggcttgttcggacaggcaacagataggctttgcaagaagcttgatgcagctgcatctgatggggaagatgtagagatggaatcacttttctcccggttgacattagatatcatagggaaggcagtatttaattacgagtttgattcacttgcaaatgatactggaatagttgaggctgtttacacagttttgagagaagcagaagatcgaagtgttgcaccaattccagtctgggagattccaatttggaaagacatctcaccacggcaaaggaaagtctcggcagccctcaagttgatcaatgatatacttgatgaccttattgcattatgcaagaggatggtagatgaagaagagttacagtttcatgatgagtatatgaatgaacaagatcctagtattctccacttcctgttggcatcaggggacgatgtttctagcaagcaacttcgtgatgacttgatgacaatgcttatagctggacatgaaacgtcagctgcagttttaacatggacattttatcttttatccaaggagccaagtgtcttgtccaagctccaaaacgaggttgatacaattctaggagatcgatttccaactatagaggacgtgaagaaactcaagtacacaactcgagtaatcaatgaatctttgaggctctatccacaaccgcctgtattgattcggcgttctcttcaggatgacatgcttgggaagtaccccataaaaaggggagaagatatatttatatctgtttggaacctgcatcgcagtccacatttatgggatgatgcagaaaagtttaaccctgaaagatggcctttagatgggccaaatccaaatgagacaaaccaaaatttctgttacttgccctttggtggaggaccaaggaaatgtgttggggacatgtttgcttcatttgagactgttgtggcaacagccatgctagttcgaagattcaattttcagctagcccttggagcccctcctgttaaaatgacaacaggagcgacaatccacacaacagaaggattgacgatgacagtaacacgaagaatacaacctcccataatgccaatgctggatatgccagcaatgaaaggggatgcacctggaagtgttcccagcggggaatctcagctcggtcagaaaggtgaagtttctcctgcccattcctga

SEQ ID NO: 5192 - DNA, 2795 bp, Ricinus communis
taaaacagacacataaactgatagaccccatcatcataattcaataccatccctttctttttactgttgattagcaatagtttcagtttagcatttaatttatcagctcttcaatctcttaactcagaagggcagcagctaaatggctgccaattttgctctccttcaagtcccatcatccatctctgctaagcaccattgtttgcaaactaagtttcaagttagaagagttaaacccatcaacctatcttcattccctcctacccaaaatggtgtgttggggaagcgtaaatttgctgttatttcatgtgcttcctcaaagggaagagagcctgagtcagaggaagatccagtcaagagtgtagagaggattcttgaagagaaacgacgagctgaattgtctgctaagattgcttctggagagttcactgtacagcaatctggctttccatctatattgaggaatggtttgtcaaaactgggggttccaaatgaaactttggaattcctattcaaatgggtcgatgctggtgaaggttatcctaagattccagaggcaaaaggagcaattagtgccattagaagtgaggctttcttcatacccttgtatgagctttacctcacttatggtggaatttttagattaacttttggacctaagtcctttctgattgtttctgatccttctattgcgaaacatatacttagagacaattcaaaggcttattcaaagggtatcttggctgaaattctagattttgtcatggggaaaggactcatcccagctgatggagaaatatggcgtgtcagacgacgtgctatagtcccagctttccatcagaagtatgtagcagccatgattggcttgttcggacaggcaacagataggctttgcaagaagcttgatgcagctgcatctgatggggaagatgtagagatggaatcacttttctcccggttgacattagatatcatagggaaggcagtatttaattacgagtttgattcacttgcaaatgatactggaatagttgaggctgtttacacagttttgagagaagcagaagatcgaagtgttgcaccaattccagtctgggagattccaatttggaaagacatctcaccacggcaaaggaaagtctcggcagccctcaagttgatcaatgatatacttgatgaccttattgcattatgcaagaggatggtagatgaagaagagttacagtttcatgatgagtatatgaatgaacaagatcctagtattctccacttcctgttggcatcaggggacgatgtttctagcaagcaacttcgtgatgacttgatgacaatgcttatagctggacatgaaacgtcagctgcagttttaacatggacattttatcttttatccaaggagccaagtgtcttgtccaagctccaaaacgaggttgatacaattctaggagatcgatttccaactatagaggacgtgaagaaactcaagtacacaactcgagtaatcaatgaatctttgaggctctatccacaaccgcctgtattgattcggcgttctcttcaggatgacatgcttgggaagtaccccataaaaaggggagaagatatatttatatctgtttggaacctgcatcgcagtccacatttatgggatgatgcagaaaagtttaaccctgaaagatggcctttagatgggccaaatccaaatgagacaaaccaaaatttctgttacttgccctttggtggaggaccaaggaaatgtgttggggacatgtttgcttcatttgagactgttgtggcaacagccatgctagttcgaagattcaattttcagctagcccttggagcccctcctgttaaaatgacaacaggagcgacaatccacacaacagaaggattgacgatgacagtaacacgaagaatacaacctcccataatgccaatgctggatatgccagcaatgaaaggggatgcacctggaagtgttcccagcggggaatctcagctcggtcagaaaggtgaagtttctcctgcccattcctgatttgatataagcccatacctttgctgtgattcaattaatagggagtagaaggaaagaaaaaagcaaaaaaccaatctggaagaggtcgaaatgtcttcattttccaagtttttaaagttggtagcaaagcaatgtaccctcctcagagagatatatatatacccctttgcacttataatgtaagaaactgttgaaatcttgaagttggttattataagacaatttttgcagctcttgcttttgcacccgttggttagtattgcagctcttgcttttgtccacattctcatcttagcagttgcaagctcatctatgcaggcatggatcagcataaacatttctttgcattgaagttgaaaattgcttctttttatcaaccaaaaagaaaattagaagtaaaaataatgcttctttttttttctatcttttaatttttcaagaaaaagtaagtctattcaacttaaaagcagaaaaacaatctgaaaaaactgtataaaaagccaaacatcatattaataacataacacggcaaaaccaacatatcagataaaacttatagtgtttcataatatggaaaatcaaaatcatctgcggcaaccaaagcatcctcgtagtgaaggaaactttgaatgtgcaggtggtgaccaaggttcagattccaaccttttgccaggaaaatgtttataaaaagcatttactgcaccttttaccccatcctcctcctccatggccttggacaattcaacagcaagtt

SEQ ID NO: 5193 - DNA, 2646 bp, Medicago truncatula
ttaacattgtaaaatttcatggagcaattaaaattttattaatttcagtggaatgagtaattgacgaaacttacaatttcaaatctttaattggttatttactctacaaataactcactaccaaacaacactttccattccaattcccatataaatatccttaaatattaatttttttacaatgcttcgatgtcgtacttattggttcaatcgaacgtggtggttcaatcaaacgtggctgattctcataaaaacaaaacatgaaaatagtatctatccaaaagattccaactcagaacctgacacaaaaacacaaaactcctttgacacatgagtgttgtgtattaaaacacttacacttatctcttccacaattggatgttacttttgtaacaccaattttgtgttatctaacttctatggcttctcatcttactcttcttcatgctcctcctcctctttcacttcaaacaaaaacctttcattccaaatatattaccataaaaccactcaaaccaaccaccactttttcttcatcttgttctctctttccatgttccttaaaaacatcacatagaggatcatgttcttcattcattgcatgttcttcttcaaatggtagaagtccaaatgattcagtggatgatggtgttgttaagagtgctgaccagcttcttgaagagaaaagacgagctgaattgtctgctaaaattgcctcaggtgaattcactgtcaaacaagaatctggtttaccttctatattaaagaagagcttgtcaaatttgggagtgtccaatgagattttggaatttttatttggtttgtatcctaaaattcctgaggcaaaagggtcaattagcgccattcgaagtgaggcctttttcattccattgtatgaactttacatcacatatggtgggattttcaggctgaattttggaccaaagtcctttctgatagtatcggatccggctattgcaaaacacatattgaaagacaattcaaaggcttattctaagggtatcttggctgagatcctggattttgtaatggggaaagggcttatcccagctgatggggaaatatggcgagttagacggcgtactattgtcccagcattgcatctgaagtttgtagcagctatgatcggcctttttggacaagctacagacaggctctgccagaagctagatactgctgcatctgacggagaagatgttgaaatggagtcacttttctctcgattgacgttggacgtcattgggaaagcagtattcaattatgattttgatagtttatcaaacgacactggtataattgaggctgtttataccgtactgagagaagcagaagatcgaagcatttctccaattccagtctgggatctcccaatatggaaagacatatccccgcgtcaaaggaaggttactgcagctctcaaacttgtcaatgatacacttaacaatctcatagcaatatgcaagagaatggtggatgaagaagagctacagtttcatgaagagtacatgaatgaacaagatccaagtattcttcacttcttgttggcgtcaggagatgatgtgacaagtaagcaactccgtgatgacttaatgacaatgctcattgctggacatgaaacttcagccgctgttttaacttggaccttttatcttctttcaaaggaacctagtgtcatgtccaagctccaagaagaggttgactctgtacttggtgaccgatttccaactattgaagacatgaagaaacttaaatatacaactcgagtgatcaatgagtcactgaggctttatccacaaccgcctgtgttgattcgtcgctctattgaggatgatgttcttggagagtatcctataaaaagaggagaagatatttttatatccgtgtggaatctgcatcgcagtccaacactgtggaatgatgctgataaatttgaacctgaaagatggccattagatggacctaaccctaatgagacaaatcaaggcttcaaatatcttccatttggcggagggccacgaaaatgtataggggatatgtttgcttcatacgaggttgtagtagcacttgcaatgcttgttagacgattcaactttcaaatggcagttggagctccaccagttgttatgactactggagccacaattcatacaacacaagggttgaacatgactgtaacacgcagaataaaacctcccatcgttccctcattacagatgtcaacattggaagtggatccatccgtgagcatttctgataaaacagaggaaataggtcagaaggaccaagtttatcaggctcaaaagtcgtgatttctggaaatgaatccatacaacataaaatgagtacaaatagagttattttctatcttccaagtgaattacttctttagttcctttctaaaaaggaagagagtcaagtccttcaaatccttcacatcttcacaattcttagtaaatagagtacaacaattcacaaatcatttcttatcgaaaaagcttctaaagaaatatagtatttaaggcaattgatattatcatctattatgtagagtcagtaaatactatgaacgtggatcaaagttacaaattttattctatatatacacatttatagttgatatttgaa

SEQ ID NO: 5194 - DNA, 2295 bp, Arachis hypogaea
cggcaggggaaggtgattaccccgaaattcctgaggcaaaaggatctgtcaaggctattagaaggtgaggcattcttcattccattgtatgaactttacctcacatacggtggaattttcaggttgacttttggaccaaagtcctttttgattgtatctgatccgtctatagcgaaacacatcttgagagacaattcaaaggcttattcgaagggtatcttggctgagatcctagagtttgtaatggggacagggctcatcccggctgatggggaagtgtggcgagttcgacgacgagctatagtcccagcattgcatctgaagtacgtagtgacgatgattagcctttttggacaagccacagataggctctgcaagaagctagatgatgctgcatctgtacggggtaagtattgtttgtagatggaatcacttttctctcgattgaccttggacatcattggaaaggcagtattcaattatgatttcgacagtttaacaaatgataccggtatagttgaggctgtatatactgtactgagagaagcagaagatcgaagcgtttctccgattccagtatgggagatcccaatatggaaagacatatcaccgcgtcaaaggaaggtttctgctgctcttaaattggtcaatgatacacttaatgagctggtagcaatatgcaagagaatggtggacgaagaagagttacagtttcacgaggagtacatgaatgagcaagatccaagtattctgcatttcttgttggcatcaggagatgatgtgtcgagtaagcaactccgcgatgatttaatgacaatgctcattgctggacatgaaacttcagctgctgttttaacttggaccttccatcttctatcaaaggagcctagcgtcgtgtcaaagctccaagaagaggttgactccgtactaggggatcgatttccaacgatcgaagacatgaagaaactccgatatacaacccgagtgatcaatgagtcaatgaggctttaccctcaaccaccagtgttgatccgtcgctctcttgagaatgatatgctcggcgagtatcctataaaaagaggtgaagatatctttatatctgtctggaacctgcatcgtagtccaaacctatgggatgatgctgataagtttcaaccggaaagatggccagtagatggacctaaccccaatgagacaaatcaaaacttcaagtatcttccatttgggggaggaccgcggaaatgtgttggtgatttgtttgcttcatacgagaccatagtagcacttgccatgcttgttagacggttcaactttcaaatggcagttggagccccaccggttgagatgactactggagcaacaattcatacaacacaagggttgaagatgacagttacacgcagaataaaacctccaatcgtgccctcattacaaatgtcaaccaaggaaattgatccatccatgagcaaagatgacacaagtcagaaaggcgaagtttatcaggctcagtcctaaatctttgaagttgtgaaattaattatgtatagttctatcttccatccatttttttatgcatgtaatgagattggaacacagcaatctttcacatcgtcacaacttctaaaaaatagtttacctgagttcacaaactataaattcatctatagaaacttagaggaggatgcacaaaatactctctgcttttctagtataagtgtcaacagagattggaacaatgatatctgaaataacatttgtaataatatgagttgatataccttgatttcttagtataagacatagggcctaaagtaaatggaatttacattccatccaccagtgggtgtaaaacaagtagcattgatcaatgaaatgaggagcaggaacattcactatttgctgctaaataagagagaagagtgattatcatttacaagtaaattagatcctgatgaatcaatatccatggagatgattacacagaattaaaaaaaaacacgatttacatttcttaatggcacattacattagaatagactgaagggtgaacatgtgatttaagtgagccaattagctatacgaggatttatatctatctagaagttgtggatttagatctagagagaccaaagcatcctaggaaggagaacccaagtctaggcacggtggctaccggttgatggttggtctcggaatcaggtgtttgaggataataatgtttgtagaaggctgcaactactcctgccacccccttttcatgttttatggcatcggcaagtttttcggcattccttt

SEQ ID NO: 5195 - DNA, 2292 bp, Glycine max
gaagcttacacacggtacacagacacagtatcaagtgttgtgttatgttgcgttagtgcattaaccacttatacttatacacttatctgttgtccactgctccttcagcaacaacagcaacactttttggtgccatccatggcttcccacgttgctcttcttcgtgctcctcctcctctttcaatctccactcaacgcttccatgccaaacagatttccattaacggactcaaattcacttcttcttcttcttgttttccatgttccataacaacacagagagggtcttgttcctctgtgattacatgttcatcttcgaatgacagagacccgaattcggtggatgatgaagatgtaaaacaagtggagcgcattctcgaagacaaacgacgagctgcattgtctgctaagattgcctcaggggaattcaccgtgaggcagaaatctgttttactttcaataatggagggcttggcaaaggtgggggcgcccaatgaagttctggagtttttgtctggttgggttgaagggggtggcttgcaacccaaaattcctgaggcaaaagggtcaatcaaagctattcgaagtgtggccttcttcattcccttgtatgaactttacctcacatatggtgggatttttaggttgacctttggaccaaagtcctttctaatagtatcagatccctctattgcaaaacacatattgagagacaattcaaagtcttattcaaagggtatcttggctgagatcctagactttgtaatggggaaagggctcatcccagccgatggtgaaatatggcgagttagacgtcgtgccatagttccagcattgcaccagaagtatgtagcagctatgattggccttttcggacaagcttcagataggctctgccagaagctagatgctgctgcatccgatggagaagatgttgagatggaatcacttttctctcgattgaccttggacatcattggcaaggcagtattcaattatgattttgatagtttatcaaatgacactggtatagttgaggctgtttatactgtactgagagaagcagaagatcgaagtgttgctccaattccagtctgggagatcccaatatggaaagacatatcaccacgtctaaggaaggttaatgcagctctcaaattcatcaatgatactcttgatgatttgatagcaatatgcaagaaaatggtggatgaagaagagttacagtttcatgaggagtacatgaatgaaaaagatccaagtattctacacttcttgttggcatcaggagatgatgtgtcaagtaagcaacttcgtgatgacttaatgactatgctcattgctggacatgaaacatcagctgctgttttaacttggaccttttatcttctatccaaggagcctagagttgtgtccaagctccaagaagaggttgactctgtacttggagatcgatatccaactattgaagacatgaagaaactcaaatatacaacccgagtgatcaatgagtcattgaggctttacccacaaccacctgtgttaattcgccgctctcttgaggatgatgttcttggagagtaccctataaagagaggtgaagatatctttatatctgtatggaacctgcatcgcagtccaaaactatgggatgatgctgacaagtttaaacctgaaagatgggcattagatggaccaagtcctaatgagacaaatcaaaacttcaaatatcttccgtttggtggcggaccacggaaatgtgtaggtgatttgtttgcttcatacgagacggtagtagcacttgcaatgcttatgagacggttcaactttcaaatagcagttggagctcctccagttgagatgaccactggagctacaattcatacaacacaagggttgaagatgactgtaacacacagaataaaacctcctattgtgccctcattacagatgtcaactatggaagtggatccatccataagcctttctgatcaggatgaagtaagtcagaaaggagaaatttatcaggctcagtcctaattgctggtgtataaacaaatcataaaccatacaatgagtgcaaagggggaaaaaaagtagtattctttacattcttttagctgcttctgtgaaatatgtagtaaggtgaggcttgatgtccccaacaatccccccaaccccgctcctttcgcaaggaagagaactaaacttcaaatccttcacgcctttacagttcttattgaaaaggttgaaatacacaaattataaatatataaatacaactttaaatac

SEQ ID NO: 5196 - DNA, 1634 bp, Malus domestica
ttattcaaagggaatcttggctgaaattctagaatttgtcatgggaactggtctcattccagcagacggtgaaatatggcgcagacggcgacgtgctatagttcctgcattgcatcagaagtatgtaacagctatgattaatctcttcggacaagctacagacaggctttgccaaaagctagatgctgctgcatctgatggggaagatgtagagatggagtcacttttctcccgtttgacactggatatcattggcaaggcactttttaattatgattttgattcattaacaaatgacactgggattgtcgaggctgtgtacactgtcctgagagaatcagaagatcgtagtgtttcaccaataccagtatgggagatcccaatatggaaagacatttcaccacgacaaagaaaagtctcaacagccctcaaattaattaatactgcactggatgatttgatagcaatttgcaagagaatggtagacgaagaagagctacagtttcatgaggagtacatgaatgaacaagatcctagtattctccatttccttttggcatctggcgatgatgtttctagcaagcaactccgtgatgacttgatgacaatgctaatagctggacatgaaacatcagctgcagtcttaacatggacgttttatcttctttccaaggaacctagggtcatggccaagctccaagaggaggttgattccattctaggcgatagatttccaaccattgaagacatgaaaaaactcaagtatgcaactcgagtgattaacgaatccttgaggctttacccacaaccacctgtgctaattcgtcgttctcttgaggatgacaagcttggagacttccctattaaaaggaatgaggatatattcatttgtatttggaatctgcatcgcagtccaaaacaatgggatgatgcagataagttttaccctgaaagatggccattagatggacccaatccaaatgagacgaaccaaaattttcgttacttgccctttggtggaggaccacggaaatgcgtaggtgacatgtttgccacattcgagactgttgtagctctttcgatgcttgttcgaagatttaactttcaaatggcactaggcgctcccgaggtcaagatgacaacgggagccaccattcacacgacggaagggttgaagatgacagtcactaggaggataaaacctccgatcgttcccacattggagatgccttcatttgaagtggatacgcccgtcggtgtcccaaaaggggattctgtagctggtcagaaaggtgaggtttcttctgctcatccttgattattttacgttccgatgtgtttgatgtgcttcggttaaatcttatgctcgacgatgtgaggtctgtagataatgctataaattgagagggcggcgctagttaataagatgcaagtgcatacccgcggtcctgccacagaaaagggttgcaaaacttagaagaaaatgtgtttgtatagttcatttgaagcatatttaactcatcaatatagttcttaatcagcattgttggtagagtccccgcgacgagtcatcgcgctctgtaaatctgtcaatttactttgtttttcgtatgaatgaggatcatttgctcgga

SEQ ID NO: 5197 - DNA, 2296 bp, Prunus persica
gttgtgcgtgcgctagaaaacggccacatttggcctctgcgttatcatcttccttccttcctctctctctttcttatgctcttctttctcagttgctggcactgcccaacaccctcaattgccaatcctgagggctgaggctgtccctgtaaccaatggctgccactattcctctgcttcagttcgtccccaccaaaaccttccaagccaagattcactcgaacagactcagacccaccaagcagagaggaacttttggtttatctatggttacatgctcttcttctaatggaagagagcctgattctgtggatggtgtgaagagcgtggagcggttgcttgaagagaaaaggcgagctgagctgtctgctcggattgcctcaggagaattcactgtcgagaaaactggttatccatctcaattgaagaacggtttgtcgaagttgggtgttcctcgggagattctagattttttattcagttgggctgatgcacatgatggctctcccaaaattccagaggcaaaaggtgcaattggtgccattcaaagtgaggcctttttcatcccactatatgagctttacctcacttatggtggaatttacaggctgacctttggaccaaagtcctttttgatcgtttctgatccttccattgccaaacatatattaagggataattcaaaggcttattcaaagggaatcttggctgaaattctagagtttgtcatggggaaaggactcatcccagcagacggtgaaatatggcgtgttcgacgacgtgctatagtccccgcattgcatcagaagtatgtagcagctatgattaatctctttggagaagctacagagaggctttgccaaaagctagatgctgccgcatctgatggggaagatgtagagatggagtcacttttctcccgtttgacactggacatcattggcaaggcactttttaattatgattttgattcattaacaaatgacactgggatagttgaggctgtgtacactgtcctgagagaagcagaagatcgtagtgttgcaccaataccagtatgggaaatcccaatatggaaagacatttcaccacgacaaagaaaggtcgcaacagccctcaaactaatcaatactacgctggatgatttgatagcaatttgcaagaggatggtagacgaagaagagctacagtttcatgaggagtatatgaatgaacaagatcctagtattctccatttccttttggcgtctggggatgatgtttctagcaagcaactccgtgatgacttgatgacaatgcttatagctgggcatgaaacatcagctgcagttttaacatggaccttttatcttctttccacggagcctagcgtcatgtcgaagctccaagaggaggctgattccgttctaggagatagatgtcccacaattgaagatgtgaagaaactcaagtatgcaactcgtgttattaatgagtccttgaggctttacccacaaccacctgtgttaattcgtcgttctcttgaggatgacaggcttggagactactctattaaaaggaatgaggatatatttatttgtatttggaatctgcatcgcagtccaaaacaatgggatgatgcagataagtttaagcctgaaagatggccattagatggacccaatccaaatgagacgaaccaaaattttcgttacttgccctttggtggaggaccacggaaatgtgtaggtgacatgtttgccacatacgagactgtggtggcacttgcaatgcttgttcgaagatttaactttcaaatggcacttggtgctcctgaggtcaagatgactacgggagcaacaattcacaccacagaaggtttgaagatgacagttaccaggagaataaaacctcccatagtgcccacattggagatgccaacatttgaagtggatacatctgtaggtgcttcaaaaggggattctttagttggtaaaaaaggtttgtagataatgctgtaaattgagagagggcaagtgcatagggttgcaagaccaagaaagaaactgtgtttgaatagttcagcggccaacggctttatttttaagccatcaatatagttcttaagtctcttgaagaatcgttcagctttgtaaatttccaagctccctaccaaagcatcacatctttctcagtgtattaaaaacacttccaataacagtttttactgccctggcggaattggccctaatagacattatctaataatgaaaacaaaagcatctgtagaagatttgtttgacgagcaaaacaaaaa

SEQ ID NO: 5198 - DNA, 2052 bp, Phaseolus coccineus
gttaggaaattatttggcattttcttagcatagccataaaattttgaattcttgttttccttacgtatcatatgttcttggattctttaattcttctttttttacgaagagttcttttgtacaaaaggagctcattctcgaagagaaacgacgagctgcattgtctgcgaggattgcctctggggaattcaccgtgaagcagacatctgttttggtttctatactggagggattggcaaaggtgggggtgcccaatgaagttctggactttttgtttggttgggttgaaggggctggtgagcaccccaaaattcctgaggcaaaagggtcaatcaaagctgttcgaagtgtggcctttttcattcccttgtatgaactttaccccacatatggtgggatttttaggttgacgtttggaccaaagtcctttctgatagtatctgatccgactattgcaaaacacatattgaaagacaattcaaaggcttattcaaagggcatcttggctgagatcctagattttgtaatggggaaaggtctcatcccagctgatggtgaaatatggcgagttagacgccgtgctatagtcccagcattgcaccagaagtacgtagcagctatgattggcctttttggacaagccgcagataggctctgccagaagctagatgctgctgcatccgatggagaagatgctgagatggagtcacttttctctcgattgaccttggacatcattggaaaggcagtattcaattatgattttgatagtttatcaaacgacactggtataattgaggcagtttatactgtactgagagaagcagaagatcgaagtgtttctccaattccagtatgggatatcccaatatggaaagatgtatcaccacgtttgaggaaggttaatcaagctctcaaattgatcaatgatacgcttgatgatctgatagcaatatgcaagagaatagtggatgaagaagagttacagttttatgaggagtacatgaatgaaaaagatccaagtattctacacttcttgttagcatcaggagatgatgtatcaagtaagcaacttcgtgatgacttaatgaccatgctcattgctggacatgaaacatcagctgctgttttaacttggaccttttatcttctatccaaggagcctagggtcatgtccaagctccaagaagaggttgactctgtacttggagatagatatccaactattgaagatatgaagaaactcaaatatacaacccgagtgatcaatgagtcattgaggctttacccacaaccacctgtgttaattcgtcgctcgattgagaatgatattcttggagagtaccctataaagagaggtgaagatatatttatatctgtctggaacctgcatcgcagtccaaaactgtgggataatgctgacaagtttgagcctgaaagatggccattagatggaccaaaccccaacgagactaatcaaagcttcaaatatcttccgtttggtggaggaccacggaaatgtgtaggtgatttgtttgctacatacgagactgtagtagcacttgcaatgcttgttagacggttcaactttcaaatggcagttggagctccacctgttgagatgactactggagctacaattcatacgacacaaggcctgaagatgacggtaacacacagaataaaacctcctattgtgccctcattacagatgtcaactttggaagtggatccatctataagcctttctgatcaggaagaaataagtctgaaaggccaagtttaccaggctcaggctcagggtcagccctaactgctgttgtgtaacaaatcataaaccatacaatacaatatataaaatgagtggaaaggggaaaaagttgagtagaattcttttcattcttttagctttgagtgaattatgtagtaaggtgaagctttatgtcctcaaaaatcaacaatccccttgctcctttcgcaaggaagagagcaaaactacaaatatttcattcctttaaatttcttatttgaaatggtgtattttcatattat

SEQ ID NO: 5199 - DNA, 2382 bp, Cajanus cajan
tgtcgttcatggcttcccacgttacccttcttcaggcccctcctctttcaatctccactcaacgctttcgtgccacacggatttgcataaatggtctcaagccccccacctattcttcttcttcttcttcatgctttccatgttccatagcaacacaaagagggtcttgttccccggtgattgcgtgttcctcttcgaatggcagagaccctgattcggtggatgatgatattgatggtgaagtacggaaactggagcgcattcttgaggaaaagcggcgagctgcattgtctgctaggattgcctcaggggaattcaccgtgaagcagaaatctgtgtatgcaataaaaaatcctttttttaagtttcaaatgtttccttctttcgtgggaattttttgttaatacaatgatggagtggttgttaatgtccccatctgtcttcaattttggtctaactcttgtgtggtgcgtgatttgaattggtataatcaaagagtcatttttgtttggtttttctattttgtgggtttgatgtagttttctttctgtacttgagggcttgacaaaggtgggggtgcccaatgaagttctggaatttgtatttggttggcttgaagggggtggtatgtaccccaaaattcctgaggcaaaagggtcaatcagtgccattcgaagtgtggccttcttcattcccttgtacgaactttacctcacctatggtgggatttttaggttgacctttggaccaaagtcctttctgatagtatctgatccgtccattgcaaaacacatactgagagacaattcaaaggcttattcaaagggtatcttggctgagattctagattttgtaatggggaaagggctcatcccggctgatggtgaaatatggcgagttagacgacgagccatagtcccggcatttcaccagaagtatgtagcagctatgattggcctttttggacaagctgcagataggctctgcaagaagctagatgctgcagcatctgatggagaagatgttgaaatggagtcacttttctctagattgaccttggacgtcattggcaaggcagtattcaattatgattttgatagtttatcaaatgacactggtatagttgaggctgtttatactgtactgagagaagcagaagatcgaagtgttgctccaattccagtatgggagatcccaatatggaaagacatatcaccacgtctaaggaaggttaatgcggctctcaaattgatcaatgatacgcttgatgatctgatagcaatatgcaagagaatggtagatgaagaagagttacagtttcatgaggagtacatgaatgaaaaagatccaagtattctgcacttcttgttggcgtcaggagatgatgtgtcaagtaagcaacttcgtgatgacttaatgacaatgctcattgctggacatgaaacatcagctgctgttttaacatggaccttttatcttctatccaaggagcctagagtcatgtccaagctccaagaagaggttgactctgtacttggagatcgatttccaactattgaagatatgaggaaactcaaatatacaacccgagtgatcaacgagtcattgaggctttacccacaaccgcctgtgttaattcgtcgctctattgatgaggatgttcttggagagtaccctataaaaagaggtgaagatatcttcatatctgtctggaacctgcatcgcagtccagaactgtgggataatgctgataagtttgaacctgaaagatgggcattagacggaccaaaccctaatgagacgaatcaaaacttcaaatatcttccatttggtggaggaccacggaaatgtgtaggagatttgtttgcttcatacgagactgtagtagcacttgcaatgcttgttagacggttcaactttcaaatggcagttggagctccaccagttgagatgactactggagctacaattcatacgacacaagggttgaagatgacagtaacacacagaataaaacctcctattgtgccctcattacagatgtcaacattggaggttgatccatccataagcctttctgataacgatgaaataagtcagaaaggcgaaatttatcaggctcagtcctaattgctggtgtaagtgtaacatatcataaaccatacaatataaaatgagtggaaagggaaaagaaaagtagaattattttcattctttcagctgcttgagtgaattatgtagtaaggctttatgtcccaacaatctcccaccccctctcctttcgcaagagagcaatacttcgcattcctcacacctttacaattcttataaaaattagaattcacaaattataaatttgtaatacaactttaaagaaatttg

SEQ ID NO: 5200 - DNA, 2016 bp, Fragaria vesca
tccaaacaaagctccaaacgaatagactactcagacccacaaagcagagaggaaatattgggttctcagttattacttgctcttcaaatggaagagggcctgattctgtgaagagtgtggagcagttggctgaagagaaaaagcgagctgagctgtctgctcgaattgcctcaggagagttcactgtgaacaaaactggttatccatctgaattgaagaacggtttgttgaagttgggtgttcctagggaggttctagactttttattcaattggggagacatgcaacaaccgcgtctgaaaattccagaggcgaaaggatcagttagtgctgttcagaatgaggcctttttcattcccctatatgagctttacctcacatatggtggaattttcaggctgacctttggaccaaagtcctttttgattgtatctgatcctgccattgccaaacatatattaagagataatgcaaaggcttattcaaagggaatcttggctgaaattctagaatttgtcatgggtaaaggactcatcccagcagatggtgaaatatggcgtgttcgacgacgtgctattgtccctgcattgcatctgaagtatgtaacagctatgattaacctctttggacaagctacagagaggctttgccaaaagctcgacactgctgcatctgatggggaagatgtagagatggagtcacttttctctcgtttgacactggacatcattggcaaggcactttttaattatgactttgattcattaaccaatgacactgggatagttgaggctgtttacactgtcttgagagaagcagaagatcgcagtgtggcaccaataccattctgggagattccaatatggaaagacatttcaccacgacaaaaaaaggtggcaaaagcgctgaaattaatcaatgttacgttggatgatctgattgcaatttgcaagaggatggtagacgaagaagaactacagtttcatgaggagtacatgaatgaacaagatcctagtattctccatttccttttggcatcaggggatgatgtttctagcaagcaactccgtgatgacttgatgacaatgcttatagctgggcatgaaacatcagctgcagttttaacatggaccttctatcttctttcgaaggagccaagggtcatgtcaaagctgcaagaggaggttgactctgttctaggggatagaatcccaaccattgaagacatgaagaaactaaagtatgcaactcgagtgatcaacgaatccttgaggctatacccacaaccacctgtgttaatccgtcgctctcttgaggatgacaggctgggagaatacccgataaaaaggaatgaggatatttttatttctgtctggaatttgcatcggagtccaacactatgggatgacgcagataagtttaagcctgaaagatggccattagatggacccaatccaaatgagacgaaccaaaacttcagttacttgccctttggtggaggaccaaggaaatgtgtaggtgacatgtttgccacatacgagaatgtggttgcacttacaatgcttgttcgaagatttaactttcaaatcgcactttgtgctcctgaggttaagatgactacaggagcaacgattcacactacagaagggttgaacatgacagtcacaagaagaataaaacctcccatagtgccaacattggaggtgcctgcatttgatgcggatacatctgttggtgtttcgaaaggggattctttagtcggtcaaaaaggtgtataaagtaatctgtaaatccaagagctatggccagatgaaagtgtgtagatgcagtcttgccaaaaaggaaagggatcgaaaactacaaaagaaatatgcaactttgtatagtgcaacagtgactgtatttgcagctatctcaagtcatcaataattaagatgagaggattgagagagcacaatactgcgatctttgaactttattaaattcttggttccctactaaagcatttcaacagaa

SEQ ID NO: 5201 - DNA, 2475 bp, Citrullus lanatus
tcaggcggaatctttgagtactagttgtgcagagaagtaagaagatgccaacagccgttccttagcggttgaaacagcgaaaacgccaagcacatggtccggcgttatctttttttctcttttacaacttgcttcctcaaatttgttcttctcttcatttacgattctgatatctgaattttatccataaccaagctaccccatcatcttctatggctgccaatttcgccatgcttaaaccttgttcggcattttcgacttcatcatccgttcagaggaaatttcgtgcgcataaatcactatgcactgccccatgttcctctttttatccacaatgtcaaggaggagcttatggtttatgtgccgttaaatgtgcttcttcaaatgggaaggggcctgattccctggataatggagttaaaaaagtggagaggttacttgaagagaaacggcgggctgaattgtctgctcggatcgcttctggcgaatttacagtcgaaaaaactggttttccatctatattgaggagtgggttgtcaaagttgggtgttcccagtgagattctggatttactatttggtttcgtcaatgctcaagaagaatatcccaagatcccagaagctaaaggatcaataagtgcaattcgtagtgaggctttcttcatacctctgtatgagctttatctcacgtatggtggaatatttagattgacttttgggccaaagtcgttcttgatagtgtctgatccttccattgctaaacatatactgaaggataatccaaagaactattctaagggtatcttagctgaaattcttgacttcgtcatggggaaggggcttataccagctgatggggagatatggcgtgtacgaagaagggctatagtcccttctttgcatatgaagtatgtaggagctatgattaatctttttggagaagctgcagataggctttgcaagaagctagatgctgcagcatctgatggagtagatgtggaaatggagtccctattctcccgtttgactttagatatcattggcaaggcagtttttaactatgactttgattcacttacaaatgatgctggcatagttgaggctgtttatactgtgctaagagaagcagaagatcgcagtgttgcgccaattccggtatgggaaattccaatttggaaggatatttcaccacggcaaaaaaaggtctccaaagccctcaaattgatcaatggcactcttgatcaactaattgctatatgcaagaggatggttgatgaggaggaactgcagtttcatgaggaatacatgaatgagcaagatcctagcatccttcatttccttttggcatcaggagatgatgtttcgagcaagcagcttcgtgatgacttgatgaccatgcttatagctgggcatgaaacatctgctgcagtcttaacatggaccttttatcttctttcgaaggagcctagggtcatggccaagctccaaaaggaggttgactcagtccttggggatcgttttccaaccattgaagatatgaagaacctcaaatatgccacacgaataattaatgaatccttgaggctttacccacagcccccagttttaatacgtcgatcccttgataacgatatgctcgggaagtaccccataaagaagggtgaggacatattcatatctgtttggaacttgcatcgcagtccagaactttgggatgatgcagataagtttaatcctgaaaggtggcccttggatggacccaatcctaatgagacaaatcaaaatttcagatatttgccttttggtggtggaccacggaaatgtgtgggagacatatttgcttcatatgagactgttgtagcacttgccatgcttgtacggcgatttgacttccaaatagcacttggagcacctccagtaaaaatgacaacaggagctacaattcacacaacagatggattgcaaatgacagttacacgaagaatgaaacctccaatcatacccactttagaggtgcctgaaatggtcgttgattcatctgtcagtttcttgaaagatgaaacacaaattgttcaagaaggagaagtttcttctgcacattcctaataatattgtagcaatctcgccatggttgagatttagtccacttatactaaaaagggaggaacttgaaaaccgatcgtcctgagttcctctcgactgaggttcaaaatttctttcaatcggtctaatgtatcccagttggtgaaaatcctcggttgcacatagaatgatttgtatatgtaaagaaactgttcttgttatccttcttagatattataaagttaaatgtatttccatctttaaatccattgatttagctgcaaactttggcagttaaactcttgatttctttttcttttgtgtaaatagctaaatagtttctaaattgacaatgttctttgtaccaatggaataatgcaaaaacaaagtcatt

SEQ ID NO: 5202 - DNA, 1898 bp, Cucumis melo
caaagatgggtgttcccagtgagattctggatttactatttggattagtcaatgctcaagatgaatatcccaagattcctgaagctaaaggatcaataaatgcaattcgtagtgaggccttcttcgtgcctctgtatgagctttatctcacgtatggtggaatatttagattgacatttgggccgaagtctttcttgatagtgtctgatccttccattgctaaacatatactaaaggataatccaaagaattattctaagggtattttagctgaaattcttgactttgtcatggggaagggacttataccagctgatggagagatatggcgtgtacgaaggcgggctatagtcccttcgttgcatatgaagtatgtaggagctatgattaatctttttggagaagccgcagataggctttgcaagaagctagatgctgcagcatctgatggagtatatttggaaatggagtccctcttctcccgtctgactttagatatcattggcaaggcagtttttaactatgactttgattcacttacaaatgacgctggcatagttgaggctgtttatactgttctaagagaagcagaagatcgcagtattgcaccaattccggtatgggacattccaatttggaaggatatttcaccacggcaaagaaaggtctcgaaagctcttaaattgatcaatgatactctcgatcaactaattgccatatgcaagaggttggttgatgaggaggagctgcagtttcatgaggaatacatgaatgatcaagatcctagtatccttcattttcttttggcatctggagatgatgtctcgagcaagcagcttcgtgatgatttgatgactatgcttatagctgggcatgaaacatctgctgcagtcttaacatggaccttttatcttctttcaaaggagcctagggtcatggccaagctccaagaggaggttgattcagtgctcggagatcgttttccaacaattgaagatatgaagaacctcaaatatgctacacgaataattaatgagtccttgaggctttacccacagcccccagttttaatacgtcgatctgttgataacgatatgctcgggaagtaccccataaagaagggtgaggacatattcatatctgtttggaacttgcatcgcagtccagaacattgggatgatgctgataaatttaatcctgaaaggtggcctttggatgggcctaatcctaatgagacaaatcaaaatttcagatatttgccatttggtgggggaccacggaaatgtgtgggagacatatttgcttcatatgagactgttgtagcacttgccatgcttgtccgacgatttgacttccaaatggcacttggagcacctccagtaaaaatgacgacaggagctacaattcacacgacggatggattgcaaatgacagttacacgaagaatgaaacctccaatcatatccactttagaggtgcctgatatggttgttgattcatctgttagtttcttgaaaaatgaaacacaagttcaaggagaagtttcttctgcgcattcctaatgatactgtagcaatctcattgtggttgagatttaattcactcatagtaagaagatgcaggagagagagagagagagagaggaactttaaaccgatcctcgagttcctatcttctgaggattgatgatattttcaatattttcaattggtcggatgaagcccagtttgtgaaagtcatcagttgcacatagaatggtttgtatatgtatagaaactattcttattattagatatttataaagatatatgtatttccttgtttaaatcccaatttagctgcaaactttgccttgctattttctttttctttaatgtacatagctaaatagtttctaa

SEQ ID NO: 5203 - DNA, 2062 bp, Mimulus guttatus
acacttcccacgttatcatctttctctctcctcggttttctctctctaaaccaaccaacaatggctgccaacctttcctttcttcaattctcatccccgatccttcaatcgaaggactgcagaagaaaattagcccccgctgttaatttcaagtccaatggggtgagctgctcgtactcgagtaatggtagaggaggtcccaaagacgacgccgtaaaggaagtggagaagcttctagaagagaaacgtagggctgagctgtcagcccgtattgcctccggcgaatttaccgttgaaaagcctagctttggttcacaactgaaagacggtttgtcaaaattgggcttgcccgaagaggtgcttggattcgtattcaattttagtggtggaccaaacaatttaaagattccagaggcaagaggttcaatcagtgccattacaaacgagccgtttttcattcccttgtacgagctttttctaacatacggtggaatttttaggctaacgtttggtcccaagtcattcttgatagtgtcggatccttcaattgccaaacatatattgaaagacaatccaaaatcttattcgaagggcattttagctgaaattcttgattttgtgatggggaaaggacttatacctgctgatggggagatatggcgtgttagaagacgggctatagtacctgcgctgcatcagaagtttgtggctgcaatgtttggcctatttggagaagcgacagatagactgtgcaaaaagcttgacgctgctgcagctgatggtgaagatgtagagatggagtcccttttttctcgtttgactttagatatcatcggtaaagctgtcttcaattatgatttcgactctttaagtgtagacactggaattgtagaggctgtgtatactgtactaagagaagcagaagacagaagtgttgcaccgattccattttgggagattccgatatggaaggatatttccccaaagcttaagaaggttaacacagctctcaagctgattaatgacacactagatgatctgattgcaatttgtaagaaaatagtagacgatgaagaattgcagtttcatgaggaatacatgaatgaacaagatcctagtattcttcatttcctattagcatctggtgatgatgtctcgagcaagcaactccgtgatgatttaatgacattgctcatagctggacatgaaacatcggctgctctgctgacgtggaccttctatcttctttcacaggatcctagtgttatggccaagcttcaaaatgaggtggacttagttctaggtgatagaattcccactgttgaagatatgaagaagctcaaatatacaactagagtaattaatgagtcattaagactctatccgcaaccacctgttttgattcgccgctccctcgaagaggacgtacttggaaagtacccaattaaaaggggtgaagatattttcatctctgtgtggaatcttcatcgcagccctaatcattgggaagatgctgacaaattcaatcccgaaagatggcctttagatggtccaaatcccaatgagacaaaccagaatttcagttacttgccctttggtggaggaccaagaaaatgtattggagatatgtttgcttcatttgagaatattgtagcggtgacaatgcttgttcgtagattcgacttccaattagccctcggagcacctcctgtgaaaatgactacaggggcaactattcacacaacggaaggtttgaagatgacagttacaccaaggagaagagctccgataattccaaatttagacattccgactgtgaacgtggactcgtcgctgaactttccggaggctacaacagtcccgattcagaaagaccaggtctcccctgtggtttcatagttataattgtgcatatatacattggattatttattgaataaagtaaatatagtaaggagcatatatcgcttgcccaaataatatatatacattgttgtaacgcgacacatttcattccacttgctccagtagatgtttcaaaaatcattttgttacttcgtca

SEQ ID NO: 5204 - DNA, 2178 bp, Solanum phureja
tagatacctatagacggctgccggtatctttacactaacaaacactccataattccaacttacttctctcttcgtttttagtggttgttgagtgcgccacattgtcaactgcattcttcattatctccatttttctctttcatggcttcttctcttcctctttttcaatttccagcacagcattactctaaatctagactcactttctcacctaaattcaatggtagtgcatcaaattttacaattaggtgttcttcaaatggaaaacagcctgagtcggtagatgaaggagtgaaaaaggtggaaaagcttttagaagagaaaaggcgagctgaattatctgctcgtattgcttcaggcgagtttactgttgaacaatctggattctcgtcattgctcaaaaatggtttgtctaaattgggtgtaccaaaggagtttcttgagttcttctctcgacggacgggcgattatcctcgcattccagaggcaaaaggatccatcagtgctattcgggatgagccattcttcatgccgctttatgagctttaccttacttatggcggaattttccggttgatttttggtcccaagtctttcttaatagtttctgatccatcaatagccaaacacatactgaaggataattctaaggcttattctaagggtatcctagctgaaatattggactttgtgatggggaagggacttatacctgcagatggagaaatttggcgcgtcaggcggcgtgccattgtaccagcattgcatcaaaagtacgtagcagctatgattggcttatttggaaaagcaaccgacaggttgtgcaaaaagcttgatgttgctgcaactgatggagaagatgtagagatggaatcactattctcccgtctaacattagacatcattggcaaagctgtatttaattatgattttgactcgttaactgtagacactggtatcgtggaggctgtatatacagtgcttagagaagcagaagatcgcagtattgcaccaattccagtttgggatttgcctatctggaaagatatctctccaaagcttaaaaaggtcaatgcagctctcaagttgattaatgacacattggataatctgattgctatatgtaagaggatggtagacgaagaagagttgcagtttcacgaggaatacatgaatgaaaaagatcctagcatcctccatttcttgttagcatctggagatgaggtctcaagcaagcaacttcgtgatgacctcatgacaatgcttatagccggacatgaaacatctgcggcagtgctaacatggaccttttatctgttgtccaaggaacctagtgtcatggcgaagcttcaagatgaggtcgattcagttctaggggataggttcccaaccattgaagatctaaagaaactcagatacacaactcgtgtgattaatgagtctttaagactatacccacagccaccagtcttgattcgtcgttctattgaagaggacgtagttggaggttacccaattaaaaggggtgaagacattttcatttctgtttggaacttgcatcgatgccccaatcattgggaagaagctgatagattcaatcctgagaggtggccacttgatggacctaacccaaatgagacgaaccaaaatttcagttaccttcccttcggcggaggaccaagaaaatgtgttggagacatgtttgccacatttgagaatttagtggcagttgcaatgcttgttcgacgatttgattttcaaatggctcttggagctcctcctgttaaaatgacaactggggctaccatccacaccacagaaggattaaaaatgactgtaacacgaagaacaagacctccaatagtgcccaaattggagatggcatcattagaagtagatgtcaactcagtgtcaagcgaaagagccaaagctgaagcttctactgttcgaccataatagaactgaatacaagcaacagcagcatgtatttaacagacaggggaactatgtatgtttagggtccttaatgctgtcagtcaagataaggaagtcactgtaagtataacggtatacaatggatccttatagacaaaaatctcattaaaattgaatccacttttggtggcctgttctttattgagccttgaaatggtcaaatttcatttcaattgagctatc

SEQ ID NO: 5205 - DNA, 2249 bp, Glycine max
cccactttttcattcagcgacaacaacagcaacactttttttttgtgccatccatggcttcccacgttgctcttcttcgtgtccctcctcctctttcaatctccactcaacgcttccatgccaaacagatttgcataaacggactcaaactcaccaacacttcttcttcttcttcttcttcttcttgttttccatgttccataacaacacaaagagggtcttgttcctctgtgattacatgttcatcttcaaatggcagagacccaaattcggtggatgaggaagatgtaaaacaagtggagcgcattctcgaagagaaacgacgagctgcattgtctgctaagattgcctctggggaattcaccgtgaagcagaaatctggtttactttcaataatggagggcttggcaaaggtgggggtgcccaatgaagttctggaatttttgtttggttggtttgaagggggtggcgagcacccgaaaattcctgaggcaaaagggtcaatcaaagctgttcgaagtgtggccttcttcattcccttgtatgaactttacctcacatatggtgggatttttaggttgacctttggaccaaagtcctttctaatagtatcagatccctctattgcaaaacacatattgagagagaattcaaaggcttattcaaagggtatcttggctgagatcctagactttgtaatggggaaagggcttatcccagctgatggtgaaatatggcgagttagacgtcgtgctatagtcccagcattgcaccagaagtatgtagcagctatgattggcctttttggacaagctgcagatcggctctgccagaagctagatgctgctgcatctgatggagaagatgttgagatggaatcacttttctctcgattgaccttggacatcattggcaaggcagtattcaattatgattttgatagtttatcaaatgacactggtatagttgaggctgtttatactgtactgagagaagcagaagatcgaagtgttgctccaattccagtctgggagatcccaatatggaaagacgtatcaccacgtctaaggaaggttaatgcagctctcaaattaatcaatgatacgcttgatgatctgatagcaatatgcaagagaatggtggatgaagaagagttacagtttcatgaggagtacatgaatgagcaagatccaagtattctacacttcttgttggcgtcaggagatgatgtgtcaagtaagcaacttcgtgatgacttaatgaccatgctcattgctggacatgaaacatcagctgctgttttaacttggaccttttatcttctatccaaggagccaagagtcatgtccaagctccaagaagaggttgactctgtacttggagatcaatatccaactatagaagacatgaagaaactcaaatatacaacccgagtgatcaatgagtcattgaggctttacccacaaccacctgtgttaattcgccgctctcttgaggatgatgttcttggagagtaccctataaagagaaatgaagatatctttatatctgtctggaacctacatcgcagtccaaaactgtgggatgatgctgataaattcgaacctgaaagatgggcattagatggaccaagtcctaatgagacaaatcaaaacttcaaatatcttccgtttggtggcggaccacggaaatgtgtaggtgatttgtttgcttcctacgagactgtggtagcactcgcaatgcttgttagacgattcaactttcaaatagcagttggagctccaccggttgagatgactactggagctacaattcatacaacacaagggttgaagatgactgtaactcacagaataaaacctcctattgtgccctcattacagatgtcaactttggaagtggatccatccataagcctttctgatcaagatgaagtaagtcagaaaggcgaagtttaccaggctcaggctcagtcctaattgctgctgtataacaaatcataaaccatacaatgagtgcaaggggggaaaaagtagtattctttatattcttttagctgcttgagtgaaatttgtagtatggtgaggcttgatatccccaacaatcccccaaacccagctcctttgcaaggaagagggcaaaacttcaaatccttcacgcctttacaattcttattaaaaagggtggaatacacaaattataaatttataaatacaacctaaaataaatttgacaagaggttgaacaaa

SEQ ID NO: 5206 - DNA, 1999 bp, Valeriana officinalis
cattcattagtaagagattcggtaggattagaggatccaaatccatgttttatcaccagaaagataacgaagaagctgacaaaaaccttgtacagagtatcttctccgcaaaaagattccatttcttcttcttcttcacatatgtgttgattgcggttcatacttttgaatttccttcgtcttcttctaatggccgccaattgtccgctcctacaattcgataaatttcacagcaacagattgagagtatccactccatctgctttcgccgccaaactaaacagaacttgtcgtgtgtctttaattagatgttcctccgacggcgataagatcgcagataaggcacttgaagaaaaacgccgtgctcaattgtccgctcgtattgcttccggcgagttcaccgttgagaaaactggttttggttcagagttgataaatggattgacaaaattgggagtaccaagtgccattgttgagcccttatctaagttgatcaatggaggtgaagattatttaaagattccagaggccaaaggagcgattagtgctattaggagcgaggcgtttttcatccctttatacgagctttatcttacttatggtggaattttcagattgacatttggccccaagtcttttctcatagtttcggatccttccattgccaagcacatactcaaggataattctaaagcttactcaaagggaattctagcagaaattctagaatttgttatgggaactggccttattccagctgatggggaggtttggcgggttagacgtcgtgctattgtcccatcattacatcaaaagtatgtaacagccatgattggattgttcggtcaagctacagacaggctttgcaagaaactcgacgctgctgcatatgatggtgaggatgttgagatggagtcccttttctcccgtttgacgttggatatcataggaaaagctgtttttaattatgattttgattctttaactaacgataccgggattgtagaggctgtatatactgttttgagagaggcagaagatcgaagtgtttcccccatcccgttctgggagattcccatatggaaagatatatcaccaaagctaaaaaaagtgaatagttccctcaagctcattaatgaaactcttgataatctcattgccatatgtaagagaatggtggatgaagaagagttgcagtttcacgaggaatacatgaatgaaagggatcctagtattcttcattttctgttggcatcaggagatgatgtctcaagcaagcaactacgcgacgatctcatgacgatgcttatagctgggcatgaaacaactgctgcagtactcacctggactttttatctccttaccacggaacctagtgttatggctaagcttcaaaacgaggttgactcagtgttaggtgaccgaattccaacgattgaagacatgaagaaacttagatatacaactcgagtcatcaatgagtcattgagactatacccccaaccacctgttttgatacgccgttccattgtagatgacacacttggcgactatccaatcaaaaggggtgaagatatatttatatctgtttggaatctacatcgaagccctaagcattgggaagatgcagagaagtttaaccctgaaagatggcctttagatggacctaatcctaatgaaaccaaccaaaattacagttacttgccatttggtggaggaccaaggaaatgcgtgggtgacatgtttgcgtcatttgaggcggtggttgcagtggccatgctcattagacgtttcaatttccaaatggcactttctgcccctcctgtggagatgacaacaggagcaacaatacataccacacaagggttgaatatgactgtcacgaggagaattaaccctccaatagtttccacgttccctgttttgcaggttaattcacctgaagatgcaaacccagttcgcaaaggcgaagtttcttcagcagcacgttcttaatttt

SEQ ID NO: 5207 - DNA, 1766 bp, Cirsium arvense
gagatgctccgagaagagaaacggcgagccgagttgtcggctcgaattgcttccggcgaatttacagttgaaaagccaggttttggttcattgttggtgagtggtttgacaaaattgggtttaccaacggagtttgttgaatctttatctcaatggataaaccccggtgaaggttacccaaaggttccggaggcaaaaggagcaattagtgccattcgtagtgaggcctttttcatccctttatatgagcttttccttacttatggtggaattttcaggttgacttttggtccaaagtcttttctgatcgtatctgatcccatcattgccaaacgcatattgaaagacaatgcaaaggcgtattcaaaaggtattttggctgaaattctagaatttgtaatgggaaccggattaattccggcggatggtgagatatggcgagttagacgacgggttatagttcccgcactacatcaaaagtatgtagcagcgatgattggcttatttgcacaagctaccgatcggttgtgcaaaaaactcgatgatgctgcttacaatggcgaggatgtggagatggaatcgcttttttcacgtttgacattagatatcattgggaaagcggtatttaattacgattttgattcgttgacgacggataatgggatcgtggaggccgtatacacggttttacgagaagcggaggatcgaagcgtttcgcctattccgacttgggagattccgatatggaaagatatttcaccaaggcagaagaaggtcaatgaatcacttaagttgatcaacacaaccttggatgatttaattgcaatatgcaagagaatggttgacgaagaagaggtagagttcaacgaggaatacatgaacgaaaccgatcccagtattctccatttcttgttggcatcgggagacaatgtgtcgagcaagcaacttcgagatgatttgatgacgatgcttattgcaggacatgaaacgaccgccgcagtattaacatggaccttttatcttctttccaaggagcctagtgttgtgtccaagcttcaaaacgaggttgatgcggttctaggtgataggtttccgaccatcgaggacatgaagaaacttaagtatacgactcgagtgattaatgaatcattgaggctctacccacaaccaccggttttgattcgtcgttcccttgaagatgatgttcttgataaatatccaattaagagaggtgaagattttttcatttcggtttggaatcttcatcgctctcctaagcattgggtagatgcggataaatttaatcctgaaagatggcctttagatggaccaaatcccaatgagaccaaccagaatttcagttacttgccgtttggtggtggaccaaggaaatgtgttggtgacatgtttgcttcatttgaggccatagttgctgtgtcgatgcttgttcgtagattcaactttcaaatggcactcggagctccacccgtcaaaatgacgacaggggcaactattcacacgacggaaggtttgaacatgacggtaacacgaagaatgaagcctccaattgttccaacattggagacacaaaatttggaaaatttggattcgtcaacaaccgttcctgaagctgatccgattgttacttaaaaacattatatttcttttggcctcattctttcccattacacgatataatacgaaataggaagaagaaaggaaaaaaaggtataatacacaatgcccacatagctttactacttccg

SEQ ID NO: 5208 - DNA, 2068 bp, Sorghum bicolor
cactttccatgtcactgcaccactgccgcgctgccaccatgcccgccgccgccagcgccatcggactctcgaccgcgggcgctgtcccgttccgcctccccgcctccggctgcgcccaccagggccacctccgcctccttcctcctcctcctcctgctgccgccgcctgccgccgccgcttgcttctccgctgcgccgcctcgtctggcggtggcggcagcggcggctccgacccggccctcgaagagcagcggcgccgccaggccgagctcgccgcgcgcattgcgtccggcgagttcaccgtgcaaggccccgggtggattgcgcctctcgttgggaagctctccaagttgggcccgccgggggagctcgccgccgcgctgctcaccagggtggcgggcgctggcgcggcgcgtggcggcccagagatcccacaggcactcgggtcgatcaacgccgtcgtgggtcaggccttcttcgtgcccctgtacgacctcttcctcacctacggcggcatctttcgcctcaactttggccctaagtcgtttcttattgtctccgatcctgctatcgctaagcacatcctgagggacaactccaaagcttattccaagggaatacttgcagagatattggagtttgtgatgggtaagggtttgatccctgctgacggggagatttggcgtgttcggaggcgtgctattgttcccgcgttgcatcagaagtatgtgactgcgatgattggtctctttggagaagcttcacatcgtctctgcgagaaattggacaaggcagcagcggatggggaggacgtggagatggagtcgttgttctctcgactcacattggatgtcatagggaaggcagtcttcaattatgattttgactcattatcttacgataacggaatagtcgaggcagtgtatgtaacactaagggaagcagagatgcgtagcacttctcctataccaacctgggaaataccaatatggaaggacatttccccacggcagaagaaggtcaacgaagctctcaagttgataaatagtactctagatgaactaattgccatatgcaagagaatggtagagcaagaagatcttcagtttcatgaggaatacatgaacgagcaagatcctagtattcttcacttccttttggcatctggagatgatgtatccagcaagcaactccgtgatgatttgatgaccatgctcatagctggtcatgagacttctgcggcagtcttgacatggacgttttatcttctatctaagtatccgaaagtaatggccaagctccaagatgaggttgatagtgttctaggtgatggtttgccaacaattgaggatgtgaaaaaactgaagtacacgactcgggttattaatgaatcattgagactatatccacagccgccggttttaattcgtaggtcacttgaggatgatatgctcggagggtacccaattggccgaggagaagatatttttatttctgtctggaatcttcaccactgcccaaagcactgggatgatgcagaagttttcaacccagaaagatggcctttggatggaccaaatccgaacgagataaaccaaaatttcagttacttaccatttggtggcggaccaaggaaatgtgtaggtgacatgtttgccacttttgagaatgtggtggcaacagcaatgcttgtcaaacgatttgactttcagttggctccaggagcacctccggttgacatgacaactggagcaacgattcacacgactgagggattaaaaatgactgttactcgaaggacaagggcaccagtaattccaaacctggagatgaaaattatttctgattcacaagaacccgcactttctaccccatccatggttgttagtgctgcttctgttgcttcaggagaagatcaagggggcgtctcctgatttaagcagtttcaagcttcaacaacatacagaatgagtatatccatttatattgctgtggaagtatttggctagtttacagcatttggttgcgcgagcagtacaaaacagagatggagtctcctggcgtgcta

SEQ ID NO: 5209 - DNA, 1971 bp, Sorghum bicolor
gttcccgcactttccatgtcactgcaccactgccgcgctgccaccatgcccgccgccgccagcgccatcggactctcgaccgcgggcgctgtcccgttccgcctccccgcctccggctgcgcccaccagggccacctccgcctccttcctcctcctcctcctgctgccgccgcctgccgccgccgcttgcttctccgctgcgccgcctcgtctggcggtggcggtggaggtggtgccggaggcagcggcggctccgacccggccctcgaagagcagcggcgccgccaggccgagctcgccgcgcgcattgcgtccggcgagttcaccgtgcaaggccccgggtggattgcgcctctcgttgggaagctctccaagttgggcccgccgggggagctcgccgccgcgctgctcaccagggtggcgggcgctggcgcggcgcgtggcggcccagagatcccacaggcactcgggtcgatcaacgccgtcgtgggtcaggccttcttcgtgcccctgtacgacctcttcctcacctacggcggcatctttcgcctcaactttggccctaagtcgtttcttattgtctccgatcctgctatcgctaagcacatcctgagggacaactccaaagcttattccaagggaatacttgcagagatattggagtttgtgatgggtaagggtttgatccctgctgacggggagatttggcgtgttcggaggcgtgctattgttcccgcgttgcatcagaagtatgtgactgcgatgattggtctctttggagaagcttcacatcgtctctgcgagaaattggacaaggcagcagcggatggggaggacgtggagatggagtcgttgttctctcgactcacattggatgtcatagggaaggcagtcttcaattatgattttgactcattatcttacgataacggaatagtcgaggcagtgtatgtaacactaagggaagcagagatgcgtagcacttctcctataccaacctgggaaataccaatatggaaggacatttccccacggcagaagaaggtcaacgaagctctcaagttgataaatagtactctagatgaactaattgccatatgcaagagaatggtagagcaagaagatcttcagtttcatgaggaatacatgaacgagcaagatcctagtattcttcacttccttttggcatctggagatgatgtatccagcaagcaactccgtgatgatttgatgaccatgctcatagctggtcatgagacttctgcggcagtcttgacatggacgttttatcttctatctaagtatccgaaagtaatggccaagctccaagatgaggttgatagtgttctaggtgatggtttgccaacaattgaggatgtgaaaaaactgaagtacacgactcgggttattaatgaatcattgagactatatccacagccgccggttttaattcgtaggtcacttgaggatgatatgctcggagggtacccaattggccgaggagaagatatttttatttctgtctggaatcttcaccactgcccaaagcactgggatgatgcagaagttttcaacccagaaagatggcctttggatggaccaaatccgaacgagataaaccaaaatttcagttacttaccatttggtggcggaccaaggaaatgtgtaggtgacatgtttgccacttttgagaatgtggtggcaacagcaatgcttgtcaaacgatttgactttcagttggctccaggagcacctccggttgacatgacaactggagcaacgattcacacgactgagggattaaaaatgactgttactcgaaggacaagggcaccagtaattccaaacctggagatgaaaattatttctgattcacaagaacccgcactttctaccccatccatggttgttagtgctgcttctgttgcttcaggagaagatcaagggggcgtctcctgatttaagcagttt

SEQ ID NO: 5210 - DNA, 1247 bp, Raphanus sativus
  misc_feature (1008)..(1008): n is a, c, g, or t
gagttctttattgaactgtgtacccaaggaggactttggtggaggtcatcccgatcccaacctaacctatgctaaggagcttgtggcacgaatgggtttaggtaaatctgacaccggagttgaacctccagagtttggtgccgctgctgatggtgatgcagaccgtaacatgatccttggtaaaaggttctttgtaactccttctgattcagttgctataattgctgcaaatgctattggggccataccgtacttcagctctggtttgaaaggtgttgcaaggagcatgccgacctcagctgctcttgatgtcgttgcaaaaagcttgaatttgaagttctttgaggttccaacaggctggaagtttttcggtaatctgatggatgctggaatgtgttctgtttgtggggaagagagttttggaactggctctgatcatatccgtgagaaagatgggatttgggcagttcttgcgtggttgtccatacttgctcacaagaacaagggaaatcttgaaggtgacaataaattggtgacggttgaagacattgtccgcaaacactgggctacctatggccgtcactattacactcgttacgactatgagaatgtagatgcaggtaaagctaaggaactgatggagcatttggtcaaactgcaatcttcaatccctgaagtcaacaagatggtgaaaggaattcgttcggacgtggcgaatgtatccagtgcagatgaattcgagtacaaagatccagttgatggctccatctccaagcaccagggaatccgttacttgtttgaagatggttcacgacttgtcttccgtctgtctggaactggctcggaaggagcaaccatccgactatacattgaacagtacgagaaggatgcttcgaaaaccggacgagagtcccatgaagctctgtctcctctggtggacatagctctgaagttgtccaagatggaggagttcactggccgatcagcccccaccgtcataacataaanaaaaggcgggtcaagtgcaacggtctcaaatcattcacttctttgttctgcgtcttttggggatgcttttctttcttctcattatatgacgatgctatgaataatttagtctctgggggggctttcatatttcatgagttatcgtgaagcttatacttggatttgtctttctcggtttttgttattttacatgtattacgtacttacgtgattaagatttgttattgcggttttaatga

SEQ ID NO: 5211 - DNA, 1593 bp, Brassica oleracea
  misc_feature (835)..(835): n is a, c, g, or t
  misc_feature (934)..(934): n is a, c, g, or t
  misc_feature (940)..(940): n is a, c, g, or t
ggaaaacgggggacctgctcctgaatcaatcactgataagatttacgagaacactaagacgatcaaggagtacccaatagcagaagatctacccattgttgatatatctgccattggcgtatccagttttgaaggacctggaggaaagtttgatgttgaagtttttgattccgcggatgactacgttaaactaatgaagtccatcttcgactttgaatccatccggaagttgctttcatctccaaagttttcattctgctatgatgcaatgcatggagttgctggagcctatgcccatcggatctttgtcgaagaactcggttcgcaagaaagttctctattgaactgcgtacccaaggaggactttggtggaggtcatcccgatcccaatctgacctatgctaaggagcttgtggcacgaatgggattaggtaaatccgacaccggagttgaacctccagagtttggtgctgctgctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagaaagttttggaactgggtcggatcatatccgtgagaaagatgggatttgggcagttcttgcgtggctgtctatacttgctcacaagaacaangaaactcttgatggtgacgctgaattggtgacggttgaagacattgtccgcaaacactgggctacctatggccgtcactattacactcgttacgactangagaangtagatgcaggtaaagctaaggaactgatggagcatttggtcaaattgcaatcttcaatccctgaagtcaacaagatggtgaaaggaattcgctcggacgtggcgaatgtatccagtgccgatgaattcgagtacaaagatccagttgatggctccatctccaagcaccagggaatccgttacctgtttgaagatggatcacgacttgttttccgtctgtctggaactggctcggaaggagcaaccatccgactctacattgaacagtacgagaaggatgcttctaaaaccggacgagagtcccatgaagctctgtctcctctggtggacatagctctgaaactgtccaagatggaggagttcacgggccgatcagcccccaccgtcataacataaaaaggcgggtcaagttcaacggtctcaaatcatacacttctttgggacgctttgtttcttctcatttaaatgaaactatgaataattaagagtctcggggaggctttcatatttcatgagttatcgtgaagcttatacttggatttgtctttctcggttttgttattttacatgtattacgtacatgattaagatttgttattgcagttcaatgattttgcaagttccgaatcttaacatctaacaactttattgat

SEQ ID NO: 5212 - DNA, 1176 bp, Brassica rapa
  misc_feature (898)..(898): n is a, c, g, or t
acccaaggaggactttggtggaggtcatcccgatcccaatctgacctatgctaaggagcttgtggcacgaatgggattaggtaagtccgacaccggagttgaacctccagagtttggtgctgcggctgatggtgatgcagaccgtaacatgatccttggtaaaaggttctttgtaactccatctgattcggttgctataattgctgcaaatgctgttggggccataccttacttcagcactggtttgaaaggtgttgcaaggagcatgccgacctcagcagctcttgatgtcgttgcaaagagcttgaatttgaagttctttgaggttccaacaggctggaagttttttggtaatctgatggatgctggaatgtgttctgtttgtggggaagagagttttggaaccgggtcggaccatatccgtgagaaagatgggatttgggcagttcttgcgtggctgtccatacttgctcacaagaacaaggaaactcttgatggtgacactaaactggtgacggttgaagacattgtccgccagcactgggctacctatggccgtcactactacactcgttacgactatgagaatgtagacgcaggtaaagccaaggaactgatggagcatttggttaaattgcaatcttcaattcctgaagtcaacaagattgtgaaaggaattcgttcggacgtggcgaatgtctccagtgcggatgagttcgagtacaaagatccagttgatggttccatctcaaagcaccagggtatccgttacttgtttgaggatggatcgcgacttgttttccgtctgtcgggaactggctcggaaggagcaaccatcaggctctacattgaacagtacgagaaggatgcttcgaagattggacgagagtcccaggangctctgtctccactggttgacatagctctaaagctgtccaagatggaggagttcacgggccgatcagcccccaccgtcataacttaagagggtggtcagaagtacaaacgatctcaaatcttacacttatgtctgtgtctaagggatactttcttctcactctatatgaataaataagcctcagggagacttcacatttcttttcggaatcttgaacaagcctgttttgagttatcgcgaagagctttatacttgtttggattgacttttctcggttt

SEQ ID NO: 5213 - DNA, 1047 bp, Cleome gynandra
cgttaccccttcggattcggtagccataatcgcagcaaatgctgttgcggccatcccatatttcagctctggtttaaaaggtgttgcgaggagcatgccgacctcagctgcccttgatgttgttgccacaagcttgaatttgaagttctttgaggttccgactggctggaagttttttggtaatctgatggatgccgggatgtgctcagtctgtggcgaagaaagtttcggaactgggtcggatcatatccgtgagaaagatgggatatgggcagttcttgcttggctctccatcctcgctcacaagaacagtggaaaccttggtggggactcaaatctggtctcagttgaagatattgttcgtcagcactgggccacctatggccgacactattacactcgatacgactatgagaacgtagatgctgctgcagctaaggaactcatggcatacttggtcaaattgcaatcttctctccctgaagtcaacaaaatggtgaagggaatccattcagatgtggcaaatgtctcccatgccgatgaatttgaatacacggatccagttgatggttccatctcaaagcaccagggcatccgctacttgttcgaggatggatcacgacttgtattccgtctctcggggacgggctcagaaggagcaaccatccggctgtatattgaacagtatgagaaggatgcggcaaaaactgggcgagactctcaggaagcactcggaccactggtggacgtggctctgaagctgtcaaagatggaggagttcaccggccgatcagcccccaccgtcattacatagaggtgcgctttgttgtgtctttctttggacggatgtcgtttctatactcataataataataataataataataatatagctaaagagagaaagagagacttctgattgtggatttttcaacaaattttatgattttatatacatatgtatgtgttttctatttgcatgtaatttgtaagggtgaaatgttgggtcgtcgattgcccttcttcggcatcgttcattcgataaca

SEQ ID NO: 5214 - DNA, 2059 bp, Ambrosia trifida
attgcacgtctttccgtatatctcactcatctctctctctctctagaaaaccatcactcactttctctccatattcgccaaccttcttactctctctctctctgacaacagcttaactaatggcgagttttactgttaatcgtgtggaaacctcgccgattgagggccaaaagcctggcacttctggacttaggaagaaggttaggtgttcacccaaccacattacttgcataattttgttcaatcgacatttaacgccctttctgcagagaacgttaaaggatctacactcgttgtttcgggtgatggacgctactactcaaaagatgcaatccagattataatcaaaatggcagccgcaaatggtgtaagacgtgtttgggttggtcaaaatggacttttatccacgcctgctgtatcagcagttgtacgtgaacgagttggcgctgatggtgccaaagcaaacggggcatttattttgacagctagtcacaacccaggtggccccaatgaggattttggaattaaatacaatatggggaatggtgggccagcacctgaaggaattactgataaaatctttgagaacactaaaacaataaaggagtattttattgcagaaggcctacctgatgtggatatctcagcaattggaatttcaaacttttcaggtcctgacggtcaattcgacgttgatgtttttgactcgtcaagtgactacgtgaaattgatgaagtcgatctttgatttccagtccatcaaaaagctaattacatctccacagtttagttttgttatgatgcacttcatggagttgctggcgcttatgctaaccgtatatttgttgaagagcttggtgcaaaagagagctcactattaaactgtgttcccaaggaagacttcggtggtggacatcctgatcccaaccttacttatgcaaaagagttggtagcaagaatgggattgggtaaaaaccctgatagtaacccaccagagtttggcgctgctgctgatggtgatgctgacaggaacatgatccttggtaaaagattttttgttacaccatcagattccgttgctatcattgccgccaatgcagtccagtctataccctacttttcatctgggttaaagggtgttgccaggagcatgccgacatctgctgctcttgatgttgtagccaagagtttgaacttaaagtttttcgaggtaccaactggctggaagttctttggtaacttgatggatgctggattgtgttcagtttgtggtgaagaaagttttggaactggatcggaccatattcgtgagaaggatggaatctgggctgtcttggcttggttatctattcttgctcataaaaacaaggacaacctcaatggtgggaaccttgtgactgttgaagacatcgtgaaacagcactgggctacctttggccgccactactacactcgctatgattatgagaatgtcgatgcaggtgctgcaaaagaactaatggctcacttggtcaagttgcaatcttctattagtgatgttaacaaaatcatcaaggggatacgacctgatgtggcaaatgttgcaagtgctgacgaatttgaatacaaagatcctgttgacggttcaatctctaagcatcagggtattcgttatttattcgaagacgggtcacgtttggttttccgtttatcggggacagggtcagaaggcgccacaattcgcctttacattgagcaatatgaaaaagattcatccaaaactggaagagattctcaagaagcacttgctcctctggtggaggttgctctaaagctgtcaaagatgcaagaattcactggtcgttcagcccccactgtgattacataaacatatataaacgcatgccgttgctgctgctgctgctactgtgcaatctgggcttgtttgttagtttaacatgcatcgtcttgtgtgttgattgtttgatgatttacaaagttttgttgtttaataatcagttgtatctcgagtacatttaccaacaatatcctgacattacggctatatttaatttcataag

SEQ ID NO: 5215 - DNA, 1970 bp, Ambrosia trifida
tacgtacacttttaacgtaccctttccttggtctagagaagcgttaaaggttacttacactcgttgtttcgggtgatgacgctactactcaaagatgcaatccagattataatcaaaatggcagccgcaatggtgtaagaagtgtttggttggtcaaaatggacttttatccacacctgctgtatcagcagttgtacgtgaacgagttggtgctgatggtgccaaagcaaacggggcattattttgacagctagtcacaacccaggtggccccaatgaggattttggaattaaatacaatatggggaatggtgggccagcacctgaaggaattactgataaaatctttgagaacactaaaacaataaaggagtattttattgcagaaggcctacctgatgtggatatctcagcaattggaatttcaaacttttcaggtcctgacggtcaatttgacgttgatgtttttgactcgtcaagtgactatgtgaaattgatgaagtcgatctttgatttccagtccatcaaaaagctaattacatctccacagtttagtttttgttatgatgcacttcatggagttgctggtgcttatgctaaccgtatatttgttgaagagcttggtgcaaaagagagctcactattaaactgcgttcccaaggaagacttcggtggtggacatcctgatcccaaccttacttatgcaaaagagttggtagcaagaatgggattgggtaaaaatcctgatagtaacccaccagaatttggtgctgctgctgatggtgatgctgataggaacatgatccttggtaaaaggttttttgttacaccatcagattccgttgctataattgccgccaatgcagttcagtctataccctacttttcatctgggttaaagggtgttgccaggagcatgccgacatctgctgctcttgatgttgtagccaagagtttgaacttaaagtttttcgaggtaccaactggctggaagttctttggtaacttgatggatgctggattgtgttcagtttgtggtgaagaaagttttggaactggatcggaccatattcgtgagaaggatggaatctgggctgtcttggcttggttatctattcttgctcataaaaacaaggacaacctcaatggtgggaaccttgtgactgttgaagacatcgtgaaacagcactgggctacctttggacgccactactacactcgctatgattatgagaatgtcgatgcaggtgctgcaaaagaactaatggctcacttggtcaagttgcaatcctctattagtgatgttaacgaaatcatcaagggaatacgacctgatgtggcaaatgttgcaagtgctgacgaatttgaatacaaagatcctgtcgacggttcaatctctaagcatcagggcattcgttatttattcgaagacgggtcacgtttggttttccgtttatcagggacagggtcagaaggcgccacaattcgcctttacattgaacaatatgaaaaagattcatccaaaactggaagagattctcaagaagcacttgctcctctggtcgaggttgcactaaagctgtcaaagatgcaagaattcactggtcgttcagcccccactgtgattacataaacatatataaacgcatgccgttgctgctgctgctgctactgttgctactgtgcaatctgggcttgtttgttagtttaacatgcatcgtcttgtgtgttgattgtttgatgatttcaaagttttgttgtttaataatcagttgtatctcgagtacatttaccaacaatatcctgagtcctgacattacggctatatttaattgcataagcttcgtgcaactggacttatgaatacgagtctcgctggaacatatattgaagctcatgatactgttcaaaccaagcaagtcgacttgtttgaaatctatacagtttggttcacactttggcaaaaaagaa

SEQ ID NO: 5216 - DNA, 2072 bp, Tragopogon dubius
acggttcctaataatagaatatccctcaccacgtttttccgtatatcactctccctcttcgccaaccatcactcacccccttcgccaaccttactctttctgaaaaactcaaggaatggcgacttttaaggttactcgtgtcgaatccaagccaattgaaggccaaaagcctggcacttctggtctcaggaagaaggttaaagttttcacacaaccccattacttgcacaattttgttcaagcgactttcaacgccctttctgctgaaaaagtcaaaggttctacccttgttgtttcaggggatgggatactactcaaaagatgcaatccagattataattaaaatggcagctgcaaatggagcaagacgtgtttgggttggtcaaaatggacttttgtcaacacctgctgtgtcagcagttgtacgtgaaagagttggtgctgatggttccaaagcaactggggcgtttatattgacagcaagtcacaacccgggtggtcccaatgaggattttggaattaaatacaatatggaaaatggtgggccagcacctgaaggagttactgataaaatctttgagaacactaaaacaataaaggagtattttattgcagaaggcttacccgatgtggatatctcaaaaactggagtttcaaacttttcaggtccagatggtcaatttgatgttgatgtttttgactcagcaagcgactatgtgaaattaatgaagtcaatctttgacttccagtcaatccaaaagttgattgcatgcccacagttttctttctgttatgatgcccttcatggagtagctggagcttatgctaaccgtatattcgtacaagaacttggtgcaaaagagagctcattgttaaactgcgttcccaaggaagactttggtggcggacaccctgatcccaatttaacctacgcaaaagaattggtagcacgaatgggattgggtaaaacccccgacagtaaccctccagaattcggtgctgctgctgatggtgatgctgatagaaacatggtccttggtaaaaggttttttgttaccccttcggattctgttgctatcattgctgccaatgcagttcaatccattccctacttttcatctggcttaaaaggtgttgctaggagcatgccaacatctgctgcacttgatgttgtagctaaaagtttaagcctgaagttttttgaggtaccaaccgggtggaaattctttggtaacttgatggatgctggaatgtgttcagtttgtggtgaagagagttttggaacggggtctgatcatatacgtgaaaaggatggaatttgggctgttttggcttggatgtcaattctcgcttataaaaacaaggataatctcagtagtgggaagcttgtgactgttgaagatattgtgaagcaacactgggctacctatggacgccattattatactcgatatgattacgagaatgttgatgctggtgccgccaaggaactaatggctcacttggtgaagttgcagtctaatcttagtgaagttaataaaaccataaagggaataagatctgacgtggcaaatgttgcaagtgctgatgaattcgaatacaaagatcctgtcgatggttctgtctccaagaatcaaggaatccgatatttgttcgaagacgggtcccgtttggtattccgtttatccgggaccgggtcagaaggagccacaatccgtctctacatcgagcaatacgaaaaggactcatcaaaaaccggcagagattctcaagaagcactttctcctttggtggaggtcgctttgaagctgtcaaagatgcaagaatacacaggcaggtccgcaccgactgtgattacataaatatataaaacgtgatggtggtggtgatcgtgttcggaagctatatgtatttttggtgttgttataggaataagtttgtttgttagtttcagcaggcatcatcgtgtcgttgaatgcttgatgatttacagtgtttttgttgtcgtttcgttaataattcagttgtgtatcttgagagaacctttatctacaatctcctaaatgtacggc

SEQ ID NO: 5217 - DNA, 1005 bp, Euphorbia esula
  misc_feature (435)..(435): n is a, c, g, or t
  misc_feature (515)..(515): n is a, c, g, or t
  misc_feature (896)..(896): n is a, c, g, or t
  misc_feature (955)..(955): n is a, c, g, or t
  misc_feature (971)..(971): n is a, c, g, or t
tggttgctcgcatgggattgggcaaatcaaactcagaagttgaaccaccagaatttggtgctgctgctgatggtgatgcagatcgtaatatggtccttggtaaaaggttttttgttactccatcagattctgttgcaattattgctgccaatgcagttggatccataccttatttctcttctggtctaaagggagttgctaggagcatgccaacatcagctgcccttgatgttgtggccaaacatttgaatctcaaattttttgaggttcccactggctggaagttttttggaaatttgatggatgcaggaatgtgttcagtttgtggggaagaaagtttcggaaccggctcggatcacattcgtgagaaagacggaatttgggcagttcttgcttggttatctattctggcccacaaaaataaggaaaatctcnatggaggaaagcttgtaactgttgaagatatagttcgtgatcactggactaaatatggccgccactattatactcgctangattatgagaatgttgatgcaaatgcagcaaaggagctaatggcaaatttggtcaagctacaatcttccttgggtgaagttaatgagattgtgaaggggataagatcagatgtatcaaaggttgttcatggtgatgagtttgaatacaaagatcctgttgatggttcaatctcaaagcaccagggtatacgatatttatttgaggatggatctcgactggttttccgcctctccggaaccggatcagaaggggcaactatccggctctacattgagcaatacgagaaagatccatcaaaaactggaagagaatcttcagaagcacttgctcctcttgtggatgttgctctcaaattttcgaagatgcaggagttcactggncgatctgctccgactgttattacataaatgcccctgtttttacatgggaaagctttatnatagattgaatgcccngccttgaataataccacgatgagtagttcataat

SEQ ID NO: 5218 - DNA, 2058 bp, Arnica chamissonis
agagtagaaaacggactctcagatcaccgactgaagtgctctgcaccgatgtgaggttccgaattatcgaatatcccccgccacgtctttccgtatatctcactcactctctccggaccatcactcactctcctctccaatccatctctgccaaccttgctctatctgaaaaaactgcaagtaatggcgaatttcacggttaatcgcgtcgaatcctcgccgattgaaggccagaagcctggcacgtctggactcaggaagaaggttaaagtgttcacccaaccacattacttgcataattttgttcaatcgaccttcaatgccctttctgcagagaaagttaaaggttctacacttgttgtttctggtgacggacgatactactcaaaggatgcaatccagattataattaaaatggcagcttcaaatggtgtaagacgcgtttgggtcggccaaaatggcctgttatccacacctgctgtatcagcagttgtacgggaacgagttggggctgacggttccaaagcaaatggggcattcatattgacagctagtcacaaccctggtgggcccaacgaggattttggaattaaatacaatatgggaaatggtgggccagcacctgaaggaattactgataaaatctttgagaacactacaacaataaaggagtattttattgcagaaggcctacctgatgtggatatctcagcaattgggatttcaaacttttcaggtccagatggtcaatttgatgttgatgtctttgactcagcaagtgactatgtgaagttgatgaagtcaatatttgacttccagtccatccaaagttaattgcatctccacaatttagtttctgttacgatgcacttcatggagttgctggagcttatgctaaacgtatatttgttgaagagcttggtgcaaaggagagttctttgttgaactgtgttcccaaggaagactttggtggtggacatcctgatcccaacctaacctatgcaaaagagttggtagcaagaatgggattgggtaacaaccctgatagtaacccaccagaatttggtgctgctgctgatggtgatgctgataggaacatggtccttggtaaaaggttttttgttacaccttcagattctgtcgctatcattgccgccaatgcagtccaagcaataccctacttttcatctggattaaagggtgttgccaggagcatgccaacatctgctgctctcgatgttgtagctacaagtctgaaccttaagttttttgaggtgccaacgggctggaaattctttggtaacttgatggatgctggattatgttcagtttgtggtgaagaaagttttggaactgggtcggatcatatacgtgaaaaagatggaatctgggctgtgttggcttggttatccatccttgctcacaaaaacaaggacaaccttaatggtgggaaccttgtgactgttgaagatattgtgaagcaacactgggctactttcggacgccactattatactcgctatgattatgagaatgttgatgcaggtgctgcaaaggatgttatggctcacttggtcaagctgcaatcctctattagtgatgttaacaataccataaagggaatacggtcagacgtggcaaatgtcgtcagtgctgacgaatttgaatacaaagatccggttgacggttcaatctctaaaaatcagggaattcgttatttattcgaagacgggtcacgtttggttttccgtttatctgggaccgggtcagaaggagccactattcgtctttacatcgagcaatacgaaaaagattcatccaaaaccggaagagattctcaagaagcacttggtcctttggttgatgttgcactaaagctgtcaaagatgcaagaattcacaggccgttctacgcccacggtgatcacataaatatatatacatgctgctgctacgacggacaacgtatgtatttttcgtgtttttatagcaataaagttggcttttgagcggtgcaggttttgattgttagtcacacgcatcttgttgaatgcttgat

SEQ ID NO: 5219 - DNA, 1034 bp, Cirsium arvense
taacctatgccaaagagttggtatcacgaatgggtctcggtaagaatcctaacagcgaccctcctgaatttggtgcggcagcagatggtgatgctgataggaacatgatccttggtaaaaggttttttgttactccttcggattctgtagctatcattgctgccaatgcagtccaaaccataccctatttttcatctggtttaaagggtgttgccaggagcatgcccacatcagctgctcttgatgttgtagctaagcatctgaacttgaagttctttgaggtaccgactggctggaaattctttggtaacttgatggatgctggactatgttcagtttgcggtgaagagagttttggaactggttcggaccatattcgtgagaaggatggcatctgggcagtgctggcttggctatccatccttgctttcaaaaacaaggacaacctcaacggtgggaagcttgtgactgttgaagacattgttaagcagcactgggccacctttggacgccactattatactcgctacgattatgagaatgttgatgcaggtgctgcaaaggaactaatggcttacttggtcaagatgcaatcctctctcgatgaagttaacaagatcgtgaagggagtacgctcagatgtgtcgaatgtttccagtgctgatgaattcgagtacaaagatcccgttgacggttcaatctcaaagcatcagggaatccggtatttgtttgaagacgggtcacgtttggttttccgtttatcaggaaccgggtcagaaggtgcaacaattcgtctttatatcgaacaatacgagaaagattcatccaagatcggaagagattctcaggaagcacttgctcctctggttgaggttgctctcaaactctcaaagatgcaagaattcactggccgttcagcccccaccgtcatcacataaaatatatttacatacatgggtaacgctctttatgtcataaagttaaagttagcccgtaagttttccaccaaaactgcggcttacgttattatatat

SEQ ID NO: 5220 - DNA, 1212 bp, Flaveria ramosissima
ctcttcatggagttgctggagcttatgctaaacgtatatttgtcgaagagcttggtgcaaaagagagctcattattgaattgtgttcccaaggaagacttcggtggcggacatcctgatcccaatcttacatatgcaaaagagttggtagcaagaatgggattgggtaaaaaccctgatagtagcccaccagaattcggtgctgctgctgatggtgatgctgacaggaacatgatccttggtaaaaggttttttgttacaccatcagattctgttgctatcattgctgccaatgcagtccaatccataccctacttttcatctgggttaaagggtgttgccaggagcatgccaacatctgctgctcttgacgtcgtagccaaaagtttgaacttaagttttttgaggtaccgactggctggaaattctttggtaacttgatggatgctggtttgtgttcagtctgtggtgaagaaagttttggaacgggatcggaccatatccgtgaaaaggatggaatctgggctgtcttggcttggttatccattcttgctcataagaacaaggacaacctcaatggtgggaaacttgtgacggtcgaagacatcgtgacactgcactgggctacctttggacgccactattatactcgttatgattatgagaatgtcgatgcaggtgctgcaaaagaactaatggctcacttggttaagttgcaatcttctattagtgatgttaacaaaatcataaaggaaacacgatctgatgtcgcaaatgttgcaagcgctgacgagtttgaatacaaagatcctgttgatggttcaatctctaagaatcagggaatccgttatttatttgaagatgggtcacgtttggttttccgtttatcagggactgggtcagaaggtgccacaattcgtctttacattgaacaatacgaaaaagatgcaacaaaattggaagagattctcaagaagcacttgctcctctggtggaggttgcactaaagttgtcaaagatgcaagaattcacaggtcgttccgcccctaccgtgattacataaataaatatactcgtgctgctggctgtctgaaatctgggcttgtttgttagttacaaaagcatcgtcttgtttgttaaatgtttgatgatttacaaagtttttatttgtcgttaataattcagttgtatcttgagagcatttaccaacaat

SEQ ID NO: 5221 - DNA, 1733 bp, Tripterygium wilfordii
caaaatggactgctttcaactccagccgtatctgctgttattcgtgaaagggttggagtagatggatccagggcaacaggaggatttatattgactgcaagccacaatccaggtggtcctcatgaggactttggaataaaatataacatggaaaatggtggacctgctcctgagggaatcacggatcagatctacgagaacactaaaactatcaaggagtacttaattgcagaagatcttcctgatgtggatatcagcacaataggtgtcaccagctttagcgggcctgaggggcagttcaatgttgaagtctttgattcagcaagtgactatgtaaagttgatgaagtcaatctttgacttcgaatccattcggaagctactgacatctccaaaatttagtttctgttatgacgcaatgcatggagttggtggagcttatgcgaaacctatttttgtggaagagcttggtgcacaagagagctcattgttgaactgcacacccaaggaggactttgggggagggcatcctgatccaaatcttacttatgccaaggagttggttgtccgtatgggattgggaaaatcagattctcaaggtgaaccaccagagtttggtgctgcatctgatggtgatgcagatcgtaatatgatccttggtaaaaggtttttcgttacgccatcagactctgttgctatcattgctgcaaatgcagttgaagcaataccgtatttctctgctggtctgaagggggttgccaggagcatgccaacatcagcagctcttgatgttgtagctaaacatctgaatttgaaattttttgaggtacccactggttggaagttttttggaaatctgatggatgctggattatgttcagtatgtggagaagaaagttttggaactggctctgaccatatacgtgagaaagatgggatttgggcagttttggcttggctatccatacttgcccacaaaaatagggaaaacttgatggagataataaacttgtcagtgttgaagatatagtttgccagcattgggctgcatatggtcgccactactatactcgatatgactatgagaatgtggatgcaggcgacgcaaaggaattaatggcacatttagtcaaactgcagtcttcccttccgaaagtgaatgatattgtgaaggggatacgttctgatgtgtcaaaggtgatccatgctgatgagttcgagtacaaggatcctgttgatggttatatctcaaagcaccagggtattcgttatttgtttgaggatggttctcgattgatcttccgcctctcaggaactggctcagaaggtgcaaccattcgtctatacatcgagcagtatgaaaaggatccatcaaagactgggagggaatctcaagaagcacttgctcctcttgtggaggttgctctgaagctttctaagatgcaggaattcaccggacgatctgcaccaactgtaattacataaatgtatgctgccagcggggagtttacatactaaaactattttcttgttgggtcatggactattacaaactcctaataagatccatttaggcttcctaaaaaacttcactgcagccttgactgaggctagtattatttactcgagttatgagaggatattaattttgttgctcaaaataaaataaaatcttctctatgtatggcagtaatataatattggctgaatcatacttttcgtcctcgaagttgt

SEQ ID NO: 5222 - DNA, 1372 bp, Momordica charantia
tatcctctcccaaattctcattctgttatgatgctctacatggtgttgctggagcttatgcaaaacgtattttcgtggaagagcttggtgcacaagaaagctcattactgaactgcgtacctaaggaggactttggaggaggtcatcctgatcccaatctgacttatgccaaggaattggttgatcgtatgggattgggtaaatcaaaatctggacaagagcccccggaatttggtgctgctgctgatggtgatgcagatcgcaatatggtccttggtaaaaggttttttgtcactccttcagactctgttgccataattgctgctaatgctgttgaagctataccatacttctctgctggtttgaagggtgttgccaggagcatgccaacctccgctgcagtagatgtggttgccaaaaacttgaacttgaaattttttgaggtgcccactggctggaaattttttgggaatctaatggatgcaggaatgtgctccgtctgtggtgaagaaagttttggaactggatccgaccatattcgtgaaaaagatggaatctgggcagttttggcttggttatctattcttgcttataaaaacaagggaaaccttgatggtggaaagcttgtgacagttgaagacatagttcgcaaacattgggccacctatggtcgtcattattatactagatatgattatgagaatgttgacgttggagcagcaaaggaactaatggccaatctggtgaagctgcaatcttcgcttgctgaagttaatggaattgtcaagggaatacgttcagatgtgtcaaaggttgtccatggtgatgaatttgaatataaagatcctgttgatggttctatctcaaagcaccagggcattcgatatttgttcgaggatggttcacgactggttttccgcctatcaggaactggctcagaaggtgcaacaattcggctctacatcgagcaatacgagaaggatccatcaaaaactgggagagattctcaagaagctcttgcacctctggtggaagttgctcttaaactctcaaaaatgcaagaattcactggccgatctgctcctaccgtcattacataaataccatgattttgaagaaataagtttagtcttgcggtggcgcgagatgtgttaaaaatctcactgtaagtgcttccagagtgtttgtttggcgggaaattttagcctacataaattttgaattgattgtcctaataatcttttacgcttcatatgaagcgtgactaagttatagatatatgtgtactcgaattatggggttttacccattattttctataccttactcatatatttgagtcttacataccttaccaaatttcttagagtta

SEQ ID NO: 5223 - DNA, 1877 bp, Flaveria ramosissima
atacacccaaccacattacttgtcataatttgttacaagtcgacgttcaacgcttctttctgccgaagaaagttaaaggttccgtacgctgttgtttctggtgatggtcggtactactcaaaaggaggcaatccagattatattaaaatggcagctgcaaatggtgtaaggcgcgtttgggttggccagaatggacttttatccacaccctgctgtatcagcagttgtacgtgaacgagttggcgctgatggttccaaagcaaatggtgctttcatattgacagctagtcacaaccctggtgggcccaacgaggattttggaataaaatacaatatggagaatggtgggccagcacctgaaggattactgataaaatctttgagaacactaaaacaataaaggagtattttatctcagaagacctacctgatgtggatatctcagcaattggaatttcaaacttttcaggtcctgatggtcagtttgatgttgatgtttttgactcagcaagcgactacgtgaaattgatgaagtcaatctttgacttccagtccatccaaaagttaattgcatctccacaatttagtttctgttatgatgcattgcatggagttgctggagcttatgctaaacgtatatttgttgaagagcttggtgcaaaggagagttcattattgaactgtgttcccaaggaggactttggtggaggacatcctgatcccaacctaacctatgcaaaagagttggtagcaagaatgggattgggtaaaaaccctgatagcaacccaccagaatttggggctgctgctgatggtgatgctgataggaacatgatccttggtaaaaggttttttgttacaccttcagattctgtcgctatcattgctgccaatgcagtccaagccataccctacttttcatctggattaaagggtgttgccaggagcatgccaacatctgctgccctcgatgttgtagctaaaagtctgaaccttaagttttttgaggtgccaactggctggaaattcttcggtaacttgatggatgcgggattatgttcagtttgtggtgaagaaagttttggaactgggtcggatcatatacgtgagaaggatggaatctgggctgtgttggcttggttatccatccttgctcataaaaacaaggacaacctcaatggtgggaaccttgtaacggttgaagatattgtaaagcaacactgggctacttttggacgacactattatactcgctatgattatgagaatgttgatgcaggtgctgcaaaggaagttatgactcacttggtcaagctgcaatcctccattagtgatgttaacaataccataaagggaatgcggtcagatgtggcagatgtcgtcagtgctgatgaatttgaatacaaagatccggtagatggttcagtctctaaaaatcagggaattcgttatttattcgaagacgggtcacgcctggttttccgtctatctggtaccgggtcagaaggtgccacaattcgtctctacatcgagcaatacgaaaaagattcatccaaaactggaagagattctcaagaagcacttgctcctttggttgatgttgcactgaagctgtcaaagatgaaagaatacactggccgttctgccccgactgtgatcacataaatatatatacatgttgctgctatgatcgacaacgtatgtattttcgtgttttatagcaataaagttagcctttgagtggtgcgggttttggcctatgagtttcacaggcatcactttgttgtaatgcttgatgatttacaaagtttgttgtcgataatcattcagtttgtatgttgagaatcttttactttactcctatatttactgcttcc

SEQ ID NO: 5224 - DNA, 1031 bp, Flaveria ramosissima
attcggtgctgctgctgatggtgatgctgacaggaacatgatccttggtaaaaggttttttgttacgccatcagattctgttgctatcattgctgccaatgcagtccaatccataccctacttttcatctgggttaaagggtgttgccaggagcatgccaacatctgctgctcttgatgtcgtagccaaagtttgaacttaaagttttttgaggtaccgactggctggaaattctttggtaacttgatggatgctggattatgttcagtttgtggtgaagaaagttttggaacgggatcggaccatatccgtgaaaaagatggaatctgggctgtcttggcttggttatccattcttgctcataagaacaaggacaacctcaatggtgggaaacttgtgacagtcgaagacatcgtgacactgcactgggctacctttggacgccactattatactcgttatgattatgagaatgtcgatgcaggtgctgcaaaagaactaatggctcacttggttaagttgcaatcttctattagtgatgttaacaaaatcataacggaaacacgatctgatgtcgcaaatgttgcaagcgctgacgagtttgaatacaaagatcctgttgatggttcaatctctaagaatcagggaatccgttatttatttgaagatgggtcacgtttggttttccgtttatcagggactgggtcagaaggtgccacaattcgtctttacattgaacaatacgaaaaagatgcaacaaaaattggaagagattctcaagaagcacttgctcctctggtggaggttgcactaaagttgtcaaagatgcaagaattcacaggtcgttccgcccctaccgtgattacataaataaatatactcgtgctgctggctgtctgcaatctgggcttgtttgttagtaacaaaagcatcgtcttgtttgttaaatgtttgatgatttacaaagtttttattgtcgttaataattcagttgtatcttgagagcatttaccaacaatatcttgaaattg

SEQ ID NO: 5225 - DNA, 1506 bp, Flaveria ramosissima
aatatacacctgctgtatcagcagtttgtacgtgaacgagttggcgctgatggttccaaagcaaatggggcatttattttaaccgctagtcacaacccaggtggtcccaatgaggattttggaattaagtacaatatggaaaatggtgggccagcacctgaaggaattactgataaaatctatgagaacactaaaacaataaaggagtattttattgcagaaggccttcctgatgtggatatctcagcaattggaatttcaaacttttcaggtcctgatggccaatttgatgttgatgttttcgactcagcaagcgactatgtgaaattaatgaagtcaatctttgacttccagtccatccaaaagttaattgcatctccacaatttagtttctgttatgatgcactgcatggagttgctggagcttatgctaaacgcatattcgttgaagagcttggtgcaaaggagagctcattattgaactgtgtgcccaaggaggactttggtggtggacatcctgatcccaacctaacctatgctaaagagttggtagcaagaatgggaatgggtaaaaaccctgatagcaacccaccagaatttggtgctgctgctgatggtgatgctgataggaacatgatccttggtaaaaggttttttgttacaccttcagattctgttgctatcattgctgctaatgcagtccaagccataccctacttttcatctggattaaagggtgttgccaggagcatgccaacatctgctgctctcgatgttgtagctaaaagtctgaaccttaagttttttgaggtgccaactggctggaaattcttcggtaacttaatggatgctggattatgttcagtttgtggtgaagagagttttggaactgggtcggatcatatacgtgagaaggatggaatctgggctgtcttggcttggttatctatccttgctcataaaaacaaggacaacctcaatggtggaaaccttgtgactgttgaagatatagtgaagcaacactgggctacttttgggcgccactattacactcgctatgattatgagaatgtcgatgcaggtgctgctaaggaagttatggctcacttggtcaagctgcaaacctctattagtgatgttaacaataccataaagggaatgcggtcagatgtagcagatgttgtcagtgctgatgaatttgaatacaaagatcccgtagacggttcagtctctaaaaatcagggaattcgttatttatttgaagacgggtcacgtctggttttccgtttatctgggaccgggtcagaaggtgccacaatccgtctctacattgagcaatatgaaaaagattcatccaaaaccggaagagattctcaagaagcacttgctcctttggttgatgttgcactaaagctgtcaaagatgaaagaatacactggccgttctgccccgactgtgatcacataaatatatatacatgttgctgctatgatcgacaacgtatgt

SEQ ID NO: 5226 - DNA, 1441 bp, Olea europaea
aacaattaaggaatacttaattgcggaaggcctgccagatgtggacatcagtacaataggtgtgacaagcttttgcaggtcctgaaggacaatttgacgtagatgtttttgattcagcaagtgattatgtcaagttgatgaaatccatttttgatttccagtctatccagaagttgcttacatctccgaaattcactttctgttatgatgcacttcatggagttgctggggcatatgctaaacgtatatttgtggaagagctaggtgcagatgaaagctctctacttaattgtgtacctaaggaagactttggtggagggcatccagatcccaatctgacctatgcaaaagagttagttgcacgtatgggactgagtaagacaaactcagaacaacagcccccagaatttggagctgctgctgatggagatgcagaccgcaatatgatcctcgggaaaaggttttttgttactccatctgattctgttgctataattgctgcaaatgctgttcaagcaataccttacttttctgggggcctaaaaggagtcgcaaggagcatgcccacttcagctgctcttgatgttgttgctaaacacttgaatttgaaattttttgaggttcccactggctggaaattctttggtaacttgatggatgctggaatgtgttcagtctgtggtgaagaaagttttggaactggctccgaccacatacgtgagaaagatggaatctgggctgttttggcttggctatctattctggcctataaaaataaagataaccttggggaagagaagctcgtgagtgttgaagacattgttcgccagcactgggctacttatggacgccactattacactcgatatgattatgagaatgttgatacaggtggtgcaaaggaactgatggcgcatttggtgaagctacaatcctcccttgatgaagttaacaaaataataaagggaaaaagatcagacgtatcgaatgttgtcaatgctgatgaatttgagtacaaggatcctgttgatggttccatttcgaagcatcagggcatccggtatctgtttgaagatggatcccgattggttttccgtctttctggaactggttcagagggggctaccatccgtctttatgttgagcaatatgagaaggattcgtccaagatagggagagattctcaagaagcacttgctcctctggttgaggttgcacgtaagctatctaagatgcaagaattcaccggtcgatctgccccgactgtcattacatagacacgctactaaatgatatactcagtaagaaattaattactttttctgattgtgtggatgctagagaacctgtacacaatcagaacttataaaagttctctataaatccatcctttacataattggcttttgattggaataatgtggattgatacttaactgct

SEQ ID NO: 5227 - DNA, 1196 bp, Plantago ovata
ggaggtcatccagatcccaatctcacctacgcaaaggaattagttgctcgtatggggctgggcaagacaaataccgaacaagagccaccagaatttggcgcagctgctgatggagatgctgatagaaatatggttcttggcaaaaggttttttgtcactccatctgattctgttgctattatagctgcaaatgctgttcagtcgattccttacttttctggtggtctaaaaggagttgcaaggagcatgcccacgtcagctgctcttgatgttgtggccaaaaacctaaatctgaaattctttgaggttccaactggctggaaattctttgggaacctaatggatgctggaatgtgctcggtctgtggcgaagagagttttggaactggctcagaccacatacgtgagaaggatggaatatgggctgttttggcttggctttctattcttgcttataagaacaaggataaccttgagggagataagcttgtgactgttgaagatattgttcgtcagcattgggctaaatatggacgccattactatactagatatgactatgagaatgttgatgctggtgctgcgaaggagctgatggcctatttggtcaagctgcaatcctccctcagtgagcttaatggcattataaagggtattcgctcagatgtctcaaatgttgccaatgctgatgaatttgagtacaaagatccagttgatggttccatttcaaagcatcagggcattcggtttctgtttgaggatgggtctcgactggttttccgtctttctggaactggttcagagggtgccaccatccgtctttacattgagcaatatgagaatgattcgtccaagactgggagagattctcaagatgcactttctcccctggttgaagttgctctgaagctgtctaagatgcaagagttcactggccgaactgctcccactgttattacataagaggctgcagagggcataaacgaagagtctacatgtatgtggttaaataatttcatgttttgtgtctcaattctcagtttcaatttatctactgatgtcccctaaaaatatgcatgtacttttgctatctgagttttctagcaatgttcaagatatgtaatctgtttagttataaaagtagtgtcgtaaggtgacattagagtgatttccatcgacaccgggcatagactgct

SEQ ID NO: 5228 - DNA, 911 bp, Eschscholzia californica
ggttcttggtaaaagattctttgtgactccatctgattctgttgccataattgctgcaaatgcagtccaatctattccttatttctctgctggtctaaagggggttgccaggagcatgcccacatcagcggctctcgatgttgtagccaaacatttaaatctgaaattctttgaggtacccactggctggaaatttttcggaaacttgatggatgctggattatgttcagtttgtggggaagaaagttttggaactggttcagaccatatacgtgagaaagatggaatctgggcagtgttagcttggttatctatactcgccttcaaaaatcaaggatacccttggtggtgataaacttgtaactgttgaagacatagttcgtcagcattgggccacttttggccgtcactattacactcgatatgactatgaaaacgtggatgcaggcgcagccaaggagttaatggctaatttagtccaactccaatcttccattcctgatgttaacaagatcataaaaggaattaggtcagatgtgtcagatgtcgtccaagctgatgagtttgaatacaaagatccagtggatggctccatctcaaagcaccagggtatccgatatcttttcggagatggatcacgattggttttccgtctttctggaactggttcagaaggggcaactattcgtctttacattgaacaatatgagaaggattcttcaaagatcgggagggattctcaagaagcactttctcctctcgtggaagttgctcttaaactttctaagatggaagaattcaccggtcgatcaactccaaccgttatcacatagattaactgtttctacgcacaggcatttgggctatatccgttttcaagttgctcgatgttgtgtttaagcaaacaagta

SEQ ID NO: 5229 - DNA, 1165 bp, Raphanus sativus
  misc_feature (579)..(579): n is a, c, g, or t
  misc_feature (940)..(940): n is a, c, g, or t
gaacctccagagtttggtgccgctgctgatggtgatgcagaccgtaacatgatccttggtaaaaggttctttgtaactccttctgattcagttgccataattgctgcaaatgccattgaagccataccgtacttcagctctggtttgaaaggtgttgcaaggagcatgccgacctcagctgctctagatgtcgttgcaaaaagcttgaatttgaagttctttgaggttccaacgggctggaagttttttggtaatctgatggatgccgggatgtgttccgtctgtggggaagaaagttttggaactggctccgatcatatccgtgagaaagatgggatatgggcagttcttgcgtggatgtccatactggctcacaagaacaaggatagcattgacggtgacactaaactggtgacggttgaagacattgtccgccagcactgggctacctatggccgtcactactacactcgttacgactacgagaatgtggacgcaggtaaagctaaggagctgatggagcatttggtcaaattgcaatcttcaattcctgaagtcaacaagattgtgaaaggaatncgctcggacgtggcgaatgtctccagtgcggatgagttcgagtacaaagatccagttgacggatctatctcaaagcaccagggaatccgttacctgtttgaggatggatcacgacttgttttccgtctgtctggaactggctcggaaggagcaaccatcagactctacattgaacagtacgagaaggatgcttctaaaataggacgagagtcccaggaagctctgtctcctctggttgacatagctctgaagctgtccaagatggaggagttcacgggccgatcagcccccaccgtcataacttaagaaggcaacgaacccaaatcatacacttctgtcttgcgtctaatgggatacactntctgttctctcactatatgaaataataatgtctcttgataacttcatattttcttttcggaatcttgaacaatcctgcttgccgagttcctgaattatcgtgaagagctttatacttgtatggattttgtctttctcggttttgttctctcttgttttacatctattactacatgatataagattttgttatacacaaacgttattgcaagtttagtctatttac

SEQ ID NO: 5230 - DNA, 1266 bp, Flaveria ramosissima
actcagcaagcgactacgtgaaattgatgaagtcaatctttgacttccagtccatccaaaggttaattgcatctccacaatttagtttctgttatgatgcattgcatggagttgctggagcttatgctagacgtatatttgttgaagagcttggtgcaaaagagagctcattattgaactgtgttcccaaggaggactttggtggaggacatcctgatcccaacctaacctatgcaaaagagttggtagcaagaatgggattgggtaaaaaccctgatagcaacccaccagaatttggtgctgctgctgatggtgatgctgataggaacatgattcttggtaaaaggttttttgttacaccttcagattctgtcgctatcattgctgccaatgcagtccaagccataccctacttttcatctggattaaagggtgttgccaggagcatgccaacatctgctgctctcgatgttgtagctaaatgtctgaaccttaagttttttgaggtgccaactggctggaaattcttcggtaacttgatggatgctggattatgttcagtttgtggtgaagaaagttttggaactgggtcggatcatatacgtgagaaggatggaatctgggctgtgttggcttggttatccatccttgctcataaaaacaaggacaacctcaatggtgggaaccttgtgacggttgaagatattgtgaagcaacactgggctacttttggacgacactattatactcgctatgattatgagaatgttgatgcaggtgctgcaaaggaagttatggctcacttggtcaagctgcaatcctctattagtgatgttaacaataccatagagggaatgcggtcagatgtggcagatgtcgtcagtgctgatgaatttgaatacaaagatccagtagatggttcagtctctaaaaatcagggaattcgttatttattcgaagacgggtcacgcttggttttccgtttatctggtaccgggtcagaaggtgccacaattcgtctctacatcgagcaatacgaaaaagattcatccaaaaccggaagagattctcaagaagcacttgctcctttggttgatgttgcactaaagctgtcaaagatgaaagaatacactggccgttctgccccgactgtgattacataaatatatacacatgctgctgctatgatcaacaacgtatgtattttcgtgttttatagcaataaagttagcctttgagtggtgcgggttttggcctatgagtttc

SEQ ID NO: 5231 - DNA, 1144 bp, Ipomoea nil
tctaagactcaccccgagtcaaacccacctgaatttggagcagccgctgatggagatgcagaccgcaacatggtccttgggaagaggttctttgtgactccttctgattctgttgctataattgctgctaatgcagttgctgcaatcccatacttttctggtggcctgaaaggagttgccaggagcatgcccacatcagctgctcttgatgtggtggctaaacacctcaacttaaaattttttgaggtgcccacaggttggaagttttttggtaacttgatggatgctggaatgtgctcagtttgtggtgaagaaagctttggaactggctcagatcatattcgtgaaaaggatggaatttgggctgttttagcctggctaaatattcttgcccataaaaataaagatctaagtggcaagcttgtaacggtagaagatattgttcgccaacattgggccacttatggacgtcactattatactagatacgactatgagaatgttgatgcatctggtgcaaaggaactgatggctcatttagtcaagctgcaatcctcccttgatgaagttaacaagattgtagcaggaatacggaatgatgtttcaaaggttgtccatggtgatgaatttgagtacaaagatcctgttgatggctccatctcaagtcatcagggtatccggtatctctttgaagatgggtcacgattggttttccgtctgtctggaactggttctgagggtgcaaccatccgactgtacattgagcaatatgagaaggatgcgtccaagattggaagagaatctgcggatgcacttgcccctcttgtggaggttgctcttaaactgtctaagatgcaggaattcactggccgatccgccccaactgttataacataaatagttggtctgctttaattattagtctgttttttttgtatatcctgacaaaactataataaagtgtttaccgttattatattgaccgttcggtcaaacacaccgcatatatgaacaactatatatgcagaggaatgagaggattttggggttatcattttgtagtattgtatgattctatgagtgtattgctgattgagtgattggttatccatatcctccgtaagttttgttttaattttacaat

SEQ ID NO: 5232 - DNA, 2076 bp, Ambrosia trifida
gcgtatgaagcgctcgctctgcatcgacgtgcggttgcgaataacagaatatcccccgccacgtgtttttcatatatcactctctctacacatacatcactcactcttcatcttctccaacctttgcattctctctgaaaaaagaaacttatggcgaatttcaccgttaatcgcgtcgttacctcgccaattgaaggacagaagcctggcacatctggactcaggaagaaggtcaaagtattcacccaaccacattatttgcataattttgttcaatcgacgttcaacgccctttctgcagagaaagttaaaggttctacacttgttgtgtcgggtgatggacgttactactcaaaggatgcaatccagattataattaaaatggcagctgcaaatggtgttagacgcgtttgggttggccaaaatggacttttatccacacctgctgtgtcagcagttgtacgggaacgagttggggctgatggttccaaagcaaatggggcattcatattgacagctagtcacaaccctggcgggcccaatgaggattttggaattaaatacaatatgggaaatggtgggccagcacctgaagggattactgataaaatctttgagaacacaaaaacaataaaggagtattttattgcagaaggcctacctgatgtggatatctcagcaattggggtttcaaacttttctggtcctggtggtcaatttgatgttgatgtctttgactcagcaagcgactatgtgaaattgatgaagtcaatctttgatttccagtccatcaaaaagttaattacatctccacaatttagtttctgttttgatgcacttcatggagttggtggagcttatgctaaacgtatgtttgttgaagagcttggtgcaaaggagagctcattgttgaactgtgttcccaaggaagactttggtggtggacatcctgatcctaacctaacctatgcaaaagagttggttgcaagaatgggattgggtactaaccctgatagtaacccaccagagtttggtgctgctgctgatggtgatgctgataggaacatgatccttggtaaaaggttttttgttacaccttcggattctgtcgccatcattgctgccaatgccgtccaagccataccctacttttcgtctggattgaagggagtggccaggagcatgccaacatctgctgctcttgatgttgtagctaaaagtctgaaccttaagtttttgaggtaccaactggctggaaattctttggtaacttgatggatgctggtttatgttcagtttgtggtgaagaaagttttggaacggggtcggatcatatccgtgaaaaagacggaatctgggctgtgttggcttggctatccattctggcccataaaaacagggacagacttgatggcgggaagcttgtgactgttgaagatcttgtgaagcaacattgggctacttttggccgtcactattatactcgctatgattatgagaacgtcgatgcgggtgctgcaaaggaagtaatggctcacttagtcgagcttcaatcctctatcagtggtgttaacactaccataaagggaatacgatcagatgtggcagatgtcgtcagtgccgatgaatttgaatacaaagatccggttgacggttcagtctctaaaaatcagggaattcgttatttattcgaagacgggtcacgtttggtcttccgtttatctgggaccgggtcagaaggtgccacaattcgtctttacattgagcaatatgaaaaagattcatccaaaaccggaagagattctcaagaagcgcttgctcctttggttgatgttgcactaaagctgtcaaagatgctagaatataccggacgttctgcgcctactgtgatcacataagtatatatacgcgctgctgctatgatcgacatcgtatgtattttttgtgttttatagaaataaagttaacttttcagtggtgcgggttttgcttgttaccttcacaggcatcactttgttaaatgcttgatgatttacaaagttttgttgtgctaataattcagtctggaccttgaga

SEQ ID NO: 5233 - DNA, 1573 bp, Flaveria ramosissima
tgatggacgatactattcaaaggatgcaatccagattataattaaaataggcagctgcaaatggtgtaagacgtgtttgggttggtcaaaatggacttctatccacacctgctgtatcagcagttgtacgtgaacgagttggtgcagatggttccaaagcaaatggggcatttattttgacagctagtcacaaccctggtggtcccaatgaggattttggaattaaatacaatatggaaaatggtgggccagcacctgaaggaattactgataaaatctatgagaacactaaaacaataaaggagtattttattgcagaaggccttcctgatgtggatatctcagcaattgggatttcaagcttttcaggtcctgatggtcaatttgacgttgatgtttttgactcatcaagtgattatgtgaaattgatgaaatcaatctttgatttccagtccatcaaaaagctaattacatctccgcaatttagtttttgttatgatgctcttcatggagttgctggagcttatgctaaacgtatatttgtcgaagagcttggtgcaaaagagagctcattattgaactgtgttcccaaggaagactttggcggcggacatccagatcccaaccttacatatgcaaaagagttggtagcaagaatgggattgggtaaaaaccctgatagtaacccaccagaatttggtgctgctgccgatggtgatgctgataggaacatgatccttggtaaaaggtttttcgttacaccatcagattctgttgctatcattgccgccaatgcagtccaatctataccctacttttcaactgggttaaagggtgttgccaggagcatgccaacatctgctgctcttgatgttgtagccaagagtttgaacttaaagttttttgaggtaccgaccggctggaaattttttggtaacttgatggatgctggattatgttcagtttgtggtgaagaaagttttggaactggatcggaccatatccgtgagaaggatggaatctgggctgtcttggcttggttatccattcttgctcataagaacaaggacaacctcaatggtgggaaacttgtgactgtcgaagacattgtgacactgcactgggctaccttcggacgccactattatactcgctatgattatgagaatgttgatgcaggtgctgcaaaagaactaatggctcacttggtcaagttgcaatcttctataagtgatgttaacaaaatcataaaggaaacacgatctgatgtggcaaatgttgcaagcgctgacgagttcgaatacaaagatcccgttgatggttcagtctctaagaatcagggaatccgttatttattcgaagatgggtcacgtctggttttccgtttatcagggaccggatcagaaggtgccactattcgtctttacattgaacaatatggaaaagatgcaaacaaaaattggaagagattctcaagaagcacttgctcctctggtggaggttgcactaaagttgtacaaagatgcaagaattcacaggtcgttccgcccctacgtgattacataaataatat

SEQ ID NO: 5234 - DNA, 2031 bp, Artemisia annua
ttccaaagcaaatggtgcatttatactgacagcaagtcacaacccaggtggtcccaatgaggattttggaattaaatacaatatgggaaatggtgggccagcacctgaaggaattaccgatcaaatctacgagaacacaaaaacaataaatgagtattttcttgcagaaggcttacctgatgtggatatttcggcaattggcatttcaaaattttcaggtcctgatggtcagtttgacgttgatgtttttgatgcagctagtgactatgtgaaattgatgaagtcaatatttgactttgaggccatgaaaaagttaattgcatctccacagtttagtttttgttatgatgcgcttcacggagttgctggagcttatgcaggtcgcatatttgttgaagaacttggtgcaacagaaagctcattgttgaactgcgtacctaaggaagactttggtggtggacatcctgatcccaacctaacgtatgccaaagagttggtctcacgaatgggattgggtaagaaccctgacagtaacccaccggaatttggtgctgctgcagatggtgatgccgataggaacatggttcttggtaaaaggttttttgttaccccatcagattctgttgctatcattgctgccaatgctgttgaatccattccctacttctcatctggattaaagggtgttgcacggagcatgccgacatctgctgctcttgatgttgtagctaaaagtttgaacttgaagtttttcgaggtaccaaccggctggaaattctttggtaatttgatggatgctggtctatgctcagtttgtggtgaagagagtttcgggactggatcggaccatatccgtgagaaggacggaatctgggctgtgttggcttggttatccattcttgcttataaaaacaaggacaatctcaatggaggaaatcttgtgactgttgaagacattgtgaagcagcactgggctaaatttggacgccactattatactcgctatgattacgagaatgttgatgcaggtgctgcaaaggaactaatggctcacttggtcaagttacaggcttctctcagtgatgttaacactaccataaagggtataagatcagatgtggcaaatgttgccagtgctgatgaatttgaatacaaagatcctgttgatggttccatctcaaagaatcagggaatccgctatttatttgaagatgggtcacgtttggttttccgtttatccggaactgggtcagaaggtgccacaattcgtctttacattgaacaatacgaaaaagattcatccaagactggaagagactcccaggatgcacttgctcctctggtggaggttgctctaaaactgtcaaagatgcaagaatacacaggccgttctgccccaactgtcatcacataaatatacgatacatgctgcggctgctatccacaacatatgtatttttcgtgtttttatagcaataaacttagtgtttcagctgtctgggcttgtttgttagtttcacaagcatcgtctttctttttgaatgcttgatgatttacaaagtttttttgtctttaataattcagttatattgtatcttgagaacccttatatcaacaatattacaaatttgcggctttttgttttaatgtgaactgaaatcttaacaagactcggattttgcttgattcatagaaggggaatgaagagcagtctcagctttgtttatagctcatgctcatctatggaatcaaaccatgtgttagttcacatgtaaataagagtttgggattcttctaaagtattgatccttagcgttcttgattagaaaacacacgtccacgggctgcattcataaagcatagggcatgtacgcttatacctttaaatagagggggcaatttgtgtgctaaatatcataaaaatagagttttactggctaatttataaaagatttgggggcatttggtcttcacttttttgaaatgagcatgtaaggctctttctcaattgaaaagcattgcaattattta

SEQ ID NO: 5235 - DNA, 1157 bp, Phaseolus coccineus
ctgggattgggcaaatcagaaccacaagatgagccaccagactttggtgctgcttctgatggtgatgcagatcgcaacatgatacttggtaaaaggttttttgtcactccttcagattccgtggccattattgctgcaaatgctgttgatgctataccatacttttctgccggtttaaagggtgttgccaggagcatgccaacctctgctgctctggatgttgtagccaaaaatctgaatttgaaattttttgaggttcccacaggttggaagttctttggtaatttaatggatgctggattatgttcagtctgtggtgaagaaagttttgggactggttctgatcatattcgtgagaaagatggaatctgggcagttctggcctggctatctatacttgcatataaaaataaagataaacttgaagacaagcttgtcactgttgaagacatagttcgccagcattgggctacttatgggcgccattattatactcgatatgactacgaaaacgtggatgcaggtgcagcaaaggaactgatggcttatttggtcaagctgcagtcctcgctttcagaagtcaacgagattattaagggggtaaggtcagatgtttcgaaggttgtcaacgctgacgaatttgagtacaaagatcctgtggatggttccatctcatcacatcagggaatccgatatttatttgaggatggatcgcgattgattttccgtctctctggaactggatcagaaggtgcaactattcgactatacattgagcaatatgagaaggatgcatcaaagattgggagactttcaaatgaggcgcttgctcctcttgtggaagttgcattgaaactttcaaaaatggaggaattcactggtcgatctgcaccaacagtcattacatgaacgcatagaagtggaagaggtgattagatctgaagcttctgagaatgtcatttcttctttgtccagtttctatccagtattacggatagccgacctgtacctttggttgtgttgcagcctttgatatgggcacttgagtggaatttgaattactttatctaaattttgatgtgctgaataatttgcaactgccgagtgctattatatagtcttaatataatggttcctcttgggggcaaaaaaaaaaa

SEQ ID NO: 5236 - DNA, 2071 bp, Populus trichocarpa
cgaataatcctcctcagatacccattccctcaccactccttgagcaagtaccataatttttaagtcacagtacagcccttttgctctcccctgctagaaaaaaatggtgctattcaatgtttcacgagtggagaccactcctttcggagaccagaaacctggaacttctggccttcgcaagaaggtgaaggtgttcaagcaacctaattatctgcagaattttgtccaatcaaccttcaatgccctcactccacaaaatgttagaggtgctacacttgttgtttctggtgatggtcgctatttctcaacggatgctatttcagattattactaagatggcagctggaaatggattaagacgtgtttgggttggtcagaatggactgctttcaactcctgcagtatctgctgtaatacgtgaaagagttggggtagatggatccaaggcaacgggagcatttatattgacagcaagtcacaacccaggtggtcctaatgaggattttgggatcaaatataacatggaaaatggtggacctgctcctgagggaatcacagataagatttatgagaacactaaaacaataaaggagtacttaactgctgatctgcctgatgtggatattacagcaattggtgtaaccagctattgtgggtctgagggacagtttgatgttgaggtgtttgactcggctagcgattatgtcaaattgatgaagtctatttttgactttgagtccatccggaagctcctttcctctccaaaattcactttctgctatgatgcactacatggagttggtggggcatatgcaaaacgcatttttgtggaggagcttggagcacaagagagctccttattgaactgtgtaccgaaggaggactttggaggagggcatccagatcccaatctcacttatgcgaaggagttggttgctcgtatgggattgggtaaatctaactctgaagttgaaccaccagaatttggtgctgcttctgatggtgatgctgatcggaatatgatccttggtaaaaggttctttgttactccatcagattctgttgccatcatcgctgcaaatgcagtggaggccataccatatttctctgctggtctaaaaggagttgccaggagcatgccaacatcagctgcccttgacgttgtggcaaaaaatctgaacttgaaattttttgaggttccaactggatggaagttttttggtaatttgatggatgctggtttatgttcagtttgcggggaagaaagttttggaactggctcagaccacatacgtgagaaggatggaatttgggcagttctggcttggctatccattctggcttgcaagaatagagaaaatcttggtggtggaaagcttgtgacagttgaagatatagttcacaaccattgggctacctatggtcgccactactatactcgatatgactatgagaatgttgatgcaggtgcagcaaaggaattaatggcatgcttggtcaaactgcaatcttcccttactgaagttaacgagattgtcagtggtatacaatcagatgtgtcaaaggttgttcatgctgatgagtttgaatacaaagatcctgttgatggttccatttcaaagcaccagggtattcgatatctgtttgaggatggctcaagactggttttccgcctctcaggaactggttcagaaggtgctaccatcagactctacattgagcaatatgagaaggatccatcaaaaactggaagagattctcaagatgcacttgctcctcttgtggcagttgctctggggctttctaagatgcaggaattcactggccgatctgcaccaaccgtcataacatagatgtgagctgctaggcgcagcagtggggatcagagtcaccttgaatgtggaaagtgtggtcttgataaaccatgcttttatatgttgaatactttttaagaaatccaataatgctacatatgcttttctttttgtcgccttaccaaaaaaggcaggagtacgatttactaaaacacgctgatccaaagttttgaagttcaaaataagaatttttctca

SEQ ID NO: 5237 - DNA, 1295 bp, Triphysaria pusilla
ttcttaaatttgttactttatttgtttgttaaatttgtattgtaagttcctatttttgattttcaatctatcaagaagttaatagcatctccaaaattcagtttctgttacgatgctcttcatggagttgctgtggcttatgctagccgtatatttgttgaggagctaggtgccgatgaaaactcattgctgaactgtgttcccaaggaggattttggtggaggtcatcccgatcccaatctgacctatgctaaagaattagttgctcgtatgggattgggcaagacgaactctacgaacgagccaccggaattcggggctgctgccgatggagatgctgaccgcaatatggttcttggcaaaaggttttttgttactccatctgattctgttgctatcatagcggcaaatgctgtccaagcaataccttacttttccggtggtttaaaaggagttgcaaggagcatgcccacgtcagctgctcttgatgtcgttgctaaaaacctgaacctgaaattctttgaggtgccgactggctggaaattctttggcaacctgatggatgctgggatgtgttcggtttgtggagaagagagtttcgggactggctcagaccacatacgtgagaaagatggaatctgggctgttttagcttggctgtctattcttgcctacaagaacaaagacaacattggaggagataaacttgtcagtgtcgaagacattgttcgccagcattggtccacatatggccgtcattattacactcgatacgattatgagaatgttgatgcaggtagtgccaaggaattgatgacctatttggtcaaactgcaatccaacctctctgaagttaacaatattataaagggtattcgcccagacgtcgcaaaggtcgtcaatgctgatgaatttgagtacaaagatccagttgatggttcaatttcaaagcatcagggtatcagatatctgttcgaagacgggtcccgattggttttccgactttctggaactggttcggagggtgcaactatccgtctctacatagaacaatacgagcaggattcatccaagatcggaagagattctcaagaagcactttctcccttggttgaggtagctcttaagctgtctaagatgcaagagtacactggccgatctgctcccactgttattacatagatgctgcagattgtgctcaaaagttacttaattttgttgagaaaaataaaataatcaatgctggctcttatgcacttgcgtaatgaaacctttgctttaaaagactgttttat

SEQ ID NO: 5238 - DNA, 1072 bp, Thalictrum flavum
ggtaaacgatttttttgcgactccatcagattctgttgcgattattgctgcaaatgcagttgaagcgattccttacttctcttctggtttaaagggagttgccaggagtatgcctacatcagctgctcttgatgtggtggcaaagcatttaaatctgaagttctttgaagttcccactggctggaagtttttggaaacttgatggatgctgggatgtgctcagtttgtggtgaagaaagttttggaaccggttcagatcatattcgtgagaaagatggaatctgggcagttttagcttggctctctattcttgccttcaagaacaaggacaatcttgatgggaaagatcttgttaccgttgaagacatagttcgtcagcattgggccacttttggtcgccactattatactcgatatgactatgaaaatgttgatgcaggtgcagcaagggagctgatggcgaatctggttaaactacagtcttcacttcctgatgtgaataagattattgggggaatacgatcagatgtgtcagaagtcgtcgatgctgatgagtttgaatacaaagatcctgtcgatggctccatctcaaagcaccagggtattcggtatctgtttaaagacggatcaagattggttttccgtctgtctggaactggttccgaaggtgcaactatccgactttacattgagcaatatgagaaggattcttcaaagattgggagagagtcttcagaagcccttgctcctcttgtggaggttgctctcaagctttccaagatgcaagaatacactggccgttctgctcccacagtcatcacctaaattgaccccccagattgaacatcttgtctatatttcagctggactcttctattttgtggtatgaggaatttttctgagccatgatactccacatgaacccagtgagatatcttactatatagtatgttctaataaaaacagccttaccatatcatcaacagaggagagatcagtatacctccataatcctgttaagaaagaaaagttttagaaatagttagaattataattaacaaaaaaaagtttt

SEQ ID NO: 5239 - DNA, 2052 bp, Vinca minor
tctcacactcgtcacccgcttctcttctcttcttcgctttaaaagtttcgtccagaaatggtgttcaaggtcgttcgtgtcgaaactaagccttttgatggccagaagcctggtacttccggtcttcgtaagaaggtgaaggtctttacacaatctcactacttggaaaattttgtccagtccacttttaatgcccttggagctgacaaagtcagaggtgccacacttgtagtttctggtgatggtcgctactactcgaaagatgcgatccagatcatcatcaagatgtcagccgctaatggagtgagacgcgtttgggttggtcaaaacggtctgctatctactccagctgtatcttgtgttgtacgtgagagagttggggctgatggatctaaggctacaggagcatttatattgacagcaagccacaacccaggaggccctaatgaggattttggaattaaatacaacatggaaaatggaggacctgcaccggaatcagttacaaataagatatatgaaaacactacaactataaaggagtacttaattgcagaaggactgccagatgttgatatcattaccatagcagtttcaaactttgctggtccagaggggcaatttgatgttgacgttttcgattcagctaatgattatttgaagttgatgaagtcaatttttgatttccagtcaatccagaagttgctttcatctccaaactttaccttctgttttgatgcacttcatggggttgctggagcgtatgctaaatgcatttttgttgaagagcttggtgcaaaagaaagttctttgttgaattgcgtacctaaggaggactttggtggtgggcatccggatcccaatcttacctatgcaaaagagttagttgaatgtatgggattgggcaagacggacagtggaaaagagccaccagaatttggtgctgctgctgacggggatgctgaccgcaacatggtcctggggaaacggtttttgttactccatcggattctgttgctatcatagctgcaaatgcggttgaaaccatcccttacttttccagtggtctgaaaggagttgccaggagcatgcccacatcagctgctcttgatgtcgtagctaaaaatcttgacctgaaattctttgaggtgcctactgggtggaaatattttggcaatttgatggatgcgggaatgtgttcagtttgtggtgaagaaagttttggaactggctcggatcatatacgtgagaaagatggtatttgggctgttttggcttggctatcaattcttgcctacaaaaacaaagacaacttaggtggggggaagcttgtaactgttgaggaaattgttcgccagcactgggaaacttatggacgccactattatacacgatatgattatgagggtgttgatgcaggtggcgccaaggaattgatggcacatttagtcaagctacaatcctccttaagtgaagtgaacaagatgataaaggacattcgtccagatgttgcaaatgttgccaccgctgatgagttcgaatataaagatcctgttgatggttccatctccaagaatcagggaattcggtacatgtttgaggacggttcacgactggtcttccgtctctctggaactggatcagagggtgctactatccgtgtgtacattgaacaatatgaaaaagactcgaacaagaccggcagagattctcaagatgccctttctcctctggttgaagtcgctcttaaactttctaagatgcaagagttcactggccgatctgcacccaccgttatcacataaatccttttacactgcatctaattgtgtacgccttactataaaataattcagcatgatattactcttatattatcccggaagagttctgccaataactttttattttacttaatagttcttttagattacaatataaaaagtttgttttcttgtaaccttctacaatgagcacagacaaggcgagagtagtgcagacggatgatcctatcattgagtttttatttgaaatattccagttttgttgtta

SEQ ID NO: 5240 - DNA, 1447 bp, Carica papaya
tttttgatttcgagtctatccgaaagttgctttcatctccgaagtttactttctgctatgatgctttacatggagttgctggagcttacgcaaaatgtatctttgtggaagagcttggtgcccaagaaagttcattattgaactgcactcccaaggaggacttcgggggagggcatccagatcccaatctgacttatgcaaaggagttggttgctcgtatgggactgggtaaatcagattctgggtttgagccaccggagtttggtgctgctgctgatggtgatgcagaccgtaacatgattctcggtaaaaggttctttgttactccatcagactcggttgccataattgctgcaaatgcagttgatgcaattccctatttttctgcgggtctaaagggcgttgccaggagtatgccaacctcagctgctcttgatgttgtggccaagaacttgaatttgaaattttttgaggttcccactggctggaaattttttggtaatttaatggatgctggattgtgttcaatctgtggggaagaaagttttggaacaggctcggaccatatccgtgaaaaggatggaatctgggcagttcttgcatggctgtctatacttgcttataagaataaggataaccttgatgggagaaagcttgtgagcgttgaagacatagtccgccaacactgggctgcttatggtcgtcactattatactcgatatgactatgagaatgtggatgcggctgcagcaaaggaattgatggcatatttggtcaagttgcagtccacacttcctgaagttaatcagatcgtgaagggaatatgctctgatgtatcaaatgttgctgctgcggatgaatttgaatacaaagatccagttgatggttctgtatcaaagcaccagggcattcgatatctctttgaggatggctcacgattggttttccgtttatcaggaactggttctgaaggtgcaactatccgtctctacattgaacagtatgagaaggatccatcaaaaacagggagagattctcaagaagcacttgctcctcttgtggaggttgcactccagctttctaagatgcaggagttcacgggccgatctgcaccaaccgttattacatagatgctcaacatacccaacaataatagtaataattttaagcgtcatcctctgaggtcacgacgtcaaacactgtattggctggtagttggcctaaatttgagtattctcatcctatcgtatgcacggcttatgacaaaaattttgacgtaaaaaataatttgggtcttctgatacatgtttgatttcacaagttctaattttttttttttttttttatctattcagaaaattagttgcctggtttctatcgtgtttgtatgggctaattctgtcgccagtgtagagttaatgaattatctttctttgcctggttttta

SEQ ID NO: 5241 - DNA, 961 bp, Brassica juncea
gcaaggagcatgccgacgtcagctgctctcgatgtcgttgcaaaaagcttgaatttgaagttctttgaggttccaacaggctggaagttttttggtaatctgatggatgccgggatgtgttccgtctgtggagaagaaagttttggaactggctccgatcatatccgtgagaaagatgggatatgggcagttcttgcgtggatgtccatacttgctcacaagaacaaggatagcatagacggtgacactaaactggtgacggttgaagacattgtccgccagcactgggctacctatggccgtcactactacactcgttacgactatgagaatgtagacgcaggtaaagccaaggaactgatggagcatttggttaaattgcaatcttcaattcctgaagtcaacaagattgtgaaaggaattcgttcggacgtggcgaatgtctccagtgcggatgagttcgagtacaaagatccagttgatggttccatctcaaagcaccagggtatccgttacttgtttgaggatggatcgcgacttgttttccgtctgtctggaactggctcggaaggagcaaccatcaggctctacattgaacagtacgagaaggatgcttcgaagattggacgagagtcccaggaagctctgtctcctctggttgacatagctctgaagctgtccaagatggaggagttcactggccgatcagcccccaccgtcataacttaagaagcgattccaaatcctacacttctgtactttcttctcactacatgaataatatgtctcagggggacttcatatttcggattttcatagttcctgagttatcttaaggctttatactttgtatggatttgtctttctcggttttgttttctcttgttttacatctattcttacatgatataagattttgttataacagttcaacgattttgcaagtttcatctcttttttt

SEQ ID NO: 5242 - DNA, 1050 bp, Humulus lupulus
gaacctccagaatttggtgctgctgctgatggtgatgcagaccgtaacatggtccttggtaaaaggttttttgttactccttcggactctgttgccataattgctgcaaatgcagttgatgctatcccatacttttctgctggtctgaagggagttgccaggagcatgcccacatctgctgctcttgatgttgtagctaagcatttgaatttgaagttctttgaggtacctactggctggaaattttttggcaacttgatggatgctggattatgttctgtttgtggtgaagaaagttttggaactggttctgaccacattcgagagaaagatgggatctgggcagttttggcttggttatctattcttgcacataagaataaggataaccttgatggaggaaagcttgtgagtgttgaagaaatagttcgtcaacattgggctaaatatggtcgccattattatactcgatatgactacgagaatgtggatgcgggtgcagcaaaggaactaatggcgtacttggtcaagctgcaatcttcccttcctgaagtgaatgagatagtgaagagtgcacgttcagatgtttctaaggttgtccatggtgatgaatttgaatacaaagatcctgttgatggctccatttcaaaacaccagggtattcgatacttgtttgaggacggttcaagattggttttccgtctctccggcactggctcagaaggtgcaaccatccgtctatacattgagcagtacgaaaaagatccatctaaaattggcagggactctcaggaagcacttggtcctcttgttgaggttgctctcaagctttccaagatgcaggaatatactggtcgaactgccccaactgttattacataaatgtgcattagttcagcaagttggaaatttggaagtttcctcaaagtgcttatggagaaggttctttcttttcatttggttctccctacttatctctatcatgtgctaccaagctgagcggacacccagtcagtgttgcgtaccacaagtgtactgatataaattttt

SEQ ID NO: 5243 - DNA, 3444 bp, Phalaenopsis aphrodite
agtggttgggtgaggattgttaaaagcagcatcaagatccacttgcatagaattgatggcctggaactccacttggtcaccagagtttttagttatgcttggttctgcaggggtaatactctcaagctgtaaagtctcagtttctggaatcacatctccattattcttgtcagctattgaagcaaaaacaagagaatcctccggagctgaaataccgccaatctgctcttcggttggcaaagccatttcataattctttggtgcctccagtgactctttaaatacatcttggggttgcaaaatggctcctacagaaatgctagcatctgcctccatcaattggtcaggcccagcagcatttccatcttgaacttcattgaaagatttttcaactgcagatggtattgtagaagcttcatgtacagaaagcctggagagtaacttagaatgacccaacttagaaaactcttgttcattatccaatgaattcagataagtcctttgattttcttccaagttagaagatccaatggcaaggtaatcccttttcttaagctctgatgtagaaatcaaatgacttccaaaattgccggtactactcaaacgtgaaggtgtcgtcataaggccattggtgctgaaggaaggagatctccatggaggcaacgattgcaagtaagatttagccatctcaattggtgaaccaacatcttcctccaaaggaatttgattcatgagcatgttcgaaatggaaggcccataactttgatcatatgtaggactaggagacagttttttctcttcaaaccatttctttgcctccataacagctttgttgcgaagatcagaaaaaactgcttcctgggtataaaatcgtggagagaaggaagataaacttctggaagagaaattggatatcccatagagattcctgtcatggttcaaatttggcaccgcattttgcgttccctcaccgatttctatagaattcctgtatggtacccgtgattgaattatctcaaccagtttgttgcattcgtctctcgtaaaagtctcctgcataagcaactgctcaataacaagctttgtttcactttttggaataatggctagtgcctccatatttatatctgcctcacattctctaattttaaaggcggctaaatcatcagagcgcaattgatcctcatgctcattgggatcatagtcggagtactcgtcggaattggaatagcactccgacggggacggactgcggttttcagggcctaggacggacaagaacaactttccgaagccggaaatgagacccctgagccaaccaagacttcttccggtttgcgcttctggcactcgatgtggtatcagcgtcgtagaggatggcggtcggctgtaaggcgagaacgacggtagtaaccggcggcggccgcggataaccttcccgccggatcccaactcctctcgctcctcgccccctcttatctctctgcacgttgctgaagatcttggaagaaccaaaagaaaaatggtggtatttgccgtgagccggaaggaaacgagtcctatcgagggtcagaaaccgggaacgtcgggcttaaggaagaaggttaaagtgttccagcaacctaattatctacacaactttgttcaatcaacttttgatgcacttactgctgagaaagtgcgaggtgccacaattgttgtttctggggatggccggtatttctctaaagatgctattcagatcataataaagatggcagctgcaaatggagtaagacgagtatggattggtcaaaacggtctactctccacacctgctgtatcttgtgttatccgggaacgagttggtgcagatggatctaaagctactggggcttttattttgactgctagtcacaatccaggtggaccaaatgaggattttgggatcaagtacaacatggaaaatggtggacctgcaccagaggctattactgataaaatttatgccaacacaaaaacgataaaggaatacctcattgcagaagatattccagatgtggatgtttctaccattggtgtgaccaactttagtggacctgaaggactatttgatgtggaggtgtttgactcagccagtgattatgtacaacttatgaaatcaatttttgatttttcatcaatccaaaagcttctcgcttctccaaatttcagtttctgctatgatgcacttcatggtgttgctggagcttatgccaaacgcatttttcttgaagaacttggtgcaaaagaaagctctctgttaaattgcactcctaaggaagactttggtgggggccatccagaccctaacctgacttatgccaaggaattagttgcacgaatgggattgagcaaatcagaaccacaagatgagccccctgagtttggtgcagctgctgatggtgatgctgatcgtaacatgattctcggtaaaaggttctttgtgactccatctgattctgttgccatcattgctgctaacgctgttcagtctattcctttttttcttctgggctgaagggtgttgccaggagcatgccaacctctgcagcgcttgatgttgtagcaaataatctaaatctgaatttttttgaggtgccaactggatggaaattctttggcaacttgatggatgctggactttgttcgatctgtggtgaagaaagctttgggacaggttcagatcatattcgtgagaaggatgggatctgggcagtcttagcatggctttctattcttgcctacaagaacaaagacaacctcattgggggaaagctagtgacagtagaagacatagttcgccaacactgggctacttatggtcgccacttttatactcgatatgattatgagaatgtggatgcagctggagctaaggagcttatggcatatttggtcaaattgcagtcatccatcccagaagtgaacaagattataaaggaaataagatcagatgtttctgatgtcgcacatgctgatgagttcgaatacaaagatccagtcgatggctcaatctcaaagcaccagggaattcgttacttgttcacagacggctcgcggctcgttttccggctctccggaactggttcagaaggtgccacaattaggctctacattgaacagtacgagaaggattcttcaaatacagcaagggattcacaggaagctcttgctcctcttgtggaagtggctctgaaactttccaagatggaagagttcacaggacgatctgcaccaactgttatcacctaaggttatgacaatcagcaatttttttgacttgttgaattgtttaaaataagcttgtttctatttataaatatttgttactttttgcaatttcagaattccttgcatcataattttgtttttgcagcttacacatgaaataacctgcaagtcatttgtaacttatctcatgca

SEQ ID NO: 5244 - DNA, 1229 bp, Trifolium pratense
  misc_feature (937)..(937): n is a, c, g, or t
  misc_feature (1104)..(1104): n is a, c, g, or t
  misc_feature (1135)..(1135): n is a, c, g, or t
ctttggagggggacacccagaccctaatttgacatatgcaaaagagttggttgctcgtatgggattgggaaaatcagaacctcaaggtgagcccccagagtttggtgctgctgctgatggtgatgcagaccgcaacatgatacttggtaaaaggttttttgtcactccttcggattctgtggccattattgctgcaaatgctgttcaagcaataccatacttttctgctggcctaaagggagttgccaggagcatgccaacctctgctgccttggatgttgtagcaaaacatctgaatttgaagttttttgaggttcctacgggttggaagttctttggtaatttaatggatgctggattgtgttcagtttgcggtgaagaaagttttgggactggttcggatcacattcgtgagaaggatggaatctgggcagttttggcctggctatctatacttgcatataaaaataaagataatcaagacaagctcgtaacagttgaagacatagttcgccagcattgggctacctatgggcgccactattatactcgatatgactacgaaaatgtggatgcaggtgcagcaaaggaactgatggcacatttggtcaaactgcagtcctcactttcagaagtcaataagattgtgaagggagcaagctcagatgtttcaaatgttgtccacggtgatgaatttgaatacaaggattctgtggatggttccgtttcatcgcatcagggcatccgatatttgtttgaggatggatcacgattgatcttccgcctctctggaactggatcagaaggcgcaactattcgactatacattgagcaatatgagaaggatccatcaaagattgggagactttcacatgaagcacttgctcctcttgtggcggctgcattgaaactttcaaagatggaggaatttaccggncgatctgctcccacagtcattacataaatacatatactcccagaaccaagtcatttcttattgtctgtcaaaatttccatccaatgttaattttgtgagtaaccaacctgtatactgttggttgttttcagccctttactatgggcacttgagtggactttgtactnctttaactaaattttgatgtgctaaataatntgaaaccgtcgagtgctgattatatatactcttattaatataatatttactcttctgttggctttattttggccactcttttcataaacccttc

SEQ ID NO: 5245 - DNA, 1123 bp, Actinidia deliciosa
gaaacatgatccttggtaaaagttttttgttactccatcagattcagttgctattattgctgcaaatgctgttcaagccataccttatttttctggtggtctaaagggtgttgccaggagcatgcctacatctgctgcactagatgtagttgctaagcatttaaatttgaaattttttgaggtgcctactggctggaaattctttggtaacttaatggatgctggattatgttcagtttgcggtgaagaaagttttggaactggttcggaccatattcgtgaaaaagatggaatctgggctgtattggcttggctctcaattcttgcttatagaaataagaataacctcagtgatgttgaaaagcttgagacagttgaagacattgttcgccagcattgggctatctatggccgccactattatactcgatacgattacgagaatgttgatgcaggtgcagcaaaagaactgatggtgtatttggtcaacctgcagtctgatcttgctgaagttaacaagattgtgaaggggatctgttctgatgtctcaaatgttgccgatgcggatgagttcgaatacaaagatcctgttgatggttccatctcaaaacatcagggaattcgatatctgtttgcagatgggtcacgattggttttccgcctctctggaactggctcggaaggtgcaaccattcgtctttacatcgagcaatacgagaaggatccctcaaaaactgggagagattctcaagcagcacttgctcctcttgtggaggttgctctcaagctgtctaagatggaacaattcaccggccgatctgctcccactgtcattacatagatcaatctacatttctacacagagcatcagactgtatgtcttctcgagtataataaaacactaagaaagcttttcactacatggctgatactatatgtagcttttgtagtggcctcgtgatagtagccaatactagagatgctttataatatctttttttttcccttccttttttcccagaataatttgcatgtggcatgaatcttttgatttacaaggttgagctattcaattacatcgttatgcgattaatggagaattaatgttcagttggaatgctaa

SEQ ID NO: 5246 - DNA, 1264 bp, Elaeis guineensis
gttcacattctgttatgatgcacttcatggtgttgctggaatttatgccaaacgtatttttgttgaagagcttggtgcaaatgaaagttcacttatgaattgcactcccaaggaagactttggagggggtcatccagatcctaatctgacgtatgcaaaggaattagttgcacgaatgggactgagtaaatcaggctctcaaggtgaaccacctgagtttggtgctgcagctgatggtgatgcagatcgtaacatgatccttggcaaaagattttttgtaactccatcggattctgttgctataattgctgccaatgctgttgaagccattccatatttcagctccggtttgaagggggttgccaggagtatgccaacatcggctgcccttgatgttgtggcaaaaaatttaaatcttaaattttttgaggtaccgactggatggaaattttttgggaacttgatggatgctgggctttgttcaatctgtggtgaagagagctttggaactggttcggatcatattcgtgaaaaggatggaatctgggcagttttagcttggctttctattcttgcttacagaaacaaggacaagcttgatggggataagctggtcacagttgaagatatagttcttcagcattgggccacttatggtcgtcactactatactcgatatgactatgagaatgttgatgctggcgcagctaaggaacttatggaacatttggtcaacctgcaatcctctcttcctgatgtcaacaagattatcaaggagataagaccagatgtctcaagtgttgtccaagcggatgagtttgaatacaaggatcctgtggatgggtctatctccaagcatcagggtatccgatatctctttgaggatggatcacgactggttttccgcctctctgggactggctctgtcggtgcaaccattcgagtctacattgagcaatatgagaaggaccctatgaagactgggagggattcacaagaagcacttgctccacttgtggctgtggcgatcaaactctcaaagatgcaggagtttacaggacgatctgctcccactgttatcacataaaccagagtagattaactaataaaatatgggtcgagcttgcttggttttgtattgcagtggtgcgaggccagggcatcctacaggtattttgacttgaaagtttaccaatacagtccagtctcatcttgtggtgagaagagtgtaataaaatttatccgatactgctctccttcaacc

SEQ ID NO: 5247 - DNA, 2243 bp, Lippia dulcis
tgattgaatatggaagtgaggttttgttaattttagagtgagcgaaaaacggagatctaactgttaggccgaggagaatcaaagtatcagaataaatacactctttacaatcaccactttaattgtctgaaacactctacacgcatcccttctgcatttttttgagccaagatgacatcgtttaaggttacccgcgtccagacttctccaattgatggccagaaacctgggacttctggccttaggaagaaggtgaaggtattcgtgcaaccccattacttgcaaaattttgtccagtccacttttaatgcccttggagctgataaaatgaaaggtgctacgcttgttgtctctggtgatggtcgctactattcaaaggatgctatccagatcatcatcaaaatggcagctgcaaatggagtaaggcgtatctgggttggtcagaacgggttgctatccactcctgctgtttccgctgttatacgtgaaagagtaggcgctgatggctccaaggcaaatggggcatttatacttacagcaagccacaacccaggggggccaaatgaggatttcggaatcaaatacaacatggaaaatggtggacctgcaccagaaggaataactgacaagatctattcgaacaccaccacgattaaggagtacctgattgccgaaggcctacctgatgtggacatctccaaaattggattaggctaactttactggtcctgatgggcagtttgatgttgatgtttttgattcagcaagtgactatgtcaaattgatgaggtctatttttgatttcaagtctatcatgaatttattgtcatctccaaaattctctttctgctacgatgcacttcatggtgttgctggagcttatgctaaacgtatatttgttgaagagctaggggcaaaggaaagctctttgcttaattgtgtacccaaggaagattttggcggaggacatcctgatcctaatctgacatatgcaaaagaactagttgctcgtatgggattgagtaagttagacaacactgaggacccaccagagtttggcgcggctgctgatggagatgccgaccgcaacatggttcttggaaaaaggttctttgttactccatctgattctgttgctattatagctgcaaatgctgtacaggcgataccctacttttctggtggtctaaaaggagttgcaaggagcatgcccacatcagctgctcttgatgttgtagctaagcacttgaatctgaaattctttgaggtgccaactggatggaaattctttggcaacctaatggatgctggaatgtgttcagtttgtggtgaagaaagtttttggaactggctctgaccacatacgtgagaaagatggaatatgggctgtgctggcttggctagccattattgcctataagaacaaagacaatctcgggggagataaacttgttagtgttgaagacattgtgcgccagcattggtccacatatgggcgtcactattacactcgatatgactatgagaatgttgattctggtggtgccaatcaactgatggattatttggtcaagctgcaatcgaacctaactgaagtcaacaacattgtaaaaggaatccggtcagatgtctcaaaagttgtgaatgctgatgaatttgagtacaaggatcccgttgatggttccatttcaaagcatcagggaatcagatacctatttgaagatggatctcgattagttttccgactctctggaactggttcggaaggtgctactatccgtctctacatagagcagtatgagaaggatccatccaagatcgggagggaatctcaggacgcacttgctcctctagttgaggttgctcttaagctctctaagatgcaagaatacactggccgatctgctcccactgttattacatagatgctgcaggcacagtggtgaggagtttgtttgtatcccgatatcgttcgttgacataattttgttgagaaaaataagcaatgcaataactctaccagtgaggcattgtatacacaggcatgaaaccatgtactgaacatggtctgtgttaccttgttatgagggttgtggatttgattatattgtcacccccattattttggtatctgctttgtgttaagcaggaaggttttattctgtatcggaacataatattcatatggttactaataatgagtataaagtttaccattccaccattagaataaggaaaaagaa

SEQ ID NO: 5248 - DNA, 1719 bp, Sequoia sempervirens
cggtactattcaaaagaggctattcagataatagtaaaatggcggctgcaaatggagtgaggtgcatttggataggccaaaatggactgctttcaacacctgcagtgtcagcagttatacgcgacagagtgggggcagatggagagaaagcatccggagcttttatattgacagccagccataatccaggaggtccgcatgaggactttggtattaagtacaacatggaaaatggtggaccagctcctgaagggattactgacaagatatatgagaatacaaagacaataaaggagtattttattgcagaagatctcccagatgtagacatatcaactataggcataacacattttggtggccctgagggaccttttgatgtggatgtctttgattctgctgaagattatgtcaaattgatgaagactatcttcgactttgaagccattcaaaagttgcttacatgccctaaattcacattctgttatgatgcacttcatggtgtggctggagcatatgctaaaagaatttttgtcgaagagctttctgcagatgagagctcattgataaattgtattccaaaggaggattttggaggaggacatccagatccaaatttaacatatgccaaggaactggtagcgcgaatgggattgggtaaagaggctcctgcatcagagccaccagagtttggtgctgctgctgatggtgatgcagatcgcaatatgattcttggaaagaggttttttgtgacaccatcagactctgttgcaatcatcgcagcaaatgcagttgaagccattccatacttcagctctggtttgaaaggtgttgcaaggagcatgccaacatcagctgcacttgatgtggttgccaaaaatttaaatctcaagttttttgaggtgcccactggttggaagttctttggaaatttaatggacgctggaatgtgttctgtttgtggtgaagaaagctttggcactggttctgatcatatcagagagaaggatggaatctgggcagttttagcatggctttcaattcttgctttcaaaaacaaggataatcttgctggtgggaagcttgtctctgtggaggacatagtccatagccattgggcttcctatggtcgacactattacacacgttatgactatgaaaatgttgatgctgctgctgcaaaggagcttatggctcatttggttaagttgcaatcttctctccccgaagtgaacaagataattaagggagtgagacctgacgtttctgatgttgtacatggtgatgagtttgaatacaaagatccagtagatggttccgtttcgaaacaccagggtatacgttatctctttgaagatggttctcgactgatattccgactttctggcactgggtctgaaggtgcaactattcggctatacattgagcaatatgaagccagtccaagcaagacaggaagaaattcacaagaggctcttgccccactggtggaagtagctttgcagctttccaagatggaggagtttacaggccgctcaagtcctactgtaattacatgaattttaggaaatgtgataggtgatttgtgcgtacagggttatctggtgaaaaaaacacctggataaaattttccaataaatctttatgaacatctgacattgcagagcaaaagcctaaatattgatattgggtattcgtgcaatagaggcgatattcttt

SEQ ID NO: 5249 - DNA, 2098 bp, Taxus baccata
cacatctgcaaaacccttgcattgcatatactcattgtgtatactcttgtactgtttcatttccatataagcttagatctgaattcaggtggagcggaaaaatggtgctctttagcgtggttaggaaggaaacttctccttacgatggacaaaagccagggacatccggcctcaggaagaaggttaaagtcttcatacaggagaattatttgcagaattttgttcaagcaactttcaatgcactgtcagctgagaaaataaaaggttctacaatcgttgtgtctggggatggacgatactattcaaaagatgctattcagataataataaaaatggcagctgcaaatggagtcaggcgtatttgggtaggccaaaatggtcttctttcaacacctgcagtttctgctgttatacgtgacagagttggggcagacggagagaaagcatcgggagcttttatattgacagccagccataatccaggaggcccgcatgaggactttggaataaagtacaacatggaaaatgggggaccagctcctgaagggataactgacaagatatatgagaatactaagacaataaaggagtattttattgcagaagatctcccagatgtagacatatcaaccatagccataacgcattttggtggccctgaaggaccttttgatgtggatgtctttgattctgccgaagattatgttaaattgatgaagactatctttgactttgaagccattcagaagctgcttacatctcccaaattcacattctgctatgatgcacttcatggggtggctggagcatatgctaaaagaatttttgttgaggagctgtctgcagatgagagctcattaataaattgtactccaaaggaagatttcggaggaggtcatccagacccaaatttaacatatgccaaggaactggttgcacgaatgggattgggtaaagaggctcctgcattggaaccaccagagtttggtgctgctgctgatggtgatgcagatcgcaatatgattcttggaaagaggttttttgtgactccttcagactctgttgcaatcattgcagcaaatgcagttgaagccattccatacttcagctctgggttgaaaggtgttgcaaggagcatgccaacatcggctgcacttgatgtggttgccaaaaacttgaatcttaagttttttgaggtgcccactggttggaagttttttggaaatttaatggatgctggattgtgctctgtttgtggtgaagaaagctttggcactgggtctgaccatattagagagaaggatggaatctgggcagttttagcatggctttcaattcttgctttaaaaaataagaataatcttgatggtgggaatcttgtctctgtggaggacatagtccatagccactgggcttcctatggtcgtcactactatacacgctatgactatgaaaatgttgatgcagctgctgcgaaggagctcatggctcatctggttaaattacagtcttctcttcctgaagttaacagaaaattaaggaagtgagatcagatgtttctgttgttgtacatgctgatgagtttgaatacaaagaccctgtagatggttctgtttccaaacaccagggtatacgctatctctttgaagacgggtctcgattggtattccgactttctggcactgggtctgaaggtgcaactattcggctgtatattgagcaatatgaagccgatccaagcaagacaggaagaaagtcacaagacgctctttccccactggtggaagtagctctacatctttcaaagatggaggaatttacaggccgctcaagtcctactgttatcacatgagttatagaaaatgtgatagtggtgatttgtgtgttcaggtttatctggtgaaaaagacacttggataaaattttccaataaaattttagaggcaaggcatttaagagcaaaaatacttgatattgacatgagatatttttgcaatagaggtggtcttaattcaccaaatttcaagaaatcctgggtgatggtgttttatcctaaaaaattggctaataaaggagtgttgtcaccattggacttgcg

SEQ ID NO: 5250 - DNA, 2029 bp, Distylium racemosum
ttcgatagcttgcttgtggtgtagattttacagacacatagagctgatcttttttcgacgtgaagcgcaaaaatggtgattttcagtgtatcccggaaggagaccactccgtacgacggacagaaaccaggcacatccgggctcaggaagaaggttaaagtcttcgcgcaagagaattacttgcacaatttcgttcaagcaactttcaatggactgtcagctgagaaagtcaaaggtgccacaatcgtggtgtctgggggatggacgttacttctcaaaagaggctattcagataataataaaaatggcagctgcaaatggagtaagtcgtgtttgggtaggccaaaatggacttctctctacacctgcagtgtcagcagtcatacgtaacagagttggggcagatggagaaaaagcattgggagcttttatattaacagccagtcataatccaggaggcccagatgaggattttggaataaagtacaacatggaaaatggtggaccagcacctgaagggattactgacaagatatatgaaaatactaagacaataaaggaatactttatatcggaagatctcccagatgtggacatctcaactataggtgtaacaagatttggcggtcctgaggggccttttgcagtggatatctttgattctactgaagatcatgttaaattgatgaagactatctttgactttgaagctatccaaaagctgattacatgccccaaattcacattctgctttgatgcacttcatggggtggctggaatatatgctaaaaggatttttgttgaggagctttctgcaaaggagagttcattaataaattgtactccaaaggaggattttggaggaggccatcctgacccaaatttaacatatgccaaggaattagttgcacaaatgggtttgggtaaagaggctgctgcagtggagccaccagagtttggtgctgctgctgatggtgatgcagatcgcaatatgattcttggcaagaggttttttgtgactccatcagactctgttgcaatcattgctgcaaatgcagttgaatccattccatacttcagctctggtttgaaaggtgttgcaaggagcatgccaacatcagctgcgcttgatgtagttgccaaaaatttgaatctcaagttttttgaggtacctactggttggaagttttttggaaatttaatggatgcgggaatgtgttctgtttgtggtgaagagagttttggcactggttctgaccatattagagagaaggatggtgtctgggcagttttagcttggctttcaattcttgcatacaaaaataaggataatcttgatggtggggagcttgtcactgtggaggacatagtccgtaaccattgggcatcttatggtcgtcactattatacacgctatgactatgaaaatgttgatgcaactgctgcaaaggagctcatggcatatttggttaagttgcagtcttctctcactcaagttaacaagataatcaagggagtgagatcggatgtggctgaagttgtacatgcagatgaatttgaatacaaagaccctgtagatggttctgtttcgaagcatcaaggcatacgctatctttttgccgatgggtctcgattagtgttccgactttctggcactgggtctgtgggtgcaactattcggctatacattgagcaatatgaagccgattcgaccaagacaggacgagattcacaagaagctcttgcaccgctggtggatgttgctttacgtctttcaaagatggaggaattcacaggccgctcaagtcccactgtaattacttgagttatagaaaatgtgataaagatgatggatgtgtcaaggcttatctggtgaaaaagggacgtctggatagttttttccaataaattctataaaatataagacagtgaatggcaatcacttgcttgatcctaccatgacattcgtacacaggagtcttccttttgccaattttgaagttgtttgtctaaacattttattaataaa

SEQ ID NO: 5251 - DNA, 1347 bp, Fagopyrum esculentum
ctccaaagttctcgttttgttatgattcacttcatggagttgctggtgtttatgctcaacgtatttttgtggaagagcttggtgcagatagctcatcattgttgaactgtgtaccaaaggaagattttggcggaggacatcctgatccaaatttgacctatgcaaaggagctagttgagcgcatggggttaggtaagtcgagttctcaagagccaccggagtctggtgctgctgctgacggtgatgctgatcgtaacatggtccttgggaaaagattttttgtgactccatcagactctgttgctataattgctgcaaatgctgtcgaatgcattccttattttctggaggtttgagggagttgcaaggagcatgccaacatcagctgcccttgatgttgttgcaaagcatctcaagttgaagttttttgaggtgcccactggctggaaatttttggtaacttaatggatgctggaatgtgttctgtttgtggtgaagaaagctttggaactggctctgaccatgtacgtgagaaggacggaatctgggcagttttggcttggctatcaattcttgctttcaagaataaggataatctaagtggtggaaagcttgttagtgttgaagatattgtccgcaagcactgggagacttatggtcgacactactatacacgctatgactatgagaatgttgatgcaggagctgctaaagaacttattgctcatctggtcaagcttcaatctaccattcccgaagttaacaagattgtgaaggcggcacgtccagatgtgtccaatgttgtaagtggtgatgagttcgagtacaaggatcctgttgatggctcaatctccaagaaccagggcgtacgctatctatttgaggatgggtcaagactggttttccgtctctcgggaactgggtcagaaggagcaaccatccgtctatacatagagcagtatgagaaagattcatcaaagatcggcagagattcacaagaagcacttgctcctcttgtggaggctgctctcaaactttccaagatgcaagagttcactggccgatctgctcctaccgttattacataaatacagcaacgtttctgtgggaaaatatatcgaactaaaccgtaaaggtggggacacattagatgccttgccatgtctctttcatgttttatctttcaaacagctgagtcttttccggttggcgacctctttagaggacagcaagttttgctgataaacttccatataagctaaataaaagggctgtttgtgttttgccaatctctggcgattttggttgtaggtgtgcccttctaaaataattttaatgatcatgttc

SEQ ID NO: 5252 - DNA, 1513 bp, Cynodon dactylon
ccgggtagacatcagcgaatatctcatctctgaagaccttccagatgttgatatttctgttgttggtgtcactagcttcagtggacctgaaggcccatttgatgtcgatgtctttgactctagtgtggattatataaagctaatgaagtctatttttgattttgaggcaatcaaaaagctggtgacctctccgaaatttacgttctgttatgatgcacttcatggtgttgctggagcttacgccaaacagatcttcgtggaagagcttggtgccgatgaaagttcactgttgaactgtgtcccaaaggaggactttggtggtggccatccggatcctaacctcacctatgcaaaggagttagttgagcggatgggtcttgggaagtcaacctctaatgttgagccacctgaatttggagctgcagctgatggtgatgctgaccgcaatatgattctgggtaaaagattctttgtgacaccatcagactcggttgccatcattgcagccaatgctgttcaatcaattccttacttttcttctggcctgaagggagttgcccggagcatgccaacatcagctgcccttgatgttgtcgcaaagaatttaaatctcaagttctttgaggtgcctactgggtggaagtttttcgggaaccttatggatgcgggaatgtgttcaatctgtggtgaagagagctttggaactgggtctgaccacattcgtgagaaggatggtatttgggctgtgctagcatggctgtctatccttgctttcaagaacaaggacaaccttggaggagataagcttgtctcggttgaggatattgttcgtcagcactgggccacttatggtcgccactattacacgcgctatgactatgagaatgttgacgcaggggcagctaaggaacttatggcaaacctggtcagcatgcagtcgtcactttctgatgttaacaagttgatcaaggagattcggtcagatgtttctgatgtagttgcagctgacgagtttgagtacaaggatcctgttgatggatctgtctccaagcaccagggtatccggtacctcttcggagatggttcaagactggtattccgcctctcaggaactggttctgttggcgccaccatccgtgtctacattgagcagtacgagaaggattcctccaagattgggagggaatcacaggacgcccttgctccgctggttgatgtggcactcaagctctcaaagatgcaagagtacactggccggtctgcccccaccgtgatcacataaattttggaaaagtcgccattttagaatgagttgaggcacttacaaaaaattccattccagcctcgtgtttgatagtttttttttttgttacatctcactaccaataaaatgtatgtatcagactcgtctcattttattgcctgcagactcggccgctggcacagcatgaggcaataatcctgccagtgatgtaattgggagcgtgtttcaccatagtaatatatcgatatg

SEQ ID NO: 5253 - DNA, 2184 bp, Panicum virgatum
gtgctctccctgccctccgtcgctataatagcgccacgcccccgtcgccatcgtcaccataccaccactccctcccgatccctccaccgccaccgccaccgccaccgccaccgcctcctccgcctcacccctcttctcgcctcgtgcgtcgaccggcggccgatcgtctgcggcccagacatggggctcttcactgtcacgaagcaggccaccacgcccttcgacggccagaagcccggcacctccggcctccgcaagaaggttactgtattccagcagcctcattatctgcagaactttgtccaatcaacattcaatgcccttcctgctgatcaagtaaaaggtgcgaccattgttgtctctggtgatggccgctatttctcgaaagatgctgttcagatcataacaaaaatggctgctgccaacggagtaagacgtgtttgggttggactaaacagtctcatgtcaacccctgctgtatctgctgttatccgtgaaagaaccggtgcagatggatcaaaggctaccggtgccttcatcctgacagcaagccataacccaggtggtccgactgaggattttgggatcaaatacaatatgggaaatggtgggcctgcacctgaatccgttactgatagtattttctctaatacaaagacaatctctgaatacctcatcgctgaagaccttccagatgttgatatttctgttgctggtgtcactagcttcagtgggcctgaaggcccctttgatgtggatgtctttgactccagtgtagattacataaagttgatgaagtcaatctttgactttgaagcaataaaaaagctgctgacctctccaaagtttacgttctgctatgatgccctccatggtgttgctggagcttatgccaaacacatctttgtggaagagcttggtgctgatgaaagctcactgttgaattgtgtcccaaaggaggactttggaggtggtcatccggatcctaacctcacctatgcaaaagagttggttgaacggatgggtctcggaaagtcatcctcaaatgctgagccccctgaatttggtgccgcagctgatggagatgctgaccgcaacatgattctgggtaaaagattctttgtgacaccatcggactctgttgctattatcgcggccaatgctgttcaatcaattccttactttgcttctggcctgaagggagttgccaggagcatgccaacatctgctgcccttgatgttgttgcaaagaatttgaatctcaagttctttgaggttcctactgggtggaaatttttcgggaacttgatggatgctggaatgtgctcaatctgtggtgaagaaagctttggcaccggttctgaccatattcgtgagaaggatggtatttgggctgtgcttgcatggctttctattcttgctttcaagaacaaggacaaccttggaggagacaagcttgtcaccgttgaagatattgtccgtcagcactgggccacatatggtcgccattattacacacgctatgattatgagaatgttgacgcaggggctgctaaggagcttatggcaaacctggtcagcatgcagtcatcactttctgatgttaacaagttgatcaaggagatccggtctgatgtctctgaagtagtttcagctgacgagtttgagtacaaggaccctgttgatggctgtgtccaagcaccagggtatccgatacctctttggagatggttcacgactggtgttccgtctctctggaactggttctgttggtgccaccattcgtgtctacattgagcagtacgaaaaggattcctccaaaaccggcagggattcacaggatgcccttgctccactggttgatgttgcgctcaagctctcaaagatgcaagagtacactggccgctccgcccccaccgtgatcacataaaattttgaagagcccgcatttttgaatgaattgaggcacttacacacactctccttccggcctcgtttgatagctttttgttgcatctcgcctctgaataaaatgtatgtatcagacttgtctcgttttgttgcccatactgcagggtgcaggctcagccgctggcacagcatgcggcaataatctcgtcactgtgttgtaattgagagcgtttttctcgtaagtcgtaatatatcagatgccattttggtttg

SEQ ID NO: 5254 - DNA, 2113 bp, Gnetum gnemon
gctctttcgtcggaggtctttttatttgcgttagtttgtagcagagcttctcaaagtttgattcgtctgtttcagagcttcggaaagtttgattcgtccttttcagctgaattgaggaagcggaagtcggaaaaaatggtgttgttcagcgtcacgaagaaggcgacgacgccttacgacggccagaagcccggcacgtcgggccttaggaagaaggtagcaatattcaagaaagataattacttgcacaattttgttcaagcaactttcagtgcactctcaccagccaaagtgaaaggtgctaccttggtggtttccggcgatggacgctatttctctaaggatgctattcagataataataaagatgtctgcagcaaatggtgtgagacgtgtttgggtagggcagaatgggttgctttccactcccgctgtatctgcggtggtccgcaacagagtgggagctgatggagagaaagcaactggggcatttatattgactgccagccataatcctggaggtccacatgaggactttggaataaaatacaacatggagaatggtggtcctgctcctgaaggggtcacaaacaaaatatacgagtttactaagatcataaatgagtactatattgcagaagatctacaagatgttgatctatcaagcataggcataacaaaatatactggaccagaggggcagtttgatgttgatgtctttgatgctactgaagaatatgttaaattaatgaaaactatatttgactttgaagctattcgaaaattgcttacatctcctaagttcaccttctgctatgatgctcttcatggggttgctgggatttatgctaagcgtatatttgtggaggaactttcagctaatggaagctcactattgaactgcacacctaaggaagactttgtgggggccatccagatccaaatttgacatatgctaaagaattggttgcacgtatggggttaggaaaagagccttcttctgaccctcctgaatttggtgcagcagcagatggagatgcggatcggaacatgatacttggcaagagattttttgttactccatcagactctgtggcaatcattgcagctaatgcagtggaagcaattccttactttagctctggattgaaaggtgttgctaggagcatgccaacatcagctgcattagatgtcgtagcaaaaaacttgaatctgaagttttttgaggttcccactggctggaaattttttggaaatcttatggatgctggtatgtgctctatatgcggtgaagaaagctttggaactggttctgatcatattcgagagaaggatgggatctgggctgtattagcatggcttaacatccttgcttacaaaaacaaggataaccttgttggtggtgggaagcttgtaactgtcgaagacatagtccgaaagcattgggcttcttatggccgacactactatacacgctatgattacgagaatgttgatgcagatgctgcaaaggaattgatgaaacatttggttaagttgcaatcaaatctttcacaagttaacaagttgataaaagaagcaagcccagatgttgctgatgtgaagaatgctgatgaatttgaatataaagatcctgttgatggctctgtttcaaagaaccagggcatacgatacctttttgaagatggatcacgattggtcttccgcttatctggaactggctccgagggtgcaacaattcgtgtatacattgaacaatatgaagccgattccactaaaacaggaagaaattctcaagaggcccttgcacctctggttaaagtggctttaaaactgtcaaaaatggaagaattcactgggcgctcaagtcctacagtcattacatgagagagcgcaaaggattgttgccggaatttttgttatcttatagtgcagtaatttataagcagattggaattactaatttagaaacaatatgcaaaacaaatactatagcttaccgtcgccggtagacttttgtttgtaaaagtttaataaatcatagtatctttgctgtgattttacaaaaccacgcggccacctgttaattaccaatcaatcctgctatccttaga

SEQ ID NO: 5255 - DNA, 1185 bp, Amaranthus tuberculatus
attgggtaaatcaaactcagaaggtgaaccgcctgaatttggtgctgctgctgatggtgatgctgaccgtaatatgatcctgggtaaaaggttttttgtgaccccatcagattctgtcgctattattgctgctaatgcagtagaagcaattccatacttctctggtggtctgaagggagttgccaggagcatgcctacttctgctgctctggatgttgttgctaaagctctaaatttgaagttctttgaggtgcccactggctggaaattttttggtaatctgatggatgcaggacaatgttcagtatgtggtgaagagagtttcggaactggctctgatcatgtacgtgaaaaggatggaatttgggctgtattggcctggctatctattctttctcagaagaacaaaaataaactcgacggtgaaaagcttgtgactgttgaagacattgttcgtcagcattgggccacctatggtcgacactattacacaagatatgattatgagaatgttgacgcaggtggtgcaaaagaactaatggcacatttggtcaatctgcaatcagatcttccccaagttaacaagattgtgaagaaagtaaattcagcagtgtccaatgtgattaatgctgatgagtttgaatacactgatcctgttgatggttcaatttctaagcatcagggtattcgttatctgtttgaagatggctcacgattggtgttccgcctttctggaactggctctgagggagcgacaatccgtgtgtacattgaacaatatgaaaatgactcctcaaaaactggcagagattctcaagaagcacttaaacctcttgtggaagttgctctagagctttctaagatgcaagaattcactgggaggtctgagccgactgttatcacataatcgcaaatttccgagatggatggtgcctcccttattgagtccaaggttttgcctcttttcttaggaggcaatagtactttttctataccatattttccgaatcaaactcagttttaatgatcaacgatataattgtataagagggagctcgttgttttgagttccagagttgacaataggcaactctagtagagatgtgtcctttgctcgagttcatgagttgacactcaattaaggaatcaaaataattttacttatacttctatatgaaaattagc

SEQ ID NO: 5256 - DNA, 1625 bp, Leymus cinereus x Leymus triticoides
  misc_feature (367)..(367): n is a, c, g, or t
  misc_feature (1464)..(1464): n is a, c, g, or t
  misc_feature (1467)..(1467): n is a, c, g, or t
  misc_feature (1497)..(1497): n is a, c, g, or t
cagccacaacccaggtggtccaaccgaggactttggaatcaaatacaacatggaaaatggtggacccgcccctgagtctgttaccgataagatcttctctaatacaaagacaattaccgaatacctcattgcggaggaccttcccgatgttgatatttctgtgacaggtgtcacttccttcactggacctgaaggcccttttgatgtcgatgtcttcgactctgctacagattacatcaagctaatgaagacaatctttgacttcgagtctattaagaagcttctggcatctccaaagttctcgttctgttttgatggtcttcacggtgttgctggagcttacgcaaagcgcatttttgtggatgancttggtgccagtgaaagctcactgttgaactgtgttccaaaggaagactttggaggtggtcatccggaccctaacctcacctatgcaaaagaactggttgatcggatgggtcttgggaaaacctcaaatgttgaaccccctgaatttggtgctgcagctgatggagatgctgaccgcaacatggttctgggtaaaagattcttcgtgacaccatcagattcggttgccattattgcagccaatgctgttcaatcaattccttactttgcttctggcctgaagggagttgccaggagcatgccgacatcagctgcacttgatgtagttgcaaagaatctaaatctcaagttctttgaggtgcctactgggtggaaattttttgggaacctgatggatgctggaatgtgctcagtttgtggtgaagaaagctttggcactggttctgaccacatccgtgaaaaggatggtatttgggctgttctagcatggctatctattctagcttacaagaacaaggacaaccttggaggagataagcttgttactgttgaagacattgttcttcagcactggggtacttatggtcgccattattatacacgatatgactatgagaatgttgatgcagaagctgccaaggaacttatggctaacctagtcaagatgcagtcgtccctgtccgatgttaacaagtttatcaaggagatccagcctgcggttgcagatgtggtctcggctgatgagtttgagtacaaggatcctgttgatggttctgtctccaagcatcagggtatccggtatctcttcggagatggttcccggctggtgttccgcctttctggaactggttcagttggtgctactatccgtatttacattgagcagtatgagaaggactcttccaaaaccgggagggagtcaagtgatgctctttctccactggttgatgtggccctgaagctttcgaagatccaggagtacaccggccgatctgcccccacggtgatcacataaattttgacctagatatgagccgaggccgcgtatgaagttcagttctggcctcctgttcgatagcttctttttacatctccctnacnacctgaataaatgtatgtgccagaccgtcnccgtttcgttgcctatactgcatactctgctgccggtacagtatatggccgtaatcttgtcacagtgattgtaatcaagagtgcgtttcttcatgcaatatattgacgtgttttctttttaaaaaaaa

SEQ ID NO: 5257 - DNA, 1189 bp, Orobanche aegyptiaca
atatttgtggaagagctaggtgcccaagaaagctctctactgaattgtgttcccaaggaagattttggtggagggcatcctgatcccaatctgacctatgcaaaagaattagtggctcgtatgggattgggtaaggtgaactcccaagaggagccaccagaatttggtgctgctgctgatggagatgctgaccgcaatatgattcttggcaaaaggttttttgttacaccatctgattctgttgctatcatagctgcaaatgctgttcaagcgataccttacttttctggtggattaaaaggagttgcaaggagcatgcccacttcagctgctcttgatgttgttgctaagaaccttaatctgaaattctttgaggtgcccactggctggaaattcttcggcaacctgatggatgctggaatgtgttcagtttgtggtgaagaaagttttggaactggctcagaccatattcgtgagaaagatggaatatgggctgttttagcttggctatctattcttgcctataagaacaaagacaatctgggaggtgaaaaacttgtcagtgttgaagacattgttcgccagcattggtccacatacggacggcattattacactcgatatgactacgagaatgttgatgcaggtggtgcgaaggaactgatggcctatttggttaagctgcaatcatccctttctgaagttaacaacattataaatggaatccgcccagaagtctctaagatcgtccatgctgatgaatttcagtacaaggatcctgttgatggttccatttcaaagcatcagggtataagatatctgtttgaagacgggtcccgactggttttccggctttctggaactggttctgaaggtgctactatccgtctgtacatagaacaatacgagcaggatccatctaagattggaagagattctcaagaagcacttgctccactggttgaggttgctcttaagctgtctaagatgaaagagtatacggagcgatcggctcccactgttatcacataaatgctgcagatcgtgtgattaaatattttgttgatggaccagaaatgtttcacataatttttgttgagaatcgatgaaacaatgtcagtgatatattatcagctcttatacactgtgtatcgtgaaaggttgtcttggaaaaatgtttatgcccttt

SEQ ID NO: 5258 - DNA, 2226 bp, Sciadopitys verticillata
attactttgatttacaaggtgaagcaagaaaatgacgattttctgtgtagtcaggaaggagaccacaccatacgatgggcaaaagccagggacatccggcctcaggaagaaggttaaagtctttgcgcaagagaattacttgcataatttcgttcaagcaactttcaatgcactgtcagctgagaaaataaaaggtaaaacaattgttgtgtctggggatggacgcttctatacaaaagaggctattcagataattataaaaatggcagctgcaaatggagtaaggcgcatttgggtaggccaaaatgggctgctttcaacacctgcagtatcagcagttatacgcgacagagttggggcagatggtgagaaagcatcgggagcttttatattgacggccagccataatccaggaggcccgcatgaggactttggaataaagtacaacatggaaatgggggaccagctcctgaaggaattactgacaaatatatgagaatactaagacaataaaggagtattttattcagaagattaccggatgtagacatatcaactataggcataacaagttttggcgggcctgagggaccttttgatgtggatgtctttgattctactgaagattatgttaagttgatgaagactatcttccactttgaagccatccaaaagctgcttgcatgtcccaaattcacattctgctatgatgcgcttcacggggtggctggcatatatgctaaaaggatttttgttgaggagctatctgcaaatgagagctcactaataaattgcactccaaaggaggattttggaggaggtcatccggacccaaacttaacatatgccaaggaactggttgcacgaatgggattgggtaaagagactcctgcattggatgtgccagagtttggtgctgctgctgatggtgatgcagatcgcaatatgattcttggaaagaggttttttgttactccatcagactctgttgcaatcattgcagcaaatgcagttgaagctattccatacttcagttctggtttgaaaggtgttgcaaggagcatgccaacatcagctgcacttgatgtagttgccaaaaatttgaatcttaagtttttgaggtgcctactggttggaagtttttggaaatttaatggatgctgggatgtgttctatttgtggtgaagagagttttggcactggttctgaccatattagagagaaagatggaatctgggcagttttagcatggctttcaattcttgctttcaaaaataaggataatcttgatggcggagaacttgtcactgtggaggacatagtccataaccattgggcttcttatggtcgtcactattatacgcgctacgactacgaaaatgttgacgcaggtgctgcaaaggagctcatggcttatttggttaagttgcagtcttcaattcctgcagttaacaagataatcaaggaagcgagaccagatgtttctaatgttatacatgctgacgaatttgaatataaagatcctgtagatggttctgtttccaaacaccagggtatacgctatctctttgaagatggttctcgattggtgttccgactttctggtactgggtctgaaggtgcaactattcgtctgtatattgagcaatatgaggtggattcaaccaagacaggaaaaaattcacaggaggctcttgctccactggtccaagtagctttacatctttcaaagatggaggaatttactggccgcttaagtcctactgtaatcacatgagtatgggaaatgtgataaaggtgacacgggtgtgttgaggttatctggcgaaaaagacacctggataaaattttccaataaaatttttcaagcatctgacagtgaacactagagaaattatttgatattgatatgacatattttgcaatagaaaaggtcttgtttttgccaaatctcaagaaaactcctgtgagacggtttttagcctagcagttccacctaattaaaaatggattggaagataggtgttagtattggacttttatttagatggtaaaggggctatttagactgagatttaggcaacatgttacgttgcatctgagaatgtctactcttgtcagaacaagggatttaccttaaacattattcaaaatttatacccccgaagttttcaccttgcgaccaaattaggaagtacacaaagccttactaatcctcactgtaat

SEQ ID NO: 5259 - DNA, 2343 bp, Setaria italica
gaaattttaataaaaagtgaacgggaaaaaaagaagccaggagaacgacggaatgatccctcctgtgtgctcctgctccctgccctcccccgctataataccgccacgccctcgtcgccatcgtcatcgcaccaccactccctccccgccctctcactcccgatctctcctccaccaccagcgcctcctccgccccacccctctcctcgcctcgcgcggcgaccggcggcggatcgtcggcggcccagccatgttcagtgtgacgaagaaggccaccacgcccttcgagggccagaagcccggcacctccggcctgcgcaagaaggttactgtattccagcagcctcattatctgcagaactttgtccaatcaacattcaatgcccttcctgctgaagaagttaaaggtgcgactattgttgtctctggtgatggccgctatttctcaaaagatgctgttcagatcataacaaaaatggctgctgccaatggagtgagacgtgtttgggttggacaaaacagtctcatgtctactccagctgtatctgctgtcatccgtgaaagaattggtgaagatggatcgaaggctactggtgccttcatcttaacagcaagccacaacccaggtggtcccactgaggactttgggatcaaatacaacatgggaaatggtgggcctgcccctgaatctgttaccgacaagattttctctaatacaacgacaatctctgaataccttatctccgaggaccttccagatgttgatatttctgaaatcggcgtctctagcttcagtggacctgaaggtccctttgctgtggaggtctttgactccagtgtagattacattaagttaatgaagtcaatttttgattttgaggcaataaaaaagctgctgacatctccaaaatttacattctgttatgatgccctgcatggtgttgctggagcttatgccaaacacatctttgtggaagagcttggtgctgatgaaagctcactgttgaattgtgtcccgaaggaggactttggaggtggtcatccggaccctaacctcacctatgcaaaagagttggttgaacggatgggtcttggaaagtcatcctccaatgtcgagcctcctgaatttggtgctgcagctgatggagatgctgaccgaaacatgatcctgggtaaaagattctttgtgacaccatcagactctgtcgccattatcgcggccaatgctgttcagtcaattccttactttgcttccggcctgaagggagttgccaggagcatgccaacatctgctgctcttgatgttgttgcgaagaatttaaatctcaagttctttgaggtgcctactgggtggaaattttttgggaacttgatggatgctggaatgtgctcaatctgtggtgaagagagctttggcactgggtctgaccacattcgtgagaaggatggtatttgggctgtgcttgcgtggctgtctattcttgctttcaagaacaaggacaaccttggaggaggagataagcttgtctctgttgaagatattgttcgtcagcactgggccacctatgggcgccattattacacacgctatgactatgagaacgttgatgcaggggctgctaaggagcttatggcaaatctagtcagcatgcaatcatcactatctgatgttaacaagttgatcaaggagatccgatctgatgtttccgaagtagttgcagctgacgagtttgagtataaggatcctgttgatggctctgtgtccaagcaccagggtatccgatacctctttggagatggttcacgactggtgttccgtctctctggaaccggttctgttggtgccaccatccgtgtctacatcgagcagtacgagaaggattcatccaagaccggcagggaatcatcggatgcccttgctccactggttgatgttgcactcaagctctccaagatgcaagagtacacgggccgctctgcccccaccgttatcacataaatttttgaagaacctgtgttttagaatgagttgaggcacttacaaaccttcattccggcctcgtatttgatagtttttccccctctgttgcatctcaccagtgaataaaatgtatttttattgcccatactgcagacttgccgctggcacagcatgcggtaataaatcttgttacagtgctgtaattgggagcgtgtttctcctcgtaatgtatcagatgtgttttgtttgtttgagcatgtcaaaatcttcacccacctgtgtacactcgtcactgttgttttgtggtctgcttggtgttgagcctgtgctatgaatcgtcagacgtgacaacctttccctgt

SEQ ID NO: 5260 - DNA, 1837 bp, Cedrus atlantica
agcgtaaacaggaaggaaacctctccctacgatggacaaaaaccaggaacatctggcctcaggaagaaggtcacagtcttcaagcaacagaattacttgcacaatttcgttcaagcaacttttgatgcactgtcagcagagaaagtaaaaggttccacaattgttgtctctggtgatggccgttacttttcagaagaggctattcagataataataaaaatgtcagctggaaatggagtgaggcgtgtttgggtaggccaaaatggattgctttcaacaccagcagtttcagcagttatacgcaatagaattggagcagatggaggaaaggcatcgggatcttttatattgacggctagccataatgcaggaggtccaaatgaggactttggaataaagtacaacatggaaaatggcggaccagctcctgaagggattactgacaagatctatgagaatactaagacaataaaagagtattttactgcagaagatctcccaaatgtagacatatcaaccataggcataacaagttttggtggccctgagggacctttcgatgtggatgtctttgattccactgaagattatgttaaattgatgaagactatatttgacttcgaagctatccaaaagctgctcacatgccccaaattcacattctgctatgatgcacttcatggagtggctgggatatatgccaaaaagatttttgtggaggagctgtctgccagtgagagttcattaataaattgcattccaaaggatgattttggaggaggtcatccagacccaaatttaacatatgccaaggaattggtaacacggatgggattgggtaaagaagctcctggttcggaagtgccagagtttggtgctgctgctgatggtgatgcagatcgtaatatgattcttggcaagagattttttgtgactccttcagactctgttgccatcatagcagcaaatgcagttgaagccattccatacttcagctctggattgaaaggtgttgcaaggagtatgccaacatcggctgcactggatgtagttgcaaaaaatctgaatcttaggttttttgaggtgcccactggctggaagtttttggaaatttaatggatgctggaatgtgttctatttgtggtgaagaaagttttggcactggttctgaccatattcgagaaaaggatggagtctgggcagttttagcatggttttcaattctagcttacaaaaataaggataacctcaatggtgggaagctagtcactgtggaggacatagtccgtagccattgggcttcttatggtcgccactattatacacgttatgactatgaaaatgttgatgcaggtgctgcaaaggagctcatggcacatttgattaaactgcagtcttctctcccagaagttaacaagttaattaaagaagtgagaccagatgtttctgctgttgtgcatgctgatgaatttgaatacaaagatcctgttgatggttctgtttccaaacaccagggcgtacgctatctttttgaagatggatctcgattggtgttccggctttctggtactgggtctgtaggtgcaaccattcggttgtatattgagcaatatgaagtggattccaccaagattggaagagattcacaagaggctcttgctcccctggtggaagtagctctacaactttcaaagatggaagaatttactggaccgctcgagtcctactgtaatcacatggagttataggaatattagtgtaagtgacatgtagaagttggcttatctttttaggaatggactgatgatcaagcttctagtaatttctacatctgatt

SEQ ID NO: 5261 - DNA, 1187 bp, Sarracenia psittacina
aagaggattttggaggagggcacccagatcctaatctgacctatgcaaaggagttagttgcacgtatggggttgggtaagtctagccctcaacatgaaccaccagaatttggagctgccgctgatggtgatgccgaccgtaacatgattcttggtaaaaggttttttgttactccatcggattcagttgctattattgctgcaaatgctgttcaagccataccttacttttcaggtggtctaaagggagttgccaggagcatgcctacatctgctgctctagatgttgttgctaagcatttaatttgaaattttttgaggtgcctactggctggaattctttggtaatttaatggatgctgggttgtgttcagtttgtggtgaagaaagtttggaactggctcagatcatattcgtgagaaagatggaatctgggctgtattggcctggctttcaattcttgcttatagaaacaaggataacctcggtgggggaaagcttgagagtgttgaagacattgtccgtaagcattggtctacctatggtcgccactactatactcgatatgattatgagaatgttgatgcaggtgcagcaaaagacctgatggcacatttggtaaacctacaatctgatcttactgaagtcaatagtattgtaaagggcgcgagttcagatgtctcaaaagttgtccatggtgatgagttcgaatacaaagatccggttgatggttccatctcaaagcatcagggtattcgatatctgtttgaagatgggtcacgtttggttttccgcctctctggaactggctcggaaggtgcaaccattcgtctttacatcgaacaatacgagaaggatccatcaaaaactgggagagattctcaagatgcacttgctcctctggtggaggttgctctcaagctgtctaagatagaggagttcaccggccgatctgcccctacagttattacatagatccatattgctacacacctccatgactgtatgtctttcttggaaacaatactaatagtagtatttggtcatgccaggccttgtgccatcaactgctatattaaagttgtcactatatgtttttgcctttatagcatgttctttgagaagatgtgggacttgaaatgatgcttggtaagcagtttttgttcagaaatgtgtgaatgttggatc

SEQ ID NO: 5262 - DNA, 2349 bp, Setaria italica
aaaagggccacgccggaaggaaattttaataaaaagtgaacgggaaaaaaaagaagccaggagaacgacggaatgatccctcctgtgtgctcctgctccctgccctcccccgctataataccgccacgccctcgtcgccatcgtcatcgcaccaccactccctccccgccctctcactcccgatctctcctccaccaccagcgcctcctccgccccacccctctcctcgcctcgcgcggcgaccggcggcggatcgtcggcggcccagccatgttcagtgtgacgaagaaggccaccacgcccttcgagggccagaagcccggcacctccggcctgcgcaagaaggttactgtattccagcagcctcattatctgcagaactttgtccaatcaacattcaatgcccttcctgctaaagaagttaaaggtgcgactattgttgtctctggtgatggccgctatttctcaaaagatgctgttcagatcataacaaaaatggctgctgccaatggagtgagacgtgtttgggttggacaaaacagtctcatgtctactccagctgtatctgctgtcatccgtgaaagaattggtgaagatggatcgaaggctactggtgccttcatcttaacagcaagccacaacccaggtggtcccactgaggacttcgggatcaaatacaacatgggaaatggtgggcctgcccctgaatctgttaccgacaagattttctctaatacaacgacaatctctgaataccttatctccgaggaccttccagatgttgatatttctgaaatcggcgtctctagcttcagtggacctgaaggtccctttgatgtggaggtctttgactccagtgtagattacattaagttaatgaagtcaatttttgattttgaggcaataaaaaagctgctgacatctccaaaatttacattctgttatgatgccctgcatggtgttgctggagcttatgccaaacacatctttgtggaagagcttggtgctgatgaaagctcactgttgaattgtgtcccgaaggaggactttggaggtggtcatccggaccctaacctcacctatgcaaaagagttggttgaacggatgggtcttggaaagtcatcctccaatgtcgagcctcctgaatttggtgctgcagctgatggagatgctgaccgaaacatgatcctgggtaaaagattctttgcagactctgtcgccattatcgcggccaatgctgttcagtcaattccttactttgcttccggcctgaagggagttgccaggagcatgccaacatctgctgctcttgatgttgttgcgaagaatttaaatctcaagttctttgaggtgcctactgggtggaaattttttgggaacttgatggatgctggaatgtgctcaatctgtggtgaagagagctttggcactgggtctgaccacattcgtgagaaggatggtatttgggctgtgcttgcgtggctgtctattcttgctttcaagaacaaggacaaccttggaggaggagataagcttgtctctgttgaagatattgttcgtcagcactgggccacctatgggcgccattattacacacgctatgactatgagaacgttgatgcaggggctgctaaggagcttatggcaaatctagtcagcatgcaatcatcactatctgatgttaacaagttgatcaaggagatccgatctgatgtttccgaagtagttgcagctgacgagtttgagtatcaggatcctgttgatggctctgtgtccaagcaccagggtatccgatacctctttggagatggttcacgactggtgttccgtctctctggaaccggttctgttggtgccaccatccgtgtctacatcgagcagtacgagaaggattcgtccaagaccggcagggaatcatcggatgcccttgctccactggttgatgttgcactcaagctctccaagatgcaagagtacactggccgctctgcccccaccgttatcacataaatttttgaagaacctgtgttttagaatgagttgaggcacttacaaaccttcattccggcctcgtatttgatagtttttccccctctgttgcatctcaccagtgaataaaatgtatttttattgcccatactgcagacttgccgctggcacagcatgcggtaataaatcttgttacagtgctgtaattgggagcgtgtttctcctcgtaatatatcagatgtgttttgtttgtttgagcatgtcaaaatcttcacccacctgtgtacactcgtcactgttgttttgtggtctgcttggtgttgagcctgtgctatgaatcgtcagacgtgacaacctttc

SEQ ID NO: 5263 - DNA, 1820 bp, Utricularia gibba
ccttgttgtctctggtgatgggcgttactactcaaaggatgcaatccagatcatcattaaaatggctgctgcaaatggagttagacgggtgtgggttggtcagaacggtttgctgtcaactcctgctgtctcagctgtgatacgtgagagagtaggagcagacggatctagggcgaatggagcatttattctcacggcgagccacaatcctggaggaccaactgaggatttcggaattaagtacaatatgggaaacggaggacctgcaccagaaggaattactgataagatctacagaaacacaactaccatcaaggaatacttaattgcagaaggatttccggatgtagatatttctgcagttggagtcactagttttcgtggacccgagggaccatttgatgttgatgtttttgattcagcaaatgattatgtcaatttgatgaagtctatctttgatttcgactccattcagaagttactctcatcccaaaattttactttctgttatgatgcccttcatggagttgctggagcttatgctaaacgcatattcgtagaggagctaggtactaaagaaagctctctactgaactgtgtgcccaaggaagactttggtggaggccatccagaccccaacctcacatatgccaaagaactagttgctcgtatgggtttaggtaaggaaagccctgaacaggagcctcctgaattcggtgctgctgctgatggagatgctgaccgtaatatgattcttggaaaaaggttttttgtcacaccttctgattctgttgctataatagctgcgaatgcggtccagtcaataccatacttttctggtggtcttaaaggagtcgcaaggagcatgccgacatctgctgcccttgatgtggtagctaagaacctaaacctaaaattctttgaggttcccactggttggaaattctttggcaacctgatggacgcaggaatgtgttctatttgtggtgaagaaagctttggaactgggtctgaccacatacgtgagaaggatggtatatgggctgtattggcatggttatccattcttgcatacaagaacaaagacaacttggtgggagagaagaagcttgtgagtgtcgaggacatagtttttgatcactgggctaagtatggacgtcattattacacccgatatgattatgaaaatgtcgatgctactgctgccaaggaactgatggcctctttagtgaagcttcaatctgacctcgttgaacttaacaatatcgtgaaaggactcgtctcaggtgtctccaatattgtccatgctgatgaatttgagtataaagatccagtggatggctctatttcaagccatcaaggcattagatacctcttcgaagatggctcccgactggttttccgactttctggaactggatctgagggagctactattcgcctgtacatcgaacaatacgagaaagacccatccaagaccaagagagactctcaagacgccctcgctcctctggtcgaagttgctctgaagctatccaagatgcaagacttcaccggccgatcggctccaacggttattacataaatcctggccacagtgcttgcttgaagctgttttcatgcactaataagagacggtgaagtttgttccaacttcactaaaaacttcacttgctttctgtcgagagttgatggaagtccatgatgatgtgtattgtggacgtacaagaagatgctgatacatctgtttcttggaataaaccaccttgctgttgtgaaatgaagctgctttagttgagggaacaaaaaaaaaaaaaaaa

SEQ ID NO: 5264 - DNA, 961 bp, Solanum melongena
ctgccaatgctgtacaagctattccttatttttctggaggtttgaaaggtgttgccaggagtatgcccacatctgctgctcttgatgtagttgctaaacagctgaacttgaaattttttgaggtacccactggttggaaattttttggtaacttgatggatgctggaatgtgctcaatttgcggagaagaaagttttggaactggctcagaccatattcgagagaaagatggaatatgggctgttttggcttggttatctatcctcgcctataagaacaaggacaaccttggggaaggtaaccttgtgtctgttgaagatattgttcgccaacactgggcaacctatggacgtcactattacactcgatatgactatgagaatgtcagtgctgatggtgcaaaggagcttatggctcatttggtgaagctgcaatcttccattgatgaagttaacaagtttataaagggaatccgttcagatgtttcaaatgtcgtgcatgctgatgaatttgagtacaaggacccagttgatggttcggtctcaaaacatcagggtataagatatctatttgaagacggatcacgattggtgtaccgtctttctggaactggctcagagggtgcgacgatccgtctctacattgaacagtatgagaatgattcatccaagactgggagagattctcaggaagcacttgctgctctggtggaggttgctctgaaactatcgaaaatgcaggaatacactggtcgttctgccccaactgttgttacataaacttattgtgtattatatacttgctagaactaaataattaaataagtgtactgtccgtactggatgaacaccagagaatatgcagagatgatatcaaagttttgaatttgcagtcttttgtgatggactcgtttccggagttgaagtgtcttcctcgaatatataaatgcggcaatttctcg

SEQ ID NO: 5265 - DNA, 1907 bp, Silene vulgaris
aagatgtcagcagctaatggagcgaaaagcatttgggttggtcagaatggtttgctttcaacacctgctgtatcagcagttatacgtgaaagagttgggaaagatggctcaaaggcgtctggatctttcattttaactgcaagtcacaatccaggaggccctactgaggatttcggaattaaatacaacatggaaaatggagggccagctccggagggagtaactgataagatttatgagaacaccactactataaaggagtacttgattgctgaagatgtgccagatgttgacatatcgaaattgggtacatctagcttcacagggcctgagggagagtttgaagttgaagtatttgatgcaacagaaacatatgtacagttgatgaagtctatctttgatttcgaggctatcaaaaagctgcttgcatgcccaaaattctcattctgttatgattctctccatggagttgctggtgtctatgctacacggatctttgtaaaggagcttggcgccagtgaaagttctctgttgaactgcacaccaaaggaagattttggtggtgggcatcctgatcccaacttgacctacgctaaggagctggttcagcgtatgggtttgggtaaatcaagctcgccaggtgaaccaccggaatttggtgcagctgctgatggcgatgctgatcgtaatatgatcctgggtaaaaggtttttcgtgacaccgtcagattcggttgctattattgcagctaatgctgtagaagcaataccatatttctctggtggtctgaagggagttgctaggagtatgcctacttcagctgctttggatgtggtagcaaaagctcttaatctagagttctttgaggtgcccactggctggaaattttttggaaatttaatggatgctggaaaatgttcagtatgtggtgaagagagttttggaactggctctgatcatgtacgtgaaaaggatggtatctgggctgttttggcttggctatcaatcctagcttataggaacaaagacaaacttaatggaggagagcttgtgactgttgaagacatagttcgtcaacattgggctaaatatggtcgacactactatacaagatacgattatgagaatgttgattctgggggagcaaaagaactcatggcacatctggtcaatctgcaatcaaatctccctgaagttaacaagattgtgaagtctgtagattcaactgtggcaaatgtagttgatgccgatgaattcgagtataaagatccagttgatggttcagtgtcaaagcaccagggtatccgctatctgtttgcagatgggtcacgattggtattccgtctttctggaactggctctgaaggagctaccgttcgtgtatacattgagcaatatgaaaatgactcctccaaaactagcagagactctcaggatgcactcaaacctcttgttaacgttgctctcaagctctctaagatgcaggagttcacaggcaggtctgagcccactgtcattacttaagttgcggtcataaaaatttgacgcagcatccattagttttgtgatatcttcatgtggtgaggcaatatggtttcgaatttgtctatttctcaaagacacgcttgtgacttgcgagagagcatgtacttcattttacatttttttgtttctgggaagccgaataggctgtacttctaaagagaacttcactagtcgagttttggcgtctgtgttgagcactatttttgcaggatgacctcgataaaacagctcctgtagtgtcaatagtgaccttcctggttaatggaagtcgtatttcttagtaattgtttgtctattcggccggatgttgtttacctgtttccatgaatttgttatcttttgaaagctctctgaccagttcc

SEQ ID NO: 5266 - DNA, 916 bp, Elaeis guineensis
  misc_feature (812)..(812): n is a, c, g, or t
  misc_feature (831)..(831): n is a, c, g, or t
  misc_feature (882)..(882): n is a, c, g, or t
caaaagaattggttactaggatgggattgggtaaatcaagcccacaagatgagccaccagagtttggtgccgctgctgatggtgatgcagatcgtaacatgatccttggtaaaagattttttgtgactccatcagattctgttgctatcattgctgccaatgcagttgaagctattccttattttgcttcgggactaaagggtgttgcaaggagcatgccgacatcagctgcccttgatgttgtggcaaagaatctaggtctaaagttttttgaggtacccactggctggaaattttttgggaacttgatggatgctggactgtgttcaatttgtggtgaagaaagctttgggacgggttcagatcatattcgagaaaaggatggaatctgggcagtcttggcttggctttctattcttgcttacaaaaacaagaacaactttaatggtgaaaagctggttactgtggaagacattgttgtccagcactgggccacttacggtcgtcattattatacacgatatgactatgagaatgttgatgcagctgcagcgaaggaacttatggcatacttggtcaatctgcagtcatctctttcagatgttaacaagattgtaaaagaaataagaacagatgtctcaaatgttgtccaagctgatgaatttgaatacaaggatcctgttgatggttcgatctcaaagcaccaaggcatccgttatctctttgaggatggatcacgattggttttccgcctctctggaactggctcggaaggagcaactattcgactatacattgagcagtatgagaangactcttcaagacacggangaattcacaagaagcacttgctccacttgtggatgtggcactgaaactttnccagatgcaagaatttcaggcaggtctgctcccc

SEQ ID NO: 5267 - DNA, 965 bp, Capsicum annuum
gcacgagggtacaagctattccttatttttctggaggtttaaaaggagttgccaggagtatgcccacatctgctgctcttgatgtagttgctaaacatctgaacttaaaattttttgaggtacccactggttggaaattttttggtaacttgatggatgctggaatgtgttcaatttgtggagaggaaagttttggaactggctcagaccatattcgcgagaaagatggaatatgggctgtcttggcttggttatctatccttgcctataagaacaaggacaaccttggggaaggtaaccttgtgactgttgaagatatcattcgccaacactgggtaacctatggacgtcactattacactcgatatgactacgagaacgtcaatgctgatggtgctaaggagcttatggctcatttggtgaagctgcaatcttccattgatgaagttaacaaggttataaaggaaatccgttcagatgtttcaaatgtcgtgcatgctgatgaatttgagtacaaggaccccattgatggttcggtctcaaagcatcagggtataaggtatctatttgaagatggatcacgattggtgttccgtctctctggaactggctcagagggtgctactatccgtctctacattgagcagtacgagaaggattcatccaagattggaagagattcgcaggaagcacttgctccactggtggaggttgctcttaacctatcgaaaatgcaggaatacactggccgttctgccccaactgttattacataaactcgttgtgcgtgcttttgtatgttatgaactaaataattgaataagcatactgtccttgctggacgaacaccagagaatatgcaagatgatgtcaagttttgagaactatgtctggagttgaagcatcttgttcaaatatattagtgcggcaatttatagtttcttaatcgttcatcttgaaaaaaa

SEQ ID NO: 5268 - DNA, 2334 bp, Physcomitrella patens
aacactcgtcgctgaatcggctgccaacttttcttcttctcgccttttgacacattgatctctgaaccgatcggaatgcagttgtggggttaagtagtctctgctctcgacccagaccgttcgggtccacacttagactatccttttgtaactccttgtcaccggtggattgtaaagtactctgctcgcgcgcactctggttttgcctatcttcgtttcacagcacccgcgacgtcgtgcaaggtcttgtaagatgggtctttttaaggtggtggagcaggaaactaagccgatcgatggccagaagcctggcacatctggtctgcgcaagaaggtgacagtattcaagcaagagcattatcttgccaactttgttcaggctaccttcgatgctcttccttcggagaaagtgaaaggctccaacattgttgtatctggagatggccgttactggtcgacggaagctattcagatcgtcatcaagatcgccgctgctaatggcgtaaagagagtgtgggtcggacagaacacacttttatccacccccgctgtgtcttcaatcatccgaaaccgagttaacagtcagggtgaaaaggcttacggggccttcattctgactgccagccacaaccctggtggtcccgacgaggattttggaattaagtacaactgtgaaaacggaggtccagctcctgaaagcttgaccaacaagatttatgaaaataccaagaagattacagcttatcgaactgcggatggcatcccaaatgttgatgtgacccaaattggtgttaccagctttgagggacccaatggcacctttgacgtggaagtgttcgattcaactgaggattatgttaaattgatgaagtctatttttgacttcacagcaatcaaggatttgatcacaaaccctaagtttaccttctgttatgatgcacttcatggtgttgctggtgtgtacgccaaaaagatcttcttggaagaattgggagcaaaggaaagctcattgttaaactgcgagccgaaggaggacttcggtggaggtcatcctgacccaaacctaacttatgctaaggaacttgtgcaagtcatgggattgggcaagacccaaccagatgaggttccggaattcggtgccgcggctgacggtgatgctgatcggaacatgattcttggcaagaggttttttgtaaccccgtcagactctgtggctattattgcagccaatgctgttggagccatcccttatttcagtggtggtctgaagggagttgccaggagtatgccaacgtccgctgcgcttgatgtggtggctaagaagttgaaccttaagtttttcgaggtaccaacagggtggaagttctttggtaacctcatggatgccggcatgtgctctgtgtgcggtgaagagagttttggaacaggttctgatcacataagagagaaggatggaatctgggctgttttggcatggctctccattctggctcacaggaacaagcaagctggtggtgataagcttgtgacagtggaagagattgttactgaacactggaacacctatggtcgacattattacacgcgttacgattatgagaacgtggattccgatgctgcaaaaaaacttatggagaatcttgttgagctccaatcaaatctggatgatgtgaacagtatgatcaagaagatcagaccagatgttgctgaggttcaagaagcagacgagtttgagtacaaggacccagttgaccagtccgtgtcttgtcatcagggtatccgttatcttttcaaggatggttctcggctggtattccgtctctcaggaacaggttcagtcggcgctacaattcgtctttacattgagcagtacgaagctgatcctaccaagaccttcaagccctcagctgaggctctggcacctcttgtggaggtagctttgaagctgtcaaagatggaggaatttacgggtcgctcagagcctaccgttatcacttagacagtgtactaatggcaaacagtggaaagcgaggcagaacatggtttatgcaacacgcagcatggttggttgtgtaattgcagtagtagtggaaggatcttgggatctacattcgtattttgggaggagttaaatatgaacctagttgtttccacagacgcactttgccgaaacagtgaagttacagtcaaatgtgcagaaccgatttctcaattttgtattttttgaaataaaataccttgatgtaaaaacgcatggcatcgtgtgattgtttcatgttgatgcttataaaatgtgttatctggagctacctaagagcacttattcactcctgt

SEQ ID NO: 5269 - DNA, 2393 bp, Ceratodon purpureus
gcagacgctatgggatggacgccgatgagcagcggtgaagacagagatcaagaggagcagcgagagagagaaagagagagagatctgtgagagagagagagatttgagagagggcgcaaccctagcctggatttgtggaccactgggccggtgaccctaccaccacgcgtcgcagcaaccgagctcacctttctcgcgtcgcgaatcggctgcgtacataaccactgcatcgatcggcatgccttgagttctgcagccggctcttaacgcatccccagatccatcaaggccactctttgactatccttctctgccctgccggattgcaaactgtgcatccccctgtgtgcttgcaagagcttgaaagatggtgtttcaagttgtgaagcaggagactaagccgatcgatggccagaagcccggtacttctggtttgcgaaagaaggtgacggtgttcaagcaagaccactatcttgccaactttgtgcagtccaccttcgatgctcttccttctgagaaagtgaaaggatccaacattgttgtgtctggtgatggccgttattggtcgacggaagctattcagattatcattaaaatcgcagctgcgaatggcgtgaaaagggtttgggttggccagaatactcttctttccactcctgctgtgtctgcaatcatccgagaccgagttaacagcaacggtgaaaaggcgtacggggcattcatcctgactgccagccacaaccctggtggtcccgatgaggactttggaatcaagtacaattgcgaaaacggaggcccagctcctgaaagcttgactgacaagatctacagcaacaccaaggctatctcagcttattacactgtagatggcatcccagatgttgacgtcaccaagattggtacaactagctttgagggacctgatggcactttcgaggtggaagtgttcgattcaaccgaggattatgtgaagttgatgaagaccattttcgacttcacggcaatcaaggacttgctcacaaaccccaagttcactttctgctatgatgcacttaatggtgttgctggtgtgtacgccaagagaatctttttggaggagctaggagcacaggaaagctccttgctgaattgcgtccccaaggaagattttggtggaggccaccctgaccccaacctgacctatgccaaggagcttgtgcaagttatgggactgggcaagaagccgcccaccaatgatgttccagaatttggtgccgctgctgatggtgatgctgatcggaacatgattctgggcaagaggttctttgtgaccccatcagactctgtagccatcatcgcagctaacgctgttggggctattccgtatttcaatggtggtcttaaaggagtggccaggagcatgccgacatcggctgccttggatgttgtggctcaaaagttgaatctgaagttcttcgaggtaccaaccggatggaaatttttcggtaatctcatggatgctggcatgtgctctgtatgtggtgaagagagttttggcactggttccgaccacattagagagaaggatggaatttgggctgttttggcttggctctctatcttggcccacaggaacaagttggctggtggtgacaagcttgtgacagtcgaagagattgttactgagcactggaacacttacggtcgccattattacacacgttacgactacgagaatgtggatgctgaagctgccaagaagctcatggctcatcttgttgacctccagtcgaagttgggtgatgtgaacaatatgatcaaggagattagacctgatgttgctgaggttaaagaagctgacgagtttgagtacaaggacccagttgacaactccgtgtccagccaccagggtatccgttacctcttcaaggatggttctcggctggtgttccgtctctccggaactggttcagttggagccacaattcgtctgtacattgagcagtacgagtcggaccccaccaagacattcaagccctctgctgaagctttggcacctcttgtggaggttgcattgaagctatcgaagatcgaagagttcacaggccgctcagagccaactgtgatcacttagacacgacataatggcaagcagtggaaagcgaggcagaaaatggcatatgcaacagtgctgactaaggttttagtttgaagagcggttgcttggtatcgagtataggctttttgggggtagtgcaaccgttcgactgtactaatctctctgttctccagatgcatattgccggcatagtgctagagttgtagccaactgtgcaggatttattttcaattttgtatttacttgttaatctcacaaatgttgcagcacggactcaacaacttatgactcgaat

SEQ ID NO: 5270 - DNA, 1064 bp, Malus domestica
gagtttggtgctgctgctgatggtgatgcagatcgtaacatggtcctcggtaaaaggttttttgttaccccttcggattctgtagccatcattgctgcaaatgcagttgaagccataccttacttcaaaactggtctgaagggagttgccaggagcatgcctacctctgctgcccttgatgttgtagccaaacatctaaatttaaaattctttgaggtacccactggctggaaatttttcggtaacttaatggatgctggtttatgctcagtttgtggggaagaaagttttggaacaggttccgaccatatccgtgagaaagatggtatctgggcagttttagcttggttatccatacttgcttataaaaataaggaaaatcttggcggggagaagcttgtcagtgttgaggacatagttcgtaagcattgggctacctttggtcgccattattatactcgatacgactatgagaatgtggatgcaggtaaagcaaaggaactgatggcttctttggtgaaattgcaatctgatctttctgaagtcaacaagattgtgaagggaatacactctgatgtttccaatgttgtcaacgccgatgaatttgagtacaaggatcctgttgacggttccatctcaaaacaccagggcatccggtacttgtttgaggacggatcacgattggttttccgcctctcaggaaccggctcagaaggtgccacaatccgactctacattgagcaatatgagaaggatccatcgaaaattggcagagaatcttcagaagcgcttggtcccctcgtggaggttgctcttaagctttcgaagatgcaagagttcaccggacgatctgcccctactgttatcacatagatccacatctctaaaatcacataaaaaaggaccggcttcttatcttcaaatatattagtaataagagaacttttttttgtaattttgacgggtctgttggactctcatgtctacaatttttgtttgtccaaaataatgcgaattttgaatggtactttgcaatctcttgtccaaatctcgtgtcctttaaa

SEQ ID NO: 5271 - DNA, 907 bp, Petunia hybrida
aatttggggcggctgctgatggagatgcagatcgtaacatgatcttgggaaaaagattctttgtgactccttctgattctgttgctatcattgctgccaatgctgtacaagctattccttatttttctggaggtttgaaaggagttgccaggagtatgcccacatctgctgctcttgatgtagttgctaagcatctgaacttgaaattttttgaggtacccactggttggaaattttttggtaacttgatggatgctggaatgtgttcagtttgtggagaagaaagttttggaactgggtcagaccatattcgagagaaagacggcatatgggctgttttggcttggttatctatccttgcctataagaataaggacaaccttgagggaggtaaccttgtgactgttgaagatattgttcgccaacactggacaacctatggccgtcactattacactcgatatgactatgagaatgttgatgctggtggtgctaaggagcttatgtctcatttggtgaagctgcaatcttcccttgatgaagttaacaaaattgtaaagggagtccgttcagatgtttcaaacgttgttcatgctgatgaatttgagtacaaggacccagttgatggttcagtctcaaagcatcagggtatcagatatctgtttgaagatggatcacgattgattttccgtctctctggaactggctcagagggtgctactatacgtctctacattgagcagtatgagaaggattcatccaagattggaagagattctcaggaagcacttgctcccctggtggaggttgctcttaaactatcaaaaatgcaggaatacactggtcgctctgccccaactgttatcacataaacttattcgtgtatggtgtactcgcatttgtacct

SEQ ID NO: 5272 - DNA, 2519 bp, Physcomitrella patens
attgtcttgccattgatcgatcagcggatcgctacatccatcgtcgtgcattagatcttctggcctgctctagagccagatcgatcgaggccacacttagactatccctctccctgctaccagtggggttgaaaagtgcactctcttgctgatcagcttgttttctctggttgtgacaccaacgacgcatttctagatccgaatacttagcttgaaggatggtgctctttaaagttgtgaagcaggagactaaggcgatcgatggccaaaagcctggtacctctggtttgcgtaagaaggtgacagtgtttaagcaggaccattaccttgccaactttgtgcaagccaccttcgatgcccttccttctgacaaagtgaaaggttccaacatagtcgtgtctggtgatggccgttactggtcaacggaagctatccagatcatcatcaaaattgccgcagctaatggcgtaaagagggtctgggtggggcagaacactcttctttccacccctgccgtgtctgcaatcatccgagagcgagtgaatagtcatggtgaaaaggcgtacggtgcattcattctgaccgccagccacaaccccggtggtcccgacgaggactttggaatcaagtacaattgtgaaaacggaggcccagctcctgaaagcttgaccaataaaatctacgaaaacaccaagaaaatcacggcatatcataccgcagatggcatcccaaacgttgacgtcaccaagattggtgttaccagttttgagggacctgatggcacctttgatgtagaggtgttcgactcaactgaggactatgtgaagttgatgaagactattttcgacttcacagcgatcaaggatttgattaccaaccccaagttcagcttctgttatgatgcactgcatggcgttgctggtgtgtatgctaagaagattttcttggaggaattgggagcgaaggaaagctcactgttgaattgcgaacccaaggaagacttcggtggaggtcaccctgatcccaatttgacctacgctaaggaactcgtgcaagttatgggattgggcaagactcaacctgacgagattccggaattcggtgccgctgctgatggtgatgctgaccgaaacatgattttgggcaagaagttctttgtgactccatcagactctgtagctatcattgctgctaatgctgttggggctatcccctatttcagtggtggtctgaaaggagttgcaaggagtatgcctacttcagctgccctggatgtggtggctaagaagttgaacctggagtttttcgaggtaccaacaggatggaagttctttggtaacctcatggacgcaggcatgtgctcggtgtgcggtgaagagagttttggaacaggttctgaccacattagagagaaggatggaatttgggccgttttggcatggctctctatccttgctcacaggaacaagcaggctggtggtgacaagcttgtgacagtggaagagattgtcactgaacactggaacacttatggtcgtcattattatacacgttacgactatgagaatgtggactccgatgatgcaaagaaactcatggctcatcttgttgatctccaatcaaagcttggcgatgtgaacaacttgatcaaggagattagacctgatgttgccgaggttcaagaagctgacgagtttgagtataaggatccagttgaccagtccatatccagccaccagggtatccgctacctgttcaaggatggttctcggctggtgttccgtctctctggaactggttcagtgggcgctacgattcgtctgtacattgagcaatacgaagctgatcctgccaagatattcgaaccctctgccgaggcgttggcacctcttgtggaggtagctttaaagctttcgaaaatggaggagttcacaggccgctcggagcctacagtcatcacttaaatattatgctaatggcaagcagaggaaagcgaggcagaaaatggcttatgcagctggcaacatcttgcattgttcaccagcagcatcagcctgaattcaactacattcatatttggaaggagtttagctatggccaacagtttagatgtttacatggatatgtatggccggaaagtgcaaaaattgtagccaactgtgccgaaccgatttcttaacgttgtatttatttttaatttaagaacgtgatcacagtaatgcgctccagtattacttggcattttctatgttgacatttactcgagtgtagcaagtagcgaccaacagaaaatcatttctttgtcacaggacagttaatcttgattcctttcgaaaaccacttacattcaaaaggatatccgaactttttttcttatatggtgattaactaggacctcatcactgatctcaaaattagcatattttagaacaaacgtacaattgcctatcgtagaagttagtaaatgtacatcctgtgaagaattctcaactatatccgcattttgatcatttcatgca

SEQ ID NO: 5273 - DNA, 951 bp, Ocimum basilicum
ttctgatggagatgctgaccgcaatcttattcttgggaaaaggttttttgttactccttctgattctgttgccatcatagctgcaaatgccgtgcaagcaataccctacttttctggtggtctaaaaggagttgccaggaggatgcccacttcagctgctcttgatgtcgtagctaagcacttgaatttgaagttctttgaggttccaactggatggaaattctttggcaatctgatggatgctggaatgtgttcaatttgtggggaagaaagttttggaactggctcagaccacattcgtgagaaagatggtatatgggctgttttggcttggctatctattcttgcggataagaacaaagacaatctcgggggtgagaagtttgtcacggttgaagacattgtacgccagcattggtctacatatgggcgtcattattacactcgatacgattatgagaatgttgattccggtggtgctaaggacttgatggcttatttggtcaagctgcaatccaacctaactgaagtcaacaacattataaagggaatccgatcagatgtctccaatgtggtaaatgctgatgaatttgaatacaaggatcctgttgatggttccatttcaaagcaccagggcatcagatatctatttgaagatggatctcgattggtattccgactatctggaactggttctgaaggtgctactatccgtctctacatagagcagtacgagaaggacccatccaagactgggagagagtctcacgaggcacttgctcctctcgttgaggttggccttaagctctctaagatgcaagaattcactggccgatctgctcccactgttattacatagacgatctgcacacaggagtgagtttgtatcgcattgaagtataaaaacagttataattttgttgagaaaaataaacgatgcaataaatttac

SEQ ID NO: 5274 - DNA, 1160 bp, Cajanus cajan
ggtgcggctgctgatggtgatgcagatcgcaacatgatacttggtaaaaggttttttgtcactccttcagattccgtggccattattgctgcaaatgctgttgaatctataccatacttctctgctggtttaaagggtgttgccaggagcatgccaacctcggctgccctggatgttgtggccaaacatctgaatttgaagttttttgaggtccccaccggttggaagttctttggtaatttaatggatgctggattgtgttcagtctgtggtgaagaaagtttcgggactggttctgaccatatccgtgaaaaagatggaatctgggcagttttggcctggctgtctatacttgcgtataaaaataaagatacacttgaagacaagcttgttaccgttgaagatattgttcgccagcattgggctacttatgggcgccactattatacacgatatgactacgagaatgtggatgcaggtgcagcaaaggaattgatgggatatctggtcaagctgcagtcctcactttcagaagtcaatgagattgtgaagggggtaaggtcagatgtttctaatgttgtaaacgctgatgaatttgaatacaaagatcccgtcgatggttccgtttcatcacaccagggaatccgatatttgtttgaggacggatcacgattgattttccgcctctctggaactggatcagaaggtgcaactattagactgtacattgagcaatatgagaaagatccatcaaagattgggagactttcaaatgaagcacttgctcctcttgtggaagttgcattgaaactttcaaagatggaggaattcactggtcgatccgctccaacagtcattacatgaacgcatacaagtggaaggcgataaaatctgaagcttcatcgagtcatttcttgtttgtccagtttctatccagtatcttagggatgggcgacctgtactgttgtttgcagcctttgtttgctatgggcacttgagtggagtttaaattgctttatttctaaattttgatgtgctgaataatttgcaactgccgaatgcagatcataagtcttaatgtaatgattcctcttgtatttattgggggcgctctttccttccttcttttggtcttgccgtgaaagttgacgagctgaaca

SEQ ID NO: 5275 - DNA, 1530 bp, Flaveria ramosissima
ccctttctgctgagaaagttaaaggttctacacttgttgtttcgggtgatggacgttactactcaaaggatgcaatccagattataattaaaatggcagctgcaaatggtgtaagacgtgtttgggttggtcaaaatggacttctatccacacctgctgtatcagcagttgtacgtgaacgagttggcgctgatggttccaaagcaaatggggcatttattttgaccgctagtcacaacccaggtggtcccaatgaggattttggaattaagtacaatatggaaaatggtgggccagcacctgaaggaattactgataaaatctatgagaacactaaaacaataaaggagtattttattgcagaaggccttcctgatgtggatatctcagcaattgggatttcaagcttttcaggtcctgatggtcaatttgacgttgatgtttttgactcatcaagtgactatgtgaaattgatgaaatcgatctttgatttccagtccatcaaaaagctaattgcatctccacaatttagttttgttatgatgctcttcatggagttgctggagcttatgctaaacgtatatttgtcgaagagcttggtgcaaaagagagctcattattgaattgtgttcccaaggaagacttcggtggcggacatcctgatcccaatcttacatatgcaaaagagttggtagcaagaatgggattgggtaaaaaccctgacagtaacccaccagaattcggtgctgctgctgatggtgatgctgacaggaacatgatccttggtaaaaggttttttgttacaccatcagattctgttgctatcattgctgccaatgcagtccaatccataccctacttttcatctgggttaaagggtgttgccaggagcatgccaacatctgctgctcttgacgtcgtagccaaaagtttgaacttaaagttttttgaggtaccgaccggctggaaattctttggtaacttgatggatgctggattatgttcagtttgtggtgaagaaagttttggaaccggatcggaccatatccgtgaaaaggacggaatctgggctgtcttggcttggttatccattcttgctcataagaacaaggacaaccttaatggtgggaaacttgttacagtcgaagacatcgtgacactgcactgggctacctttggacgtcactattatactcgttatgattatgagaatgtcgatgcaggtgctgcaaaagaactaatggctcacttggtcaagttgcaatcttctattagtgatgttaacaaaaccataaaggaaacacgatctgatgtggcaaatgttgcaagtgctgatgaatttgaatacaaagatcctgttgatggttcaatctctaagaatcagggaatccgttatttatttgaagatgggtcacgtttggttttccgtttatcagggactgggtcagaaggtgccacaattcgtccttacattgaacaatacgaaaaagatgcaacaaaaattggaagagattctcaagaagcacttgc

SEQ ID NO: 5276 - DNA, 1246 bp, Brassica oleracea
ggatctacctgctaaagacggaagcacctacggttcaggaaacttcgtcgtaaccctcggaatcggaacaccgaaacacgatctgtctctgatcttcgacacaggaagcgacctgacgtggattcaatgcgagccatgtgttcgaacttgctattcccaaaaggaaccaatctttaacccgtcttcctcttcctcataccacaacgtgtcttgctcatcggctgagtgtagctcactctcttccgctacaggtaattccggaacatgctcggcttcgaactgcgtctacggtattcaatacggcgatcaatcattctccgttggctttctcgctaaagaaaagtttactctaacggcttctaacgtattcgacggcgttaacttcggctgcggtgagaacaaccaaggactcttcaccggagtcgccggacttctcggccttggccgtgacaagctctctttcccgtcgcagacggcggcgacctacaacaagatcttctcctactgcctcccttcttccgctagctacaccggtcatctcaccttcggatccgccggagtctccagatccgttaaattcactccgatctccacgatcaccgacggcacatccttctacggtctcgacatcgtcggaatctccgtcggcggtcagaaactggcgattcctccgacggtgttctccactccgggagctctgatcgattccggtaccgtcatctctcgcctcccgccgaaggcctacgcggcgctgcgaggcgcgttcaaggcgaagatgtcgcagtacaagaatgcgtcgggagtctcgatcttggacacgtgttttgatctcaccgggtttaaaacggtgacgatcccgacggtgtcgttttacttcaatggtggggccgtggtggagcttggctcgaaaggggttttgtacgcgtttaagatgtcgaaggtttgtttggcgtttgcagggaatagcgatgataataacgctgctatctttgggaacgttcagcagcaaacgctggaagttgtgtacgatggtgcggccgggcgggtcgggtttgctccgaatgggtgtagttaatgaaaacattatgggtaaattttatttatggatttggcgccaaattagctttatccttaatcaagtgtgtaatttgtgtgagcacgtgatggtctatgaaagtgtaaatggtacacgtttactgtaaaaggccaaactattaatttacatatgttaactccaaaaaaaaaa

SEQ ID NO: 5277 - DNA, 1202 bp, Brassica napus
ttcgacacaggaagcgatctgacgtggattcaatgcgagccgtgcgttcaaacatgctattctcaaaaggaaccaatctttaacccgtcctcgtcttcctcgtactacaacgtctcgtgctcttcggccgcgtgtacttctctctcttcagctacaggtaactctggaagctgctcagcttcgacgtgcgtctacggtattcaatacggcgatcaatccttctccgtcgggtttctcgcgaaggagaagttcacgctaacgacccccaacgtattcgacggcgtttacttcggatgcggcgagaacaaccaaggactcttcaccggcgtcgccggacttctcggactcggccgtgacaagctctccttccctcgcagacgcaacaacatacaacaagatcttctcctactgcctcccttcctccgccagctacaccggccatctcaccttcggaaccgccggaatctccagatccgtcaagttcactccgatctccaccatcaccgaaggcacgtccttctacggcctcgacatcgtcgggatcaccgtcggaggtcagaagctagcgatcgctcccaccgtgttctcaactccgggggctttgatcgactccggaaccgtcatcactcgtctcccgccgaaggcttacgcggcgctgaaagacgcgttcaaggcgaagatgagtcagtatccgagcgcgtcgggggtctcgatcttggacacgtgtttcgatctcagcgggttaaaaacggttacgattccgaaagtggcgttttctttcagcggcggcgcggttgtggagcttggatcgacgggggttctatacgcgtttaagatgtcgcaggtttgtttggcgtttgcggggaatagcgatgacactaacgctgccatctttgggaacgttcagcagcaaacgctggaggttgtgtacgatggtgcgggtgggcgggtcgggtttgctcctaatgggtgtagttaaagctttaaaaaggggtggatttaattatatggatttggcgttaattagctttatccgttattcaagtgtgtaattgggctgaaatcgttatgggcctgtgaagtaaagtgtacagaaataaatttgtgtggatgatacgacaaaacagttataccttctattggagaagctgtgtgcaaattcaaattaaaaatttcaaactgttgaaaaataattcaacccg

SEQ ID NO: 5278 - DNA, 1037 bp, Brassica napus
tctttaacccgtcctcgtcttcctcgtactacaacgtctcgtgctcttcggctgcgtgcagctctctctcttccgctacaggtaattctggaagctgctcagcttcgacgtgcgtctacggaatccaatacggcgatcaatccttctccgtcgggtttctcgccaaggagaagttcacgctaacgagctccaacgtattcgacggcgtttacttcggctgcggcgagaacaaccaaggactcttcaccggcgtcgccggacttctcggactcggccgtgacaagctctccttcccctcgcagacggcgaaggcttacaacaatatcttctcctactgcctcccttcctcatctagctacaccggacacctcaccttcggaaccgccggaatctccagatccgtcaaattcactccgatctccacgatcaccgaaggcacgtccttctacggcctcgacatcgtcgcaatcaccgtcggaggtcagaagctagcgatcgctcccgccgttttctcaactccgggggctttgatcgactccggaaccgtcatcactcgtctcccgccgaaagcctacgcggcgctgaaagacgcgttcaaggcgaagatgagtcagtatccgagcgcgtcgggggtctcgatcttggacacgtgtttcgatctcagcgggttaaagacgtttacgatcccgaaagtggcgttttctttcagcggcggcgcggtcgtggagcttggatcgacgggggttctatacgcgtttaagatgtcgcaggtttgtttggcgtttgcggggaatagcgatgacactaacgctgccatctttgggaacgttcagcagcaaacgctggaagttgtgtacgatggtgcgggcgggcgggtcgggtttgctccaaatgggtgtagttaaagcttaaaaaaggggtggatttaattatatggatttggcattaattagctttatccgttattcaagtgtgtaattgggctgaaatcgttatgggcctgtgaagtaaagtgtacagaaataaatttgtgtgga

SEQ ID NO: 5279 - DNA, 1670 bp, Brassica rapa
ctcgcttactggcttctggtttgatgttatagtcatcctcccggttcctcaggctgtgttttggttagtggtgccaaaactgataagagaagagaaggttaagctgataatgacgatccttctgctgatcttcttgttccagttcctccccaagatttatcactgcatctgcttgatgagaaggatgcagaaggtcactggttacatttttgggactatttggtggggttttgctcttaacctcatcgcgtatttcatcgcttctcatgtagctgggggatgctggtatgttcttgcaatacagcgtgtggcttcttgtatcagacagcagtgcatgaggactgcgaactgtaatctgagtctgtcttgccaagaagaggtctgttaccaattcgtgtcacccagtagcacaattgggtttccatgcgtatctgggaacctcaccagtgtggttaagaagcctatgtgcttagactctgacggaccattccgatatggtatctacggttgggcgcttccggtcatctctagcaactctcttgccgttaagatactttaccctatcttctgggggttaatgactctcagcacattcgggaacgatcttgagcccacaagcaactggcttgaggttgttttcagcatagttatggtccttagcgggttactactcttcactctcttgatcggaaacattcaggtgtttttgcacgcggtgatggcaaagaagaggaaaatgcagatacggtgtagggatatggaatggtggatgaaacgtaggcagttgccttctcggttaagacagagagttaggagatttgagcggcagagatggactgccttgggtggagaagacgagctggaacttatacaagatctgcctccgggtcttcggagagatattaagagatatctttgcgttgatctcattaacaatgttccattgttcaggggcatggacgatttgatcctagacaacatttgcgatcgtgctaagcctcgtgtctactctaaagacgaaaagatcatccgggaaggagatcctgtacagagaatgatattcatcatgcgtgggagagtgaaacgtaaccagagcctaagcaaaggcgtggtagccactagtacgctcgaaccaggcggttacttaggcgacgagctactctcatggtgcctacgtcgtccattcattgaccgtcttcctccttcctccgcaacatttgtctgtctcgataacatcgaggcgttctctctcggatccgaagatcttaggtacataacagatcatttccgctataagttcgcaaacgaacgtcttaagaggactgcaagatactactcctcaaactggaggacgtgggctgcggtgaatattcaaatgtcgtggcgccggtacaggaagagaacatgtggtggtgtaggcggttcgatgagtcctgtgtcggaacatagcgtggaaggtaacagtgaacgccgtttgcttcagtatgctgcaatgttcatgtccatccgaccgcatgatcatctcgagtaaaaccaaaaaaaaaagttactaaatcatcggttgaaataattgtttgtatccattgttcgtcctcaattgtttttgttccattgcttgtgtaaaataaaacctctctttcgattatgcgtatttgagtttaaaactagca

SEQ ID NO: 5280 - DNA, 751 bp, Brassica napus
tcttcgaagagatattaagagatatctttgcgttgatctcattaacaaggtaccattgttcaggggcatggacgatttgatcctagacaacattagcgatcgtgctaagcctcgtgtctactctaaagacgaaaagatcatccgggaaggagatcctgtacagagaatgatattcatcatgcgtggaagagtcaaacgtaaccagagcctaagcaaaggcgtggtagccactagtacgctcgaaccaggcggttacttaggcgacgagctactctcatggtgcctccgacgtccatttatcgaccgtcttcctccttcctccgcaacatttgtctgtctagacaacatcgaggcgttctccctgggatcagaagatctaaggtacataaccgatcatttccgttataaattcgcaaacgagcgtcttaagaggactgcaagatactactcctcaaactggaggacgtgggcagcggtgaatattcaaatgtcgtggcgccggtacaggaagagaacctgtgtaggcggttcgatgagtcctgtgtcggaacatagcgttgaaggtaacagtgaacgccgtttacttcagtatgccgcgatgttcatgtccatccgaccgcatgatcatcttgagtaaaaccaaaaaggtttttaaatttatcggttgaaaataattcattgtatccattttgtccgtcctcgattgttttttgttgttccaattgctgtgtaaaataaaatcgctctttcg

SEQ ID NO: 5281 - DNA, 1475 bp, Raphanus sativus
  misc_feature (329)..(329): n is a, c, g, or t
  misc_feature (338)..(338): n is a, c, g, or t
  misc_feature (383)..(383): n is a, c, g, or t
  misc_feature (911)..(911): n is a, c, g, or t
  misc_feature (1390)..(1390): n is a, c, g, or t
  misc_feature (1417)..(1417): n is a, c, g, or t
  misc_feature (1420)..(1420): n is a, c, g, or t
gttgggactatttggtggggttttgcccttaacctcatagcctatttcatcgcttctcatgtagctgggggatgttggtatgttcttgcaatacagcgtgttgcttcttgcattagacagcaatgcatgaggaccgcgaacttaacctgagtctgtcttgccaagaagaggtctgttaccaattcgtgtcacccaccagcacaattgggtttccatgcatgtctggaaacctcaccagtgtggttaagaagcctatgtgcttagactctgacggaccattccgatatggtatctacggttgggcacttccggtcatctccagcaactcncttgcggtnaagatcctttaccctatcttctgggggctaatgactctcagcacnttcgggaatgatcttgagcccacaagcaactggcttgaggttgttttcagcatagttatggtccttagtggtttattactcttcacgctgttgatcggaaacattcaggtgtttttgcatgcggtaatggcaaagaagaggaaaatgcagatacggtgtagggatatggaatggtggatgaaacgtaggcagttgccttctcggttaagacagagagttaggagatttgagcggcagagatggactgccttaggtggagaagacgagctggaacttatacaggatttgcctccgggtcttcgaagagatattaagcgatatctttgcgttgatcttattgagaaggtaccattgttcaggggcatggacgatttgatcctagacaacatttgcgatcgtgctaagcctcgtgtctactctaaagacgaaaagatcatccgggaaggagatcctgtacagagaatgatattcatcatgcgtggaagagtcaaacgtgaccagagcctaagcaaaggcgtggtagccacnagtacgattgaaccaggtggttacttcggcgacgagctactctcatggtgcctacggcgtccatttatcgaccgtcttcctccttccaccgcaacatttgtctgtctagacaacatcgaggcgttctccctcggatcagaagatcttaggtacataacggatcatttccgttataaattcgcaaacgagcgtcttaagcggacggcgagatactactcctcgaactggaggacgtgggctgcggtgaatatccaaatgtcgtggcgccggtacaggaagagaacctctggtggtgtaggtggttcgatgagtcctgtgtcggaacatagcgtcgaaggtaacagtgaacgccgtttgcttcagtatgccgcgatgttcatgtccatccgaccgcatgatcatcttgagtgaaagtttcttaaatatgtatgtcgaaataattgtttgtatccattgttcatcctcgattgttttcgttncattggttgtttaaactaaaatctctnttncgatgatatgtatgtccccttatttgagttttctcttaatgtacatctttacagt

SEQ ID NO: 5282 - DNA, 666 bp, Brassica oleracea
aggggcatggacgatttgatcctagacaacatttgcgatcgtgctaagcctcgtgtctactctaaagacgaaaagatcatccgggaaggagatcctgtacagagaatgatattcatcatgcgtggaagagtcaaacgtaaccagagcctaagcaaaggcgtggtagccactagtacgctcgaaccaggcggttacttaggcgacgagctactctcatggtgcctccgacgtccatttatcgaccgtcttcctccttcctccgcaacatttgtctgtctagacagcatcgaggcgttctccctgggatcagaagatctaaggtacataaccgatcatttccgttataaattcgcaaacgagcgtcttaagaggactgcaagatactactcctcaaactggaggacgtgggctgcggtgaatattcaaatgtcgtggcgccggtacaggaagagaacctgtgtaggcggttcgatgagtcctgtgtcggaacatagcgttgaaggtaacagtgaacgccgtttacttcagtatgccgcgatgttcatgtccatccgaccgcatgatcatcttgagtaaaaccaaaaaggtttttaaatttatcggttgaaaataattcattgtgtccattttgttcgtcctcgattgttttttgttgttccaattgct

SEQ ID NO: 5283 - DNA, 817 bp, Brassica napus
ccacgcgtccggctaagcctcgtgtctactctaaagacgaaaagatcttcgaagagatattaagagatatctttgcgttgatctcattaacaatgtgccattgttcaggggcatggacgatttgatcctagacaacatttgcgatcgtgctaagcctcgtgtctactctaaagacgaaaagatcatccgggaaggagatcctgtacagagaatgatattcatcatgcgcgggagagtgaaacgtaaccagagcctaagcaaaggcgttgtagccactagtactctcgaaccaggcggttacttaggggacgagctactctcatggtgcctacggcgtccatttatcgaccgtcttcctccttcctccgcaacctttgtctgtctcgacaacatcgaggcgttctccctcggatccgaagatcttcggtacataaccgatcatttccgctataaattcgcaaacgagcgccttaagaggactgcaagatactactcctcaaactggaggacgtgggctgcggtgaatatacaaatgtcgtggcgccggtacaggaagagaacatgtggtggtgtaggcggttcgatgagtcctgtgtcggaacatagcgttgaaggtaacagtgaacgccgtttgcttcagtatgcagcaatgttcatgtccatccgaccgcatgatcatctcgagtaaaaccaaaaaaaaagttgctaaatttatcggtcgaaataattgtttgtatccattgttcgtcctcaattgtttttgttctctttgtgtaaaataaaacctctctttcgattatgtgtatttgagtttaaa

SEQ ID NO: 5284 - DNA, 2615 bp, Theobroma cacao
cctccctttttctttcccaaaggtttccccctttttttcccccatccctttttccgtccaaacttttcccctttcaaggtttcccctcctccacttacttccctttccttgaaaatagaaacgcatgtaaaatggttttatttggtgttttccaattctgtaacaggtggattggactctgccagcttcaaaactcccccggcgagaactctgatcacagcggcgacatcagcgaagacaacccaatttccaacaccgtagaatgctacgcttgcactcaagtaggagttccagttttccactccaccagctgcgaccatgctcaccagcctgaatgggaagcctcagcaggctcttcccttgttcccattcaggcccgagcgggccagaagaagactcaagctgctgcatctcggcacccttctggcccgttaggacgtgtgcttgatccaaggagcaagcgcgtgcagaaatggaaccgcgcgttcctgctggctcgtggcatggccttagctattgatcctctgtttttttatgctttatcgataggcagaggtggctttccttgtttgtacatggatggtggccttgccgccattgtaaccatccttcgcacgtgtgtcgacgccgtgcatttgtttcatctatggcttcagttcaggctggcgtacgtgtcaagggagtcactcgtcgtcggttgcggcaaactagtgtgggacgcacgtgccatagcttctcattacgttcgttcccttaaaggtttctggtttgatgcctttgtgattctcccagttcctcaggcagtattttggttagttgtacccaaactaatcagagaagagcagatcaagcttataatgactatactgctattaatcttcttgttccaattcctcccaaaggtttaccatagcatttgtttgatgagaaggatgcagaaggtcacaggttacatctttggcaccatttggtgggggttcggccttaatctcatagcctacttcatagcctctcatgtcgctggaggatgctggtatgtcctcgcaatacagcgcgtagcctcatgcctgcggcaacaatgtgagagaagtgagaggtgcaaactctcgttgtcttgctcagaggaggtgtgttaccaatttctatttccagctgaagcagtaggaaatccttgtggtggtaactcaacaaaagttgtcggaaaaccattatgtttagatgttcatgggccattcaattacggtatttatcagtgggctcttcctgtcgtttctagcaattctgttgctgttaagatcctttatcccatattttggggcttaatgactctcagcacctttggaaacgatcttgaaccaacaagtcactggttagaagtgatgttcagtatatgcattgtgcttgctggattgttgctcttcactttattgattggaaacatccaggttttcttgcatgctgtcatggcgaagaagagaaaaatgcagctgagatgtcgtgacatggaatggtggatgaagcgtaggcagttaccatcccgtttgaggcaaagagttcgccactttgaacgccagaaatgggcaactttgggaggagaggatgaaatggaattaatcaaagacttgcctgaaggcctccggagggacattaagcgctacctttgccttgacctcatcaaaaaggttcctctgttccacaacttggatgaccttattcttgacaacatctgcgatcgagttaagccacttgtcttctctaaagacgaaaagataattagagaaggagatcctgtgcaaagaatggtgtttatagttcgtggacgcataaagcgtagccaaagccttagcaaaggcatggtagccacaagtataattgagccaggaggctttttgggtgatgagctgctctcctggtgtcttcgtcgcccatttatagaccgtcttccagcctcatctgcaacatttgtttgtgtagagtcaattgaagcatttggccttgatgcaaacaatctcagatacatcactgatcacttcaggtacaaatttgccaatgagaggcttaagagaacagcgagatactattcatccaattggcgaacatgggcagctgtgaatatacaacttgcctggcggcgttacagaaccaggactagaggtccaatgatttctgttacagagaatggaaacagcagtgatcgccggttgctgcaatatgctgcaatgttcatgtcaatcaggccacatgaccatctagaataaaagcagctgccgcaatgctttggtcattctgtactcatctaataaagtcttgcttctcttggcagaatattcaccatggaaattcgtgggacattgtactttttgtataatatgagaattggaacttaacttttcaggaaataataataaaaccctttcgatgaactaaaccatttccataagctctctcaagtctcaattcaatgtctcttacaacatccgactgcaagactttatattgtaggcggccaatatgtaaaactttgagcctgagttcaaaccagtaataggaagggttctttttttaaatgaaccctatgcataaagtgtttttgataataaattttttcataattt

SEQ ID NO: 5285 - DNA, 891 bp, Brassica juncea
aagcagtgttgtcatgctaagttctgatgaacaaagattccttgaagcgtcaatggcttatgtgtctggcaatccaatcatgagtgatgaagaatacgacaagcttaaaatgaaactgaagatggatggaagtgagattgtgtgcgagggtcctagatgcagtcttcgtagtaaaaaggtttacagtgatctcgccgtggattatttcaaaatgttcttgttgaatgttccagcaaccgttgtcgctctcggactgtttttcttccttgatgaccttacgggttttgaaatcacttacttgctcgagcttccggaaccattcagtttcatcttcacatggttcgctgcggtgcctgcaattgtgtatctggcgctatcactcaccaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccaaggtttcattctcaggggaaatgtattatgatgtaatattgatactaatagataaacaagatggagaaatcaaagaagagaaaaagaaaagcaaaagagtttgttttgtgtgctgtcttttataagcttcagacgtttccatgtagctgtcattgactggtattgtgtgttgtaagtaaatctgaggtgaaatcagagaaaaaacaccatgtgattacttctttgaggaatttcgctctcactagaaaaaataaaatggaaaaacgggacaacaagttacctacacttggat

SEQ ID NO: 5286 - DNA, 904 bp, Brassica napus
ttatgtctaacgaagagtttgataaccttaaagaagagttgatgtgggaaggaagcagtgttgtcatgctaagttctgatgaacaaagattccttgaagcttcaatggcttatgtgtctggcaatccaatcatgagtgatgaagaatacgacaagctcaaaatgaaactaaagatggacggaagtgagattgtgtgcgagggtcctagatgcagtcttcgtagtaaaaaggtttacagtgatctcgccgtagattatttcaaaatgttcttgttgaatgttccagcaaccgttgtcgctctcggactgtttttcttccttgatgaccttacgggttttgaaatcacttacttgctcgagcttccggaaccattcagtttcatcttcacatggttcgctgcggtgcctgcaattgtgtatcttgcgctatcactcacaaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccatggtttcattctcaggggaaatgttttatgatgtaatattgatactaatagataaacaagatggagaaatcaaagaagagaaaaagaaaagcaaaagagtttgttttgtgtgctgtcttttataagcttcagacgtttccatgtagctgtcattgactggtattgtgtgttgtaagtaaatctgaggtaaatcagagaaaaaacaccatgtgattactccttgaggaatttcgctctcactagaaaaaataaa

SEQ ID NO: 5287 - DNA, 992 bp, Brassica napus
ctttcttattacccgtcaaagccactaccgatcagtcaggtcaggtgggtgggaagaagttgatagcaagatcttaccttactgtagcatcaacaagaacgagaagagatcaatcggtgaaatggaacaagagtttctccaagcgatgcaatcattctattacgaaggaaaggctgttatgtctaacgaagagtttgataaccttaaagaagagttgatgtgggaaggaagcagtgttgtcatgctaagtaatgacactaatatgattttctagtatcttcatgctccgttcgcagaatatgatcagttattttgtgttttcaggttctgatgaacaaagattccttgaagcttcaatggcttatgtgtctggcaatccaatcatgtctgatgaagaatacgacaagctcaaaatgaaactaaagatggacggaagtgagattgtgtgtgagggtcctagatgcagtcttcgtagtaaaaaggtttacagtgatctcgccgtagattatttcaaaatgttcttgttgaatgttccagcaaccgttgtcgctctcggactgttttcttccttgatgacctacggtttttaaatcacttacttgctcgagcttccggaaccattcagtttcatcttcacatggttcgctgcggtgcctgcaattgtctatcttgcgctatcactcaccaagctgatcatcagagactccttgatcctgaagggcccttgtccaaactgtggaacagagaatacatccttctttggaacaatactatccatctccaatgatggttccaccaacaatgttaaatgctccggatgtggaacggcgatggtgtatgactcaagtactcgtttgatcacattaccagaaggaggcaatgcttaaacactatgggccatggtttcattctcaggggaaatgtattatgatgtaatattgatactaatagataaacaagatggagaaatcaaagaagagaaaaagaaaagc

SEQ ID NO: 5288 - DNA, 1474 bp, Tropaeolum majus
cggccggggtactcttatctatggattcgctttctctccctccggatattttctttccttccaaacatcaaaaacccagtaaaataatgcacttgaaaccacccataacaatacctctgtaattatagaccaaacttctttccatcacttctttagttataatggctaccaaactaacctttgctttaacaccctctggtttattccctgcaactaatcagaaacctattgcccctccttcaacaaggtttcaatcaattaaattcgatgggagaaaactgcatgttcacaaaagactgttcatgctacctatcaaggctactgctgatcagccaggtaaggtagaagatgacgttgtggatcgtaatgtcttgcaatattgtagcctggataaaaaagagaagaagtcaataggtgaacttgagcaagatttccttcaagcactgcaagccttctattacgagggaaaagcagtaatgtcaaacgaggaattcgataatctcaaggaagaacttatgtgggaaggaagcagtgttgttatgctaagttctgatgaacaaaaatttcttgaagcttccatggcttacgtatcaggcaacccaattgtgagtgataaggaatatgataaattaaagctaaaactaaagatggacggtagtgatattgtggtcgagggtccacgatgcagtctccgtagtagaaaggtgtacagtgatctcaacgttgattatttcaaaatgctcctattgaatgtgccagcaactgttgttgcactgggattgtttttcttcctggatgatttgacaggatttgagatcacatatcttttggagctcccagagccattcagtttcatattcacctggtttgctgctgtacctctcatagtttacttggcgttgtcacttacgaaactaatcgtgaaagactctttgatcttaaagggtccctgtccaaactgtggcacagaaaacacctccttctttgggaccatattatctattcccaatggtggttctactaatgctctcaaatgttcaaattgtggaaccggattggttttcaactccagtacacgcttgattactttgccagaaggaagtgaagcatgaggaagcctctataaccaacataatgcaggactcagcaaggagggaaccttaaggatgcgtttacactggattcgtatcctaactggttgtcaatgttaatagtgttactataataggtttgtccaaagcaagagaagagaagagaagagtgtaattgttgtcatgaaaacgtacaaaatacccagtaaaaccatgatttgtgtattacctttagtttctatcatctctaattcacaccaagcacacatggtttttttatcagaacaccaaccatagatgtcacatttaagcttcactttgctaattatcgttataataaaagctagaaaattagtttctaagtaaaaaaaaaaaaaaggccg

SEQ ID NO: 5289 - DNA, 1388 bp, Carica papaya
atctctcagatttccccctgtctttccctccaaacatcaatacacacacataacccagcaaaggaaaaataaaaattaaaaaaaaaacaaaaacaaaatgaacctgaacccatctataccaacaccattttcctagacagacttcaactctgctcagcatttctttacccagatggctagcaaattggccttcattctaacatcccctcgtttattcactgcaactactaaaaaatccatcatttatttttcttcttccacaaagattcaatcacttgggttcaatggaaagcagctctgtgttcgaagaagattgtttatgctaccccctcaggctactgctgatcaacagggcaagatagaagaagatgaagttgttgacagtaaaattcttccctattgtagcatcgacaagaaggagaaaaagtcaattggtgaacttgaacaagattttcttcaagcactacaagccttctattatgagggtaaagcaataatgtcaaatgaggaattcgacaatctcaaggaggaacttatgtgggaaggaagcagtgtcgtgatgctaagctctgatgaacagaagtttctggaagcatcgatggcttacgcggccggcaaaccaattttgagcgatgtggaatttgataacttgaagacgaaactaaagatggatgggagtgaaattgtggttgagggtccacgatgcagtcttcgcagtagaaaggtatacagtgacctttctgttgattatttcaagatgctcctcttgaatgttccagcaactgttgttgcactaggattgtttttcttcctggatgatctgaccggatttgaaatcacgtatcttttagagctcccggagccattcagtttcatctttacatggtttgctgctgtgcctttcattgtctggttggccctttcgcttacaaagttaattgtgaaagattctctgatcttaaagggcccttgtccaaactgtggtaccgagaacgtctccttcttcggaattatattatccatttctaatggtggtacaactaacaacgttaaatgctcaaattgtcaaactgatttggtgtacgattcaaagacccgcttgattacattgcctgaaggaagtgaagcttgattagaggaaaggctcttactcgctaatgatgaacttggagatgaagaatgttgcattatgtaaatcttgagtagtcatttggagtgggagaaggaagtaagagatattgtgcaaggtggaaattagagttgtatctcaactcttggtttgtaacagtgtaagtatatgtatcatgtatatgtatacctatgataggtttgtccagagaaaagcaagagaaaggatagtcgtggaaaggtgtagtttggttgcttga

SEQ ID NO: 5290 - DNA, 1340 bp, Trifolium pratense
tgaaaatttctcagagtcaccaccactattgcttgcaataatcaccatgttcacagcaaccaaagtagctttcacattaacaccccctcgtctatgtactgcacccccaacaccatccattccaatttcttcttcattttctcgtcctcaattcacttcccgccacttatgtcttcgccggagattattcttactttcccctaaagccaccgcagatcaagggaacgttgaaggagatggtgttgttgatagtaatgttctaccatattgtagcatagatcaaaagaaagtcaagaaatccgttggtgaactcgagcaagaatttcttcaagcgcttcaatcattctattatgagggaaaggctattatgtcgaatgaagaatttgataatctcaaggaagaactcatgtgggaaggaagcagtgttgttatgctaagttcagatgagcaaaaatttcttgaagcttctatggcttatgtatctggaaatccaattttgaatgacagagagtatgatgcattgaaattgaggctaaagagggaagggagtgaaattgtggtcgagggtccaaggtgcagccttcgaagtagaaaggtttacagtgacctgtccgttgactatttaaagatgttcttgctgaatgtcccagccacggtggttgcattaggattgttcttcttccttgatgatataactggatttgagatcacttacttgctagagctgccggagccttttagtttcattttcacttggtttgctgctgttcccctcattgtatatctagctctatcattaacaagagccattatcaaagattttgtgattttaaagggtccctgcccaaactgtggacatgaaaatacctccttcttcgggactatactgtcaatttcaagtggtggttccaacaacaaagtcaaatgctccgactgtggaactgaaatggtttatgattcaagtacaagattgattacattgccagaaggaagtaatgcctaagtggaggtattcctggaaaccatattcattgttcaagcaatggaagctcattaataggagttactatgaaagtgacaaatttatgaatcagcaatgaatgtgctgtattatgttatcactgtcactcataatgtgtgtgaatgtgtcacactatcctacttgtaagtatatgggctttgtatacttgtaagtaatatggactttgtatagcatacactgcattgtttactggaagaagagttatgagggtgcttaacaccatcaatgagtctaaccttaaataatgtgtgtaaggagttttgttacacgcttttaaggaatttttccttccttctgc

SEQ ID NO: 5291 - DNA, 1280 bp, Medicago truncatula
ctcaaattttctcagttacactgccaccattcatcatgttcactgctaccaaagtagccttcactttagcaccccctcgtccatgttctgcacccccaacacccttcattccattctctttttcttctgtttctcctcctcaccttaattcccgccacttatgccttcgccgcagattattcctactttcacctaaagccactgcagatcaacaagggaatgttggagattttgacggagatgctgttattgataccaatgtcctcccatattgtagcatagatcaaaaaaaggagaagaaatccgttggtgaactcgagcaagaatttcttcaagcactccaatcattctattatgagggaaaggctattatgtcaaatgaagaatttgataatctcaaggaggaacttatgtgggaaggaagcagtgttgtcatgctaagttcggatgaacaaaaatttcttgaagcttctatggcttatgtttctggaaatccaattttgactgacaaagagtatgataagttgaaattgaatctaaagagagaagggagtgaaattgttgttgagggtccaaggtgcagccttcgaagtaaaaaggtttacagtgacctgtctgttgactatttaaggatgttcctgctgaatgttccagccactgtggttgcattaggattgttcttctttcttgatgatctgacaggatttgagatcacttacttgctagagctgccggagccttttagtttcattttcacttggtttgcggctgttcccctcattgtatatctagctctatcactaacaagggccattataaaagattttgtgattttaaagggtccctgtccaaactgcggaactgaaaatacctccttctttggaacaatactgtcgatttcaagcggtggttccaacaacaaagtcaaatgctctgactgtggaactgaaatggtgtatgattccggtacaagattgattacattgccagaatgaagtaatgcataggtggaggtattcctggaatcatattcattgttcaagcaatgtgagctcattaataggaattactatgaaagtgacaaattatcaatcagcaacatgctgtattatgtgtcatgttatcactgtcacgcataataatgtgattgatctcaatgtttgaatattgtcactatccaacttgtaagtatatgggctttgtatacttgtaaagtaatctggactctggataacatacactgcattgttactggaagagttacgagggtgcttaacacc

SEQ ID NO: 5292 - DNA, 1056 bp, Tripterygium wilfordii
ttgaagaagatgagaatgttgacagcaaaatcctaccatattgtagcatagacaagaaagataagaaatcactgggtgaaatggagcaagaatttcttcaagcactacaagcattctattatgagggaaaagctataatgtcaaatgaagaattttgataatcttaaggaagaactaatgtgggaaggaagcagtgttgttatgctaagttctgatgaacagaagtttttggaggcttcaatggcttatgtagcagggaacccaatcatgtcagatggagactatgataagttgaagatgaggctaaagacgggagggagtgaaattgtggctgagggtccacggtgcagtcttcgtagtagaaaggtgtacagcgacctgtatgttgactattttaagatgttcctgttgaatgttccagcaactgttgttgctcttggactgtttttcttcctggatgatctaactggatttgagatcacatatcttttggagctcccagagcctttcagtttcatcttcacgtggtttgctgctgtgcctgccatattttggttagctcaattgcttacgaaattaatcgtgaaagagtttttaatcttgaagggcccttgtccaaactgtggtactgaaaatgtctccttcttcgggaccatactatcagtctccaatggaggatccaccaataaccttaaatgctcaaattgtggaactgagttggtgtatgattcatcaacgaggttgattacattgccagagggaagtgaagcttgattggaggatgcattcattttaaggggtctgcgctccaattgttgctaaatcttagcagtcagtggtgaaggatgtttatgtaacgcggaatcatcggttgtgaattggagtgacatttttgagatgtacactgttttgcctcattgttctgtcaatattgtaagtatgtaaatgcctgtaacaggcctgtccacaggaaagcaaatagtagtgcacaaaactgctgcgaaaattgtcaaaacaaccaaccttatgatatagaatttcgcctcattttcgtgt

SEQ ID NO: 5293 - DNA, 1325 bp, Arachis hypogaea
tgcaatcttcttgtagtaatactatatccatcaccatggcaagcaagttattagcatttgcattggcacaccctcgtgctcctaccccaacacctctcattccaatatcttcaacttcttcttcctcttctgctaattttggtgcccaccaccttgttcaagtcagtggccgccacttatgtctccgccgccgactcttgatgctctcccccaaggccactgccgatcagcaacaaggcaaggttgaagaaaatgatggtgttgatgatgatggcaaaatcctacaatattgtagcatagataagaaaaagagatcagttggagaaatggagcaagagtttcttcaagcactccaagcattctattatgaggggaaggcgattatgtcaaatgaggaatttgataatctaaaagaagaactcatgtgggaagggagcagtgttgtcatgctaagttctgatgaacaaaaattcttggaagcttccatggcctatgtttctggaaaaccaatcctgagcgacaaggagtttgaccagttgaaattgaggctaaagatggaagggagcgagattgtggccgagggtccacgatgcagtcttcgtagtagaaaggtttacagtgacctatctgttgactacttaaagatgtttctgctcaatgtcccagcaactgtggttgcattaggattgttcttcttcctcgatgaccttactggtttcgagatcacatatcttctagagcttccagagccgtttagtttcattttcacatggtttgccgctgttcccctcattgtgtggttggctcagtcacttacaagtgctattataaaggattccttgattctaaagggtccctgtcctaactgtggtactgaaaatacttcattctttgggactatactttctatttcaagtggcgattccaccaacaaagtcaaatgtgaaaactgtggtaccgcattggtgtatgattcaactacaagattgattacattaccagaaggaagcagttcctaagtggagtacgtgaagatatatataagacacacaaatgggtagtgactaattttatcaagtcagaaaacagtggtgataaatcactattgtaatatgtgccaccactatcatacttgaaagctttaattatatgagctttgtgtatcatatattaccaagaattgttcatacaccactggatgagatagtgcaatcaggatccttattccctaattaacacggtcgccgatcaagttcaactccaaattccccttcccctgtataagaattgtgccaaacaacccttaaagaattattacattgaac

SEQ ID NO: 5294 - DNA, 1576 bp, Glycine max
acgttccagttaccttatcttccacctcagatacctctcttcactcttccatcatcttcctctccctccagacaaaacatcaccaccaccttcaacttaatttcccagttacactgccaccactttgattccaaataaccaccatcaccatgttcacggctagtaagctagccttcacattaacaccacctcgtccatgcactgcacctttgacaccaatctcttccttgtcctcttcttcttcttcttcttctgcttcagcttctggtatcaacttcattcagttcaatggacgccacttatgcctccgacgcaggctgtttctactctctcctaaggccactgcagatcaacaagggaaggttgaagaatttgaagatgattcaaatgttgttgatagtaaaatcctcccatattgtagcatagataaaaaagagaagaaatcaattggtgaacttgaacaggaatttcttcaagcactgcaagcattctattatgagggaaaggctatcatgtcaaatgaagaatttgataatctcaaggaagaactcatgtgggaaggaagcagcgttgtcatgctaagttctgatgagcaaaaattcctggaagcttctatggcttatgtgtctggaaatccaattatgagtgacaaagagtttgatgagttgaaactgaggctaaagaaagaagggagtgaaattgtggctgagggtccaaggtgcagtcttcgtagtaaaaaggtttacagtgacctatctgttgattatttgaagatgttcctgctgaacgtcccggctactgtgattgcattaggattgttcttcttcctcgatgatctgactggatttgagatcacatatctgctagagctgccggagccttttagtttcattttcacttggtttgctgctgttcccctcattgtgtggatagctctgtcactgacaaatgccattgtaaaagactttgtgattttaaagggtccttgtccgaactgcggtactgaaaacacctctttctttgggactatactttcaatttcaaatggtggttccaccaacactgtcaaatgctccaactgtggcactgcaatggaatatgattcaacttcaagattgattacattaccagaaggaagtaacgcctgagtggaggtatgcctgaaaatcatatttattgttccagcaatgggagatcattaatagcagttcttgtgagagtgacaaatttatcatttagcaaatcgtcatgttcttccgcaaatgaccttgaagtcatgttatcactatcacacacaattggtgtcatctcaatttatgtgccaccatcctacttgtaagtataggggctttgtatatatacttgtaatatggactttgtatagcatacactggattgcctctgcttgaagagttgagttatgagggtgcttaacaccatccatgagtctaacctagaataacgtgtgtaaggatttttgttacacactcctaagaccagaacctttacatcccccaggagcatcaagaacaataaggaaaattgactatttaaataattaatgctaattgacatt

SEQ ID NO: 5295 - DNA, 1085 bp, Brassica napus
gtttaacaagccctcgacttttctccgccgtctccagcaaacccacaacttgtttctcttctccttcgtcgtcgaggactcaatgggctccgctcagccctgggagatcggttcccttgagaaaagcttcttcttgctgccttcaaaagccaccacagagcagccaggtcaagctggaggagaagacgtggatagcaacatcatgccgtattgtagcatcaacaaggctgagaagaaaacaattggtgaaatggaacaagagtttctccaagccatgcaatcgttttattacgatggtaaagcgatcatgtcgaatgaggagtttgataatcttaaagaagagctcatgtgggaaggaagcagtgttgtcatgctaagttctgatgaacaacggttcttggaagcttcaatggcttatgtttctgggaatccaatcctcaatgatcaagaatttgatcagctcaaactcaaactaaagatggatggtagcgagattgtgtgcgagggtccaagatgcagtctccgtagtaaaaaggtgtatagtgatctcgctgtagattacttcaaaatgctcttgctcaatgttccagcaagcgttgttgctctcggactgtttttcttcttggacgacattacaggttttgagatcacatatatattggagctttcagagccatttagtttcatattcacgtggttcgctgccgtgcctctgatcgtatacctggcttcatcaatcaccaaactcatcatcaaagacttcttgatcttgaagggtccttgtccaaattgtggaacggagaatgtttccttctttggaacaattctttcaatatccagcggtggcaaaaccaacaatgtcaaatgcaccaactgtggtaccgcgatggagtatgactctggttctaggttgatcacattgccagaagcaagctaagcttgaaccctgtgagatgaagatggagaaaagaagaatgggttttgtcagaagcaaaaatggatttgatgctgtatatttaagatcttccatgttagctctctatctccttcacatgttttctgatttgtaagtactgtgtatgcaa

SEQ ID NO: 5296 - DNA, 1453 bp, Castanea mollissima
aaatctttgtgctgtctttgtttccctccaaacacaaactatcccaaatcaaatgcaccaaacttcaacaatccccacttgggaaccacatcatacccttcgatcaatccctccatatctaccatagttttagctcttagctcctacccttccacttctaatggctgccaagttagccattacttcaacatcccctcagttacacactgcccctattaaaagacccttagttcctatttcttcgtttgtgtcttctttgtcttcttatacaagagctcaaacagttcaattcaatggaagacacttgtgccttcgacgccgagttatggtgcttcccacgaaggccacagctgaccaacaagaccaggttgaaggaagtgatgttgttgacggtaaaatccttccatattgtagcatagacaaagagaaaaagtcaattggggaacttgaacaagagtttcttctagcactacaatcattctattatgagggaaaagctatcatgtcaaatgaggaatttgataatctcaaggaagaactgatgtgggaaggaagcagcgttgtcatgctaagttctgatgagcagaagtttcttgaagcttcgatggcttatgtagctgggaaaccaattatgagtgatgaagagtatgataaattgaagttgaggctcaagtcggaagggagtgaaattgtagttgagggtccacgatgcagtctccgcagtaaaaaggtttacagtgacctgtctgttgactatttgaggatgttcctgttaaatgtcccagcaaccgttgttgcattaggattgtttttcttccttgatgatattaccggatttgaaattacttatctactggagctccctgagccattcagtttcattttcacatggtttgctgccgtgcctctccttgtttggctagctctctcacttacaaatgtgattgtgaaagattttttgatcttgaaggggccatgtccaaactgtggtactgaaaacacctccttctttgggaccatactatcaatttctagcggtggtaccaccaacagtgttaaatgcacaaattgtggaactgcgatggtatatgactcaaacacacgcttaattacactgccagaaggaagtaatgcttgattcaaggatcaatacattttaatggatttgcaatatcacagttactaacctatgacgttggagatgaatggctaaggttttcacgttgaagatagagatgaagcgtttcacgttatgtatatatatcctgagtcatcgtttgtgaagggaggaaattttgtgttgtaaactgaatcgcaactcaactgttcagtgtgttgatattgcatttataagtaaaactgtacgacaattgtgttgatattgtatttataagtaaatccgtgctcgtacgtatgcctattacaggctcacacagggtagagaagagtgtgt

SEQ ID NO: 5297 - DNA, 1262 bp, Raphanus sativus
tctctctcatcttcaaccacacaagggttcctggaaaacagaggaaaaaaaaggaatctcctttctcctcccagggaaaatgggtagcaagatgctgttcagtttaacaagccctcgactcttctccgccgtttctcgcaaacccaccacccctccttgtttctcgtcgaggactcaatggtctcagctcaccctggccctggaagatcggttcccttgagaaaaagattcttcctgttgcctgcaaaagccaccacagagcaatcaggtcaagtgggaggagaagacgtggatagcaacatcatgccttactgtagcatcaacaaggctgagaagaaatcaattggtgaaatggaacaagagtttctccaagccatgcaatcgttctattacgatggcaaagcgatcatgtcgaatgaggagtttgataaccttaaagaagagctcatgtgggaaggaagcagcgttgtcatgctaagttctgatgaacagagattcttggaagcttcgatggcttatgtttctggaaatccaatcctcaatgatgaagaatttgataatctcaaactcaaactaaagatggatggtagtgagattgtgtgcgagggtccaagatgcagtctccgtagtaaaaaggtgtatagtgatctcgctgtagattacttcaaaatgctattgctcaatgttccagcatccgttgttgctcttggactgtttttcttcttggacgacataacaggttttgagatcacatacatcttggagctttcagagccatttagtttcatattcacttggttcgctgccgtgcctttgatcgtatacctggcttcaacaatcaccaaactcatcatcaaagacttcctgatattaaagggtccttgtccaaattgtggaacagagaatgtttccttctttggaacaattctttcaatctccagcggtggcaaaaccaacaatgtcaaatgcaccaactgtggaaccgcgatggagtatgactctggttctaggttgatcacattgccagaaggaagctaagcttgaaccctgtgagataaagatggaaaaagaaagaatgggtttttgtcagaagcaaaaatggatttgatgcctgtatatttaagtatcttccatgttagctctctatctcctttcacatgatttctgatttgtaagtactgtgtaagcaataagggaaaatatttaatgaatacttcttcaccaacctttcataggtctaaaatgatatttatttcagactt

SEQ ID NO: 5298 - DNA, 1477 bp, Glycine max
ggaaggagaataagccgttgcaattccctccacacgttccagttaccttatctaccacctcagccttttctcttcactcttcctttccctccaaacaaacaaaagcaaccattaccaccaccaccttgaactttcccagttacactaccaccactttgattccaaataaccaccatcaccatgttcacggctagtaaactagccttcacattaacaccacctcgtccatgcactgcacccttgacaccaatctcttcagcttctggtgttcacctcattcagttcaatggcaggcacttatgcctccgccaaaggctgtttctactttctcctatggccactgcagatcaacaagggaaagttgaagaatttgaagatgattcaaatactgttgatagtaaaattctcccatattgtagcatagacaaaaaagagaagaaatcaattggtgaacttgagcaggaattcctccaagcactgcaagcattctattatgagggaaaggctatcatgtcaaatgaagagtttgataatctcaaggaagaactcatgtgggaaggaagcagcgttgtcatgctaagttctgatgagcaaaaattcctggaagcttcgatggcttatgtgtctggaaaaccaattatgagtgacaaagagtttgatgagttgaaactgaggctaaagatagaagggagtgaaattgtagctgagggtccaaggtgcagccttcgtagtagaaaggtttacagtgacctatctgttgattatttaaagatgttgctgctgaacgtcccggctactgtgattgcattaggattgttcttcttccttgatgatctgactggatttgagatcacatatctactagagctgccggagccttttagtttcattttcacttggtttgctgctgttcccctcattgtgtggatagctctgtcactaacaaatgccattgtaaaagactttgtgattttaaagggtccttgtccgaactgcggtactgaaaatacctctttctttgggactatactctcaatttcaaatggtggttccaccaacactgtcaaatgctccaactgtggaactgcaatggaatatgattcaactacaagattgattacgttaccggaaggaagtaacgcctgagttgaggtatgcctgaaaatcatatttattgttccagcaatgggagatcattaatagcagttcttgtgagagtgacaaatttatcatttagcaaattgtgatgttcttccacaaatgatcttgaagtcatatgtaatcactatcacacacaattggtgtcatctcaatttatgtgtcaccatcctacttgtaagtatatgggctttgtatacttgtaagtaatatggactttgtatagcatacactggattgcctctacttgaagagttgagttatgagggtgcttaacaccatcgatgagtctaacctagaataacgtgtttttattgca

SEQ ID NO: 5299 - DNA, 1397 bp, Malus domestica
acccaaaaaaatgaatccaaaattcagattaccaaaaaagtcctgtcttcatttactactcagctcactctgtaaccagagaattagtggcttttctcagttccaatggccaccaaactagggttcaccttaacatctacaaccccttttaatccctctattcagagaccctttgtctccgtttcttcttcctcctcgactagggttgagtcttttcagatcagtggcagacagctatgcctccacctccgccgccgccgccttttggtacttccggctaaggctacagctgaccaacaaggcaaggtcgaaaaggatgacgttgtggacagtaaaattttgccatattgtagcatagacaagaagaagaagtctttgggtgaacttgaacaagattttcttcaagctctacaatcgttctactatgacggaaaagctattatgtcaaatgaggaatttgataaccttaaggaagaactcatgtgggaaggcagcagcgttgtcatgctaagttctgatgaacagaagtttctggaagcctcaatggcctatgtgtctgggaaaccaattctgacagatcaagagtatgatgatctgaaaatgaggctaaagacggaagggagtgatattgtagtcgagggtccaagatgcagtctccgtactagaaaggtttacagtgacctgtctgttgattatttgaagatgttcctgctgaatgtccctgcgactgttgtcgcacttgcagcgttcttctttttggatgatctgaccggtttcgaaatcacatatcttttggagctgccggagccattcagcttcatttttacatggtttgctgctgtgcctgccatagtttacttagctcaggcactgacaaagctaattatcaaggatgttttgatcctgaagggcccttgtccgaactgtggtacagagaacttgtcattctttgggaccatactttccatttcaaatggaggttccaccaacaacatcaaatgctcaaactgcggaactccactggtatatgattcgaagtcgcgcctgattacgttgccagatggaagcaatgcatgatgagaatttgggagctcaaataaaatgtagcataaatgtaattaacgaataatcagcactcgtgtattgtgtaagcgttttcttgtgcagaagaagaatatgtaattttcttggttcttggggtctctttggaacatctcaacagttgattgtgaatatgaatacaaggaaagaggaagatagcatgatcggacggttcagatctagtcttatgccttccattatcagttgtcttcagctcctgtgtgcgcattgttttcaagttctctcgttcggtatagaaaattggattggaatcaatgaaattgctgttttctaga

SEQ ID NO: 5300 - DNA, 1724 bp, Citrus clementina
cacacttgtaaactaccttatctgtttgatttcgttcctctctttcgttccctccaatccaaacatcaaaactcgtacacacaaaaaaatctatcatcaccatgcatctcgctacatcaccagctacacactctattactagtattttcacctgaaaccgaaactaccatctctattttcaaatggctagcaaagtagcctctggttttacccctcaggctcagcgcgtcttcgctgtccctgtgcaaaagccagctgcagccttggttcctttttcatcctcttcaagggctcactcaaattcaaatactcagttcagtggaaggcagttttctgttcgacgcagatcttttgtactgcccagcaaggctactactgaccaacaaggtcaggttgagggagatgaggtagtcgatagtaaaattctgcaatattgtagcattgacaagaaagagaaaaagtcattgggtgaactagaacaagagtttcttcaggcactgcaagctttctattacgagggaaaagctgttatgtcaaatgaggaatttgataatcttaaggaagaactgatgtgggaaggaagcagcgtcgtcatgctaagttctgctgaacaaaagtttctcgaagcttcaatggcttatgtggctgggaaacctattatgtcggatgaagagtatgataaattgaagcagaaactaaagatggatgggagtgaaattgtggttgagggtccacggtgcagtctccgtagcagaaaggtttacagcgacctgtcagttgactacctcaaaatgctccttttgaatgtgccagcaactgttgttgcacttggattgtttttcttcctggatgatatcactggatttgaaatcacatatcttttggagcttccagagccattcagtttcatttttacatggtttgctgcggtgcctttgatagtatatttatctcaatcactcacaaaactgatcgtaagagaatctttgatcttgaagggcccctgtccaaactgtggtacagagaatgtttctttctttgggaccatactatcaatttctagtggtggaaccaccaacactattaactgctcaaattgtggaaccaccatggtttatgactcaaacacaaggttgattacattgcccgaaggcagtgaagcttaatcaaggagcaaccaataagaagcggtccttcgactttaactaactcttgaagtcggatgtgaagagtgttaaattatgtagatctatccctcctgtggaaagagagaagttatatggtttgcttcgctgtgggctcaattatgtcaatattgtatttgtaagtatatgcgtcatatacatacctgtagcaggcttgtttgcaggaacagaagatgatccattttgttgtaattaatattcagttctagtgttatatcgcaaatcaaacccatttgagcatgcttgtcactctgaacctctttccttttatggtgataattgtcactttttatagtgtgttaatctctgaatcatttaaagcagatctctgaaacatttgaagcaggccagtctaatgcatttgtaggctcgtaacagtagttgaacaactagaactgaagctgccttggatatttatgttatcaattagatggataactgaccatgaaaaatggcaactgctcggacattcaaccagcggtgtggttcaattttaatgctgtggatggtcatactcac

SEQ ID NO: 5301 - DNA, 1416 bp, Euonymus alatus
gacaatttttcatcgccttatccgttttgttgaatttctttccctccaaacaaacaaaaacctcataataagcagaatttctcacatcatcatcgattgagagtcagtttaatggctcacaaattggccttcacgatgtcatctactcgtttatttagtgctcctattcaaaaacccttgttttgtgtctcttcttcgtctccttgttcatcatctagggttcaaccgagccacttgaatggaagaaaattttgtcatcgtcgacggatgtttgtactccctatcaaggctactgctgatcaacaagggaaggtggttgaaggagatgaggctattgacggcagaatcctaccatattgtagcatagacaagaaaaataaaaaaacactgggtgaaatggagcaagaatttcttcaagcactacaagcattctactatgagggaaaagctataatgtcaaacgaagaattcgataatctgaaggaagaactaatgtgggaaggaagcagcgttgttatgctaagttctgatgaacagaagttcttagaggcttcaatagcttatgtatcagggaacccaatcatgtcagatcaagactatgataagttgaagatgaagctaaagacggaagggagtgaaattgtagttgagggtccacggtgcagtcttcgtagtaaaaaggtttacagcgacctgtatgttgactattttaagatgttgctgttgaatgttccagcatctgttgttgctcttggactgtttttcttcctcgatgatctgactggatttgagatcacatatcttttggagctccctgagcctttcagtttcattttcacatggtttgctgctgtgcctgccatagtttggtcagctcaatcgcttacgaaattaatcgtgaaggactttttaatcttgaagggcccttgtccaaactgtggtactgaaaatgtctccttctttgggaccatactatcagtctccagtggaggctccaccaataaaattaaatgctcaaattgtgaaacccagatggtctataattcatcaacgcggttgattacattgccagagggaagtgaagcttgattggaggatgaattcatttgaaggagtctgctctccgattgctgctaaatcttgaagtcagttgtgatggatgtttatgtaactcggaactatcggttgagatgtacactggatttgccccatattgttctgtcaatattgtgactgtaagtatgtaaatacctgtaacagtcctgtccacaggaaggaaaagagtagtgcacaaaactgctgcgaattttcaaaacaaaccaaccttatgatatagaatttcccttaattttcatgttgttgtccacaagctacaggtactatgatatcgagttgaatcaaatagcccttcttttt

SEQ ID NO: 5302 - DNA, 1145 bp, Tripterygium wilfordii
gtcttcggcgacgggtatttgtactccctatcaaggctactgctgatcaacaaggcaaggttgaagaagaagataccgttgacagcaaaatcctgccatattgcagcatagacaagaaagacaaaaaatcactgggtgaaatggagcaagaatttcttcaagcactacaagcattctactacgaagggaaagctataatgtctaatgaagaatttgataatctcaaggaagaactaatgtgggaaggaagcagtgttgttatgctaagttctgatgaacaaaagtttttggaggcttcaatggcttatgtagccgggaaaccaattatgtcggataaagactttgatcagttgaagctgaagctaaagacagaagggagtgaaatcgtagttgagggtccacgatgtagtcttcgtagtagaaaggtatacagcgacctgtatgttgattattttaagatgttcctgttgaatgttccagcaactgttgttgctcttggactgtttttcttcttagatgatctgactggatttgagatcacatatcttttggagctcccagagcctttcagtttcattttcacgtggtttgctgccgtgcctgccatattttggatagctcaagtccttacgaaattaattgtgaaagactttttaatcttgaagggcccttgtccaaactgtggtactgagaacgtctccttctttgggaccatactatcagtctccagtggaggctccaccaataatcttaaatgctcaaattgtggaactgagttggtgtatagttcatcaacacggttgattacattgccagagggaagtgaagcttgattggagatgcagggtgaatttattttaaggtgtcaatgtgcaaaccgttgctaaaatattgaagtcagaggtgaaggatgtgtatgtaattgtgaaattggagtgatatttgagatgtacagtggatttgtctcatattgttctgtcaatattgcgagtatgtaaatacctgtaacaggcttgtccacaagaaagagaaagtagtgcacaaaactgctgtgaattgtcaaaacaaccaaccttataatatagagtttctcctagttttcatgtgagtggtcttcttgaacaccaaatcctgaactgaagata

SEQ ID NO: 5303 - DNA, 1297 bp, Lotus japonicus
ccagttacacttccattgccaccaccaccaccattaccaccatgttcacagcttccaaactagccttcactttaacatcaccacgttcatgcactccacctacaccaacccccctaattccactctcttcttcttcttttacttcttctcgtttcaacctcattcagttcaatggccgccaattatgcctccgccggagactgtttctactttcccctaaagccactgcagatcaacaaggaaaggttgaagaatttgaagaaggtgctgttgatagcaaaatcctcccatattgtagcatagataaaaaagataaaaaatcagttggtgaaatggagcaagattttcttcaagcactacaatcattttattatgagggaaaggctatcatgtcgaatgaagaatttgataatctcaaggaagagctcatgtgggaaggaagcagcgttgtcatgctaagttcggatgaacaaaaatttctggaagcttctatggcttatgtatctggaaaaccaattctgagtgacaaagagtatgatgacttgaagatgaggctaaagatgaatgggagtgaaattgttgtagagggtccaaggtgcagtcttcgtagtagaaaggtttacagtgacctgtctgttgactacttaaagatgttcttgctgaacgttccagccactgtgattgcattaggattgttcttcttccttgatgatctgactggatttgaaatcacatatctgttagagctgccggagccttttagtttcattttcacttggtttgctgctgttcccctcattgtgtggctagctctgacaataacaaacgtcattataaaggattttttgattttaaagggtccatgtccaaactgtggtactgagaacacctccttctttgggactatactatcaattgcaagtggtggttctagcaataaagtcaaatgctctaactgtggcactgaaatggtatacgattcagctacaagattgattacattgccagaaggaagtaacgcctaagtggagtacatgcctacaggtatgcctcgaaacacagtcattgtccagcaatgggagatcattcataggagtttcttgtgaaggagaccaattttatcaataagcaaagtgtcattagtgatgtcatgttatcactgtcacacataattggtgtgatctcaaccgtttgtatgtgccagtatcctacttgtaagtatatgtggctttgtatacttgtaagtaatatggactctgtatagcatacactggaatgtttaccggtagagttaatt

SEQ ID NO: 5304 - DNA, 1521 bp, Cajanus cajan
gagtacgggggggaggagaaggaaggggaataagccgttgcatttccctccacacgttcaacttaccttatcttccagcttagctacctctcttcactcttcacttctaccatcttccttttccctccaaacaaaacaatcaccaccaccttcaacttccactgccaccacattcattccaaataaccaccaataaccatgttcacggctagtaaactagcctacatcacattaccaccccctcctccatgcactgcacccttcattccaatctcttccttgtcctcttcttctgctgttcacttcattcagttcaatggccgccacttatgccttcgccgcaggctgtttctgctttcacctaaggccactgcagatcaacaaggcaaggttgaagaatttgaagaggatgcagttgttgatagtaaaatccttccatattgtagcatagacaagaaagagaagaaatcaattggtgaacttgagcaagaatttcttcaagcactgcaagcgttctattatgagggaaaggctatcatgtcaaatgaagaatttgataacctcaaggaagaactcatgtgggaaggaagcagcgttgtcatgctaagttctgatgagcaaaaatttctcgaagcttctatggcttatgtgtctggaaacccaattatgagtgacaaagagtatgatgagttgaaactgaggctgaagatggaagggagtgaaattgtggttgagggtccaaggtgcagtcttcgtagtagaaaggtttacagtgacctatctgttgattatttaaagatgttcctgctgaatgtcccggctactgtgattgcattaggattgttcttcttccttgatgatctgactggatttgagatcacatatcttctagagctcccggagccttttagtttcattttcacttggtttgctgctgttccactcattgtgtggatagctctctctctaacaaatgccattgtaaaagactttgtgattttaaagggtccctgtccgaattgtggtactgaaaatacctctttctttgggactatactttcaatttcaagcggtggttccaccaacagtgtcaaatgctctgactgtggcactgaaatggtgtttgattcaactacaagattgattacattgccagaaggaagtaacgcctaagcggaggtatgcccgaaaaccagatatattgttccagcaacgtgagatcattaatagctgttcttgtgaaagtgacaaatttatgaattagcaaattgtcatgttcgtccgaaaaatggtcttgaagtcatgttatcattatcacacacaattggtgtcatctcaactgtttgtgccaccatcctacttgtaagtatatgggctttgtatacttgtaagtaatatggactttgtatagcatacactggattgtctctacttgaaagagttgagttatgagggtgcttaacaccatcgatgaatctaacctagaataacgtgtgtaaggattattgttacacacttgta

SEQ ID NO: 5305 - DNA, 1724 bp, Citrus sinensis
cacacttgtaaactaccttatctgtttgctttcgttcctctttttcgttccctccaatccaaacatcaaaactcgtacacacaaaaaaatctatcaccaccatgcatctcgcaacatcaccagctacacactctattactagtattttcacctgaaaccgaaactaccatctctattttcaaatggctggcaaagtagcctctggttttacccctcaggctcagcgcgtcttcgctgtccctgtgcaaaagccagctgcagccttggctccttttccatcctcttcaagggctcactcaaattcaaatactcagttcaatggaaggcagtttactgttcgacgcagatcttttgtactgcccagcaaggctactactgaccaacaaggtcaggttgagggagatgaggtagtcgatagtaaaattctgcaatattgtagcattgacaagaaagagaaaaagtcattgggtgaactagaacaagagtttcttcaggcactgcaagctttctattacgagggaaaagctgttatgtcaaatgaggaatttgataatcttaaggaagaactgatgtgggaaggaagcagcgtcgtcatgctaagttctgctgaacaaaagtttctcgaagcttcaatggcttatgtggctgggaaacctattatgtcggatgaagagtatgataaattgaagcagaaactaaagatggaagggagtgaaattgtggttgagggtccacggtgcagtctccgtagcagaaaggtttacagcgacctgtcagttgactacctcaaaatgctccttttgaatgtgccagcaactgttgttgcacttggattgtttttcttcctggatgatatcactggatttgaaatcacatatcttttggagcttccagagccattcagtttcatttttacatggtttgctgcggtgcctttgatagtatatttatctcaatcactcacaaaactgatcgtaagagaatctttgatcttgaagggcccctgtccaaactgtggtacagagaatgtttctttctttgggaccatactatcaatttctagtggtggaaccaccaacactattaactgctcaaattgtggaaccaccatggtttatgactcaaacacaaggttgattacattgcccgaaggcagtgaagcttaatcaaggagcaaccaataagaagcggtccttcgactttaactaactcttgaagtcggatgtgaagagtgttaaattatgtagatctatccctcctgtggaaagagagaagttatatggtttgcttcgctgtgggctcaattatgtcaatattgtatttgtaagtatatgcgtcatatacatacctgtagcaggcttgtttgcaggaacagaagatgatccattttgttgtaattaatattcagttctagtgttatatcgcaaatcaaacccatttgagcatgcttgtcactctgaacctctttccttttatggtgataattgtcactttttatagtgtgttaatctctgaatcatttaaagcagatctctgaaacatttgaagcaggccagtctaatgcacttgtaggctcgtaacagtatttgaacaactagaactgaagctgccttggatatttatgttatcaattagatggataactgaccatgaaaaatggcaactgctcggacattcaaccagcggtgtggttcaattttaatgctgtggatggtcatactcac

SEQ ID NO: 5306 - DNA, 1096 bp, Brassica juncea
ctcagctcagccctggaagatcggttcccttgagaaaaagattcttcttgttgcctgcaaaagccaccgcagagcaatcaggtcaagcgggaggagaagacgtggatagcaacatcatgccttattgtagcatcaacaaggctgagaagaaatcaattggtgaaatggaacaagagtttctccaagccatgcaatcgttctattacgatggcaaagcgatcatgtcgaatgaggagtttgataaccttaaagaagagctcatgtgggaaggaagcagcgttgtcatgctaagttctgatgaacaaaggtttttggaagcttcgatggcttatgtttctggaaatccaatcctcaatgataaagaatttgatcagctcaaactcaaacttaagatggatggtagcgagattgtgtctgagggtccaagatgcagtctccgtagcaaaaaggtgtatagtgatctcgctgtagattacttcaaaatgctcttgctcaatgttccagcatccgttgttgctctcggactgtttttcttcttggacgacattacaggttttgagatcacatacatcttggagctttcagagccatttagtttcatattcacgtggttcgctgccgtgcctttgatcgtatacctggcttcacaaatcaccaaactgatcatcaaagatttcttaatcttgaagggtccttgtccaaattgtggaacagagaatgtttccttctttggaacaattctttcaatctccagcggtggcaaaaccaacaatgtcaaatgcaccaactgtggaaccgccatggagtatgactcgggttctaggctgatcaccttgccagaaggaagctaagtttgaatcctgtgagatgaagatggagaaaagaagaatgggttttgtcagaagcaaaaatggatatgatgcctgtatattttaagatcttccatgttagctctctatctccttcacatgttttctgatttgtaagtactgtgtaatcaataagggaaatatttaatgaatacttcttcaccaacctttcataggtgtgatatgatagttaattcagacttcacttaaaaaaagcctgatatcaa

SEQ ID NO: 5307 - DNA, 1447 bp, Phaseolus coccineus
tccataatcctcctttccctccaaacaaaacaaacaccaccactttctttcaactttcccagctacactgcactactttgattcacaacaaccaccatcaccatgttcacggctagtaaactagccttcatgttaacactccctcgtccatgcactgcacccttgacaccaatctcttccttgtcttcttcttctccttctggtatccacctcattcacttcaatggacgccacttatgcctccgccgcaggctatttctactttctcctaaggccactgcagatcaacaaggcagggttggtgactttgaagatgatgcaaatactgttgatagtaaaatcctcccttattgtagcatagacaaaaaagagaagaaatcaattggtgaacttgagcaggactttcttcaagcgctacaagcattctattatgagggaaaggctatcatgtctaatgaagaatttgataatcttaaggaagaactcatgtgggaaggaagcagcgttgtcatgctaagttctgatgagcaaaaattcctggaagcttctatggcctatgtgtctggaaaaccaattatgaatgacaaagagtttgatgagttgaaactgaggctaaagattgaagggagtgaaattgtggctgagggtccaaggtgcagtcttcgtagtagaaaggtttacagtgacctatcggttgattatttaaagatgctcctgctgaatgtcccagctacagtgattgcattaggactgttcttcttccttgatgatctgactggatttgagatcacatatctgctagagctgccggaaccttttagtttcattttcacatggtttgctgcggttcccctcattgtgtggatagctttgacactgacaaatgccattgtaaaagactttgtgattttaaagggtgcctgtccgaactgtggtactgaaaatacctctttctttgggactatactgtcaatttcaaatggtggttccacaaacactgtcaaatgctccaactgtggcactgcaatggaatatgattcaactacaagattgattacattaccagaaggaagtaatgcctaagtagaggtatgcttgaaatcatatttattgttccagcaatgggtggtgatcaataatagaagttcttgggagagtgacagagaaaatggtcttggaagtcatgttatcactgtcacacacaactggtgtcatctcaattctatgtgccaccatcgtacttgtaagtatatggtgtttgtatacttgtaagtaatatggacattgtatagcatacactggattgtctttactcaagagttgagtgatgagggtgcttaacaccatcgataagactaacttagaataatgtgtgtacttaaggatttctgtttcacacttgtgcaaaattttccttctactactgaggccacgccctttgcatccc

SEQ ID NO: 5308 - DNA, 980 bp, Ricinus communis
tttcaccattccgaatggctagcaaattagccttctctttgactttccctcgtgtctactctgctcctattctgaaaccactcatttctttatcttcttcgtcaagaattcactccagtcacctccacggaaagcatttatctgttcgtcgcagaattcttttgcttccaatcaaagctactgctgatcaacaacaaggtaaagtggaaggagatgaagtcgttgatggtaaaattctgcagtactgtagcatagacaagaaagataaaaagtcaataggtgaaatggagcaggagtttcttcaagctctgcaagctttttactatgagggaaaagcaataatgtcgaatgaagaatttgataatctcaaggaagaactaatgtgggaaggaagcagtgttgttatgctaagttgtgatgaacagaagtttttggaagcctcaatggcttatgtatcaggaaatccaattatgagtgatgaagagtttgatcaattgaagctaagattgaagcaagaaggcagtgagattgtagtagagggtccgcggtgcagtcttcgtagtagaaaggtttacagtgatctatctgttgactacttaaaaatgttcctgctgaacgtccctgccgctgttgttgcactaggcttgttttttttcttggatgatcttacaggatttgaaattacatatcttttggagcttccagagccattcagctttatcttcacatggtttgctgcagtgcctgtcatagtctggttatctctgtctttcacaaatgcaattgtgaaagatttcttgatcctgaagggcccatgccccaactgtggtactgaaaatcagtccttcttcggaacaatattgtccatttccagtggtggtaccaccaacagcgtcaaatgctcaaattgtggaactgatatggtgtacgattccaagacacgattgattacactgccagaaggaagcaatgcttgatta

SEQ ID NO: 5309 - DNA, 1484 bp, Ricinus communis
gcagatttcttagagctccaacagcaaactatttgatcttttgaaaatacagttagatttccctccacacatttctccattgccttatcctttcactttctctgccttcttcctttctttcttttttctttccctccaaacaaaaagaaaatataatcacagaaacccattaacaaaaatcacagcatctgcacacctgaaaccgtagtttcaccattccgaatggctagcaaattagccttctctttgactttccctcgtgtctactctgctcctattctgaaaccactcatttctttatcttcttcgtcaagaattcactccagtcacctccacggaaagcatttatctgttcgtcgcagaattcttttgcttccaatcaaagctactgctgatcaacaacaaggtaaagtggaaggagatgaagtcgttgatggtaaaattctgcagtactgtagcatagacaagaaagataaaaagtcaataggtgaaatggagcaggagtttcttcaagctctgcaagctttttactatgagggaaaagcaataatgtcgaatgaagaatttgataatctcaaggaagaactaatgtgggaaggaagcagtgttgttatgctaagttgtgatgaacagaagtttttggaagcctcaatggcttatgtatcaggaaatccaattatgagtgatgaagagtttgatcaattgaagctaagattgaagcaagaaggcagtgagattgtagtagagggtccgcggtgcagtcttcgtagtagaaaggtttacagtgatctatctgttgactacttaaaaatgttcctgctgaacgtccctgccgctgttgttgcactaggcttgttttttttcttggatgatcttacaggatttgaaattacatatcttttggagcttccagagccattcagctttatcttcacatggtttgctgcagtgcctgtcatagtctggttatctctgtctttcacaaatgcaattgtgaaagatttcttgatcctgaagggcccatgccccaactgtggtactgaaaatcagtccttcttcggaacaatattgtccatttccagtggtggtaccaccaacagcgtcaaatgctcaaattgtggaactgatatggtgtacgattccaagacacgattgattacactgccagaaggaagcaatgcttgattagaggatcagtcaatttacgggatactgataatacacaggtgctactacctcgtaaagttggaagtgagcaatgtcaccttatatggatggagagggaactttcagatgtgtactctgtaatgcatctctactgttatgttaatattgtaattgtaagtaaatgcttcatacatcgacctttgataggcttccagtaaaagatgagatcaaacttgtaatcgtgctgtatagtttagccaaattgcgaatcacattgaatgactgatggtacttgagtagtcataattatcagcata

SEQ ID NO: 5310 - DNA, 1410 bp, Citrus sinensis
  misc_feature (236)..(236): n is a, c, g, or t
ccacgcgtccgcatcaccatgcatctcgctacatcaccagctacacactctattactagtattttcacctgaaaccgaaactaccatctctattttcaaatggctagcaaagtagcctctggttttacccctcaggctcagcgcgtcttcgctgtccctgtgcaaaagccagctgcagccttggttcctttttcatcctcttcaagggctcactcaaattcaaatactcagttcantggaaggcagttttctgttcgacgcagatcttttgtactgcccagcaaggctactactgaccaacaaggtcaggttgagggagatgaggtagtcgatagtaaaattctgcaatattgtagcattgacaagaaagagaaaaagtcattgggtgaactagaacaagagtttcttcaggcactgcaagctttctattacgagggaaaagctgttatgtcaaatgaggaatttgataatcttaaggaagaactgatgtgggaaggaagcagcgtcgtcatgctaagttctgctgaacaaaagtttctcgaagcttcaatggcttatgtggctgggaaacctattatgtcggatgaagagtatgataaattgaagcagaaactaaagatggaagggagtgaaattgtggttgagggtccacggtgcagtctccgtagcagaaaggtttacagcgacctgtcagttgactacctcaaaatgctccttttgaatgtgccagcaactgttgttgcacttggattgtttttcttcctggatgatatcactggatttgaaatcacatatcttttggagcttccagagccattcagtttcatttttacatggtttgctgcggtgcctttgatagtatatttatctcaatcactcacaaaactgatcgtaagagactctttgatcttgaagggcccctgtccaaactgtggtacagagaatgtttctttctttgggaccatactatcaatttctagtggtggaaccaccaacactattaactgctcaaattgtggaaccaccatggtttatgatgcaaacacaaggttgattacattgcccgaaggcagtgaagcttaatcaaggagcaaccaataggaagcggtccttcgactttaactaactcttggagtcggatgtgaagagtgttaaattatgtagatctatccctcctgtggaaagagagaagttatatggtttgctttactgtgggctcaattatgtcaatattgtatttgtaagtatatgcgtcatatacatacctgtagcaggcttgtttgcaggaacagaagatgatccattttgttgtaattaatattcagttctagtgttatatcgcaaatcaaacccatttgagcatgcttgtcactctgaacctctttccttttatggtgataattgtcactt

SEQ ID NO: 5311 - DNA, 1654 bp, Quercus alba
tcgatatgtatttgtaactacgtgacaaaaagccgttgcatttccctccacacattcccacattgccttatctaaatctttgtgctgtctttgtttccctccaaacacaaactatcccaaatcaaatgcaccaaacttcaacaatccccacctgggaaccacatcatactcttcgatcaatccctccatacctaccatagttttagctcttaactcctacccttccacttctaatggctgccaagttagccattacttcaacatcccctcagttacacactgcccctattaaaagacccttagttcctatttcttcgtttgtgtcttctttgtcttcttatacaagagctcaaacagttcaattcaatggaagacacttgtgccttcgacgccaagttttggtacttcccacgaaggccacagctgaccaacaagaccaggttgaaggaagtgatgttgttgacggtaaaatccttccatattgtagcatagacaaaaaagagaaaaagtcaattggggaacttgaacaagagtttcttctagcactacaatcattctattatgagggaaaagctatcatgtcaaatgaggaatttgataatctcaaggaagaactgatgtgggaaggaagcagcgttgtcatgctaagttctgatgagcagaagtttcttgaagcttcaatggcttatgtagctgggaaaccaattatgaatgataaagagtatgataatttgaagttgaggctcaagtcggaagggagtgaaattgtagttgagggtccacgatgcagtctccgcagtaaaagggtttacagtgacctgtctgttgactatttgaggatgttcctgttgaatgtcccagcgaccgtcgttgcattaggattgtttttcttccttgatgatattaccggatttgaaattacttatctactggagctccctgagccattcagtttcattttcacatggtttgctgctgtgcccctccttgtttggctagctctctcacttacaaatgtgattgtgaaagattttttgatcttgaaggggccatgtccaaactgtggtactgaaaacacctccttctttgggaccatactatcaatttctagtggcggtaccaccaacagtgttaaatgcacaaattgtggaactgagatggtatatgactcaaacacacgcttaattacattgccagaaggaagtaatgcttgattcaaggatcaatacattttaagggatttgcaatatcacagttactaacctatgacgttggagatgaagggctaagggcttcacgttgaagatagagataaagcgtttcacgttatgtatatatatcctgagtcatcgtttgtgaaggggggaaatttttagtgttgtaaactgaatcgcaactcaaccgttcattgtgttgatattgtatttataagtaaatctgtatgacaattgtgttgatagtgtatttataagtaaatctttgctcgtacttatacctattacaggctcacacagggaagagaagggtgtgttacttgaatgaacatcctatatatctaataaaattatgtatgtgaattgttatttcaatccaacccaccccacacccccctcttctcttttgtataaaaggtacaacacaattaactaaaacg

SEQ ID NO: 5312 - DNA, 1406 bp, Fragaria vesca
tctgagatgaacagaaagaaaccgttgcatttccctccacatattcccttatcttcttcctcccatttctttccctccaaacacaacaaaaaaaaaaaaaaaaaaaaaaaaaaaacggaataacccaaaaatcttaggcctccgttttaccactcagctctgtctgtaaactacacaattggtgacccttttgaatcattcagccatggctagcaaactagccttcaccctagtagctcctactcgctctactactactactactaatccttctattcagagaccctttgtttcagtttcgtcttcctccaccagagttcagtcgtttcagttcggcggccggcagctctgcgtacgacgtcgtttgctcgtgattccctctaaggctgccgccgacaaacagcaaggaaatgaggacgttgttgatggtaacgtcctgccatactgtagcatagacaagaagcagaagaagtcattgggagaaatggaacaagactttcttcaagcactacaatcattttattatgatggaaaagctattatgtcaaatgaggaatttgatattctcaaggaagagctaatgtgggaaggcagcagcgttgtcatgctaagttctgatgaacagaagtttttggaagcttcaatggcctatgtgtctgggaaaccaattttgagcgacaaagagtttgatgaattgaagatgagactaaaggagcaagggagtgatattgtcgttgagggtcccagatgcagtctccgtactagaaaggtttacagtgatctgtctgttgactatttgaagatgcttctgctgaatgtcccagccactgttgttgccttaggattgtttttcttcttggatgatctcactggttttgaaatcacatatcttttggagctcccagaaccattcagcttcatcttcacatggtttgctgccgtgccagtcatagtttatctagccacacaactcaccaaacttattgtcaaggatgttctgatcttaaagggcccttgtccaaactgtggtacagagaatcagtcattctttgggtcgatactatcgatttcgaacggtggtactaccaacaacttaaagtgctcaaactgtggaactgcgttggtatatgataagactacgcgcttgattactttgccggaaggaagcaatgcttagattagaaccgaaacttgggagtgcttatattgatcctcaactcaattacgtagcattaagtaaattcataatcagcacttgtatcgtgtaagtgtttttcttgtgctgaagaataagctcgacagttgcttttggtaaaagatccacaagttgattgtgaatacctcaacagttgattgtgaatatgaatacacagaaaaaaagtattatgatcggatagttcaacttt

SEQ ID NO: 5313 - DNA, 1563 bp, Eucalyptus grandis
atcttcacaatctgtctctctttccctccaaatatcaactcaagaaacgcgagatgcaataaaagaaacgatgaattggccgtcaattaacgctgatcttcctggcctgttcagtttcttcgcttcacaccacgtacaagccgagcttctcccttgacttggtatttggacatggccaccaccaagttaggggctaccctgacatgccaccgtctgttcactaggcccgctcggaagccctcgattgctttcgggtcgtccgttcccggcgcggcgtcatgttcttcctcttcttcgagggcccgacccttcgatggacggcagctgggggtccgggggcgtgtcctcgtgatcccggtgaaggctactgctgatcaacaaggcaaggtagaagagggcaaggtagaagagggagagtccgatgtcgaagatagcaatgttctgccatattgcagcatagacaagaaagagaagaagtccatcggtgaacttgaacaagactttcttcaagcaatgcaagcattttactatgaagggaaagcagtcatgtcgaacgaggaatttgacaatctcaaggaggagctcatgtgggaaggaagcagcgtcgtcatgctatcttctgctgagcaaaaatttttggaagcttcaatggcctacgtgtctggcaatccaattatgagtgatcaagaatatgacgacctgaaattgaaactgaagactgagggaagcgaaatcgttgtcgaaggcccacgatgcagtctccgcagccgaaaggtctacagtgacctttctgttgattacttcaagatgttgctgttgaatgtcccagcgactgttgttgcgcttggactgttcttcttcctggatgatataactggatttgagatcacatatcttttggagctgccggagccatatagtttcattttcacatggtttgcggctgtgccagtcatagtctggctggctctatcactgacgaatgtgattgtgaaagactcgctcatcttaaagggtgcctgccccaactgcggcacagagaatgtctccttctttggcaccatactgtccatctctaacggtggtacaactaacaatattaaatgctcaaactgcggaactgaactggtgtatgacaagaaaacacggttgattacgttgcccgagggaagccaagcttgatgagagggtcaattattgctcaagtgtttacaagatgaacgtgcctgtgcgagattcagattcaacatgcaccgtgttatggaaagccgagaaaattgctaccgcgtcatgaccttggttttgaggagaaagaaacaagacagttgtacaatatctgtcagtataacaatgattaattgcgagtgatgttaatatgtcgaatttcagttacatgctgccagtaaatacctatgatagcatcttaattagcaccgagaaaagagcgtacaaatggtttttggatgaaagatcatgtatctaaaagttctcgtacttcagcctcagtttgccataataattcttcaacttctcgctttctctttgagaactaggaaaacaaaa

SEQ ID NO: 5314 - DNA, 1410 bp, Vigna unguiculata
  misc_feature (131)..(131): n is a, c, g, or t
ggactgcactgttttcattcacagcgaccaccaccatcaccatgttcacggctagcaaactagccttcattttaacactccctcgtccgtgctctgcacccttcgcaccaatcccttccttgtctccttcntcttcttctccttctggtgtccacctcattcacttcaatggacgccactcatgcctccgccgcagactgtttttactttctcctaaggccacggcagatcaacaaggcaaggttagtgaatttgaagaggatggaaacattgttgatggtaaaatcctcccttattgtagcatagacagaaaagagaagaaatcaattggtgaacttgagcaggactttcttcaggcactacaatcattctattatgagggaaaggctatcatgtctaatgaagaatttgataatcttaaggaagagctcatgtgggaagggagcagcgttgtcatgctaagttccgacgagcaaaagttcctggaagcttctatggcctatgtgtctggaaacccaattatgactgacaaagagtttgatgagttgaaaatgaggctaaagatagaagggagtgaaattgtggctgagggtccaaggtgcagtcttcgtagtagaaaggtttacagtgacctatcggttgattatttaaagatgctcttgctgaacgtcccagctacagtgattgcattaggactgttcttcttccttgatgatctgactggatttgagatcacatatttgctagagctgccagagccttttagtttcattttcacttggtttgctgcggttcccctcattgtgtggatagctctgaatctaacaaatgccatagtaaaagactttgtgattttaaagggtccctgtcctaactgtggtactgaaaacacctctttctttgggactatactgtcaatttcaaatggtggttccacaaacactgtcaaatgcaacaactgtggcactacaatggaatatgattcaactacaagattgattacattaccagagggaagtaacgcctaaggggaggtgattctagcgatcattcataaaagttcttgtgaaagtgacaaattaatcatttagtaaattgccatgtacgtgagaaaatggtgttggaagtgatgttatcaccatcacacacaactggtgtcatctcaattgtatgtgccaccatgtacttgtgagtatatggtctttgtatacttgtaagtaatatggactttgtatagcataaactggattgtctctgcttcaagagttgagttatgagggtgcttaacaccatcgatcagattaacctacaataatgtgtgtgtaaggatttttgttacacacttgtgcaaaatttttcttctattattgaggcaagaacctgatatgaaaaaagtaatacaatttttcc

SEQ ID NO: 5315 - DNA, 907 bp, Salvia sclarea
acagcaatgtcttgccttattgcagcttagataagaaacagaaaaggactcttggtgagatggagcaggagtttcttcaagcacttcaagcattctactacgaaggaaagtctgtcatgtctaatgaggaatttgatgtcctcaaggaagaactcatgtgggaaggaagcagtgttgtaatgctaagtgctgatgaacagaggtttttggaagcttcaatggcttatgtatctgggaacccaattatgtcggatgaggaatatgataaactgaaacaacaacttaagattgacgggagtgaaatcgtggttgagggacctcgatgcagtctgcgtagtaaaaaggtttacagtgacctttctgtcgactacctcaagatgtttcttctgaatgtaccagcagcagttgttgcactaggattgtttttcttccttgatgatttgactggatttgagatcacttatctcttggagcttccagagccattcagtttcattttcacgtggtttgccgctttgccactcatactatatctggctttcacctttacgaacatcatcataaaagactttctgatcttagtgggaccatgtccaaactgtgggacggagaacacttcattctttggtaccatattgtccatatctaacgggggaaccattaacaaagtaaaatgctcgaactgtggtacggacatggtgtacgattctaagtcacggttgattacgctgcctgaaggaagtgaggcttgaatcgaggtatgcaagtcttcaagagctgatgtgattggaggggactacaagaaaacaaacctattgcgacatacacgtatgcgacattacatgtatatatcgtaaatgtgctacacttatgcttttaatgtcgtatatttaagttaattgtgcgt

SEQ ID NO: 5316 - DNA, 1402 bp, Cucurbita pepo
gcaatttccctccacacattttcgcattgccttatctttctttccctccaaatcgagccacagtcttccaacactcatcaaattcctgtttgttttctcttcttcttctccctttggccatggcgaccaaattgacgttgtcgttagcgtccttgagttcgcttactgttccgattcagaatcagaaaccggcagcttctctattttcgtcttctgcaaggtcccaattgattagggtttctagccggcgtgtgcttcttcgacggcgggtgcgtcttccacctccccgggcaactactgatcaaccaggtcaggttggggaagatgatgttgtcgatagtaatgtccttcaatattgtagtatagacaaaaggagaagaagtccattggagaacttgagcaagaatttctccaagctttacaggcattctattatgagggtaaagcaattatgtcaaacgaggaatttgataatctcaaggaagaattaatgtgggaaggcagcagtgttgtaatgctaagttctgatgaacaaaagtttttggaggcctcaatggcatatgtatctggaaatccaattttgacggataaagaatttgacgaattgaagatgagacttaagatggaagggagtgaaattgtggctgagggaccccgttgcagtctccgaagtcgaaaggtttatagtgatctctctgtggactactttaggatgttcctcttgaatgttccagccactgtagttgcactgggactgttcttcttcctggatgatatcactggatttgaaattacatacttgttggagctcccagagccattcagtttcatcttcacttggtttgctgctgtgccattcctagtttggttagctcttacccttacaaatgcagttgttagagactctttgatcttgaagggcccttgtccaaactgtggaactgagaatgtctccttctttggcaccatattgtcagtttcaagcggtggcaaaacaaacaatctcaagtgctcaaactgttcaactgagctggtgtatgactcgaaaacccgcctgatcacattaccagaaggaagcaacgcataagttagaggatttgtaagctgtaattccaggagaaacaagaccaaagggatcatcatatggaagctacaagaattctccatggttgaatatgaaggatattatgatgcttaaaaccctgccttgtagagagaaatttttagcagttgtgcaacattgtatcttgatgtacaaatttgtgaatactcatcatgtacacactatacctagagaagggtgtgatgaagtttcaccaataaaatataattaatgtatgtaaatcagaaaacaaaaaaaaaaacaaaaaagactctgcgtcataccacgtgcgttactacg

SEQ ID NO: 5317 - DNA, 796 bp, Scabiosa columbaria
aagctataatgtccaatgaggaattcgataacctcaaggaagaactaatgtgggaaggaagcagtgtcgttatgctaagctctgatgaacagaagtttctggaagctgcaatggcatatgtgacggggaaacctataatgactgatgcagagtatgacaaactcaaaatgcaactaaagatggatgggagcgatattgtggctgagggcccaaggtgcagtcttcgtagtagaaaggtttatagtgacttatacgtcgactatctcaaaatgttcctgctgaatgtccctgctgctgtagttgcactgagtttatttttcttcctagatgacttgactggctttgaaattacttaccttttggagctacctgagccattcagtttcatcttcacctggtttgctgctatacccctcatactgtatctatcgttttccatcaccaacgttgttatcaaagacttcttaatcttaaagggcccatgtcctaattgcggtactgagaacacttccttttttgggacaatactatcgatatctagtggtggttccaccaacaccatcaaatgctccaattgcggaacagcgatggtgtatgattccagcaaacgtttgataaccttgcctgaaggaagtagtgcttgaaacagaggacataaacaaggaaatggacgaagaacaagtggtgctaaaaagagggatgttggtttcgctgtaatttgtgaagctattgttgtatgatgttgatatgtaactatagcatacatgttcatatgaaatgaatacatattactaag

SEQ ID NO: 5318 - DNA, 1345 bp, Manihot esculenta
tcataacaagcaaattgcaacccattaaccaaactaatctccatatcatactctcaccttcagtttcacgattccaatggctaccaaattagccttctctttgacttctcctcgtgtctcctctgctcctctccggaaaccattcagctctttatcttcttctccttgttcttcttcttcaagggttcagtccattcagctcattggaaggcatttctctgttcgtcgcagaatctttttgcttccaatcaaggcaactgctgaccaacaaggtcaggtggaagaaaatgaggttgttgatagcaaaattctgcaatattgtagcatagacaagaaagacaaaaaatcaataggtgaaatggagcaggagtttcttcaagcattacaagcattttactatgaggggaaagctataatgtcaaatgaagaatttgataatctcaaggaagaactaatgtgggaaggaagcagtgttgttatgctaagttctgatgagcagaagtttttggaagcttcaatggcttatgtatctggaaaacccattttgagtgatgaagagtttgataacttgaagctaagattaaagcaagaaggcagtgaaattgttgttgagggtccacgatgcagtctccgtagtagaaaggtttacagtgacctctctgttgactatttaaagatgttcttactgaatgtccctgccactgttgttgcactaggcttgtttttcttcttggacgatctcactggatttgaaatatcttatcttttggagcttccagagccattcagcttcatcttcacatggttcgctgctgtgcccctcatagtttggttatctcaatctttcacaaatgcaattgttaaagactttttgatcttgaagggcccttgtcccaactgtggtactgagaaccagtccttctttggaaccatattgtcagtttcaagtggtggtaccaccaacaatgtcaaatgctcaaattgtggaactgatatggtgtatgattcaaagacccgattgattactctgccagaagggagcagtgcttgatttgaggagcaatccaatttatgggatcatagaataaaaatgctactaactcataaagttggaaggaagaagtgtcaccttatgcataattttgggtgacagttgtggaggaaaagtaaaaattttcagaagtgtactttgtaattaatgtatctccatggtgtgttaatattgtactttgtaaggaaatgcttgatatatacatccacctatatattacaggcatgtccattggaagaagatgagatcagaattgtaatgttgctgttgtatatatagattagccttgttacc

SEQ ID NO: 5319 - DNA, 1420 bp, Rhizophora mangle
ggttcagacgcagaaaagaaaatatcctcaaagcgaagcaaaatggaatgcacccattaactcaaaatcaccatatcagaaaccaaaagcaccacaggctcaactgaatctaaatctaatatggggtcatcaatggctagcaaactagccttgactttgacttctcctcgtgcatccttcaccgctcctattccaaaaccatccagctctgtaccctcttcttcttctgctcctttttcttctcttacaaaggttcagttcaatggaagacagccttgtcttcgacgccgtatgttcctacttcctgtcaaggccactgctgaccaacaaggccaggtcaaaaaagatgagatagttgatagtaatgttctgcaatactgtagcatagacaagaaaaaaagaagtctttgggtgaaatggagcaagagtttcttcaagctctacaggcattctattacgagggaaaagctataatgtcaaatgaagaatttgataatctgaaggaagagctgatgtgggaaggaagcagtgttgttatgctaagtgctgatgaacagagatttctggaagcctcaatggcttatgtgtctgggaagccaatcttgagcaatgaagaattcgataaattaaagcaaaaattaaagtcagaaggcagtgaaattgtagttgagggccctcggtgcagtctccgaagtagaaaggtttacagtgacctatctgttgactacctcaaaatgttcctactgaatgtcccagcaactgtaattgcgcttggcttgtttttcttcttggatgatattactggatttgaaatcacctatctcttggagctcccagaaccattcagctttcttttcacatggtttgctgccgtgcccttgatagtgtggtcggctctgacacttaccaatgccatcgtgaaagactctttgatcctgaagggtccttgccccaattgtggtacagagaatctatccttctttggaaccatattgtcaatctcgagcggtggctccatcaacactgttaaatgctcaaattgtggaactgaaatggtgtacgattcgaatactcggttgattacactgccagaaggaactgaggcttaaaatagaggacagggatgtacaagacagctactgctaactccagagatgggggaacatgttgtctcctttatatgcaaattgagttataaattgccaagaggatgctttcagattgtatctcggttctccatcattgtactgccgctgtatattgtattccaaagatgaagtatgtacatgctttatacatgaagtattccagggccttttccagtggaacataagagcagaaatagttgtatatcttaatcctcctacaaagcatacccttctgaatagctgtgaatataatgggtaaggttatatttatc

SEQ ID NO: 5320 - DNA, 1280 bp, Thellungiella halophila
  misc_feature (4)..(4): n is a, c, g, or t
  misc_feature (833)..(833): n is a, c, g, or t
  misc_feature (974)..(974): n is a, c, g, or t
  misc_feature (1207)..(1207): n is a, c, g, or t
aagnaattaaaaaaaaaatctcaaaatcagaacaaacctgaagctcacagtaacaaacgcatcttcaaccacaagctcctgcaaaaaatttcccggaaaacagaggaaaaggatctcctttactctcctagggaaaatgggcagcaagacgttgttcagtttgacaagccctcgacttttctccgccgtttctcgcaaacccaccgtttctttctctcctccgtcgtcgtcgaggtctcagtgggctcagctcagccctggaagatcgatttccctgagaagaagattcttcttgttgcctgcaaaagccaccacagagcaatcaggtcaagtggaaggagaagaagtcgatagcaatattaatgcttattgtagcatcaacaaggctcagaagaaatcaattggtgaaatggaacaagagtttctccaagccttgcaatcgttctattacgatggcaaagcgatcatgtcaaatgaggagtttgataaccttaaagacgagttgatgtgggaaggaagcagtgttgtgatgctaagttcggatgaacaaaggttcttggaagcttcaatggcttatgtttctggaaatccgattctgaatgatgaagaatatgataagctgaaactgaaactaaagatggatggtagcgacattgtgtgtgagggtccaagatgcagtctccgtagtaaaaaggtgtatagtgatctcgccgtagattatttcaagatgctcttgctgaatgttcctgctaccgtcgttgctctcggcctattcttctttctggacgacattacaggttttgagatcacatacatcttggagcttccggaancattcagcttcatattcacgtggttcgctgctgtgcctttgattgtatatctggctctatcaatcaccaaattaatcatcaaagacttcttgatcttgaagggtccttgtccgaattgtggaacggagaatgtctccttcnttggaacaattcttacaatctccagtggcggtaaaaccaacgctgtcaaatgctccaacaatggagtatgactcgggttctcggttgatcacattgccagaaggaagccaagcttgaaggctgtgaggtgaagatgggaaaagaagaatgggttttgtcagaagcaaaatagatattgatggttgtatatttaagatcttccatgttagctctttcctccttcacatgttttntgatttgtaagtattgtgtaagcaataagagaaatattttatgaatacttcttctatcaaccttttgtagtga

SEQ ID NO: 5321 - DNA, 1207 bp, Juglans hindsii x Juglans regia
  misc_feature (47)..(47): n is a, c, g, or t
  misc_feature (249)..(249): n is a, c, g, or t
  misc_feature (380)..(380): n is a, c, g, or t
  misc_feature (440)..(440): n is a, c, g, or t
  misc_feature (476)..(476): n is a, c, g, or t
  misc_feature (479)..(479): n is a, c, g, or t
  misc_feature (503)..(503): n is a, c, g, or t
  misc_feature (515)..(515): n is a, c, g, or t
  misc_feature (527)..(527): n is a, c, g, or t
  misc_feature (542)..(542): n is a, c, g, or t
  misc_feature (554)..(554): n is a, c, g, or t
  misc_feature (570)..(570): n is a, c, g, or t
  misc_feature (574)..(575): n is a, c, g, or t
  misc_feature (596)..(596): n is a, c, g, or t
  misc_feature (613)..(613): n is a, c, g, or t
  misc_feature (615)..(615): n is a, c, g, or t
  misc_feature (620)..(620): n is a, c, g, or t
  misc_feature (626)..(626): n is a, c, g, or t
  misc_feature (635)..(635): n is a, c, g, or t
  misc_feature (638)..(638): n is a, c, g, or t
  misc_feature (686)..(686): n is a, c, g, or t
  misc_feature (713)..(713): n is a, c, g, or t
  misc_feature (722)..(722): n is a, c, g, or t
  misc_feature (725)..(725): n is a, c, g, or t
  misc_feature (728)..(728): n is a, c, g, or t
  misc_feature (746)..(746): n is a, c, g, or t
  misc_feature (755)..(755): n is a, c, g, or t
  misc_feature (758)..(758): n is a, c, g, or t
  misc_feature (761)..(761): n is a, c, g, or t
  misc_feature (764)..(764): n is a, c, g, or t
  misc_feature (767)..(767): n is a, c, g, or t
  misc_feature (770)..(770): n is a, c, g, or t
  misc_feature (773)..(773): n is a, c, g, or t
  misc_feature (1114)..(1114): n is a, c, g, or t
  misc_feature (1197)..(1197): n is a, c, g, or t
  misc_feature (1199)..(1199): n is a, c, g, or t
  misc_feature (1204)..(1204): n is a, c, g, or t
tttcacacaaaccctgcatcacagctcctccgtacccaccatcgttnttattgctgatcatcttcactaccacccttcaacttctaatggctaccaagttagcctttactttatcttccccaagtttgcacccgccctctgttagaagacccttgtctcctatttcttcatcggtttcttcgttgtcttcctctataaggtttcagtcggttctgttcaatggaaggcacatacgtcttcggcgccgangtttggtgctacccacccaggccactgctgatcaacaagaccaggttgaaggtgcccaagggggcgaggttgtcgacagcaaaatcctgccatattgtagcattgacaaaaaagagaagaagtcagttggngaacttgaacaagagtttctgcaagcactgcaagcattctattatgagggaaaagctatnatgtcaaatgaggaatttgataatctcaaggaaganttnatgtgggaaggaagcagcgttgtnatgctaagttcngatgaacagaantttcttgaagcttcnatggcttatgtngctgggaaaccaattntganngatgaagagtatgatcaattnaagttgcggctaaagantnaaggnagtganattgttgtnganggtccacgatgcagtctccgaagtagaaaggtttacagtgacctgtcngttgactatttgaagatgcttctgttnaacgttccngcnacngttgttgcattaggattntttttcttnctnganganctnacnggntttgagattacatatctactggagctccccgagccattcagtttcatattcacgtggtttgctgctgtgcccctcttagtttggcttgctctctcactcacaaatgtgattgtgaaagatttcttgatcttaaagggtccatgtcctaattgtggtactgagaatggctccttctttggcaccatactatcaatttccagtggcggtactaccaacactctcaaatgctcaaattgtgaaactgcgttggtatatgactcaaagacacgcttgattacgttgccagaaggaagtaatgcttgattggaggcacgcacgcacgcaccctgtcaaaggatcantccagtttatgcgatccgatagttactgacctatgaagtttggagatgaagggtttcacgttatgtatatacccatggtcatntntgtanagc

SEQ ID NO: 5322 - DNA, 2890 bp, Cannabis sativa
aaaaaaaaaaaaaagtctttccttgagtctcagactcagaaactcagcctctacttctctaactctttcatacccagaaattcttttagcaaatatcataaaaaaaaaaaacctctctctgtgtgtctttctttgacctcttctaatggctagcaagttagcctttactttaacttcaccaaggcgcccttttacaactattattcaaagaccctttgctccactctcttcgtctagcaccaccaaagttcaatcttttcacttcactggacgacagctttgccttcgtcgtaggctctcagtgattccctccaaggccactgctgaccaagaaggcaaggttgaagaagatggggttgttgatagcaagatcctgccttattgtagcatagacaagaaagagaagaagtctctgggagaacttgaacaagactttcttctagctttacaatcattctattatgagggaaaagcaataatgtcaaatgaagaatttgataatcttaaagaagaactaatgtgggaaggcagcagtgttgttatgctaagtggtgatgagcagaggtttttggaggcttcaatggcttatgtatccggaaatccaattatgagcgatgaagactatgataaactgaaattaagactaaagagtcaagggagtgacattgtagttgaaggccctcgttgcagtctccgtagtaaaaaggtttacagtgatctttctgtggactatctcaagatgttcttattgaatgttccagcaactgttattgctctaggattgttttttttcctggatgatgtaactgggtttgaaattacttatcttctggagctgccagagccatacagtttcattttcacatggtttgctgctgtaccactcatagtatggctagctcaaacgctgacgaatgcgattgtgaaggactttttgatcttaaagggcccttgccccaactgtggaacagagaatacttccttctttggaaccatattatcgatttccaacggtggtactagcaacacagtcaaatgctcaaactgttcaactgaaatggtatatgactcaaactcccgcctgattaccttgccagaaggaagcaatgcttgatttacaggtacatatttcagatgcatcgttcaacttctatttttcagggtaatgcattttacgagatcaaaggcttttatcagtgtcactgtagccaatgatgtcacaagacctgtattcatcatcgttttagtggagaaggaaaatagtcttcatttttgtgcagttcagtgacatcaaatgtatggactgtgaatattgtacacgtgtatctatgcttctttacaataaccaaaagcctatttgtaagggtctaaaggtgtttaaaatggggagggaaagaattaaattattaacataactaagcaggctccttaactgaaaaatagattatgcaatcatagtgatggaatttcacatataataacatcacttgtaaaaatccctagctccggttccttttgttttttcacttacaagagcctttactccagtcccgctgaatgatatttctttaaaatagcctctgattcccttctctcagttttttttctgcttccaaattccccatgtaaaactaaaagactaacaatatcatatatagagttttttctttgatattatgaaaattttgatcacaaaatattcgaaacaaggtgaataagcatgcaggcaccatatgaaattaagtatagcttttaagcagtaaaagtacaagcacaattatagttcaactgtattaagcttaaatgttttaacatccttaaacctacaaatcagcacttgcaaggcactagagcataggaaaaaacatggcatataaacaacacctctgcacagccaaacaaccaaaaagctaacaaatcaaaggccccttcctaatcaaacctggaacactagcttagaaaattcgtccacgagttcatcctctataggatggcaacatccaagtaatctccaatctgcatcatcaaaacaatcgcaggtaaaaacatagtagaaatccacatggaaacagggtcttttttctttatggattacattgaacagggcacgtttcttgactcccccagcatattaccgcaatatatagcttagctatcactattatacaagtcaatttcgaaatagagctagtactcttctaatgctaaccaaccatctagtaaaacgggttgaaattgaaacatcagtcatgattaaacaaaaattgcttcctacctggaagtcaagttcacccaaggcctttccatcatctactcgtctcccatttccaaaggagtgtgtcattccaacctaaagaaaaaagccaataaaaaccacaacatcttagtaacaaaagaaataatggaaaaaccatattaagatataatagatttggacttctactcactagccactgaagtgtaaaaaacaacaaaagcttctaattcactataccagtttcaacacaaaacgaccacgtttatcggggtatacaaatgcaaaagacaattttgcatttcttctccttgcagctggagctacttctttcacctggaaaacaactaggatcaatcagagaaccagcagtgtagcataaatttagtcacacaaacgtgaaaatgttacttcttggggtcaatggtttgaaccacatacaagatcagttagctcacgaagagttgcatctttccaagtgtaaatttgaacctcatctttaggttctttgcctcttactgcaaaatcttcttcactatggtgacctccaatctacaacacaagaaaagccccatgagactttaccaataaatatttacttatatctttcactgcccatttacgcaacaattatgt

SEQ ID NO: 5323 - DNA, 1465 bp, Citrullus lanatus
caatttcccattttcccattttcccattttcccattgccttatcttcctttccttccaaacagggagggaaaattcatccaccttcttccaataatcctaaacaattttctgctccattttccctctcccatggcgaccaaattgacgctctccttaccgtcttcgagttcgctcactgttccgattcaaaatcagaaaccggcagcttctctgctttcgccttcttcaaggtcccaattggttagggcttctagccggcgattgttccttcgccgccgactggttcttccccctccccgggcagctactgatcaaccaggtcaggttgagggagatgaggttgttgatagtaatgtccttcaatattgtagcatagacaagaaggagaaaaagtccattggagaacttgagcaagaatttctccaagctttacaggcattctattatgagggtaaagcaattatgtcgaatgaggaatttgataatctcaaggaagaactaatgtgggaaggcagcagtgttgtaatgctaagttctgatgaacaaaaatttttggaagcttcaatggcatatgtatctggaactccaattatgacagataaagaatttgacgaattgaagctgagacttaagatggaaggaagtgaaattgtggtcgagggtccccgttgcagtctccggagtagaaaggtttatagtgacctttctgtggactactttaagatgttcctcttgaatgttccagccactgtagttgcactgggattgttcttcttcctggatgatatcactggatttgaaattacatacttgttggagcttccggagccattcagtttcatcttcacttggtttgctgctgtgccatttctagtttggttagctcttacccttacaaatgcagttgttagagactctttgatcttgaagggaccttgtccaaactgtggaactgagaatatctctttcttcggcaccatactgtccgtttcaagcggtggcaacataaacaacatcaagtgctcaaactgtgcaactgagctggtttacaactcaaaaacccgcctgatcacattaccagaaggaagcaacgcctaagtgagaggatttgttagccgtaattccaggagaaacaagaccacggggatatcataaggcagctacaagaattctccatggttagatatgaatgatattaagatgtttaagccctgcctttagagagaggatttttcagctgttgtacaacattgtatcttgatgtacaaatttgtgaatattcatcatgtataaacgatacctagagaagggtgtgatgaagtttcagaatgccatccaataaaacataattcatgtatgtaaatcatcaatctagttgaatatttcaaaactaaaatttggagttgaacaggatagagaagtatttcctttgagaaatgaagtttctattatacatagagatct

SEQ ID NO: 5324 - DNA, 2019 bp, Theobroma cacao
atttccattagcttttcaagaaaaaagacgctagaccgggctccaaaagactagatggggacccatgggctatattagcctcagccttgcccagaccgagaaatgaagcccaagaaaacgaccaccgcagatgatgacgtggcagattttgtaagatcaaaaatcggttatcctttgcagcaggacacaagaggaaagaccgttgcatttccctccacacgttcctcgcttgccttatctttgagcagcctctctttccctccaagaaaaaaaaaaaaaaagattgaaacaaattaaattacaaagctccatcatcatcagcttgagtctcaccacctgataccagcaaaataaataaataaataagtaaataaaatccaatagctccatagcgttaacagattgagctcttggttaattattcctttaattaatttcaatggctggcaaattaacctttagtttgacaccccctcgtttgttcaccgccccttttcaaaagcccttagttcctttctcttcatcttcttctaccagggttcaatccaatggaaagcagctatgtgttcgacgcagattgttcttacttcccaccaaggctactgctgatcaacaaggccagcttggagaagatgaggttgttgatagtaaaattctgccatactgtagcatagacaagaaagagaagaagtccttgggtgaaatggagcaagagtttcttcaagccctacaagcattttactatgagggaaaagctatcatgtcaaatgaggaatttgataatctcaaggaagaactaatgtgggaaggaagcagtgttgtcatgctaagttctgatgagcagaaatttctggaagcctcaatggcttatgtttctgggaaaccaattttaagtgatgaagaatttgataaactgaagcagaggctaaagatggaaggaagcgaaattgtggttgagggtccacgatgcagtctccgtactagaaaggtgtacagtgacctatctgttgactatttgaagatgttcctcttgaacgtcccagccactgtggttgccctaggattgtttttcttcctagatgatctgacgggatttgaaatcacatatattttggagctcccagagccattcagctttatttttacgtggtttgctgctgtgcccgcattggtttggttagctcaagcccttacaaaagtggttgtgaaagactctctgatcttaaagggcccttgcccgaactgtggtactgagaatgtctccttctttggcaccatactgtcggtttccagtggtggaaccaccaacaatcttaaatgttcaaattgtggaacaccattggtgtatgattcgaatacgcgattgattacattgccagaaggaagtgaagcttgattggaggtatataccatgcttatgtatgcttcccctggaatcccttcttggataactttcacgtatcagatggtacctaatatctgttagaattttcttcttcatatgtacttgctaaaacaaagggaccaaacaattattcatggattcattatgctgaaaatgataagttacgttagacttcagacacaaataactgtaatttactttgcatctctttctggggcagtgttattcccacgttaacagacacagccatggctgcaggataaattatacccaaggatccacagtaagactgccattaactcgtaaacttggagtgaagagtgtgtcgtatgttcgtaaacatggtgggtcatcattcgcagcgcaggtggaaattttgacatgtgctgcaatgtagaaggtatatcagttgtatgttgtgtcaaatactttatttgtaagtaacatgtaatatatttatgactgtaacaggcatgttgacaggaagagaggagagccaaaatgttgtcgtgagaatctttaaatcaataaaaatcatgttctatgtaatgccttttatcagctgtaattcatatactgttatactgtcatttaaatatactagtgagtaaata

SEQ ID NO: 5325 - DNA, 1364 bp, Gossypium hirsutum
cccaaataacccacctggcttccccatgccttattcatcatcatcatcatcaatggctagcaaattggctttcactttgatgcctcctcgtttcttcactgcgactattcaaaaacccgtggtttgtttctcttcctcttcttcttcttcttcttcttcttcttcttcttctaccagggttcaacccagtgggaagcatctatgttttcgacgccgattgctcttactacccctcaaggctactgccgatcaacaaggtcaggtcgaaggagatgaagttgttgatagtaaaattctgccttactgtagcatagacaagaaagagaagaagtctttgggtgaaatggaacaagagtttcttcaggccctacaagcattctattacgagggaaaagctataatgtcaaacgaggagttcgataatctcaaggaagaactaatgtgggaaggaagtagtgttgtcatgctaagctctgatgaacagaagtttctagaagcctcaatggcttatgtatctgggaaaccaattttgagtgacgaagaatttgatgagttgaagatgaggctaaagatggaaggaagtgagattgtggttgagggtccacgatgcagtctccgaagtagaaaggtttacagtgacctatctgttgactatctcaagatgttcctcttaaacgtcccagcgactgtagttgcactaggattgtttttcttcctagatgatctcaccggattcgaaatcacataccttttggagctcccagaaccattcagtttcattttcacttggtttgctgccgtgcccttgatagtttatttagcacaatcccttacaaaagtggttgtgaaagactctttgatcctaaagggcccttgcccaaactgtggtactgagaacgtctccttctttggcaccatactatcaatttccagtggtggaaccaccaacactcttaaatgttcaaattgtgaaaccacgttggagtataatgcgaaaacgaggttgattacattgccagaaggaagccaagcttgattgcaggagaaagtacttccagagatcaacatcaagaatgctactgactcataaagttggagtgaagagtgtgatgtatgttgtaaacctagtgggttatgatgtgcagctaagtaggaaattttgattaagtgctgcattgtaaaacatgtatctgttgtgtttttttatgtggaacactctatttgtaattaaacatgtaatatatatacatatttatacctaaacaggcatgttgacaagaagagaagagagcaaaaaagttgtgaaaatctttaaatttaatgaaaaccatactttatgcaatgttttgaaagagtttagtttc

SEQ ID NO: 5326 - DNA, 1231 bp, Ipomoea nil
atatttccgccaccatttctctcccaccaccgccaccgctatcgccgccgcaaatggccactaaacttgtctactctctaaccactccccggtttcttcatgcatcgtttaaaagaccattcatttctgcgccttccgcttctttgccttctgcgtctaggctcccgttgatttattttgctggaaggaagatctccgttcgccggaggtttttggttctatgccctaaggctactaccgatcagccaggtcaggtccaggaagatgaagttgaagttgacagtaatgtcttaccctattgcagcatagacaggaaagagaagaagtctctgggcgagatggaacaagattttcttcaagcattacaagccttctattatgaaggaaaggctatcatgtcaaatgaagagtttgataacctcaaggaagagttaatgtgggaagggagcagtgttgtcatgctaagtgctgatgaacagagatttttggaagcttctatggcatatgttgcagggacaccgattatgtcagacaaagagtttgacaaactaaagatgaaacttaagatggatggtagtgatattgtggttgagggtccacgttgcagtcttcgcagtaggaaggtttacagtgacctctcggtggactatctgaagatgttcttacttaatgttcctgctgctgttgtagcgctgggattgttcttcttccttgatgacttgactggattcgaaatcacttaccttttggagcttccagagccattcagtttcatcttcacgtggtttgcggctttgcctttcattctgtggctatctttttcaatcacgggattcattgtcaaagatttcctgattttaaagggtccctgtccaaactgtggtacggaaaacacttcattttttggtaccatattgtcagtatctagcggtggttccagcaacaacgtcaaatgcacaaattgtgggacagacatggtatatgattcaagcacgcgtttgattacattgcctgaaggaagtagtgcatgagaaagatatcgggaaaatggatagcagaagtgcgagttggtcgcatgatatagcagattatgtatttggatgaatgtatgagatgagaaataactggtgtctgagatgttagatactgttatatggtttgtatgtgaatgtgtagctatatcatgtatattcataactaaagagatggaaaaatctcgtagctcaaattt

SEQ ID NO: 5327 - DNA, 2203 bp, Cucumis melo
aacgtttttccctccacacattttcccattgccttatctttctttccctccaaacagcgagggaagaagaatccaatcatcttcttccaataatttctaaaacgaaattctgctcgattttccctctccaatggcgaccaaattgactctctccttaccctcctcgagttcgctcgctgttccgtttcagaatcagaaaccggcagttcctctgcttccctcttcctcaaggtcgtcgtcccaattgattagggtttctagtcgccgcctgttccttcgccggaaagtcgttcttccacctcctcgagcaactactgatcaaccaggtcaggttgagggagatgaggttgttgatagtaatgtccttcgatattgtagcatagacaaggagaaaaagaccattggagaacttgagcaagaatttcttcaagctctacaggcattctattatgagggtaaagcaattatgtcaaatgaggaatttgataatctcaaggaagaactcatgtgggaaggcagcagtgttgtaatgctgagttctgatgaacaaaagtttttggaagcttcaatggcatatgtgtctggaaatccaattatgacggataaagaatttgacgatttgaagctgagacttaagatggaagggagtgaaattgtggttgagggtccccgatgcagtctccggagtagaaaggtttatagtgacctttctgtggactactttaaaatgttcctcttgaatgttccagccaccgtagttgcactgggattgttcttcttcctggatgatatcactggatttgagattacatacttgttggagcttccagagccattcagtttcatcttcacttggtttgctgctgtaccatttcttgtctggttagcgctcacccttacaaatgcagttgttagagactctttgatcctgaagggaccttgtccgaactgtggaactgagaatgtctccttctttggcaccatactatcagtttcaagtggtggcaacacaaacaatatcaagtgcacaaactgtggaagtgagctggtttacaactcaaaaacccgactgatcacgttaccagaaggaagcaacgcctaagtgagaggaatcgttaactgtaattccgggagaaacaagaccaagggatatcataaggtattgcaagaattctccatggttggatatgaatgatattaagatatttaaaaccctgccttgtagagagaggatttttccagctgttgtacaacattgtatcttggtgtacaaatttgtgaatactcatcatgtataaacgatacctagagaagggtgtgatgaagtttcaaaatgccatccaataaaacataattcatgtatgtaaatcatcaatctagttgaatatttcaagaatttgcagtagaacggaaaggaaaagtatgtcctttgagaaataaagtttctattatacatagagatctaacaatacaatctctggggaaataagaggtcattaaataatggcaaatcgtacaagaaccagatgaccgaatgaaaattcacaatcaatacaatctattcttctacctctcatgacatctcaatatagaaaataaaaaatgcagaacagaatcgatactacagagggcgccaaatccaatcttctaaggtagcaaacaaataacactcgctctccaactaattaacagcatgcttcaacataaccaagatttctacaggattgcaacgtccaaatagtctccaatctggaagtccaattcacccaatgccttgctatcatctaatctcctcccatttccataagaatgtgtcatccccacctgttttaaaacaaatcgaccacgcttgtcgggataaacaaaagcaaaagaaagcttcgcatttcttcttctagcctctggagcaacctccttaactagatcggtcagctcccggagtgttgcatctttccatgtataaatctgaacctcatctttgggttccttacccctaattgcaaaatcctcatcggtatgatgacctccaaccttagtaaaaacgcgaagcaacaaagggcaagtcttttcgcggtcgacgggttcgaaacgaggacgaggattcggcggcggagctttggtctgagacggtggagggagtggccgccctgacggtctcccttgcgtcggagcagctgcagctccgctcgtcttctcatctctg

SEQ ID NO: 5328 - DNA, 820 bp, Raphanus sativus
ccgatgaacaaagattccttgaagcttcaatggcttatgtgtctggcaatccaatcatgactgatgaagaatacgacaagctgaaaatgaaactgaagatggatggaagtgagattgtgtgtgagggtccaagatgcagtcttcgtagtaaaaaggtttacagtgatcttgcagtagattatttcaaaatgttcctgttgaatgtaccagcaaccgttgttgctctcggactgtttttcttccttgatgaccttacaggttttgaaatcacttacttgctcgagcttccggaaccattcagtttcattttcacatggttcgctgcggtgcctgcaattgtgtatctggcgctatcactcaccaagctgatcatcagagactccttgatcttgaagggcccttgtccaaactgtggaactgagaatacctccttctttggaactatactatccatctccaatgatggttccaccaacaatgttaaatgctccggatgtggaacggcgatggtctatgactcaagtactcgtttgatcacattaccagaaggaggcaatgcttaaacctatgggccaaggtttcatttatcagggagatgtatgtaaaattgatactaatagatgaagaaggtggaaaagttaagcaaaagggtaattttgtgtgcttttataatcttcagatgtttccgtgtagctctcgttgacttgtattgtgtgttgtaagtaaatgtgaggtgaaatcagagaaagaacaccatgtgattacttctttggggaatttcactctcactagaaaaataaaatgaaaaaatggcacaaca

SEQ ID NO: 5329 - DNA, 1296 bp, Amsonia hubrichtii
gaatggctaccaaacttgggttcactataacaatccctcgtgtctactctgccccttttaaaaaaccatttatttctgtctctttttctccccttttgcagtcttctgcttcgaaggttcagccattttgttttaatgggggaaagctaccgattcagaggaaattgttgcttctttcacctaaggctactactgatcagccaggtcaggttaaaaaagatgaagttgaggacagtaatattatgccctattgcagcatagataggaaacaaaagaaatctctgggtgagatggaacaagactttcttcaagcacttcaagcattctattatgaagggaaggctataatgtcaaatgaggagtttgataacctcaaggaagaattaatgtgggaagggagcagcgttgtcatgctaagtgctgatgaacagaggtttcttgaagcttcaatggcttacgtatctggaaaaccaataatgtcagatgaagagtatgacaagctgaagatgcagcttaagatggatggtagtgatattgtgtttgagggtccacgttgcagtctccgtagcagaaaggtttacagtgatctctctgttgattatctcaagatgttcctcttgaacgtacctgcagccgtggttgcattgggattgttcttcttccttgatgatttgactggattcgaaatcacataccttttagagcttccagagcccttcagtttcattttcacgtggtttgctgccttacccttcatattgtggttatcttttacgcttacaaggattgtagtgaaagactttttgatcttaaagggcccctgtcccaactgtggcaccgagaacacctccttcttcgggaccatactttcaatatccagcggtggttccatcaacagtgtcaaatgctcaaattgcgggacagatatggtgtacgattcaactactcgcttgattacattgcctgaagtaggtaaagcatgagtgaagcatgaactttcttcagagaggtctgcaacaaggctcagaactaacaagagttttgcacgaggaagccaaggcatagtatgcatgtctagtttcaatctctacaagtggactgaggttgcggatgttgaaatgtgaagctgcataacagtttgcgtgtgaatgtaattgtttcctgtatatggctaaaattatctgtaaagtcacactttgtatgcaacgtgacagaatttggtatactcagacaaaagtttttcttaaaatggacttaaacactagtttacaaataaatagttgttttgttgtattc

SEQ ID NO: 5330 - DNA, 1368 bp, Humulus lupulus
tcattctttgagtctcagactcacaatctcagcctctacttctccagctctttcatacccagaaaatctcttaacaaaatatcataagaaaaccttctttctctctgtctctctctctctctctgacctcttctagttctaatggctagcaagttagcctttactttaacttcaccaaggcgccctttcactacaattattcagagaccctttgctccaatctcttcttccagcagcacaaaggttcaatcgtttcacttcactggacgacagctttgccttcgtcgtaggctctcggtgattcccaataaggccactgctgatcaagaaggcaaggttgaagaagatgagattgttgatagcaaaatcctgccttattgtagcctagacaagaaagggaaaaagtctttgggagaacttgaacaagactttcttctagctctacaatcattctattatgagggaaaagcaataatgtcaaatgaggaatttgataatcttaaagaagaacttatgtgggaaggcagcagtgttgttatgctaagcggtgatgagcaaaggtttttggaggcttcaatggcttacgtatccggaaatcccattatgagcgatgaagactatgataaactgaaaataacactaaagagtcaagggagtgatattgtagttgaaggccctcgttgcagtctccgtagtaagaaggtttacagtgacctatctgtggactatctcaagatgttcttattgaatgttccagcaactgttattgctctaggattgtttttcttcctagatgatgtaactgggtttgaaattacttatcttctggagctctcggagccatacagtttcatttttacgtggtttgccgctgtaccactcttagtatggttagctctgacgctgacgaatgcgattgtgaaagactttctgatcttaaagggcccttgccccaactgtggaacagagaatacttccttctttggaaccatattatcgatttccagtggtggtactaccaacacagtcaaatgctcaaactgtgcaactgaaatggtgtatgacgcaaacacccgcttgattaccttgccagaaggaagcaatgcttgatttgcaggcacataattcagatgcagaatatttactattcagtggtaatacattttacgggatcaaaggctgtgtcactgcagccaatgatgtcacaacacatgtattcatcgttcgtggagaaggaaaatagtcttcatttttgtgcagtttagtgacatcagatgtatggactgtgaatattgtacacgtgtatctatgcttctttacaataaccaaaagcctatttgtaaggtttaaagagttaagaaagggaga

SEQ ID NO: 5331 - DNA, 1293 bp, Humulus lupulus
gctctttcatacccagaaaatctcttaacaaaatatcataagaaaaccttctctttctctctctctctctttctctgacctcttctagttctaatggctagcaagttagcctttactttaacttcaccaaggcgcccttttactacaattattcagagaccctttgctccaatctcttcttccagcagcacaaaggttcaatcgtttcacttcactggacgacagctttgccttcgtcgtaggctctcggtgattcccaataaggccactgctgatcaagaaggcaaggttgaagaagatgagattgttgatagtaaaatcctgccttattgtaacatagacaagaaagggaaaaagtctttgggagaacttgaacaagactttcttctagctctacaatcattctattatgagggaaaagcaataatgtcaaatgaggaatttgataatcttaaagaagaacttatgtgggaaggcagcagtgttgttatgctaagtggtgatgagcaaaggtttttggaggcttcaatggcttacgtatccggaaatcccattatgagcgatgaagactatgataaactgaaaataacactaaagagtcaagggagtgatattgtagttgaaggccctcgttgcagtctccgtagtaaaaaggtttacagtgacctatctgtggactatctcaagatgttcttattgaatgttccagcaactgttattgctctaggattgtttttcttcctagatgatgtaactgggtttgaaattacttatcttctggagctctcggagccatacagtttcatttttacgtggtttgccgctgtaccactcttagtatggttagctctgacgctgacgaatgcgattgtgaaagactttctgatcttaaagggcccttgccccaactgtggaacagagaatacttccttctttggaaccatattatcgatttccagtggtggtactaccaacacagtcaaatgctcaaactgtgcaactgaaatggtgtatgacgcaaacacccgcttgattaccttgccagaaggaagcaatgcttgatttgcaggcacataattcagatgcagaatatttactattcagtggtaatacattttacgggatcaaaggctgtgtcactgcagccaatgatgtcacaacacatgtattcatcgttcgtggagaaggaaaatagtcttcatttttgtgcagtttagtgacatcagatgtatggactgtgaatattgtacacgtgtatctatgcttctttacaataaccaaaagcctatttgt

SEQ ID NO: 5332 - DNA, 1285 bp, Solanum lycopersicum
tcaagttcttttttttcacaaatgcaatattcatttctacactccatccatctccatctccaccaccacctccgccgcagtcgccgccacaaatggccaccaaatttggatttactataacaacaagtagtcgactttttcatgctacttttaggaaaaaaacaattttttctccaaattctgttagccctttgattaattttggtggaagaaagttatctattcgacgtaggctattggttctctctcctaaggccaccgccgatcagccaggtcagctcagggaggatgagattgaagatagtaagatcttgcagtactgtagcatcgacggtaaaggaaagaagtctctcggggaaatggagcaagagtttcttcaagcactacaatcattctattatgaaggaaaggccatgatgtcaaacgaggaattcgataaccttaaggaagaactaatgtgggaaggaagcagcgttgtcatgctaagccccgatgaacagaggtttctcgaagcttctatggcttatgtatcaggaaatccaattatgactgataaagaatatgacaagctgaagatgaaacttaagagggatggtagcgatattgtggttgagggtccaaggtgtagtcttcgaagtagaaaggtttacagtgacctttctgttgattatctgaagatgttcttgttaaatgtccctgctgctgttgttgctcttggattgtttttcttcctagacgatttgactggattcgagatcacttatcttttggagcttccggagcctttcagtttcattttcacatggtttgctgctttgccattgatactatggctatcctttacaatcacaaacgccattgttaaagattttctgatcttaaagggcccctgtccgaattgtggaacagagaatacttccttctttggtacaatattatcggtatctaatgggggttccagcaacaaagtaaaatgctcaggttgtgggacagacttggtctatgattcagaaacgcgtttgattacattgcctgaaggaagtagtgcatgattcgaggatgattttatatgtggtgatatctgcagaagagatttgctctttataacacaatctgcatggaagaaagaccatatgatgcagtttgtgaaaatgaaaaacaaattcagtgttgaatttgtgaatgatttgcaacttgtattgtgtgaatatgttatggaatgtattgtgtgtgacttataagtatatcaataataataataaaaaaattaacagttgttagtgaa

SEQ ID NO: 5333 - DNA, 951 bp, Solanum melongena
taaaattttacagtattgtaatcttgacaggaaacaaaagaaatctatgggggaaatggaacaagagtttcttcaagcactacaagcattctattatgaaggaaaggccataatgtcaaatgaggaatttgataacctcaaagaagaacttatgtgggaagggagcagtgttgtcatgctaagtgctgatgaacagagatttttggaagcttctatggcctacgtatctgggaatccgattatgactgataaagagttcgacaagctgaagttgaaacttaagatggatggcagtgaaattgttgccgagggtccacgatgcagtctccgtagtagaaaggtttatagtgacctttatgttgattacctgaagatgttcttgctgaatgttcccgcagctgttgttgcgcttggattgtttttcttcctcgatgatttgacaggatttgaaatcacttatcttttggagcttccggagccattcagcttcattttcacgtggtttgccgctttgcccttcatattgtggctatcctttacaatcacaaatattatcattaaagattttctgatcttaaagggtccctgtccgaattgtggaacagaaaatacctccttctttggtactatattatctatatctagtggaggtaaaaccaacaaagtgaaatgcacaaattgtgctacggagatggtctatgattcagccacacgcctaatcacattgccggaaggaagtagcgcatgaaatctagggtgatatgtgtgtgagacacctgcagagagattgcactaacacaatttgcatgggaaagagattcatatcaatatgtacatgatgagagcagtttgtaaaaataaaaaaccatttcttatgctaaatggtggatgctttgcaacttgcagtgtgtcaatatgtagttaaaataatgtatgtatataccataggct

SEQ ID NO: 5334 - DNA, 1375 bp, Lotus japonicus
atccaatttcacttgatagcaccactacacagtaatcaccatcattcatcaccaccatggctagcaaattagcatccacattgacataccagcgtccattcaccgccacaacacaaccaacatcctcaatttctactccccgggctcaccttgttcaatttaatggccgccgcaacgtatgccttcgccgccgccggctactcttgctctcccccaaggcctctgctgatcaacaagggaaggttgagaaagatgctgttgatagtataaaagagaagaaatcaataggtgaacttgagcaagattttcttcaagcactgcaggcattctactatgagggaaaggctattatgtcaaatgaggaatttgataatctcaaggaagaactaatgtgggaagggagcagtgttgtaatgctaagttctgatgagcaaaaatttcttgaagcagctatgggttatgtgtctggaaaaccaatcatgagcgataaagagtatgatgaattgaaactcaggctaaagatggaaggcagtgaaattgtagctgagggtccacggtgcagtattcgcagtcgcaaggtttacagtgacctgtctattgactacttgaagatgttcctgctaaacgtgccagcaactgtggttgccctgggattgttcttcttccttgatgatgtgactggatttgagatcaattctctgatagagattccagagccttatagcttcattttgacttggtttgcagctgtccccttcattgtatggctggctcagtcaattacaaatgccattataaatgactttctgattttaaagggcccatgtcctaactgtggcactgaaaatacttccttctttgggactatactgtcaatttcaagtgggaattctaccaacaaagtcaaatgtgttaactgtggtactgcaatggtgtatgattcaagtacaagattgattacattgcctgaagggagtaatgcctgagtggagggacacacaggcatgcttttgtcatatcattgttccaacgttgagatgtgatcaccatcggtgcagaagctacttaattacatacgaagctagttactaatttatcaagtcaggaatctgccatggtgatcccctaattaatcaaggccaatatcactatcatacttgtaatcaaatgagatttgtatagcatatttaggattgtccattttgattgattccgacctggaactatcataataagtctgcaaagatctgtgcgtaaaatctttagaaagtcagctgaggccttgcttcagttgtttgcttatagacttcaaggaaaatatgcaatacactgtggttgagcagggtgtatcaatgcatgccgattctcatctgca

SEQ ID NO: 5335 - DNA, 1189 bp, Capsicum annuum
ccttttgctccctcttgatcactccctctaccaccatcatcatcatcaccaccgccgcagtcgccgcgataaatggccaccaaatttgggctcactgtaacaacaaacacacacctttttcatgcaccttttaggaaaaaaccaagtttttctccatcttcaaaggttcagttgattagttttggtggaagaaagttgtcgattcgtcgaaaactattggttctttctcctaagggcactaatgatcagccaggtcaggttaaggacgatgagattgaagacaggaaaatcttgcagtattgtagcattgacaggaaagggaagaagtctctcggcgaaatggagcaagagtttcttcaagcactacaatcgttctattatgaaggaaaggcgatgatgtcaaatgaagaattcgataaccttaaggaagaattaatgtgggaagggagcagtgtcgtcatgctaagccccgatgaacagaggtttctggaagcttcgatggcttatgtatctgggaatccaattatgacggataaagagtatgacaagctgaagatgaaactcaagagggatggcagcgatatagtggttgagggtccaagatgcagtcttcgaagtagaaaggtttatagtgacctttctgtcgattatctgaagatgttcttgttaaatgtccctgctgctgtcgttgctcttggattgtttttcttccttgacgatttgactggattcgagatcacttatctcttggagcttccggagcctttcagtttcattttcacttggtttgctgctttgcctttcatattatggctatcgtttacgataacaaacgccattgttaaagattttctgatcttaaagggcccttgtccgaattgtggaacgggaaatacttccttctttggtacaatattatcggtatctaatggtggttccagcaacaatgtaaaatgctcaggttgtgggacagacatgatctatgattcagagacacgtttgatcacgttgcctgaaggaagcagtgcatgattcgaggatgatttgcttcaacacaggttgcatggaagagaccatatgatgcagtttgtgaaaatgaaaaacaagttcagtgttgaatttgtgaatgatttgcaatttgtattgtgtgaatatgttaatgtaaaatgtaatgtgtgtgattataagt

SEQ ID NO: 5336 - DNA, 1500 bp, Populus trichocarpa
cacaaaaacgacacccccgttaaccaaaatccacgatacaaactctcaccagaaaccacaccacagagtaaccatactgttcttttttcccttctgtttcaatggctagcaaattagccttcaatttgacatctcctcgagtcttcactgctcctattcaaaaaccaatcatctcttcatcttcatcattgccatccttatcatctccttcttgctctaccagggttcaactcaatggaaaacagttttctcttcgcggaagaatgctttttcttcctaccaaggccactgctgaccagcaaactgatcaagtccaagaagatgacatggatgatggtaagatcctgcaatattgtagcatagacaagaaaggcaagaagtcgttgggtgaaatggagcaagattttctgcaagcgctacaagcattttattatgaggggaaagctataatgtcaaatgaagaatttgataatctcaaggaggaactaatgtggcaaggaagcagcgtggttatgctaagttctgatgaacagaagtttcttgaagcctctcttgcttatgtatcagggaatccaatcatgaatgatgaagagtttgataaactgaagatcaaattaaagacagaaggcagcgaaatagttgttgaaggtccaagatgcagtcttcgtagtagaaaggtttatagtgacctgtctgttgactatttgaagatgttcctgctgaacgtcccggcaactgttgttgcactaggcttgtttttctttttggatgatctcactggttttgaaatcacttatcttttggagctcccagagccgttcagtttccttttcacctggtttgctgcagtgcccctcattgtttggttagctctgacactaacaaatgcgattgtgaaagactttttgatcttgaagggcccctgtcccaactgtggcacggagaacggctccttctttggaaccatattgtctatttcaagtggtggagcctccaacacccttaaatgctcaaattgctcaactgaattggtgtacgattcaaaaacacgcttgattacactgccagaaggaagcgaagcttgattagaggaactgtccatttaagggatatacagtacaactgctactaacttgtaagtttggcagcgaagagtttggcgaacaaccgtggaggagagattttcagatgctgtgtacactggagtgtatcctagtgattgtgctaatattgtatatgcaagtatgtacatgttttatatatacatcgacctatcacaggcttgttaattagaagctgagagcagtttgcatgttatgagctctataatccgctgagtgtgtgctggaataatgaattattctcttgctgttatcattggcaaaaggaacaccacagttgctgcttggctgggttttttttccggcacagctaacacccaatactagaactatgacaaatctaatgttttcacaagttcatcgatttccttggtgccaa

SEQ ID NO: 5337 - DNA, 1299 bp, Prunus persica
acccaaattcagatcaccaaaaatcagataacccaaaatcttggtctccatttactgctctgctcattctgtagacagaggattactggtctttttctcacttccaatggccaccaaattagccttcaccttaacatctccaaccccttttaatccctctagtcagagaccctttgtttctgtttcttctccctccacaagggttgagtcttttcagttcagagggaggcagctatgtctccggcgccggcttctggttcttccctctaaggctactgctgaccaacgacaagacaaggttgaagacgaggaagtttttgatggcaagatcctgcaatattgtagcatagacaagaaagggaagaagtctttgggtgaacttgaacaagactttcttcaagctctacaatcattctattatgatggtaaagctattatgtcaaacgaggaatttgataatctcaaggaagaactaatgtgggagggcagcagcgttgttatgctaagctctgatgaacagaagtttttggaagcttcaatggcctatgtgtctgggaaaccaattctgacagacgaagagtatgataaactgaagatgaggctaaagacggaagggagtgatattgtagttgagggtcccagatgcagtctccgtaccagaaaggtttacagtgacctgagtgttgactatttgaagatgctcctgctgaatgtcccagcaactgttgttgccctagcagcgttcttcttcctggatgatgtaactgggttcgaaatcacgtatcttttggagctgccagagccatacagcttcattttcacatggtttgctgctgttccagtcatagtttatttagctcaggcactcaccaaactgattgtgaaggatgttctgatcttaaagggcccttgtccaaactgtggtacagagaatgtgtccttcttcgggaccatactatccatttcaaacggcggtgctaccaacaccattaaatgctcaaactgtggaactccgttggtttatgattcaaatacgcgtttgattacattgccagaaggaagcaatgcttgattagaatttggaacttgggagtacgtatattatctacccaactcaattatgtagcataaaaagtaatgcataaatcagcacttgtactgtgtaagtggtttcttgtgctgaataatatactcgaacggtagttttttcttcttatttggatcttcgaaaatctcagcagttgattgtgaatatgaatacaaggagagaagatatcatgatcagatagttcagctttc

SEQ ID NO: 5338 - DNA, 1302 bp, Nicotiana tabacum
  misc_feature (422)..(422): n is a, c, g, or t
  misc_feature (1200)..(1200): n is a, c, g, or t
  misc_feature (1203)..(1203): n is a, c, g, or t
  misc_feature (1230)..(1230): n is a, c, g, or t
  misc_feature (1240)..(1240): n is a, c, g, or t
  misc_feature (1251)..(1251): n is a, c, g, or t
aatgcaatattcatttctacttaccctacttccacttcactccctccaccaccaccactgctgctgccgccgccgtcgccgccacaaatggccactaaatttgggtttactataactagccctcgcctttttcatgcccctttcaggaaaaaacccattttttcttcatcttctgcttctttacaaggtgcttcattttcttgttcaaagcttcgtttgattaattttggtggaagaaaattagctattaggcgtaggttattggttctctctcctaaggccacgactgatcagccaggtcagctcaacgagaatgaggttgaagacagtaaaatcttgcaatattgtagcattgacgggaaaggaaagaagtctttaggggaaatggagcaagagtttcttcaagcactgcaatcattctnttatgaaggaaaggcgatatgtcaaatgaggaattcgataaccttaaggaagaattaatgtgggaagggagcagcgtcgtcatgctaagcacggacgaacagaagtttctggaagcttctatggcttatgtatctgggaatccaattatgactgataaagagtatgacaagctgaagatgaaacttaagagggatggcagcgatattgtggttgagggtcctcggtgcagtcttcgaagtagaaaggtttatagcgacctttctgttgattatctgaagatgttcttgttaaatgtccctgctgctgttgttgctcttggattgttctttttcctcgacgatttgactggattcgagatcacttatcttttggagcttccagagcctttcagtttcattttcacatggtttgctgctttgcctttgatattgtatctatcctttacaatcacaaatatcgtcgttaaagattttctgatcttaaagggcccttgtccgaattgtggaacagaaaatacttccttctttggtaccatattatcgatatctagtggtggttctaccaacaaaataaaatgctcaggttgtgggacggacttggtctatgattcagacacgcgtttgatcacgttgcctgaaggaagtactgcatgattcgaggatgattatatatgtggagagtggagacatctgcacaatagattgcactagaacaagttgcatatattggaagtgccaaataacatacatgagtcaaggttgtaaaaatgaaaagcanttncagtgttgaaattgtgaatgttttgcnacttgtattntgtccaatatnttatgtaatgtgtgagtataagtatatcaatacaaaaaattaacaaccttt

SEQ ID NO: 5339 - DNA, 1286 bp, Solanum lycopersicum
tcaagttcttttttttcacaaatgcaatattcatttctacactccatccatctccatctccaccaccacctccgccgcagtcgccgccacaaatggccaccaaatttggatttactataacaacaagtagtcgactttttcatgctacttttaggaaaaaaacaattttttctccaaattctgttagccctttgattaattttggtggaagaaagttatctattcgacgtaggctattggttctctctcctaaggccaccgccgatcagccaggtcagctcagggaggatgagattgaagatagtaagatcttgcagtactgtagcatcgacggtaaaggaaagaagtctctcggggaaatggagcaagagtttcttcaagcactacaatcattctattatgaaggaaaggccatgatgtcaaacgaggaattcgataaccttaaggaagaactaatgtgggaaggaagcagcgttgtcatgctaagccccgatgaacagaggtttctcgaagcttctatggcttatgtatcaggaaatccaattatgactgataaagaatatgacaagctgaagatgaaacttaagagggatggtagcgatattgtggttgagggtccaaggtgtagtcttcgaagtagaaaggtttacagtgacctttctgttgattatctgaagatgttcttgttaaatgtccctgctgctgttgttgctcttggattgtttttcttcctagacgatttgactggattcgagatcacttatcttttggagcttccggagcctttcagtttcattttcacatggtttgctgctttgccattgatactatggctatcctttacaatcacaaacgccattgttaaagattttctgatcttaaagggcccctgtccgaattgtggaacagagaatacttccttctttggtacaatattatcggtatctaatgggggttccagcaacaaagtaaaatgctcaggttgtgggacagacttggtctatgattcagaaacgcgtttgattacattgcctgaaggaagtagtgcatgattcgaggatgattttatatgtggtgatatctgcagaagagatttgctctttataacacaatctgcatggaagaaagaccatatgatgcagtttgtgaaaatgaaaaacaaattcagtgttgaatttgtgaatgatttgcaacttgtattgtgtgaatatgttatggaatgtattgtgtgtgacttataagtatatcaataataataataataaaaattaacagttgttagtgaa

SEQ ID NO: 5340 - DNA, 953 bp, Chelidonium majus
gaactaatgtgggaaggaagcaggggagcttgaacaagattttcttatggcactgcaatccttttactatgaggggaaggctgtcatgtcaaacgaagaatttgataatctcaaggaagaactaatgtgggaaggaagcagcgtcgtcatgctaagttcatctgaacagaagtttctggaagcttcaatggcttatgtttctgggaaacctatattgtcggacaaggagtacgaccaattgaagttgcaattaaagatggatgggagcgagatcgtagtagagggtccaagatgcagtctacgtagtagaaaggtgtatagtgacttgactgttgactatttcaagatgtttctactgaatgttccagccgctgtcgttgcactgggattgttctttttcctggatgacataactggattcgaaatcacttaccttttggagcttccagagccattcagtttcattttcacatggtttgctgctctgcctctcatattttatctagctcaatcaatcacaaatgttattgtgaaagattttctgattctgaagggcgcctgtccaaactgtggaacagaaaatgtttccttctttgggactatactatcaatatcaagcggcggtaaaaccaacaaggtgaaatgttcaaattgtggcactgcattagaatttgattcacgaactcgtttgattacattgccagaacccgcagaagcttgaacagagcttcgtcgagcaggatgacgacctctacttgcgggaagtcctacttctctatttctgctaactattcataaaaagttggtttgggcattattatggttaagtagttttgagttcatcagctgcattacaactgaacaggaaaaagatgatctaaatgtaaaccttattgtatctgcaattttaagtcttctgttaatatgtatattttgataccaggattatccac

SEQ ID NO: 5341 - DNA, 1378 bp, Lippia dulcis
gtcgccgccgcagatggcatccaaactaggttcaaccgtcgcaaaacccagattctttgccgcccatggtaggaaacccttcttttctgtctcttctttgccgtctttggctcctggagttcagtccgttaagtttggtgccaagaaactgtctttccggcgaagactcttggttatttctcccaaggccaccactgatcagtcaggtcaattccaagaagatgaagttgtggatagcaatgtgttaccctattgcagcatagaccagaaacagaaaaagtctctgggagaaatggaacaagaatttcttcaagcgcttcaggcattctattacgaaggaaagtccataatgtcaaacgaagaatttgataacctcaaggaagaactcatgtgggagggaagcagtgttgtaatgctaagtgctgatgaacagaggtttctggaagcttccatggcttatgtatctgggaatccgatcatgtcggatgaagagtttgataaactgaaacagaaacttaagatggatgggagtgaaattgtggtagagggtcctcgatgcagtttgcgtagtaaaaaggtctacagcgacctttctgttgactatctgaagatgtttcttcttaatgtaccagcagcggttgttgcattaggattgttcttttttcttgatgatttgactggatttgaaatcacctatcttttggagcttccggagccattcagtttcattttcacgtggtttgcagctttgcctttcatattgtggttatctttcacaattacaaacgtcatcattaaagattttctgatcttagtgggaccctgtccaaactgtggcacagagaacacatcattcttcggcaccatattatcagtatctagtgggggctccgttaacacagtgaaatgtgcgaattgtggaacggatatgatatatgattctaagacacggttgattacgctccccgaaggaaaggccgcatgagttcagggttttttttccctttttttgtcaaaaatatggctgaacgtgatttggacgaagaacgcgaaagaacctatgactactgtatgatgttagagaaacggttttagtttggagagaatatcaacagtgtggataaatcgttgtatcgtgtcgtgtccgtgttcatatgttactacgttggtaaatgatcttatacagacaggttcaggaacagaagaaagaagaagcttgacaagttttctgtgtatttccacgctttatgtcatgctatttggtttattttatttaagttctttcttctccacacaaaacattgcaatatttttttgcaagctttgagcaatcggagttctgtacaaagtacagctatttatatatgggattgtagtt

SEQ ID NO: 5342 - DNA, 1751 bp, Lippia dulcis
cacgaggctcgtgctcgaacacatccaaaccagcacccccaatctcactcaaattccccaccacacattcccattcgccttatctccaaccccttccctcgctcccactaatttcccacatctttcaaatgcatctacttccccaaaaccgcctcccactctcctcgccccgccacagatggcgtcaagactcggctgcaacctatcaaaacccaatcttttcactgctcaaatcagaaagccattcttctccgcctcttctctgccgtccccagctcccggagttcactcgcttcaattcgctgccaagaaactgactttccagcgcagactgctcgttatctctcctcaagccaccagtgagcaaccaggtcaggttcaagaagacgaggttattgacagcaatgtcttgccatattgcaccttagacaagaagcagaaaaagacgatcggtgagatggagcaggagtttctgcaagcacttcaagccttctactatgaaggaaagtctatcatgtccaacgaggaattcgataacctcaaggaagaacttatgtgggagggaagcagtgttgtaatgctaagtgctgatgaacagaggtttttggaagcttcaatggcgtatgtatctgggaacccaattctttccgatgaggaatatgataagctgaaaaaacaacttaagattgatgggagtgaaatcgtggtcgaggggcctcgatgcagtctacgtagcaaaaaggtttatagcgacctttctgtcgactacctcaagatgtttcttctgaatgttccagcagcagttgtcgcattagtattgtttttctttctcgatgatctgactggattcgagatcacttatctcttggagcttccagagccattcagtttcattttcacgtggttcgcagctttgccactcatactatggttgtctttcaccttcacaaacatcattgtaaaagactttctgatcttagtgggaccatgcccgaactgtggcacggaaaacacttcattctttggtaccatactgtccatatcgagcgggggagccactaacaaggtcaagtgttcgaactgtggcacggacatggtgtacgattctaagtcgcggttgattacactgcccgaaggaagtgaggcttgaactcaggcaaggaaatatttttggttaaatatgcaattcttcaagagctggtgtgattcaaggggaaagaatgcataagcaatgtaaatgtgaggagaaattaagtagtttggtatgtgaaggatatgcgtatatgaaagatgtatcttgtgtatattattattctatacataatatatcagacaggttgtgggacttaaagaaacgagatggccaaaactaattgtatgcggtactatcccgggatcaagtatcgggctttatctacctgatcgaaaaacattcataaacccactctcataaaatctatcaaatcgaactctaccttatttgatgttgtttaatatcatgttgcttttaatgtatgttttgtgaatatacaagataaggccatttttatacttagaagttaagcattaatgtataatctatcaaatggacttattatcacaatcacttcatggtacatggagtattataatagtaataaaaatttgtttaagaacctataagagcaacaattaataatatgaggattcaataaattatcgtctctaattttaataattgtattattttaaagaggcaattacataataaa

SEQ ID NO: 5343 - DNA, 1339 bp, Gossypium hirsutum
gtattccctccacactttccatcccttaccttatctctctttccctccaacaaaaccaaagtgaaaccaatcaaataacactgctcctccatcatcaccagtttaacagatttagtattggtccaatggctagcaaattggctttaactctaacaccccatcgtttcctaaatggccatatcaaaaaccactggtttctttctcttcttctaccagggttctatcaaatggaaagcagctctgttgtcgacacagattgttcgtacttcccatcaaggctgctgctgaccaacaaggccaggtggaagaagataatgttgttgatagtaaaattctgccatactgtagtatagacaagaaagagaagaagtcattgggtgaaatggagcaagagtttcttcaagctctgcaggcattctattatgaaggaaaagctattatgtcaaatgaggaattcgataatctcaaggaagaactaacgtgggaaggaagcagtgttgttatgctaagttctgatgagcagaaatttttggaagcttcaatggcttatgtatctgggaaaccaattttgaatgatgaagaatttgatggtttgaagctggggctaaagatggaaggaagcgaaattgtggttgagggtccacgatgcagtctccgtagtagaaaggtgtacagtgacctatctgttgactatttgaagatggtcctcttgaacgtcccagcgactgtggttgccctgggactgtttttcttcttagatgatctgactggatttgaaataacatatgttttggagctcccaaaaccgttcagtttcatttttacttggtttgctgctgtgcctttgatagtttggttagctcaatccctcacaaaattggttgtcaaagactctctaatcctaaaaggtctttgcccgaactgtggtactgagaatgtctccttctttggcaccatactatccatctccaatggtggaaccaccaatacacttaaatgttcaaattgtggaaccccattggagtataattcaaaaacacggttgattactttgccagaaggaaccctaagcttgatttcgagacaatgtaattccccgttttaaacaggactggccatggatgcgggacgagttacttgcagggaaccacatcatttgcagcacaggaggaataagttttgatatgtgcttcattgtagaatgtatatttgtttgtaagccatgtagtaatatattttatacctataacaagcatgttcgacggaaagagaagtgaacaagctgtgaaaatcttatattcaatatatatgcccaaaacaaaaaggtatatttatacta

SEQ ID NO: 5344 - DNA, 1426 bp, Heritiera littoralis
cacacattctctcatgccttatcttcgagctatctctctttccctccaacactatcagcttcactctcaccacctgaaaccggcaaaacccacagagcgccatagctttaacagattgagttcttgctaaagttttgcctctgccctgtttcatcaatggctagcaaattagcctttactctgacaccccctcgtttgttcactgcccctattcaaaaacccttgatcattttctcttcgtcttcttctagcagggttcaatccaatggaaagcagctgtgttttcgacgcagatggttcttacttcccattaaggctactgctgatcaacaaggccaggtcggagaagacgatgttgttgatagtaaaattctgccatactgtagcctagacaggaaagaaaagaagtctttgggtgaaatggagcaagagtttcttcaagccctacaagcattctattatgagggaaaagctatcatgtcaaacgaggaattcgataatctgaaggaagaattaatgtgggaaggaagcagtgttgtgatgctaagttctgatgagcagaagtttctggaagcctcaatggcttatgtctctgggaatcaaattatgagtgatgaagaatttgatgatttgaagctgaggctaaagatggaaggaagcgaaatcgtggctgagggtccacgatgcagtctccgtagtagaaaggtgtacagtgacctatctgttgattatttgaagatgttcctcttgaacgtccctgcaactgtggttgccctaggattgtttttcttcctagatgatctgactggatttgaaatcacatatcttttggagctcccagaaccattcagtttcattttcacgtggtttgctgctgtgcccttcgtagtttggctagctcaagccctcacaaaagtggttgtgaaagactttctgatcctaaagggcccttgccccaactgtggtaccgagaatgtctccttcttcggcaccatactatcgatttccagtggtggaaccaccaacactctaaaatgttcaaattgcggaacctcattggagtataattcaaaaacgcggttgattacattgccagaaggaagtcaagcttgaatggagaacaaattacttccagggccacaacaagattgctactaactcataaagttggagcgaagggtgtaatatgtactaaagctggtggctcatcatttgcagcacgggaggaaaattttgatgttgctgcattgtagaatgtatttctgttgtatgtcatgtcaaatactgtatttgtaagtaacatgtaatatatttatacctataacaggagtgttgacaggaagagaagagagcaaagttgtgaaaatctttgactcaataaagaccatattctatgcaatgctctgaatgagccgcagttgatata

SEQ ID NO: 5345 - DNA, 1586 bp, Nicotiana benthamiana
aaaagcttttcaacattcaatactgtccacacattcatacacataaccttatcttcatctcttatcaaaactcatcgaattctccacttttcagttttttcgcaaatgcaatattcgtttctactgacccttttaatacttcaacttcactccctccccaccactgctgccgtcgccgtcgccgttgccgccacaaatggccactaaatttgggtttactataactagccctcgcctttttcatgccccttttagaaaaaaaccaattttttcttcatcttctccttctttacaaggcgcttcattttcttgttcaaagcttcctttgattaattttgatggaagaaaattagctattaggcgtaggttattggttctctctcctaaggccacgactgatcagtcaggtcagctcaacgaggatgaggttgaagacagtaaaatcttgcagtattgtagcattgacgggaaaggaaagaagtccttaggagaaatggagcaagagtttcttcaagcactacaatcattctattatgaaggaaaggccatgatgtcaaatgaggaattcgataaccttaaggaagagttaatgtgggaagggagcagcgtcgtcatgctaagcactgatgaacagaagtttctggaagcttctatggcttatgtatctgggaatccaattatgactgataaagagtatgacaagctgaagatgaaacttaagagggatggcagtgatattgtggttgagggtcctcgttgcagtcttcgaagtagaaaggtttatagtgacctttctgttgattatctgaagatgttcttgttgaatgttcctgctgctgttgttgctcttggattgttctttttcctcgacgatttgactggattcgagatcacttatcttttggagcttccagagcctttcagtttcattttcacatggtttgctgctttgcctttgatattgtatctatcgtttacaatcacaaatatcgtcgttaaagattttctgatcttaaggggcccttgtccgaattgtggaacagaaaatacttccttctttggtaccatattatcgatatctagtggtggttctaccaacaaaattaaatgctcaggttgtgggacggacttggtctatgattcagacacacgtttgatcacgttgcctgaaggaagtactgcatgattcgaggatgattatatgtggagaatggggagacatctgcacaatagattgcactagaacaagttgcataatggaagagccaaataacatacatgagtcaagtttgtaaaaatggaaagcactttcattgttgaaattgtgaatgttttgcaacttgtattgagtccaatatgttatgtattgtgtgcatataagtatatgaataaaaacaaattaacagattttaagcacaggtgatgaagaatatcaaggtccttgaagttgtgtcgatgtgcatgttttttgttttacgccgtttttacaagaaaaatgtattttttatacgtaagagatgtgaaaattacattcgaaaaatctttacagaatcattttcttctattcaaattgtaagtgttggcat

SEQ ID NO: 5346 - DNA, 1604 bp, Populus trichocarpa
cttctctccctccaaaatatcacaacaaaaaaaaacaaagatacgcccattaaccaaaatcaccaaatcaacgaaacaaacactcacctgaaaccacattgcagagtccccgtaatactgttatggctggcaagttagcatttacgttgacatctcctcgagtcctcattgctccgattcaaaaaccattcatctcctcatcttcttcattaccacctccttcttgctctagcagtaccagggttcatttcaatgtcaaacagttttctctgcggcgaagaatgcttttaccacctaccaaggccactgctgaccaacaagctgatcaagcccaagaagatgagatggttgatggtaaaatcttgcaatactgtagcatagacaagagaggaaaaaagtcaataggtgaaatggagcaagagtttctacaagcactacaagcattctattatgagggaaaagctataatgtctaatgaggaatttgataatctcaaggaagaactaatgtgggaaggaagcagcgtggttatgctgagttctgatgaacagaagtttcttgaggcctcaatggcttatgtatcagagaatccaatcatgagtgataaagagtatgatgagctgaaaatgaaattaaagtctgaaggcagcgaaatagttgtcgagggtccaagatgcagtcttcgtagtagaaaggtttacagtgacctgtatgttgactatctgaagatgttcctgctgaacgtaccagcaaccgttactgcactaggcttgtttttcttcttggatgatctcactggttttgaaatcacttatcttttggagctcccagagccattcagtttccttttcacctggtttgctgctgtgcccctcattgtttggttagctctgacactaacaaatgcaatagtgaaggactttttgatcttgaagggcccctgccccaactgtggcacggagaacggctccttctttggaaccatattgtctatttcaagtggtggaaccaccaacacccttaaatgctcaaattgctcaaccgagttagtttacaattcaaaaacacggttgattacactgccggaaggaagcgaagcttgatacagggataatatcctgtggatagtcataacagtcatggctactgaatgaagcagaagtccattaaagggatatacagtacaagtgttgctaactcgtaagtttggaagcaaagagtacgccttctgcagaaacttggcagagatttgtggcggagagaattttcagatattgtgtactggattgtatcttgatcactgtgttaatattgtacatgaaagtatgtacatgtttatacatctacctatcccagggttgttaattaggagctgagagcagtgtgttgccatgaagttctataatccgctgtatttagttagaatgatgaatcgttaccttgctgttatcattggcaaaagtaacaccacagttgctgattggttgggtttcctggggcagctaacacgaaatataaccatgattttgttcactatcaggacagatacgctcactcatctcttctgttgctagaagatgttcccattcttcatcaagattcta

SEQ ID NO: 5347 - DNA, 1206 bp, Solanum phureja
ttctacactccatccatctccgccagaaatggccaccaaatttggattcactataacaacaagcagtcgcctttttcatgctccgtttagaaaaaaaccaattttttctcccaattctgtaagccctttgattaattttggtggaagaaagttatctattcgacgtaggctattgtttctctctcctaaggccaccaccgatcagccaggtcaggtcaaggaggatgagattgaagacagtaaaatcttgcagtactgtagcattgacggtaaaggaaagaagtctctcggggaaatggagcaagagtttcttcaagcactacaatcattctattatgaaggaaaggccatgatgtcaaatgaggaatttgataaccttaaggaagaattaatgtgggaaggaagcagcgtcgtcatgctaagccccgatgaacagaggtttctcgaagcttctatggcttatgtatctggaaatccaattatgactgatgaagaatatgacaagctgaagatgaaacttaagagggatggcagcaatattgtggttgagggtccaaggtgcagtcttcgaagtagaaaggtttatagtgacctttctgttgattatctgaagatgttcttgttaaatgtccctgctgctgttgttgctctcggattgtttttcttcctagacgatttgactggattcgagatcacttatcttttggagcttccggagcctttcagtttcattttcacatggtttgctgctttgccattgatattatggctatcctttacaatcacaaatgccattgttaaagattttctcatcttaaagggcccctgtccgaattgtggaacagagaatacttccttctttggtacaatattatcggtatctaatgggggttccagcaacaaagtaaaatgctcatgttgtgggacagacttggtctatgattcagatacgcgtttgattacattgcctgaaggaagtagtgcatgattcgaggatgattttatatatggagatatctgcacaagagatttgctcttttaacacaagctgcgcatggaagagagaccatatgatgcagtttgtgaaaatgaaaaacaagttcagtattgaatttgtgaatgatttgcaacttgtattgtgtgaatatgttatgtaatgtattgtgtgtgactataagtttatcaataaaaaaaaaaacagttttt

SEQ ID NO: 5348 - DNA, 767 bp, Arachis hypogaea
tgaagctaaagatggaagggagtgacatcgtggttgagggtccaagatgcagtcttcgtagtagaaaggtttacagtgacctctctgtagattatctaaagatgttcctattgaacgtccctgctactgtgatcgcattaggattgttcttcttccttgatgatttgactggatttgagatcacatatctcctagagctgccagagcctttcagtttcattttcacttggtttgctgctgttccccttcttgtgtggctagctcagtcactaacaagtgctattgtcaaagatttcttgattctgaagggaccttgcccaaactgtggtgctgaaaacacctccttttttgggactatactatcagtttcaagtggaggaaaagtcaacaatgtcaaatgctctgaatgtggcactgaaatggtatttgattcaagtacaagattgattacattgccggaaggcagtaacgcctaagtttgagggatgcttgaaacaagtggtcaatggttccttatgaaattagcacatgatgatccacggaaggccatcatggagtcatgcttctcattgtcacaaacaacaattgtgatcaaactgaaactgttgttttatgccacaatgtcctacttgtaagtacatataggtatttgcatacttgtaagtaaagtaatatatatggactttgtatatagcatacactggattgttcgttgcaagctgagtcatgaataatgagggtgctcaacatagtcgatgaatctaacc

SEQ ID NO: 5349 - DNA, 633 bp, Brassica napus
gaaggagcctgagcttgacgaagaggagatggagatgattattgaatcgaagagaaagcttcagctcccgaagaggaagagaagctgaggtgggaccatgccgttacctaagctgaggacacatcagttacggtggtgctttacgacctggtgaaggagacgctatagcacagtacgttcagcaagggaaacgtatcccacgtagaggagaagtgggtcttaacgctgatgagattcagaggtttgaggatcttgggtatgtcatgagtgggagtaggcatcaaaggatgaatgctatccgtatcaggaaggagaaccaggtttacagtgctgaagataaacgggcgttggccatgtttaactatgaggagaaggctaagcgcgaggctaaggtgatgtctgatttgtccaggcttgtgcagcgccatatgggagaagagttgggtccgaatcatgatccttttggtgctgggaagactgatggagctgatgattgatttactttgcttcattctgctacttatcttatgctttcgttcttgtagtctgttccttatcgtttgtttgctgaggagtttcatagtatattgcgtttagtttactatgtccatcacattaattagcgtttgtaag

SEQ ID NO: 5350 - DNA, 1340 bp, Brassica rapa
  misc_feature (31)..(31): n is a, c, g, or t
  misc_feature (763)..(763): n is a, c, g, or t
acgttcggattgaaattttagggttggagantgacgatgaactcgcttccaaggaggttcgggagagatcaaggatacctagaccgagaccaccgtagagggaggagatccggttcagactccgacgaagagctgaaaggattgagtcacgaggagtaccggaggcttaaacgcctcaagatgaggaaatctggtaagcactgcatttggaggaacacgccgagtccgcctagagatcccaacgaggtggagtccgatgagaacgccgccgacgaggaggttccggagaaggacgaggaagatccgaaatctgagtctggtaagtcggaatctgagtctgatagatctaggaagaagaggaagagtaagagctctaggagtaagcgtagtagacgatatagcgatagcgaatctgaagatagcgagagtgatgatgattcggatgaggaagataggaggagaaggaggaggaagaagaagcagaagagtagtaggaagaggagaggacataggaggaagaggagatatagtgattctgatgatgaatctgagattagcgcttcttcgtcttctggggaagaacgtagcaaatcaaagagcaagaaggacactgattcgaaggggaagttggaagaagcggggaaggagcctgagcttgacgaagaggagatgaagatgattattgaatcgaagaagaaagctttaccagaagatgaagaagaagaaggtgaggtgggtccaatgccgttacctaaagccgaangacacatcagctacgtggtgctttacgacccggtgaaggagacgctatagctcagtatgttcagcaagggaaacgtatcccacgtagaggagaagtgggtctcaacgctgatgagattcagaggtttgaggatcttgggtacgtgatgagtgggagtaggcatcagaggatgaatgctattcgtatcaggaaggagaaccaggtttacagtgctgaagataaacgggcgttggcgatgtttaactatgaggagaaggctaagcgcgaggctaaggtgatgtctgatttgtcgaggcttgtgcaacgccatatgggagaagagttgggtccgaatcatgacccttttggtgctgggaagactgatggtgctgatgattgatttgcttagcttcccttctactgcttgtgtgggtacttatcttatgcttttactacttgctcgttactgagttttacagttctaatatgctatgcgtgtcacattatcgtctttgtgtgtttaaaaatggaagattctgacttaaggatctgctattgttcctacgcaatttgtttgagcttcagagattatagatta

SEQ ID NO: 5351 - DNA, 723 bp, Brassica napus
agcaaatcaaagagcaagaaggacactgattcgaaggggaagttggaagaagcggtgaaggagcctgagcttgacgaagaggagatgaagatgattattgaatcgaagaagaaagctttaccagaagatgaagaagaagaaggtgaggtgggtccaatgccgttacctaaagccgaaggacacatcagctacggtggtgctttacgacccggtgaaggagacgctatagctcagtatgttcagcaagggaaacgtatcccacgtagaggagaagtgggtctcaacgctgatgagattcagaggtttgaggatcttgggtacgtgatgagtgggagtaggcatcagaggatgaatgctattcgtatcaggaaggagaaccaggtttacagtgctgaagataaacgggcgttggcgatgtttaactatgaggagaaggctaagcgcgaggctaaggtgatgtctgatttgtcgaggcttgtgcaacgccatatgggagaagagttgggtccgaatcatgacccttttggtgctgggaagactgatggtgctgatgattgatttgcttagcttcccttctactgcttgtgtgggtacttatcttatgcttttactacttgctcgttactgagttttacagttctaatatgctatgcgtgtcacattatcgtctttgtgtgtttaaaaatggaagattctgactttaaggatctgctattgttccta

SEQ ID NO: 5352 - DNA, 1655 bp, Brassica napus
agtctgataaaatccaaataaatttcactagaaataatttggggaaaagataatctcgtcgtcgtcctagggatcaagatgtcgcctcctccgagctggttcatggagaatcaaggggaagtttatgaaggtcggcgtagaggatcggaatcggacgaagagctgaaggggctgagctaccaggagtaccggaggctcaaacggatcaagatgaggaacactggtaggttctgcatctggaacaacacgccgagtccaccgagagatccgaacgaggatgagaacgccgatgatgatgatgatgataacctgacgaaagcgaaaggcgaatctgattctggtaagtcgcaatctgaaactgatcgatctaggaagcgtagagggatgagatcttatgatagcgatagcgaatctgtagggagtgagagtgattctgataaggaagataggagacaacgtagaaggaagattaagagtaagaggtctaggagatcttatgatagcgatggtgaatctgaagagagtgaggaagataggaagaaaagcacaagtattaggaagaagagaagatacagtgattctgatgagagcagcgatgcatctgagattagtgcttcctcgtctggtgatgaacaacacaccaagtcaaagatcaacaggcggaagaagctctcaggcgatggttccgacgagggacgaagaagtaagaagaagaaaagaagcagaagtagtagaaagaggccaggacatacgaggaagagcagcgacattagtgcttctggggaagaacgtagcaagtcaaagagcaggaggcgtaagaagctgtcaggcgatggttctgacactgatctgaaggcgaaacttgaagaaaaggtgaaggatactgagcttgacgaagaggagttgaagaagttcaaagagatggttaatgaatcaaagaagaaatctttagctcctgaagatgaagaagaagaagctgaggtaggtccaatgccgctacctaaagctgaaggacacatcagttacggtggtgcgttaagacccggtgaaggagacgctatagcacagtacgttcagcaagggaagcgtatcccacgaagaggagaagtgggtcttaacgctgatgagattcagaggtttgaggatcttgggtatgtcatgagtgggagtaggcatcaaaggatgaatgctattcgtatcaggaaggagaaccaggtttacagtgctgaagacaaacgtgcgttggctatgtttaactatgaggagaaggccaagcgtgaggctaaggtgatgtctgatctttcgaggctggtgcagcgccatatgggagaggagttgggtccgaatcatgacccttttggtgctggaaaggctgatggagctgacgactgaatggggacatacagaagctgctgctccgctctgcttttgatgcttcatcctacttctttgtctctcagctatctttggttatgtttttttgttaccccgtgacaaaatattgtctatacgctgcgtgaagcttttctacaaacgtatgtttcttcatcgtctttgcgtgtagtttgtgaccgtgttgtagagacgacgttttgctatcttgttttgggttttaatattgttcttgttttagtagcttttgtcttaaagatctt

SEQ ID NO: 5353 - DNA, 1278 bp, Brassica napus
caacgtagaaggaagattaagagtaagaggtctaggagatcttatgatagcgatggtgaatctgaagagagtgaggaagataggaagaaaagcacaagtattaggaagaagagaagatacagtgattctgatgagagcagcgatgcatctgagattagtgcttcctcgtctggtgatgaacaacacaccaagtcaaagatcaacaggcggaagaagctctcaggcgatggttccgacgagggacgaagaagtaagaagaagaaaagaagcagaagtagtagaaagaggccaggacataggaggaagagcagcgacattagtgcttctggggaagaacgtagcaagtcaaagagcaggaggcgtaagaagctgtcaggcgatggttctgacactgatctgaaggcgaaacttgaagaaaaggtgaaggatactgagcttgacgaagaggagttgaagaagttcaaagagatggttaatgaatcaaagaagaaatctttagctcctgaagatgatgaagaagaagctgaggtaggtccaatgccgctacctaaagctgaaggacacatcagttacggtggtgcgttaagacccggtgaaggagacgctatagcacagtacgttcagcaagggaaacgtatcccacgtagaggagaagtgggtcttaacgctgatgagattcagaggtttgaggatcttgggtatgtcatgagtgggagtaggcatcaaaggatgaatgctattcgtatcaggaaggagaaccaggtttacagtgctgaagacaaacgtgcgttggctatgtttaactatgaggagaaggccaagcgtgaggctaaggtgatgtctgatctttcgaggctggtgcagcgccatatgggagaggagttgggtccgaatcatgacccttttggtgctggaaaggctgatggagctgacgactgaatggggacatacagaagctgctgctccgctctgcttttgatgcttcatcctacttctttgtctctcagctatctttggttatgtttttttgttaccccgtgacaaaatattgtctatacgctgcgtgaagcttttctacaaacgtatgtttcttcatcgtctttgtgtgtagtttgtgaccgtgttgtagagacgacgttttgctatcttgttttgggttttaatattgttcttgttttagtagcttttgtcttaaagatcttttgctttgtattcataacttttcagaaagtacgtttctaaaaaaaaaaaaaaaaaactcgaggggggcccgatccc

SEQ ID NO: 5354 - DNA, 1850 bp, Brassica napus
tcagagaaatttcactagaaataatttggggaaaagataatctcgtcgtcgccctagcccctagggatcaagatgtcgcctcctccgagctggttcacggagaatcaaggggaagtttatgaaggtcggcggagaggatcggaatcggacgaagagctgaaggggctgagctaccaggagttccggaggctcaaacggatcaagatgaggaacactggtaggttctgcatctggaacaacacgccgagtccaccgagagatccgaacgaggatgagaacgccgacgagagggatgatgatgatgatgataacctgacgaaagcgaaaggcgaatctgattctggtaagtcgcaatctgaaactgaccgatctagaaagcgtagagggatgagatcttatgatagcgatagcgaatctgtagagagtgagagtgattctgataaggaagataggagacaacgtagtagaaggaagattaagagtaagaggtctaggagatcttatgatagcgatggtgaatctgaagagagtgattccgatgaggaagataggaagaaaagcacaagtattaggaaaaagagaagatacagtgattctgatgagagcagcgatgcatctgagattagtgcttcctcttctggtgatgaacaacacaccaagtcaaagatcaagaggcggaagaagctctcaggcgatggttccgacgagggacgaagaagtaagaagaagaaaagaagcagaagtaggagaaagaagccaggacataggaggaagagcagcgacattagtgcttctggggaagaacgtagcaggtcaaagagcaggaggcgtaagaagctgtcaggcgatggttctgacactgatctgaaggcgaaacttgaagaaagttgaaggatactgagcttgacgaagaggagttgaagaagttcaaagagatggttaatgaatcaaagaagaaatctttagctcctgaagatgaagatgaagaagctgaggtaggtccaatgccgctacctaaagctgaaggacacatcagttacggtggtgcgttaagacccggtgaaggagacgctatagcacagtacgttcagcaagggaaacgtatcccacgtagaggagaagtgggtcttaacgctgatgagattcagaggtttgaggatcttgggtatgtcatgagtgggagtaggcatcagaggatgaatgctattcgtatcaggaaggagaaccaggtttacagtgctgaagacaaacgtgcgttggctatgtttaactatgaggagaaggccaagcgtgaggctaaggtgatgtctgatctttcgaggctggtgcagcgccatatgggagaggagttgggtccgaatcatgacccttttggtgctggaaaggctgatggagctgacgactgaatggggacatacagaagctgctgctccgctctgcttttcatgcttcatcctacttctttgtctctcagctatctttggttatgtttttttgttaccccgtgactaaatattgtctatacgctgcgtgaagcttttctacaaacgtatgtttcttcatcgtctttgtgtgtagtttgtgaccgtgttgtagagacgacgttttgctatcttgttttgggttttaatattgttcttgttttagtagcttttgtcttaaagatcttttgctttgtattcataacttttcagaaagtacgttttctaaagcacaaagttggattcaaatcctaagacatgaaagtagatgatgattacgtggagtatgttccagtggcgaagcgtagagcaatgcaagagcggaagggaaaggtgatggaggacaaggagaagcgcgcacctagctta

SEQ ID NO: 5355 - DNA, 1375 bp, Raphanus sativus
tttttttcttttctcgtcgtcgtccagcgttaactttagggattgaagatgacgatgaactcgcttccaaggcgatttgggaagaatcaaggatacctggatcgtgatcatcgtagagggaggagatccgactcagactccgacgaagacttgaaaggattgagtcacgaggagtaccggaggcttaaacgcctcaagatgaggaaatctggaaagtactgcatatgggagaacacgccgagtccgcccagagatcccgacgaggaagagtccgatgagaacgccgctgacgacgaggaggttccggagaaggatgttgacgatccgaaacaacggaaaggcgaatctgaatcgggtaagtcgggatctgaatctgatagatctaggaagaagaggaagagtaagaggtctaggagtaagcgtaggagaaggagtgatagcgaatcggaagaggagagcgagagtgatgattcggatgaggaagataggaggcgtagaagaaggaataagaagaagaaaagcagaagtagtaggaagaggagaggtcataggaggaagaggaggtacagtgattctgatgagagcagtgatgaagaatctgagattagtgcttcttctggggaagaacgtagcaaatcaaaggggaagaacattgatgtagaagaagcggtgaaggagcctgagcttgatgaagaggagatgaagaagttcaaggagatgattgaatcaaagaagaaagcttctgcagcagctgaagatgaagaggaagctgaggtgggtccaatgccgttacctaaagccgaaggacacatcagctacggaggtgctttaagacccggtgaaggagacgctatagcgcagtacgtgcagcaagggaagcgtatcccacgtagaggagaagtgggtcttaacgctgatgagattcagaggtttgaggatcttgggtatgtgatgagtgggagtaggcatcagaggatgaatgctattcgtatcaggaaggagaaccaggtttacagtgctgaagacaagcgggcgttggccatgtttaactacgaggagaaggctaagcgcgaggctaaggttatggctgatctttcgaggcttgtgcagcgccatatgggagaagagttgggtccgaatcatgacccttttggtgctggaaagactgatggagctgatgattgatttgctttgcttcccttctactacttgtgttggtacttatcttatgcgtttgttacttgtaaacttttccttattgcatcgtagctactctttgtttactacttgcccgttaatgggttttaacagtttcaatttgctatgcgtgtcacattatggcgtttgtgtgtgtttaaagatgaaagattctgac

SEQ ID NO: 5356 - DNA, 630 bp, Brassica napus
gaagaagctgtcaggcgatagttctgacactgatctgaaggcgaaacttgaagaaaaggtgaaggatactgagcttggtgaagaggaggagtcgaagaagttcagagagatggttaataatgaatcgaagaagaaatctttagctcctgaagatgaagaagctgaggtgggtcctaaagctgaaggacataggggttacggtcctgcgttaagacccggtgaaggagacgctatagcacagtacgttcagcaagggaaacgtatcccacgtagaggagaagtgggtcttaatgctgatgagattcagaggtttgaggatcttgggtatgtcatgagtgggagtaggcatcaaaggatgaatgctattcgtatcaggaaagagaaccaggtttacagtgctgaagacaaacgtgcgttggctatgtttaactatgaggagaaagccaagcgtgaggctaaggtcatgtctgatctttccaggctggtgcagcgccatatgggagaggagttgggtccgaaccatgaccctttcggtgctggaaaggctgttggagctgacgactgaatcaggacatacagaagctgctgctccgctctgcttttgatgcttcatcctacttctttgtctct

SEQ ID NO: 5357 - DNA, 959 bp, Brassica napus
tctgaatctgagattagtggtgatgaacaacaacacaccgagtcaaagatcaataggcggaagaagaagctcctctcaggcgacgaggaagataggggacgaagaacaagtgagaagaagaaaacaagcacaaagaagcgaggacataggagtgcttctggggaagaacgtagcaagaggcggaagaagctgtcaggcgatggttctgacactgatctgaaggcgaaacttgaagaaaaggtgaaggatactgagcttggtgaagaggaggagtcgaagaagttcagagagatggttaataatgaatcgaagaagaaatctttagctcctgaagatgaagaagctgaggtgggtcctaaagctgaaggacataggggttacggtcctgcgttaagacccggtgaaggagacgctatagcacagtacgttcagcaagggaaacgtatcccacgtagaggagaagtgggtcttaacgctgatgagattcagaggtttgaggatcttgggtatgtcatgagtgggagtaggcatcaaaggatgaatgctattcgtatcaggaaagagaaccaggtttacagtgctgaagacaaacgtgcgttggctatgtttaactatgaggagaaagccaagcgtgaggctaaggtcatgtctgatctttccaggctggtgcagcgccatatgggagaggagttgggtccgaatcatgaccctttcggtgctggaaaggctgttggagctgacgactgaatggggacatacagaagctgctgctccgctctgcttttgatgcttcatcctacttctttgtctctcaccaatctttggttatgtttttttttaattgtctatatgctgcgtgaagcttttctacaaacgtatgtttcttcatcttctagtttgcgaccgtgttgtagagacgtcgttttgctatcttgttttgggttttaatattgaaggag

SEQ ID NO: 5358 - DNA, 1521 bp, Eutrema halophilum
agatttttgtttttccgtcgtcgtcatcgaagtgaattttgggggagatccagaatgacgatgaactcgcttccaaggaggtttgggaggaatcaaggatatctggatcgagattatcgtaaagggaggagatctgattccgaatccgatgaagagttgaagggattgagtcacgaggaatacaggaggaataaacggcttaagatgcggaaatcggggaggttctgcttctgggagaacacgccgagcccgcctagagatcagaacgaggattccgatgagatctccgacgagattctggaaagggatgataacccgaaaggtaaagacaggaaaggtgagtctgattcaggcaagtcagagtcggaatctgaatctgacgacttgagatctaggaagagaaagagtaagagctctaagagaaagcgtaggcgtaggagatcgtatgatagcgatagtgagtctgaagagagtgagagtgagtcggaagaggaagataggagacgaagaaggaagaagaagagcaaaagcaaaagccgccgcagtagtaggaaaaggcgaggacataggagaaagaggagatacagtgactctgacgagagcagcgatggagatagcaaaatggaggaatctgagattagtgcttcgtcgtctggggatgaacttagcaagtcaaagagcaggaagcgtaagaaatcttcggtttctagttccaaacgaagcaagggaaagaaaacgaagtcagaaaccgaaagcgatggttctgacactgattccaaggcgcagttagaagaaacggtgaaggatcctgagcttgatgaggaggagttgaagaagttcaaagagatgattgaatcaaagaagaaagcttcagcccccgatgatgaagaagaagctgatgttggtccaatgccattgcctaaagctgaaggacacatcagttatggtggtgctttaagacctggtgaaggagacgccatagcacagtatgtgcagcaaggtaaacgtatcccacgtagaggagaagtgggtcttaacgctgaagagattcagaagtttgaggatcttggttatgtgatgagtggaagtaggcatcaaaggatgaatgctattcgtatcagaaaggaaaaccaggtttacagtgctgaagacaaacgggccttggctatgtttaactatgaggagaaggcgaagcgcgaggctaaggttatgtctgatctctcgcggcttgtgcagcgccatatgggagaagagttagggcctaatcacgacccttttggtgctggaaagactgatggagctgatgactgattggcattgcttcctgctgctgcttgtgtgggtactgtgtactcatcttatgccttttttcttgtagactgttccttatttgcatcatagttactgttgtttgctacttgcccgttaatgagagtcatagctaatgcgtcaatttgctatgtgtatcacatgattgtgtttatgtgttaaagatcaaagattctgactttagggatctgc

SEQ ID NO: 5359 - DNA, 1537 bp, Eutrema parvulum
agatttttgttttttcgtcgtcgtcgtcgtcgtcgtgaaattggggatcggagaatgacgatgaactcgcttccaaggaggtttgggaagaatcaaggatatttagatcgggattatcgaaaagggaggagatctgattcagaatccgatgaagagttgaaagggttgagtcacgaggagtacaggaggcataaacgcctgaagatgaggaaatcggggaggttctgcttttgggagaacacgccgagtccgcccagagatcccaacgaggactccgatgtcaacgccgacgaggttctggacaaggatgatgataatccgaaagggaaagaaaggaaaggtgaatctgattctgggaagtccgagtctgaatctgaatctgacgatttgagatcgaggaagagaaagagtaagaagtctaggagcaagcgtaggcgaaggagatcgtacgatagcgatagtgaatctgaagggagtgagagtgattcggatgaggaagaggaagataggagacgaagaaggaagaagaagaaaagccgaagtagccgcagtagtaggaaaaggcgaggacataggaggaagaagagctacagtgattctgacgagagcagcgatgaagatagcaaagcagaggaatctgagattagtgcttcgtcgtctggggaagaacgtaccaagtcaaagagcaggaggcggaagaggtcttcgggttctagttccaaacgaagcaagggaaagaagacgaagttggaaaccgaaagcggtggttctgacactgaattgaaggcgaaattagaagaaacggtgaaagatcctgagcttgatgaagaggagttgaagaaattcaaagagatgatggaatcaaagaagaaatcttcagctcccgaagatgaagaagaagctgaggtcggtccaatgccattacctaaagctgacggtcacatcagttatggtggtgctttacgacctggtgaaggagacgccatagcacagtatgtgcagcaaggtaaacgtatcccacgtagaggagaagtgggtcttaacgctgaagagattcagaagtttgaggatcttgggtatgtgatgagtggaagtaggcatcaaaggatgaatgctattcgtatcagaaaggaaaaccaggtttacagtgctgaagacaaacgggcattggccatgtttaactatgaagagaaggccaagcgcgaggctaaagttatgtctgatctgtcacggcttgtgcagcgccatatgggagaagagttagggcctaaccatgacccttttggtgctggaaagactgatggcgctgatgattgatctgctttgcttactgctgctgcttgtgttggtactactcatcttatgtttttttcttgtagactgttccgtatttgcagcatagttactgttgtgctgtttgatacttgtccggtaatgagctacatagttgatgcgtttaatttgctatgtgtatcacatgattgtatttctgtgttaaagatgaaagatttggactttaggaatctgcataattttc

SEQ ID NO: 5360 - DNA, 760 bp, Eutrema parvulum
cgaaagcggtggttctgacactgaattgaaggcgaaattagaagaaacggtgaaagatcctgagcttgatgaagaggagttgaagaaattcaaagagatgatggaatcaaagaagaaatcttcagctcccgaagatgaagaagaagctgaggtcggtccaatgccattacctaaagctgacggtcacatcagttatggtggtgctttacgacctggtgaaggagacgccatagcacagtatgtgcagcaaggtaaacgtatcccacgtagaggagaagtgggtcttaacgctgaagagattcagaagtttgaggatcttgggtatgtgatgagtggaagtaggcatcaaaggatgaatgctattcgtatcagaaaggaaaaccaggtttacagtgctgaagacaaacgggcattggccatgtttaactatgaagagaaggccaagcgcgaggctaaagttatgtctgatctgtcacggcttgtgcagcgccatatgggagaagagttagggcctaaccatgacccttttggtgctggaaagactgatggcgctgatgattgatctgctttgcttactgctgctgcttgtgttggtactactcatcttatgtttttttcttgtagactgttccgtatttgcagcatagttactgttgtgctgtttgatacttgtccggtaatgagctacatagttgatgcgtttaatttgctatgtgtatcacatgattgtatttctgtgttaaagatgaaagatttggac

SEQ ID NO: 5361 - DNA, 569 bp, Brassica napus
taaagactgaaggacacatgagcggttaggcctgcgttaagacccggtgaaggagacgctatagcacagtacgttcagcaagggaaacgtatcccacgtagaggagaagtgggtcttaacgctgatgagattcagaggtttgaggatcttgggtatgttatgagtgggagtaggcatcaaaggatgaatgctattcgtatcaggaaggagaaccaggtttacagtgctgaagacaagcgtgcgttggctatgtttaactatgaggagaaggccaagcgtgaggctaaggtcatgtctgatctttccaggctggtgcagcgccatatgggagaggagttgggtccgaatcatgacccttttggtgctggaaaggctgacgactgaatcgggacatacagaagctgctgctccgctctgcttttgatgcttcatcctacttctttgtctcttacctatctttggttatgttttttttgttaccccatgataaaatattgtctatatgctgcgtgaagcttttctacaaacgtatgtttcttcatcgtctagtttatgaccgtgttgtagag

SEQ ID NO: 5362 - DNA, 668 bp, Brassica oleracea
agaagttcagagagatggttaataatgaatcaaagatgaaatctttagctcctgaagaagaagaagctgaggtgggtcctaaagctgaaggacacatgagcggttacggtcctgcgttaagacccggtgaaggagacgctatagcacagtacgttcagcaagggaaacgtatcccacgtagaggagaagtgggtcttaacgctgatgagattcagaggtttgaggatcttgggtatgttatgagtgggagtaggcatcaaaggatgaatgctattcgtatcaggaaggagaaccaggtttacagtgctgaagacaagcgtgcgttggctatgtttaactatgaggagaaggccaagcgtgaggctaaggtcatgtctgatctttccaggctggtgcagcgccatatgggagaggagttgggtccgaatcatgacccttttggtgctggaaaggctgacgactgaatcgggacatacagaagctgctgctccgctctgcttttgatgcttcatcctacttctttgtctcttacctatctttggttatgtttttttttgttaccccgtgataaaatattgtctatatgctgcgtgaagcttttctacaaacgtatgtttcttcatcgtctagtttatgaccgtgttgtagagacgtcgttttgctatctt

SEQ ID NO: 5363 - DNA, 1092 bp, Raphanus sativus
  misc_feature (1086)..(1086): n is a, c, g, or t
gggagccctagcttatcatatcacaagatgtcgcctccgcctcggagctggatcacggagaatcaagggcaggcgaatcaaggtcggcgtagaggatgggattcgtcatcggaatcggatgagaaagataggagacggaagaaaagcacaagtattaggaagaagaagaagacaagatacactgattctaatgagagcagcgatgaatatgagattagtggtgatgatgaacaacacaacaagtcaaagatcaagaggcggaataagcatggatttgatgaggaagatagcagaagtaagaataaaattaaaagaagtagtagaaagaggcgaggaggagatacaaggaagaggagatacaccgattctgatgatggttctctcaaggcaaaacttgaagaaaaggtcaaggaacctcagcttgatcaagaggaatcgaacaagaaagctttagctcctgaagatgaagaagaagatgctgtggtgggtccaatgcctttgcctaaagctggaggacacatcagaaactaccacggtcgtgatttaagacctggtgaaggagacgctatagcacagtatgtgcagcaagggaaacgtatcccacgtagaggagaagttggtcttaacgctgatgagattcagaggtttgaggatcttgggtacgtcatgagtgggagtaggcatcaaaggatgaatgccattcgtatcagaaaggagaaccaggtttatagtgctgaagacaaacgggcgctggctatgtttaactatgaggagaaggccaagcgtgaggctaaggtcatgtctgatctttccaggcttgtgcagcgccatatgggacaagagttgggtcccaatcatgacccttttggttctggaaagactgatggacctgatgactgaattgggacatacagaagctgctgctccgctctgcttttgatgcttcatcctacttctttctctctcatctatctttggttatgctgttttgtctaaaacttgtcacacatacagaagctgctgctcccctctcattttatttgcactattttatatattaatataatttagcgaaataaaaatatnagaaca

SEQ ID NO: 5364 - DNA, 1149 bp, Brassica napus
ggacgatgaactcgcttccaaggaggttcgggagagatcaaggatacctagaccgagaccaccgtagagggaggagatccggttcagactccgacgaagagctgaaaggattgagtcacgaggagtaccggaggcttaaacgcctcaagatgaggaaatctggtaagcactgcatttggaggaacacgccgagtccgcctagagatcccaacgaggtggagtccgatgagaacgccgccgacgaggaggttccggagaaggacgaggaagatccgaaatctgagtctggtaagtcggaatctgagtctgatagatctaggaagaagaggaagagtaagagctctaggagtaagcgtagtagacgatatagtgatagcgagagtgatgatgattcggatgaggaagataggaggagaagaaggaggaagaagaagcagaagagtagtaggaagaggagaggacataggaggaagaggagatatagtgattctgatgatgaatctgagattagcgcttcttcgtcttctgggggaagaacgtagcaaatcaaagagcaagaaggacactgattcgaaggggaagttggaagaagcggtgaaggagcctgagcttgacgaagaggagatgaagatgattattgaatcgaagaagaaagctttaccagaagatgaagaagaagaagatgaggtgggtccaatgccgttacctaaagctgaaggacacatcagctacggtggtgctttacgacccggtgaaggagacactatagctcagtacgttcagcaagggaaacgtatcccacgtagaggagaagtgggtcttaacgctgatgagattcagaggtttgaggatcttgggtatgtgatgagtgggagtaggcatcagaggatgaatgctattcgtatcacgaaggagaaccaagtttacagtgccgaagacaaatgtgtgttggcgatgtttaactacgaggagaaggctaagcgcgaggctaaggtgatgtctgatttgtcgaggcttgtgcagcgtcatatgggagaagagttgggtccgaatcatgacccttttggtgctgggaagactgatggtgctgatgattgatttgcttagcttcccttctactgcttgtgtgggtacttatcttatgctttt

SEQ ID NO: 5365 - DNA, 608 bp, Brassica juncea
gagtacgcgggtgaaggagacgctatagcacagtacgttcagcaagggaaacgtatcccgcgtagaggagaagtgggtcttaacgctgatgagattcagaggtttgaggatcttgggtatgtcatgagtgggagtaggcatcaaaggatgaatgctattcgtatcaggaaagagaaccaggtttacagtgctgaagacaaacgtgcgttggctatgtttaactatgaggagaaagccaagcgtgaggctaaggtcatgtctgatctttccaggctggtgcagcgccatatgggagaggagttgggtccgaaccatgaccctttcggtgctggaaaggctgttggagctgacgactgagtgggacatacagaagctgctgctccgctctgcttttgatgcttcatcctacttctttgtctctcaccaatctttggttatgttttttttttaattgtctatatgctgcgtgaagcttttctacaaacgtatgtttcttcatcttctagtttgcgaccgtgttgtagagacgtcgttttgctatcttgttttgggttttaatattgaaggagatataaccatgtaattttttttttggcatcatataacca

SEQ ID NO: 5366 - DNA, 588 bp, Brassica juncea
ggagacgctatagctcagtacgttcagcaagggaaacgtatcccacgtagaggagaagtgggtcttaacgctgatgagattcagaggtttgaggatcttgggtatgtcatgagtgggagtaggcatcagaggatgaatgctattcgtatcaggaaggagaaccaggtttacagtgctgaagacaaacgtgcgttggctatgtttaactacgaggagaaggctaagcgcgaggctaaggtgatgtctgatttgtcgagacttgtgcaacgccatatgggagaagagttgggtccgaatcatgacccttttggtgctgggaagactgatggtgctgatgattgatttgcttagcttcccttctactgcttgtgtgggtacttatcttatgcttttactacttgctcgttactgagttttacagttctaatatgctatgcgtgtcacattatcgtctttgtgtgtttaaaaatggaagattctgactttaaggatctgctattgttcctacgcaatttgtttgagcttcagagattatagattatgattgtgtgacacgcatagcatattagaactgtaaaactcattaac

SEQ ID NO: 5367 - DNA, 1453 bp, Arabidopsis lyrata
agattttgtttttgtcgtcgtcgtcgtcgtcggagtgaattagggattcgagaatgacgatgaactcgcttccgaggagatttgggaagaatcatggctatctggatcgagattatcgaaacggaaggagatctggttcagattccgatgaagaattgaagggattaagtcacgaggaatataggaggcagaaacggcttaagatgaggaaatcggccaagttctgtttttgggagaacacaccgagtccacctagagatcagaacgaggattccgatgagaacgtcgacgagattctggataagaacggcggcgaaaaagataataattcgaaagggaaagaaaagaaaggtacatctgattattcggaatctgaatctgatggtttgagatctaggaagaggaagagtaagagctctaggtctaagcgcaggcgaaggagatcttatgatagcgatagtgaatctgaagagagtgattcggaagatgaagatagaagacgaagaaggaagagttctaagaagaagaaaagcagaagtaggaaaaagcgaagtcattatagaaagacgagatacagtgactctgatgagagcagcgatgaagatagtaaagcggaggaatccgagattagtgcttcttcgtctggggaggaagacaccaagtcaaagagcaagaggcggaagaaatcttcgggttctagctcgaaacgaagcaaggtaaagaaaacgaagtcagagactgaaagcgatggtatagaggaggatgattcgaagatgcaattagaagaaacggtgaagaacactgagcttgaacttgatgaagaagagttgaagaagttcaaagagatgattgaatcaaagaagaaatcttcagctgttgatgatgaagaggaagaagctgatgttggtccaatgccattacctaaagctgaaggtcacatcagttatggtggtgctttaaggcctggtgaaggagatgccatagcacagtatgttcagcaaggtaaacgtattcctcgtagaggagaagtgggtcttaatgctgaagagattcagaagtttgaggatcttggttatgtgatgagtggaagtaggcatcaaaggatgaatgctattcgtatcagaaaggaaaaccaggtttacagtgctgaagacaaacgagcattggccatgtttaactacgaggagaaggccaagcgcgaggctaaggttatgtctgatctgcaacggcttgtgcagcgccatatgggagaagaagtagggcctaatcatgacccttttggtgctacaaagactgatgaagctgatgattgattttgctttgcctcctgctacgaactgcttgtgtgggtactctatcttatactttatcttgtagactgttccttatttgcatcatagatactgttgtgttctacttgcccgttaatgagctccatattttatgctttaat

SEQ ID NO: 5368 - DNA, 1071 bp, Brassica napus
gggggtgagctaccaggagtaccggaggctcagacgcatcaagatgaggaacacgccgagagatccgaacgtcgacgagagggatgatgataacctgccgaaagccaaagtcgaatctgattctggtaagtcgcaatctgaaactgatcgatctaggaagcgtagggggaggagatcttatgatagcgatagcgaatctgtagagagtgattctgatgaggaagatagaaggagacaacgtagtagaaggaagattaagagtaagagctctaggagatctgaagagagtgattccgatgaggaagataggaaactaggaagaaaaaggaagaaaagcacaagtattaggaagaagagaagatacagtgattctgaatctgagattagtgcttcctcgtctggtgatgaacaacaacacaccaagtcaaagatcaagaggctgaagaagctctcaggcgacgaggaagaagataggggacgaagaacaagtaataagaagaaaggaagcagaaagaagcgaggacataggagtgcttctggggaagaacatagcaggtcaaagagcaagaggcggaagaagctgtcaggcgatggttctgacactgatctgaaggcgaaacttgaagaaaaggtgaaggatactgagcttgagttgaagaagttcagagaagaagaagaagctgaggtgggtcctaaagctgaaggacacatgagcggttacggtcctgcgttaagacccggtgaaggagacgctatagcacagtacgttcagcaagggaaacgtatcccacgtagaggagaagtgggtcttaacgctgatgagattcagaggtttgaggatcttgggtatgttatgagtgggagtaggcatcaaaggatgaatgctattcgtatcaggaaggagaaccaggtttacagtgctgaagacaagcgtgcgttggctatgtttaactatgaggagaaggccaagcgtgaggctaaggtcatgtctgatctttccaggctggtgcagcgccatatgggagaggagttgggtccgaatcatgacccttttggtgctggaaaggctga

SEQ ID NO: 5369 - DNA, 1727 bp, Arabidopsis thaliana
gctgcttagattttgttttcttcattgtcgtcgtcggagtgaattagggattcgagaatgacgatgaactcgcttccgaggagatttgggaagaatcatggctatttggatcgagattatcgaaacggaagacgatctggttcagattccgatgaagaattgaagggattgagtcacgaagagtataggaggcagaaacggcttaagatgaggaaatcagccaagttctgcttttgggagaacacaccgagtccacctagagatcagaacgaggattccgatgagaacgccgacgagattcaggacaagaacggcggcgaaagagatgataattcgaaagggaaagaaaggaaaggtaaatctgactcggaatctgaatctgatggtttgagatctaggaagaggaagagtaagagctcgaggtctaagcgcaggagaaagagatcttatgacagcgatagtgaatccgaagggagtgagagtgattcggaagaggaagataggagacgaaggaggaagagttcttctaagaggaagaagagtagaagcagccgtagttttaggaaaaagcgaagtcataggagaaagacgaaatacagtgactctgatgagagcagcgatgaagatagtaaagctgagattagtgcttcttcgtctggggaggaagaagataccaagtcaaagagcaagaggcggaagaaatcttcggattctagttcaaaacgaagcaagggagagaagacgaagtcagggagtgacagcgatggtactgaggaagattcgaagatgcaagtagacgaaacggtgaagaacactgagctagaacttgatgaagaagagttgaagaagttcaaagagatgattgaattaaagaagaaatcttcagctgttgatgaagaggaagaagaaggtgatgttggtccaatgccattacctaaagctgaaggtcacatcagttatggtggtgctttaagacccggtgaaggagacgccattgcacagtatgttcagcaaggtaaacgtatcccacgtagaggagaagtgggtcttaacgctgaagagattcagaagtttgaggatcttggttatgtgatgagtggaagtaggcatcaaaggatgaatgctattcgtattagaaaagaaaaccaggtttacagtgctgaagacaaacgggcattggccatgtttaactacgaggagaaggcgaagcgcgaggctaaggttatgtctgatctgcagcggcttgtgcagcgccatatgggagaagaggtggggccaaatcatgaccctttcggtgctggaaagactgaagaagatgatgattgattttgcttggcttcctgcttctgttatgtgggtactcatcttatgctttatcttgttgaatgttccttatttgcatcatagatactgctgtttgctacttgcccgttaatgagcttcgtagtttatgctttaatctgctatgtatccgttaatgagcttcatagtttatgcgttaatctgctatgtatcacatgattgtgtttgtgtgtcaaagataatagattctgacactgaggatctgcaaccgttcttgtgcatttaccttaggtcatgttcgatgattgaattttgcagggcattcacttagttctgagattgtagaacaatcaattatttaggatatccgctttgagcccaccactgtattttcgaataatgtcctttaatgagcttcacagatt

SEQ ID NO: 5370 - DNA, 599 bp, Plantago ovata
agaaggttgaggaggtaaggttgacgatgaatctagtattgagcttcttaagtataaagagatgattgagcaacacggaagaaatccacgttggatgatgagcctccggttggaccgatgcctttgccaaaggcagaagggcatataagctatggtggtgcacttaggcctggggaaggtgatgctattgctcagtttgttcagcaagggaaacgtattccgaggagaggtgaagtgggactttcggctgatgagatttctaggtttgaggatcttggttatgtgatgagtggtagtaggcatcagagaatgaatgctatccgtatcagaaaggaaaaccaggtttacagtgctgaggataaacgtgcgctagcaatgtttaactatgaggagaaagctaagcgtgaacagaaggtcatggctgatttacagaggttggtgcagcgacatattggagaggatactggtccctctcatgatccatttggtggtggaaaagccgttgaggaagctgacgattgattcatgtaaactttacttgtatgtttgctatgcttgttagttcaatatgtttcaggtgaatgtaagaatgtgctgtt

SEQ ID NO: 5371 - DNA, 1776 bp, Quercus alba
acagatagcatcggcaaacagaagcaacaatcccttgaatgatcaaaatggggaggccagcgtcgacgatcgaaatccctgataaacgacaccgttctgaccgcgataacggccgttactccccagattccgataactccttcgactacagcaggcgccaccaccgtcgtagccctaattatgacgcctacgaccgctattacgacaaccacgaccgccgccaccacaaccacaaccaagaacggagctctagcccaaaccctaggtccagcaaagcccaagactctctgcccaagcgatttggacgcgattaccgtaatggaaaccggtccgagtccgagtctgatgaggaattgaaagggctgaaccctgaggagtaccggaggctcaagaggcagaagatgagaagagcgctcactcgttgtatttggaattgcacgcccagtccgcctaggaacgagaacgagaacgagaacgagaaagctgacgagatctctgacaagtacggtggagaagacgagttaatcggcggtgaaaagagcgattcaagctcgaaagagaaggcgaaggtgagtaataggaaaggcaaatcggaaagtcagtctaattccgagtctgaatcggaatcggaaaccgatgattcgcggtcgaggaggaagaggaagaggaagagttcgatttccaagagtagtaaatacgaatctgatgagagcgagagcgagagtgaatcggaggaggaagaagaaaagcgaaagcaaagaaagaaaagcagtagtaggaatcggagccgccataggagtagcaaaagaagcagtagaagaaaagggagtagtagtaggagaaagagtaggtacagcaattccgatgagagtgatgattccgatgctagcaatcgggtaaggtcgaagaagaagaagcggagtcggagtaggaatctctcggagacagataaggacattgaggtttcgaattcagagggttccgaagttgaaaaggcagcaatgatgatagaggaggatggggagatgaaagctgaaagcattgcggaggcattgaattttaaggagatttttgaggcgcagaagaagccggctctggatactgaaccagtggttgggccaatgcccttgcctagagccgaagggcatatcagttatggtggtgcgcttaggcccggagaaggtgatgccattgcgcagtatgtgcagcaagggaagcgtattccacggagaggagaagtggggttgtccgcagatgagattcagaagttcgagggtcttggttatgtgatgagtggtagcaggcaccagaggatgaatgctattcgtattaggaaggaaaaccaagtttatagtgccgaggataagagggcgttggctatgtttaattatgaagagaaggccaagcgtgagcacaaggttatggctgatttgcagagattggtgcagcgccatatagggcaggatgtcggtcctaatcatgatcccttcggtgcaacaaagcctgcagatactgctgatgcttgatttttatgtatgtgattgctacctgtattggtttgatctcatgtccttgtattttcttgtaaaccaaatacttttgcttgtttaccaaaatgctactcttagcaatgtttcattgatgctttgaagtaattagtcagtacatttgtccttccagcacatagattgattgttttgggtttatagtcaaatcgagggtcatattgtcttctcccagtactgctataatcatcatctttcttcagtaggaaga

SEQ ID NO: 5372 - DNA, 1848 bp, Quercus alba
acagatagcatcggcaaacagaagcaacaatcccttgaatgatcaaaatggggaggccagcgtcgacgatcgaaatccctgacaaacgacaccgttctgaccgcgataacggccgttacacgccagattccgataactccttcgactacaacagacgccaccaccgtcgtagccctaattatgacgcctacgaccgctattacgacaaccacgaccgccgccaccacaaccacaaccaacaacggagctcgagcccaaaccctaggtccagcaaagcccaagactctttgcccaagcgatttggacgcgattcccgtaacggaaaccggtccgagtccgagtctgatgaggaattgaaagggctgaaccctgaggagtaccggaggctcaagaggcagaagatgagaagagcgctcactcgttgtatttggaattgcacgccgagtccgcctaggaacgagaacgagaacgagaacgagaaggctgacgagatctctgacaagtacggtggagaagacgagttaatcggcggtgaaaagagcgattcaagctcgaaagagaaggcgaaggtgagtaatcggaaaggaaaatcggaaagtcagtctaattccgagtctgaatcggaatcggaaaccgatgattcgcggtcgaggaggaagaggaagaggaagagttcgatttccaagagtagtaaatacgaatctgatgagagcgagagcgagagtgaatcggaggaagaagaagaaaagcgaaagcaaagaaagaaaagcagtagtaggaatcggagccgccataggagtagcaaaagaagcagtagaagaaaagggagtagtagtaggagaaagagtaggtacagcaattccgatgagagtgatgattccgatgctagcaatcgagtaaggtcgaagaagaagcggagtcggagtaggaatctctcggagacagagaaggacattgaggtttcgaattcagagggttccgaagttgaaaaggcagcaatgatgatagaggaggatggggagatgaaagctgaaagcattgcggaggcattgaattttaaggagattttcgaggcgcagaagaagccggctctggataccgaaccagtggttgggccaatgcccttgcctagagctgaagggcatatcagttatggtggcgcgcttaggcccggagaaggtgatgcaattgcgcagtatgtgcagcaagggaagcgtattccacggagaggagaagtgggtttgtccgcagatgagattcagaagttcgagggtcttggttatgtgatgagtggtagcaggcaccagaggatgaatgctattcgtattaggaaggaaaaccaagtttatagtgctgaggataagagggcgttggctatgtttaattatgaagagaaggccaagcgtgagcacaaggttatggctgatttgcagagattggtgcagcgccatatagggcaggatgtcggtccaaatcatgatcccttcggtgcaacaaagcctgcagatactgctgatgcttgatttttatgtatgtgattgctacctgtattggtttgatctcatgtccttatattttcttgtaaaccaaatacttttgcttgtttaccaaaatgctactcttagcaatgtttcattgatgttttgaagtaattagtctgtacgttagtccttccagcacatagattgtttgttttgtgtttatagtcaaattgagggtcgtaatgtcttctcccagtactgctataatcatcatcttcttcagtaggaagaggtctgtattgaacatgtcatgagatcataattatgactccatgttatattgatataggtggtaactccaattttc

SEQ ID NO: 5373 - DNA, 2094 bp, Aquilegia formosa
caagttcgatcacttctcttgtgagtcttgtcttcagaaacccaaattccaatatgagcagaggcgaaagagattacgataacggtggtggtggtggtggtggtggtggtggtggctattcttctcgaagacgtgattcgaggatctcatcaagggtagagattccagaacgacgacggcgtagtagttctagagatctacatcgtgaatcaccagaaagaggtaatcgaagaccatctccttcatattcttcttatgatcatcatcacaactaccataataacgattacaatcgtcgagattattcggatgaacgaaaccctagatttaataatggtagatattatgaacgagataatgataatgatagatttgatcggaatttagggtttcatgatagagattataataataagaataataatggtggtaaggttgatgaatctgattctgatgaagaattgaaaggattgagttatgaagagtatagaagacttaaacgtcagaaattgagaaaaagtttgaagaattgtatttgggaaattacacctagtcctcctcgaagagagtcagatcaattggaaccaccattggatgaatcgagggaagatttgggtattgagaaggaaaatgaaggtagtggtttgaaggatgagagtgggaaaaagcgagttgattcagaggaggaagagggttcggataagagtttatcaaattcggattctgattcggagtctgaggatttgcggtcaaggaggaagaagaagaagggaagtagtaggaagggaagaaggagaagaacaaagtcttctagttcgaggaagcggagaagtaaaagttattcagctagtgatatggaatcagatgagagtgggagtgagagtgagagtgaggattcttcttcgtcaagtgagaaggagaaaagacgtagtaagaagtcaacaagtagacggagtaagcgtgggagagagaggagcaagaggaagagtaagaaagctaggaagactgttggttctgatgaaagttgtagtaaaagtgataaatatgattcagatggatcttctgatgacgatgcaagaagtaagaaacggaaaggttctagcttggattctgattccatcaggagcaagaaaaagaaacaatctggatcggctagtgagagttcaggcaaaggcttgtctggttctgatactgatgcaaaaaacattactttgagtgatgacttaatgaaaactgagatgaacagtgaggcccttgaatttagagagttgctagaacttcaaaagaaacccgacttagacgaagaagctgttgtgggacctatgcctctgccgagagctgaaggacatataagttatggaggagctctacgacctggtgaaggtgatgctattgctcagtatgtacaacaggggaaacgtattcctcgaagaggagaagtgggtctttcagctgatgagattcagaggtatgaggaccttgggtatgtaatgagtggtagtaggcatcaaaggatgaatgccattcgtattagaaaggaaaaccaggtgtacagtgctgaagacaagagagcattagctatgtttaactatgaagagaaagcgaaacgtgagcacaaggtcatggctgatttgcagaggttggtacagcgccatattggggaggatgttggccccgctcatgatccctttaaaggaaaagccactgatgatgctgatacctgattgtcatggatgtttaagggaatggccgatggggtgcctgtgagcttggaagacagacaaactgccaagaagttcaaacagccacgtgtttgaccttcatctctgtattttctgcatgtggaaagagcaacttgcaaccaaagcaatacggaatctacattatgtctagttagtgtggggagctcacaacttgactgaccaatgcatgttacaacttcagttagcattggacttcggctgagatactggaacatgttacaattccgccttgataacttttaagtgttgattagcatgtattgaaatattttctgctgagtgcagtagctaactgtaaccgacttcatatgggaacactgattggtatttt

SEQ ID NO: 5374 - DNA, 2043 bp, Ceratodon purpureus
cggagagggagagtgcgagggggagtcgtagctatggagcgagacaggtatggccacgggcggagcgcgcttcgttctgtggctgtgcggccgaattaccgccgggaagatgaggaggacggctccgagagcgatcctgagcttcgtcgcgacccggagtatcgtcgtatcaagcgggagaagttgcggcgtcagctgaagaagtgcatttggaatgtgacgccgagcccgccgaggaatcgacgggatgaggaggaggggaatggcgttggaaacggtggcgggacggtgaatgggattcatgagcagagcgagagtgaccgggaggtggcgcatcataggaagaggtcgcatgagaggaagagtaggggtggtgatgagagcgaggaggaggaggaggagtctgaggaggagcgggataagaagcacaggaagaggtcgcgtgaccggaggcacaagggggatgagagtgaggaggagcgggataggaggaggagtagcgggaagaagtctcgtagggttgaggagagtgaagaggattccgaggtcgataagaagaagaggagtgggaagaagtctcgtagggttgaggagagtgaggattccgaggtcgataggaagaagaggagcgggaagaagtcgcagcggagggttagagttgaggaggaattgtcttctgattctgaggttgacaggaagaagaagcataagaagaggaagcatgataggaagggtgaagtgagtgaggaggaggatgatgagtatcggaagcgggggcggaagtcgagcaagcggtctcgtaagcggagggattcgtcggatgagagtgagtcggaccgtgaggtggagaagaggaaacggaaagggagatcgaaacggggaggttcggatgagagcagcgaggagggatcggatttggagcggaagggagggcggaagtcgaagcgggggagtagcagaagaagtagcaggagatcgaaagagaagacgcggaagagggagaagagtgaggaagagtctgaggaagaggtggagccaacgcggagtcatagggttgaggaggagcttgaaggaccaggatcatcgccttcagaagcagcagctgagagctcttctgggggttccgactcggatgaagctgaagaggggaaagctttattggaggttgcagctccgaatgaacttgacgaagaggcttataaattcaaggagttattggaggcgcaacggaagggtgtcgcaggcgacctggagagtgaacccatgattggaccagcaccggcaccgagggccgaggggcacattagctatggtggtgcgttgcgaccaggagaaggagatgctattgctcagtatgtgcagcaagggaaacgtattccacgacgtggagaggtcggtctctcagcagacgagatttccaatttcgaggacttagggtacgttatgagtggaagtcggcatcaaagaatgaatgccattcgtatccggaaggagaaccaggtgtacagtgccgaggataagcgtgcgcttgctatgttcaattatgaggagaaggctaagcgggagcataaggttatgtcagatttgcagcgtcttgtacagcgtcatattggagaagaagttgcgccaaatcatgatccctttgggacgacaaaagctgatgaagttccaacttgattttttggttaagctagacctaatcagcttagaaggtgagctatctgtctcgagcaggatatgttctagcggagtgccgcgacgattgtacatgatgaacaaggttgaattagccagtatagcttgaaagtgtgagcgaattggaagttcagaaacctaaatctcattacagcacattgatagaacagtgcaattgacgaagacggatatgtccactggtcattgccagcgttgataggttaacgcttcgcgagtgtatttctacctttatgtgctacacacgttcaaatgctcagacatgatacattatttttcctagacacgcatcgtctggttttgtatgttttgacaacatctgaagatatt

SEQ ID NO: 5375 - DNA, 994 bp, Carica papaya
gtcggaggaagagagtgagagcgagagtgaatcggatgatgatgaggaagatcgtaggcggagaaggaagagtacccgacgaaagagtagtaggaaaagcattagtaaaagaaagcgaagtaggaaaaagagtcgtaggcaaagtgattctgatgagagctcgagcgaagaaagtgaggaatctgatgttggtgggtctgctgatgatcaagctaagtcgaataagagggagaacaagcgggaacgtccttcgggttcccgatctaaacggagtaggagaaagaagaaatctgacgcggagactgagagttcgtattctgatgggaattctggttctggagaggatgcgaaaagcaaggtgaaggcagaagaggcaaagaaggctgagattaatgctgaggctctcgtttttaaggaaatgattgaagcacagaagaagcctgctctagataatgaaccagtagtcgggccaatgccattgcccaaagctgaagggcatattagttatggtggtgctttgaggcccggtgaaggtgacgcaattgcacagtatgtgcagcaagggaagcgtattccacgaagaggtgaagtgggtctttctgccgaggagattcagaagtttgagagtcttggttatgtgatgagtggtagcaggcatcagaggatgaatgccattcgtattagaaaggaaaatcaggtttatagtgcggaggacaagcgggccttggctatgttcaattacgaagaaaaggcaaaacgcgaacacaaggttatggcagatttacagcgcctggtgcagcgccacattgggcaagatgttggtcctacccatgacccttttgctggaaaagctgatggtgctgatgcttgatcttcatttgggtacgacctggtttcgatgtgcgaacatggatgagcgaaattgcgggagttcttccaaggaagacaggaattagcttgtttacatattccacatcttagaggactatctgca

SEQ ID NO: 5376 - DNA, 1201 bp, Quercus alba
agctcgaaagagaaggcgaaggtgagtaatagggaaaggaaaatcggaaagtcagtctaattccgagtctgaatcggaatcggaaaccgatgattcgcggtcgaggaggaagaggaagaggaagagttcgatttccaagggtagaaaatacgaatctgatgagagcgagagcgagagcgaatcggaggaagaagaagaaaagcgaaaacaaagaaagaaaagcagtactaggaatcggagccgccataggagtagcaaaagaagcagtagaagaaaagggagtagtagtaggagaaagagtaggtacagcaattccgatgagagtgatgattccgatgctagcaatcgagtaaggtcgaagaagaagcggagtcggagtaggaatctctcggagacagagaaggacattgaggttttgaattcggagggttctgaagttgaaaaggcagcaatgacgatagaggaggatgaggagatgaaagctgaaagcattgcggaggcattgaactttaaggagatttttgaggcgcagaagaagccggctttggatagcgaaccggtggttgggccaatgcccttgcctagagccgaagggcatatcagttatggtggcgctcttaggcccggagaaggtgatgccattgcgcagtatgtgcagcaagggaagcgtattccaaggagaggagaagtgggtttgtccgcagatgagattcagaagttcgagggtcttggttatgtgatgagtggtagcaggcaccagaggatgaatgctattcgtattaggaaggaaaaccaagtttatagtgctgaggataagagggcgttggctatgtttaattatgaagagaaggccaagcgtgagcacaaggttatggctgatttgcagagattggtgcagcgccatatagggcaggatgttggtcctaatcatgatcccttcagtgcaacaaagcctgcagatactgctgatgcttgatttttatgtatgtgattgctacctgtattggtttgatctcatgtccttgtattttcttgtaaaccaaatacttttgcttgtttaccaaaatgctactcttagcaatgtttcattgatgctttgaagtaattagtcagtacatttgtccttccagcacatagattgattgttttgggtttatagtcaaatcgagggtcatattgtcttctcccagtactgctataa

SEQ ID NO: 5377 - DNA, 1733 bp, Arnica chamissonis
tccgccgttaaagaccccgaagggcggcgtcgcaaccgtaattactcaccggaacctgctgcgccaactgaccggaggaatcgaaattcccgtcgcagtccagaatattcaaggtacgatgacgatttcaatagatcgcgtaaccgtcgttctcctgaccattctagatcgagttatcaaaatagtagagttagccgtagccggagtcgcagtccggattatagcaaatacgagaatccaaagagctatcgccgtgataaccgttcccctgattattctagatttagaagaagccctagccctagagtccaaacgataaattcgaacaggaaatcgaactacggagaccgaaatgaacagtatctcgaccgtggttttcgtaatgggaacggaccggactccgattccgacgaagagttgaaaggagcgagttatgaagaatacaggaggctaaaacgccaaaagatgaggaagatgttgaagaattgcatatggaatatcacacctagtcctccaagggtagataacgatttcgacgagcttgaaccagaggaaattgcagaaaaggatgtcgaagagaagtctgaattggattctaaggcgaggggccgttcatctgagtctgattcagaatcggagtcggaatcagatgactccttatctgattcagatgattccagatcaatgacgaggaggaagaagaagaataagaattccacgtctaggcgtagaagaaagaaatctatatctgctagtgagagtgagtcagactattcggtcgatgattctgaagaagacaagaggaagaagaagaagaagaagccaaagagatctaccaaacgaaagagtaagaggaatagaagaagtaattcaagaaaacgtaaagatagcgattctgaagaaagtagtgagagtgatgaaggcaaagaatcattgaagtctataagaagtcgcggttcttccccaaaatcaagcaagaaaaggggagaaaagggtagtgagaacgcaacatcagatgagaattcagattctgcaaatgatttcaaaactaaccctaaggctgatgaattagataaaacagaaatcgatagcgagttgcttatgttcaaagaaaagatagagtcaagaaagaagcttgatttggatgatgaaccagaggtgggaccaatgcccttaccaagagctgaagggcatattagctatggaggtgcactcaggcccggtgaaggtgatgcaattgcacaatatgtgcagcaagggaagcgtatccctcgtagaggagaagttggtctttcggctgatgagattagcaaatttgaagaccttggttatgttatgagtggtagcaggcatcaaaggatgaatgcaatccgtattaggaaagaaaaccaagtctatagtgctgaggataagcgggctctagccatgtttaactatgaggaaaaagcaaagcgtgaacagaaagttatggctgatttgcagcggttggttcaacgccacattggagaagattctggcccgtctcatgatccttttggtggaaaagcaacagatgatcctgatgcatgattaccaagtacgttgtcttcaatcttgaattagttgtttgttctgttttattatacgggccgtcagttgttttaagtatttgctcttgaatgctggattattatcttttcatagaatttgatatcatagtgtgccatgtaaactgaatatatcacttgcttacc

SEQ ID NO: 5378 - DNA, 2965 bp, Euonymus alatus
tgggccctaatcccgtgtgttccgttttcctttattactcaaaaaaggatttttttggacgaattctatccagtctcgaagctgccatagccgcggtggtgaattgtaaacttgaatagacgtcaatggcaagcggagggggcaacgcgcaagccccatcggcgccctacaaaccctaccgtcttatgaaaactctaaacgctcacagtcagtccgtatcctgtgtcaaattctctaacgacggcacgctcttggcatccgcatccctcgacaaaaccctaattatctggtccgcctcctcctactcactcataacccgccttgtcggtcactcggaaggtatctccgacctcgcctggtcctcagattcccactacatctgctctgcatcagatgacaaaaccctccgcatctgggactctcgttcccccttcgaatgtctaaagattttgaggggtcactcgggcttcgtattctgcgtgaacttcaatccgcagtcaaatctcatcgtgtcgggatcctttgacgagacgattcgtgtttgggaggtgagaaccggtaagtgcacaagagtgatcaacgctcactccatgcctgtgacatcggtgcattttaaccgtgacggttctcttatcgcctccggcagtcatgatggatgttgcaagatctgggatgtggagactggagcctgcttgaagtcacacgctgaggataatagtaaagccgtttcattcgtcaagttctctcccaatggcaaattcattctgcttgccaccctagacagcactcttaaactgtggaactacacggctggcaagttcttgaaagtgtatactggtcacaccaacaaacaatactgtatcacctccacattcagtgtgacgaatgggaaatacatagtgagtggatcagaagataactgtgtttacatttgggatctgcaacagaaaaccatgcttcaaaaacttgaagggcacaatggcactgtcatttctgtaagttgccatcctattgagaataagattgcttctgcaggccttgatagtgatagaaccgtgcgaatttgggtgcaagatgcctgaacttaatcatcctaaacaacgagatgcatccttttgaatgcagaagaacggacagaagaagctcttttgttctgaaattaattactgagaataattaatgtccaatgcctcaaatcactctagaggatcttctattttgtgatgagttgtaaaagtgagactgtaaactagaaatattacataagtgcatattttgtcaacaggactggaatattgatatcaattgctctgcttcatgccaaatgcatcttcagcaccccttgtcactctttcccgacgatcagcaatcatgtctgaagatgcataattatcaaggatcaacgccatcttttgcaccaaaaggatcatgagtaggaccaacatcttgcccgatatggcgttgcaccaaccgctgtaaatcagacataaccttctgctcgcgttttgccttctcttcatagttaaacatagccaatgcacgcttgtcttcagcactgtaaacctgattttctttcctgatacgaatggcattcatcctttgatgcctactaccactcatcacatacccaagatcctcgtacttctgaatctcttctgcagaaagacccacttcacctctccgtggaatacgcttcccttgctgcacatactgggcaatggcatcaccttctcctggtctaagcgcgccaccataactgatatgcccttcagctctcggcaacggcattggcccaaccacaggctcatcatccaaggtgggtttcttcctggactcaatcatctccttaaattgcaatgcctcggcatcaagttcagccttcaatgcctcctctgccatcatcgtactcttagcatcagcatcagcatcagcatcaaaaccagaactttcatcactctgtgtctcagaacttttgtttttcctgctctttttagaagaactcgaagaacgcttcagtgtttttaactttgcacggtcaactccagaatcctccgaatcactcttttcgctagcgctctcatctgaatcatatctattcttcctcctctttctgctccttttattacttttatgactgctacgtcgccggctcctccttttccttgatttcttctttcttctatctccgtcggaatcatccgattcactttcgctctcagttccagtatccgatccactatcagtataagatgatgatttcctacttcttcgcttagccctcaaactcctcctcttccttgatcgtgaatcatcctcggactcgctctccgattcactgctctctgaaccgccagattcagaatcggcttttcccttcctaccattctccttttctttccccttctctatttcacttgaatcgctctttttggcatcatcccatccgtacttctccaaaatctcttcaggttttccttcttctagttcctcgtttccattccttggcggactaggcgtgaggttccatatgcagttcctcatcgacttccgcatcttctgcctcttgagcctcctgcgctcctctaaactcaatcccttcaattcctcgtcagattccgaatcggaacgcctcccacggtcgagataagcacggtctctcccgaatttctttggaagagaatttagggtcttgtcgtacctagaatcagggcctgaactcgggattcttcttctagggctagagtacctgggcgagggcgagcgatagcggcgattcctctcccggcggtcgtcatagtcatcgtaagcggggcttcgacggcgctgacggcgatagtccggggatccctcggattcaggggtgtagcggccgttttcacgattgatccggtggcgtctgtcgggaatcacgacggtggacgctggacctcccattaggcacaggtttatgataattgaccaagtc

SEQ ID NO: 5379 - DNA, 683 bp, Flaveria ramosissima
tctgaagaggagagtgagagtgatggaggtaaagaatcgttgaagtcgaagaggagccgacggtcttcttcaaaatcgagcaagaaaaggagtgaagacagtagtgagaatgcagcctcagatgagaattcagattctgaaacccagctaaaaaccaaaccaaaggtggatgatttggagaaaactgaggttgataatgagttgcttatgttcaaagagaggctagagtcaagaaagaagcttgctttggatgatgaaccagaggtgggaccgatgcccttaccaagagccgaagggcatattagctatggaggtgcactcaggcctggtgaaggtgatgccattgcacaatatgtgcagcaagggaagcgtatccctcgtagaggagaagtcggtctttcggctgatgagattagcaagtttgaagatcttggttatgttatgagtggtagtaggcatcaaaggatgaatgccattcgtattaggaaagaaaatcaagtttatagtgctgaggataagcgggctctggccatgtttaactatgaggaaaaagcaaagcgtgaacagaaagttatggctgatttgcagcggttggttcagcgacacattggagaagatttggggccatctcatgatccttttggtggaaaagcaacagaggatcctgatgcatgattacagag

SEQ ID NO: 5380 - DNA, 725 bp, Linum usitatissimum
agattctgatgtgaatttggatcctgaaagtgatgccaagagcgaagaaccaatagcagtagatgcagaagccgtgatagctgaaaggaatgctgaagctctgaagttcaaagagatgatcgaggcacagaagaagccgcctggtttagacaatgaacctgcggttggtccgatgcctttgccccgatctgagggacacattagttacggtggagctttgaggcccggtgaaggtgacgccattgctcaatatgtgcagcaagggaagcgtatccctagaagaggagaagtgggtctttctgctgatgagattcaaaagttcgagacacttggatatgtgatgagtggtagcaggcaccagaggatgaatgcaatccgtattaggaaagaaaaccaggtttacagtgctgaggataagcgtgctttggccatgtttaactatgaagagaaggcgaaacgtgaacacaaggttatggctgacttgcagcgtttggtccagcgacatattgggcaggatgtcggtccttcgcatgatccgtttggaacaacaaaagaaaccgatgctgatgattcttgagcatgacattaggttttacaccgctgtagtcccttttgttcttccatgtttgttgtttctgaaaatttgcaagatcatagaagcctttctaaagaatgatttagtcatctattagactgttactatagaagcttttgctatccttaac

SEQ ID NO: 5381 - DNA, 2140 bp, Pinus pinaster
aagagcgacctctcagatgatgaaatctctctatataatgcttatgctggggagaagattttaattattcaaaacttgcaaatggaaaacggaagagcagaggcagacggttatcccaggcagcgaggaagattggcctcaaaggtcgaatatgtagggcgtagcagcagtaatggaaccactgggcatccaagggagcatgacggttatcatggccattcaaaaaactatggccgaagtcgaagtcgaagtcgcagcccagatccatcgaggtacgaacataagcactacccgtccagcaatggtaacagattggcttccccgtcccgttcacgtgtttcttatggcaaagccctaagtccgagccctagggtttctgatcggggtaacagttccaaagatattcatgatgaaaaccccaggacagggggagacactcttctgtacaaaagaaggcgcagtaggagtcctgatttagaatatgaaacgaggcccaatttaaacgacagccatagacagagtttcgagtgtcgaagctctgaccctctgagaaataattatgggttctacgacagacgtcggagtccaaaccctaatgacggtcgccggactgtaaaccctaatgtcgataatgagtcgcggcgtcgggatcgcagggcgagtccgagttatcatccttacgatccttctgccgggaatcgtcccttgggatttctagacagaggtgatggtcggcgtggccgtgggaatgaacagccggagagcgatgatgacgatgaggatttgaaggcggtggattttgcggagtatagaaggttgaaacggcagaagcttcgaaagaaatttaagaattgcatatggagaatcactcctagtccgcctcgggaagaaattgaacatgcagtggctagacagacgaagggtattgagaaagatgagcaggggataacgttgggcaatgataacacagccatcgaaagcaaggaagaaccccttggaaaatcgtccatgggggagaaattggatgatgggaatgcttatcgtggtaaaacttctgagggcactggaaagaaagcagggaatttaacaaagaaaactggcgggcgcaggaaaccttctccttctagcagtgggagtgattatactgaatcatctgatgatgatgagccaagaaaggacattaagggttctagatccggaaggaagaaagacaggaaatcaaagcattctagcgggagcaaaaagaggaggcatgtcagggtgagagagtatagcgaggatgatagtgtatcagaggatgactcggcgtcgtgctccagtgaaaacgaaaagctgaagaagaaaacgaatcgacaaaggaacaaacaagaaaagcgaaagaaatcgcggaatagaacgtctggatccaaaagaccacgagttcaaagttctgaagaagagaaatctgagacccattctgatagtcatgtcccatcagatgattctttagaacttgaatctggcaagaatgaagagagagcaggtgacgtcgaacctgttgaaatagacaatgaagctctgaggttcaaagaaatgattgaatctcaagaaaaaatagcggcggggcttgagaatgaaccaattgtggggccactgcctctgccaaaagcagagggccatataagctatggaggagcacttcggccaggagaaggtgacgcaattgcacaatacgtccaacaaggaaagcgtatccctcgaagaggagaagttggtctgtctgccgatgagattcaaaaatttgagacccttggctatgtcatgagtggaagcaggcatcaacgaatgaatgctattcgtattagaaaagaaaaccaagtgtacagtgccgaggacaaacgagcattggcaatgttcaattacgaggagaagtcaaaacgtgaacacaaggtcatgtcagatcttcagcgcttggtacagaggcacattgggcaagaagttgctccaacacacgatccttttgcgggcaaggcacctgaagcggcagatggataggtttatctaacaaggcatccgaagtggcagatggataggtttatctggcaaggcatccgaagtggcagatggatagaattttaagggtgtcataattattactatc

SEQ ID NO: 5382 - DNA, 1595 bp, Tripterygium wilfordii
aatgaaaacgaagaactagaagaagaaaaacctgacgagattttggagaagttcggatgggatgatgccggaaagagtgattcgagtgagagagagaaggggaaagaaaaggtgaatagcaggaagggaaaggccgattctgaatctggcggttcggagagcagtgaatcggagagcgagtctgaggatgattcacgatcaaagaagaggaggagttcgagggctaagcgtagaagtaggaaatcatcatcttatactgatagtagatcggatactgagactgagagcgaaagtgaatcggatgattccgacagagagagaagaaaaaaagaattcaaggaaaagtagtagcaggcgacgcagcagtcatagaagtaataaaaggagcagaaggaggaagaatagatatgattcagatgagagtactggacgaaaagagtgagttcggagggttcgtggaggtgaccctgcaaagctgaaaacactgaagcgttcttcgagctcttctaaaaggaagacaagaaaaacaaaaaggtactgagacagagagtgatgaaagttctgcttctgatgctgatgctaagagtaagttgatggcagaggaggcaatgaaggctgaacttgatgccgaggcattgcaatttaaggagatgattgagtccaggaagaagcccaccttggaaaatgagcctgtggttgggccaatgccgctgccgagagctgacgggcatatcagttatggtggcgcgcttagaccaggagaaggtgatgccattgcccagtatgtgcagcaagggaagcgtattccacggagaggtgaagtgggtctttctgcagaggagattcagaagttcgagactcttggatatgtgatgagtggtagtaggcatcaaaggatgaatgccattcgtatcaggaaagaaaatcaggtttacagtgctgaagacaagcgtgcattagctatgtttaactacgaagagaaggcaaaacgcgagcagaaggttatgtctgatttacagaggttggtgcaacgccatattgggcaggatgttggtcctactcatgatccttttggtgcaaaagatggtgttgatccttgacaatgatgatggttggtcaagtattctcattgttccaagtgtgttacaagtctggttgctgtcagctcgttggcattctcataaaattggcagaagggtcaaatgcaactttatgtattaggcgaactcttctcttctccctgatgaactcttctcttctccctgatgaagtgatgattctatttttgatccaatggttgggccaagatgaacactgcttttaaagttaaacttcggtgagttgtaggccacgttgggaactgcaaaaaattgacggtggatgctggtctagagatactgtgcaagggccagcatttttttccccatgttctttggttgtgaataacttggtaagtacattttagttatagagagactgtctatttagatagtctagtgcatcatgatagatgtacaaaggcgcaggtaattgaactgcctggctgttgttgacaacgatcttgacatcttctgttctttaaggacactcttgca

SEQ ID NO: 5383 - DNA, 1277 bp, Artemisia annua
ggaatgggaatgggaatgggtatgggaatgagtctgagtctgatgaggatttgaaaggagttaattacgaggattataggcggttaaagcggcaaaagtataggaagacgttgaagaggtgtatttggaatattacgcctagtccgccgagaggtgagtatgacgaggttgagctggatgaagagaaagaagttgaaggagataaggaaaagttagaggatatgaaaaactcggattcggagtctgagagtgagtcagaaagtgagagtgaaagtgagtcggatgattcgaggtcgaggaggaggaagaaggggaaggggaagagtaagagttcgaggtcgaagaagaggaggagtaggatgtcggtgagtgaaagtgcgagtgagagtgaaagtgagagcgagagtgagagtgagtcgagtgatgattcggaggaagataggaggaggaagaggaagaagtcgtcgaagagatcgagtaagcgaaagagtaggagtagtagtaggagaagtagtaaaaggaagagaagaagtggttcgaggaagagtaaggatagtgaggattctgaggaaagtagcgatagtgaggaattgtcgaagaggaaaaggagtcgatcgtcgagtaagaaaaggagtgaaaagggtagtgacgattcagcttcggaaaaggattcaggttcagaaaatgatgcgaaaggtaaagttaacgtggatgatgcagaaaaaccagtatccgagagcgagttgcttgcgattaaagagatgatagagtctaggaagaaagttgctgttagtgaagatgatgagcttgtaggaccaaagccgttgcctcgagctgaagggcatattagttatggtggtgctttaaggcctggtgaaggtgatgctatagcgcagtacgtgcagcaaggaaagcgtatcccacgtagaggagaagtcggtctttcggctgatgagattagtaggtatgagaatcttggttatgttatgagtggtagtaggcatcaacggatgaatgctattcgtattaggaaagaaaaccaagtttacagtgctgaggataagcgggctttggctatgtttaactacgaggaaaaagcaaaacgtgagcagaaagttatgtctgatttacagcgattggttcaacgacatattggagaagaaactggcccgtctcatgatccttttggtggaagtgggcaagcgacagaggatcctgatgcgtgattacagagttgtgggaattgcctatacaacatgatggagatggatgagcaa

SEQ ID NO: 5384 - DNA, 1657 bp, Gnetum gnemon
actacaacaggtccaggagccccaggggttatgatgaacgtttagattcataccctagaaaccctagatccagggattttgatgaaaatccaaggtttagaaggggcagccctagctatcatccttacagcaatggcggaggtcatgaacatgagagtgatgatgaggatgaggaacttagggggctggaattttctgagtacaggaggctcaagaggcagaagctgaaggaaaaattgaagaattgtatttggaggattactcctagccctccgaggggttatggtatggaagaaaattgggagggtcagaaaattgatgggctagaagagaatacggaggggaagttcaattccgacgattctgaaaaaaagttaaattcgaaggacaaaaatggttcagagaaggatgggaagggcagtgacgtttctgggtcatcagaattcccatcatcgagcgaggattcaagggagaaatcccggaagaatggcgggaaatctggcaagaggagtaagtacagtgaaagtgagagcagtgatagcgaacaagacagtggcagtgatgattcaagagtcaaatccaagaaaaatggcaggaaatcaggtaggaaaagaaatatagcgaaagtgagagcgaagatgatggtgtttgtgatgatccatcgaattctctaagcgaggacgacagagacaaaatcaaaaagtccaggagcacatcgggaaggaaatcttcgaagaaaattatgcagaagaggaagcgcaggcaggattcagattcacgttctgggtccgagtctgatgagaaacccacaagaaggaaacgctcggaaaaatccagcaagaaaacccgcagctccaaacacaaagataagaggagaaacggaggagatccgatgattccgcatctgaatctaaatcatcggaggtatcatctgcatctgaatctgattcaaagtccgaaaaatcaggcggtgagaagggtgttgaaaatgatcttaagaaagttgagattgacaatgaggctcttaggtttaaggaactgattgaatctcagaagaaggcagcagcaggccatgataatgaaccagcggtaggtcccatgccattgccaaaagctgaggggcatatcagctacggaggagcactcagaccaggagaaggagatgccattgctcagtatgttcagcagggaaaacgtattccaagaagaggagaagtgggtttgtctgcagaggagattcagaagtttgagtctttgggttatgtgatgagtggcagcaggcatcagaggatgaatgctatccgtatcagaaaggaaaaccaggtctacagtgctgaagataaacgtgcattggcaatgtttaattatgaggagaaggccaagcgtgagcataaggtcatgtctgatcttcagaggcttgtgcagagacacattggacaggatgttggtccaactcatgatccatttggggccaagggtggcgatgctgcagactgatatattgtattttattgctggatcgtgtttctctttgaattgctctggtttaagttcaaggtacttgcggtgaattttgtattttggagttttacaaaactgatgtgatgcaggtgctaccttttacatctgcaataaaatgttcatactctagcttttg

SEQ ID NO: 5385 - DNA, 1505 bp, Lactuca sativa
tcggccttatggcctgtagccggggtcgcagcccggactatagcaggtacgataatcaaaatagttatcgccgcactcatcgttcccctgattatcctagatctaaaagaagccctagccctagaatcaaaaccatgaatacgaacaggaaaccttattacggtgaccaaaagaaacagtatcttgatcgtaataacctgaacgggaacgggaacggaccagagtctgaatccgacgaagagttaaaaggagccagttatgaagattaccggaggctaaaacgtcaaaagttaaggaaaatgttgaggaattgtatatggaacatcacacctagtcctccaaggcgcgatgatgatcccgatgagcttgaacccgaggaaattgcagagaaggatgctgaagaagataatgaaaagtacaaggatacaaagtctgagttagattcaaaggagaggagccattcatccgagtctgaatcagaatcagaggactcggaatctgattcagatgattccagatcgaggaggaggaagaagagcaagcgttcaagttctaggcgtaagcggagaagcaggaaatcagtatccgtgagtgacagcgaatcagatgaatccactgatgattctgaagaggaagataggaggaggaagaaaaagaagcagaagaggaaatccaccaacgaaagagcagcagcaggagagatagtaagagaaagagaagaagacctcaagaaaaagtaaagatagtgattctgaagaaagcagcgaaagtaatggagaagagggatcatcaaagactaaaagaagtcgttcttcttcctcaagcaagaaaaggagcttaaagggcagtgacaattcagcatctgataagaattcagactctgaagatgatgatagaagcaaaccacaggtggatgaaccagtgaaaacagaggaagctgaacgggagttgatattgctgaaagagatgattgaatcaagaaagaaagctggtttagatgatgatgatgatgaagaagcagaagtaggtccaatgccattgccaagagcagaagggcatatcagctatggaggtgcactgaggcctggtgaaggtgatgcaattgcacagtatgttcaacaagggaaacgtatccctcgaagaggagaagttggtctttcagctgaagagattagtaagtttgaggatcttggttatgtgatgagtggtagtaggcatcaaaggatgaatgcaattcgtattaggaaagaaaaccaagtttatagtgctgaagacaaaagagctcttgccatgtttaactatgaagaaaaggcaaaacgtgaacagaaagttatggctgatttgcagcgtttggtgcaacgccatattggagaagaaactgggccttctcatgatccttttggtggaactggaagagttgcagaggatcctgctgatgcttgagatcacagactgcagttgcaggtggcaaatgcaaagggagaactaaggagagtcattacagg

SEQ ID NO: 5386 - DNA, 1539 bp, Physcomitrella patens
gtgtctcgtcacagcgagagaagcagagagtgagtgatgcaaatggatcgtggcagggagagaggccgcgatggctacgtccatagccacttgcgttctgttgcggtaccagtcagggattccaataactaccgccaccgcgaagaacacgaccgcctggaggattccgacagcgattccgagttacgtcgcacgcaggatccttcggagtatcgtcgcctcaagcgggagaagatgcgtcgccagtttaaaaattgcatttggaacgttaccccgagcccaccgcggcaccgtggcggcgagccggagcaagaaagtgagtccgattcagacgtggaccgaaagaggagacataagaaaatgaagcatagtaggagggttgaggaaagtgaggaggattcggatgttgatcgaaagaggaggcacaagtccaaaaagcgtagcagtaggtctcataagcgtagggaggcttcggacgacagtcaatcggatgacaaggtgagtagaagaagtcgaagagtaaaatcttccaaaaggagacgttctgatgacagcagtgaggaagactctgatgtcgagcgtaaggagcgtgcaaggacgaagcggggcagtagcagaagaagcagtgagaggcgatcgaaagaatcgagaaagaagttgcggaagttggaggatagttcggaggagactgaagaagaggtcgatcttaaattgggtctcatgtccaaggaagggctcaaaccatcaggacctccacattcagatggagcagcagagagttcttcaggaggctccgactccgatgaagcggatgtagaggagattggtgaggaggtcgcgaatcaaaatgaagttgacgaagaggcttttaaatttaaggagttgctggaagctcaacggaaggctgctgcagggggtctcgaaaacgaaccgatgatagggccagctccggcaccaagggctgagggtcacattagctatggtggtgcattgcgacctggagaaggagatgctatagctcagtacgtacaacaaggaaaacgtattccacgacgaggagaggtgggactttcagcagacgagatttcaacttttgaagacttaggttatgtcatgagtggaagtcggcatcaaagaatgaatgctattcgtattcgaaaggagaatcaggtgtacagtgctgaagataagcgtgcgctggctatgttcaattacgaggagaaggcaaagcgggaacataaggtgatgtcagatttgcagcgtcttgtgcagcgtcacattggacaagaggttgctcctaatcatgacccgtttggaacgacgaaagctgacgaagttccaagttgattcattcgtggtgaagtagagatgtttaacagtgaacgtaagattagatcccctctctgggacataggtcgctctggcgtagtatcccgaacaagtttgatgcgcattttctcgattttataacttggacaatgtcgagcaggttaagttgtaatctatttttgagaaatgaaaatacagtaccttcatgta

SEQ ID NO: 5387 - DNA, 2475 bp, Pinus taeda
ttcaaaactcgcaaatggaaaacggaagagcggaggcagacggttatcccaggcagcgaggaagattggcctcaaaggtcgagtatgtagggcgtagcagcagtaatggaaccactaggcatccaagggagcatgacggttattatggccattcaaaaaactatggccgaagtcgaagtcgaagtcgcagcccagatccatcgaggtatgaacataaccactacccgtccagcaatggtaacagattggcttccccttcccgttcacgtgtttcttatggcaaagccctaagtccgagccctagggtttctgatcggggtaacagttcaaaagatattcatgatgaaaaccccaggagagggggagacactcttctgtacaaaggaaggcgcagtaggagccctgatttagaatatgaaacaaggcccaatttaaacgacagccatagacagaggttcgagtgtcgaagctctgaccctctgagaaataattatgagttctacgacagacgccggagtccaaaccctaatgacggtcgccggactttaaaccctaatgtcgataatgagccgcggcatcgggatcgcaggtcgagtccgagttatcatccttacgatccttctgccgggaatcgtccctcgggatttctagacagaggtgatggtcggcgtgggcgtgggaatgaacaacccgagagcgatgatgacgatgaggatttgaaggcggtggattttgcagagtatcggaggttgaaacggcagaagcttcgaaagaaatttaagaattgcatatggagaatcactcctagtccgcctcgggaagaaattgaacatgcagtggctagacacacgaagggtattgagaaagatgagcaggggataacgttgggcaatgatgccagagccatcgaaagcaaggaagaaccccttggaaaatcgtccatgggggaaaaattggatgatgggaatgcttctcgtagtaaaatttctgaggacactggaaagaaagcagggaatttaacaaagaaaaatggcgggcgcaggaaaccttctccttctagcagtgggagtgattattctgaatcatctgatgatgatgagccaagaaagggcattaagggttctagatccggagggaagaaaaacaggaaatcaaagcattctaaaccttctccttctagcagtgggagtgattattctgaatcatctgatgatgatttgccaagaaagggcattaagggttctagatccggagggaagaaaaacaggaaatcaaagcattctagcgggagcaaaaagaggaggcatgtcagggtgagagaggatagcgaggatgatagtgtatcagaggatgactcggtgtcgtgctccagtgaaaacgaaaagctgaagaagaaaacggagcgacaaaggaacaaacaagaaaagcgaaagaaatcgcggaatagaacgtctggatccaaaagaccacgtgttcaaagttctgaagaagagaaatctgagacccattctgatagtcatgtcccatcagatgattctttagaacttgaatctggcaagcatgaagagagagcaggtgacgtcgaacctgttgaaatagacaatgaagctcttaggttcaaagaaatgattgaatctcagaaaagaatagcggcggggcttgagaatgaaccaattgtggggccacttcctctgccaaaagcagagggccatataagctatggaggagcacttcggccaggagaaggtgacgcaattgcacaatacgtccaacaaggaaagcgtatccctcgaagaggagaagttggtctgtctgccgatgagattcaaaaatttgagacccttggctatgtcatgagtggaagcaggcatcaacgaatgaatgctattcgtattagaaaagaaaaccaagtgtacagtgccgaggacaaacgagcattggcaatgttcaattacgaggagaagtcaaaacgtgaacacaaggttatgtcagatcttcagcgcttggtacagaggcacattgggcaagaagttgctccaacacacgatccttttgcgggcaaggcacctgaagcggcagatggataggtttatctggcaaggcatctgaagcggcagatggatagaatttttaacggttgtcataattattactatcttttttgtaaaattttcagtttattatattcaatgtaaagcactaagctgtgttttcttgccacttatgtccaggagtgtgttatattgccatttcttatattccaacgagcaaggctgctcttggtccaattgttttggtgactcccaatcttaaaattgcagattgcattgttggcactgttgccattttctactctgaatggttagtcaaccagaaccttttacgttggtttcatttctgtataggtaatgtttctgaaataggaatgcttgagaatcatttggaggagttttagaattatttcctgagaagatt

SEQ ID NO: 5388 - DNA, 2025 bp, Populus trichocarpa
ggcgaacttaacaagctgcaccgaagaaaccgactttaatacaggcggtcctcctccctcccattacagaaatatccttataaatcaatcttcctcgtgaacactatctcctatccctaaaatgggcaggccattgtccaccgttgaaattcctgatagacgatacattcctgaccgccagaacagccgttacacaccagaatctgacgcctcccctgaccatcgccgccgccgtgaccgtggtagtccctcttatcaaagctacgacgatcgccatcgcgaaatcgatcgcggcagacgccgtcggtcgagctcacccgactactctagaagccctagaagaagaacaacaagaagaagcccaagccctaggcaaaggcaaaccctagatcatcctctcccaaaaaaattcggcaagggccggtcttttcttgataggaatggaagggaatcggatgaggaatcggatgaggaattgaaaggattgagttttgaggagaggaggaggctgaagaggcagaagatgaggaagtctatgagttattgtatttggaatgtttcgccaagtcctccgagaggggataatgaagaggaatttgaggagaaagcggataagattgaggagaagcatggagaggatgaaaaaaagagtgatgattctagcggaaaagagaaggagaaaggaaataatggaaaggggagaatggagtcagagaattctgggagtagcgagtccgagtcagatgattcgagggagaaaagaaggaggggattgagttctaaacgtaggaggagaaggaacagtgatagtgaatcagatgttagtgagagtgaacccgactctgaagaagatcggaaacggagaaagaagtcccggaaaagtattagtaggcggagaaacagtagtaagagcattggtagaagaagaaagagtacaaggaagaagagtaagtatagtgattctgattatagtgggagtgaggagtctgatgatgatcgtgtaaagtctaagaagaggagtcgctcttccggttcgcaatctaaggggagcaagaagaagagaaccactgaaacagagggcgagaatctggattccaatgagggttctggttctgagaaaaacgaagtaaatgatgatgatgatgctgacaaggctgaaactgatgttgaggcattgatgtttaaagaaatgattgaggcacaaaagaaacccgctctggataatgaacctgaggttgggccaatgcccttgcctagagctgaagggcatattagttatggtggagctttgaggcctggtgaaggtgatgctattgctcagtatgtgcagcaagggaaacgtattccacgtagaggtgaagtgggtctttctgcagacgagattcagaaatttgagaatcttgggtatgtgatgagtggtagtaggcatcagaggatgaatgccattcgtatcaggaaagaaaaccaagtttacagtgctgaggataagcgggcgctggccatgtttaactatgaagagaaggcgaagcgtgaacacaaggtcatggctgatttgcaacggctggtgcagcgtcatattggggaggatgttggccctagccatgatccatttgctgcaaaagcatccgatgatgctgatgcttagggaggtatctgactggcaagagaaatccaagcaagcaaaaactgggaatctgacctctcacttttaattctgtgcatatcattcacatgcaaaagttgtgagaggactggtttagagaatattaatgaagatctccattgtaggacatatatgtgcagacagaatgtgatgtgtctcaataattccagggagctggcgagggatgctcatatttatgcaactgtattaactcaaggaaaattgtctttttgtttgactagacttcttacaattagatgggaactgtaattttgcactccttttaatcctttttaagttgtccattatttctgttatttttatgctgttttcttctattcaattgccacacccagcgttgt

SEQ ID NO: 5389 - DNA, 1880 bp, Populus trichocarpa
cataaacgcaaattcctaaaatgggcaggctatcatccaccgttgaaatctccgatagacgatacatccccgaccgccaaaacagccgtgacacacccgagttcgactcccctgactaccgacgccaccgtgaacgtcgcagtccctcttatcaaaactacgatgatcgtcaccgggaaatcgatcgcggccgacgccgtcgctctagctcacccgaatactcaagaagtcctagaagaagaacaacaagaagaagtccgagccctaggtacaaagaaaccctagatcattctctccctaaaaaattcggcaagggccggtcctttcttgataggaatggaagggaatcggacgaggaatccgatgaggatttaaaaggattgagttttgaggagatgaggaggctgaagaggcagaagatgaggaagtctatgaggtattgtatttggaatattacgccaagtcctccgagaagggacgatgaggaggaattggtggagaaagcggacgagatagagaagtacagagaggatgaggtaaagagcgaagattccagcggaaaagagaaggaaaaggcgaaatcagagtcggagaattctgggagtggtgagtcggagagcaagtctgagtttgagtcagatgactcgagggagaaaagagagaggaggaaatcaagttctaagcgcaggaggaggaatagtgatagtaaatcagatgtgagtgggagcgaaagtgagagtgaatcagacactgaagaagatcggaaacggggaaagaagtcgcggaaaagtattagtaggcggatcaagagtagtaagagtagtagaagaagaaagagtaggaggaagaagagtaagtatagtgattctgatgatagtgggggtgaggagtccgactctgatgatgatcgtgtaaagtctaaaaagaggaggcgttcttcaggttcgcgatctaaggggagtaagaagaagagaggttctgaaacagagagtgagaatttggattcccttgagaattctggttccgagaaaaataaagcaaatgatgacgaggctaacaaggctgaagttgacgttgaggcattgatgtttaaagaaataatcgaggcacaaaaaaaacctgctttggaaaatgaacctgtggttgggccaatgccgttgcctagagctgaagggcatattagttatggtggagctttgaggcctggtgaaggtgatgctattgcacagtatgtgcagcaagggaaacgtattccacgtagaggtgaagtgggtctttctgcggatgagattcaaaaatttgagactcttggctatgtgatgagtggcagtaggcatcagaggatgaatgccattcgtattaggaaagaaaaccaagtttatagcgctgaggataagcgggcgctggccatgtttaactatgaagagaaggcaaaacgtgagcacaaggttatggctgatttgcagcggctagtgcagcgccatattgggcaggatgttggtcctagtcatgatccttttgctgcgaaagcatctgacggtgctgatgcttaggaggtatctgacctgcaagagaaattcaagcaagcaaatgctaggaacctgtttgtgataagaccagtcgtgagaatgtcaatgaagatttcgaacataggacaaatatgtgcagacggaaggtgatttgtttctacaatttgagggagtgggcaaaggcctgcttccttttcattttactattacgtttatcattaagttcattgtcacttcgttttttacctttcaactgactgttcgagtcaataatcgcaatctattaggggagatgagaaacatgcatttattttttattttatttttatattatgatttacgttccatgtc

SEQ ID NO: 5390 - DNA, 1015 bp, Selaginella moellendorffii
ggcgaagaggcgaccgagcatttccagcagcaacggcagcagcagcgacgactccgaatccgaatccgaccaccgctccaggcggcgccacggccgacgccgcgagcacgagaaatcgaggtcagtctcgcgtcacaaaacctccactagcagcagggacaggaaatccaagtccagcagcagcagcagcagcaagcacagcaagaagaagaagcgccgccgccgcgcgagatcgccgtcgccctcctcctcttcctctccgtcgtcctctgcctcgtcggagctcaacgatggcgcgccatcggacgacgcgcgcggcggggatgaagccggggaagaacaggactccgccaagaagatgctcgagattgacgaggaggcgatcaagttccgggggctgctcgaggcccagaagaaggccgcgatgggatctctggagagcgagcccatggtcggcccggctccggcgcccaagacggagcggcacataagctacggaggagcgctgcggccgggagagggagacgccatcgcccagtacgtccagcaggggaagcgaatccctcgcagaggagaggtgggtctctcggcggacgagatccagaagtttgagtcgctgggctacgtgatgagcggcagccggcaccagcgcatgaacgcgattcgaatccggaaggagaaccaggtgtacagcgccgaggacaagcgagcgctggccatgtttaactacgaggagaaggccaagcgcgagaggaaggtcatgtcggatctccagcggctcgtccagcggcatatcggtgccgacgttggcccgactcacgatccattcggcaaaggtaccggggcagaggtagccgaaggatagagtgcgtgtgtatttagcagcaagaactcttaagaacaagaacaagtaaaacaggaactttcaagaacaagaacaatagtgtattaatcctttatcatcatcttctggaagaaaatctacaaattactcgaagaacatatatcgcagcta

SEQ ID NO: 5391 - DNA, 1950 bp, Helianthus annuus
acatctgtccaatgggataccctgcttccaccgttaaccaccccgaccgacggcgtcgcaaccgtaacgactcaccggaaccttctcctccacccgaccgtcgccaccgcagctcccgtcgctctccagaacattccaggtacgatcacgatctcaatcgttcacgtaaccgtcgttcacctgattattctaaatcaactcatcaaactcgtagtattagccgtagtcgtagtccggattatagccgttacgataatcaaactagctatcgccgtaatcaccgttcgcctgaaaactctaggtttagaacaagccctaaccctagggttcatgtagatccgaataggaaggtgaactatggagaacggaataaacagtatctggatcgtgatcgtggtggttatcgtaacggtaacggtgatggaccggagtctgagtcggatgaggagttgaaaggactgagttatgaagagtataggaggttgaaaaggcagaaaattaggaagatgttgaggaattgtatatggaatgttacaccgagtcctccgaggggggataatgagtttgatgaggatgaaccggaggaggttgtggaagaaaaggatgagttggatttgaaggcgaagggcggtggttcgtcggagtctgattcggagtcggagtcaggatcggatgactcggtttctgattccgatgattctaggtcgaggaggaggaggaagaagagttctaggtctaggcgtaggagaaagagatctgtttctgtgagcgacagtgagtcggatgattctgaagaagaagacagacggaagaagaagaagagttcgaggtctagggctagaagaaagaaatcggtatccgtgagcgagagtgagtcggactattcgactgatgattctgaagaagaaaggaggaagaagaagaagtcgaagagatctaccagacgaaagagtagcagtaggaaaactagtaagagaaagagaagaagtagttcaagaaaaggtacagatagcgattctgaagaaagtagcgagagtgatagaagcaagtccaaaagaagccaccgatcttcctcaaaatcaagcaagaaaaggagtgaaaaaggtagtgagagttcagcatcagacgataattcagattctgcaaatgaaaacaaaagtaaaccaaaggcggatgatttggagaaaacagaaaacgatagtgagatgctcatgtttaaagaaatgatggagtcaaaaaagaagcttgcattggatgatgaaccagaggtgggaccgatgccgttaccaagagctgaagggcatattagctatggtggtgcattgaggcccggtgaaggtgatgctattgcacagtatgtgcagcaagggaaacgtattcctcgtagaggagaagttggtctttcggctgatgagattagcaagtttgaagatcttggttatgttatgagtggtagtaggcatcaaagaatgaatgcaattcgtattaggaaagaaaatcaagtctacagtgctgaggataagcgggctttagccatgtttaactatgaagaaaaagcaaagcgtgaacagaaagtcatggctgacttgcagcggttggtacaacgtcacattggagaagagactggcccttcacatgatccgtttggtggaaaagcaacggaggaccctgatgcttgattgcaagatatagctgttgatctggtgtactacatggctttctctgccgttgctaccatggttttgaatggacgttgctgatcgaaggttaactgttatataacttaaagtgtccttattctgtattttgcatctttaaactgatcaaatcagtctctccgcttttctaatggttttggtgcgacattatcatgttagaacctaatttgcgtgtagaatgattgttcttgtatttttgacatattaaacgaaataaggtacacaagttcgg

SEQ ID NO: 5392 - DNA, 1030 bp, Ambrosia trifida
aaatctgtatctgtgagtgagagtgatgactactccagcgatgattctgaagaagatagggggaagaaaaagaagaagtcgaagagatctactagacggaagagtagtggaaggagaagtagtaagagaaagagaagaagtagctcaagaaaaggtacggatagcgattctgaagaaagcagtgagagtgatggaagcaagtctaaaagaagtcgtcgttcttcctcgaagaaaaggagtgaaaagggtagtgagggttcaacatcagatgagaattcggattctgcaaatgattctaaaagtaaacccaaggcggatgatttagtgaaaatagagacggatggtgagatgcttgcgtttaaagagatgatggagtcaagaaagaaggttgttttggatgaggaaccagaggtgggaccaatgcctttgccaagagctgaagggcatattagctatggaggtgcactgaggcccggtgaaggtgatgcaattgcacaatatgtgcagcaagggaagcgtatcccccgtagaggagaagttggtctttcagctgatgagattagcaagtttgaagatcttggttatgttatgagtggtagtaggcatcaaaggatgaatgcaatccgtattaggaaagaaaatcaagtctatagtgctgaggataagcgggctttagccatgtttaactatgaagaaaaggcaaagcgtgaacaaaaggtcatggctgacttgcaacggttggtacaacgccacattggagaagatactggcccttctcatgatccttttggcggaaaagcaacagaggacccagatgcttgattgcaacatcatcttctctttgttgatatagatagttgatctggtatgctacctggctttgtctgctgttgctatcatggtttgaagtccagctgctgttggatatattaattggaagttgctgatggaagctcaactattatatactcaagtgtccttattctgtatgcgatattatcatgaacctagttttattgtagaatgattg

SEQ ID NO: 5393 - DNA, 1674 bp, Cirsium arvense
gggttaccaccgcctccgccgtagaagtccgccaagaccgccgtcgcagccaccgtgacaaccgcaactatccaccggaacctgattctccgaccgaccgtcgcaaccgcacctcccgccgtagtcctgactactcaaggtacgataaccacgattccaatcgatctcgtaaccctagccgtaatcgttctcccgattattccaaatctagaaatcgtaatcgtagccctagccgtagccgtagtccggattatagtcgatacgatgatgcaaacggccatggccgtgatcgtcgttcgcctgattactctagatctagacgaaaccctagccctagggttgaaactttcaattcgaataggaaaccgagttatggcgatcaaaataggcagtatttagaccgtgattaccggaatgggaacggtaatggaccggagtctgaatccgatgaggagttgaaaggagcgagttacgaagattatcggaggctaaaacgtcaaaagttaaggaagatgttgaagaattgtatatggaatgtgactcctagtcctcctaggggcgatagcgagctggatgagattgaggtggatgaagttgcagagaaggatgtggaagaagatggagagaagtataaggatgcaaagtttgaattggattcaaagacgaagggaggttcgtctgaatctgagtcggattctgattcgaaatcggaatcagatgactcgttgtctgattcggatgattcgagatcgcgtaggaggaggaagaaggggaagagttcgagctctaggcgtaggcgtagaagcaggaaatctgtatcggttagcgagagtgaatcagacgaatccatggacgattctgaagaggaagataggaggaagaagaagaaatcgaagaggagatcgagcaaacgaaagagtagcagtagcaaaagttctaagaggaagagaaggagcaaatcgagaaaaagtaaagatagtgattctgaagaaagtagcgacagcgaagaactcgaggaaccaccgaagctcaagaggagtcgtagcacttcctcacaacccaaatcaagcaagaaacggagcgaaaatggcagccagaattcagcatcagacgtgaattcagactcggaaaacgatacaaacaaacccaaggtggacgatacagaaaatacagaggtagacagcgagttgcttatgttcaaagagatgatcgaatcccgaaagaagcccgctctggatgatgaaccggaggtagggccgatgccattgccgagagccgaagggcatattagctatggaggtgcactcaggcctggtgaaggtgatgccattgcacagtatgttcagcaagggaagcgtatcccacgaagaggagaagttggtctttctgccgaggagattagcaagtttgaggatcttggttatgttatgagtggtagtaggcatcaaaggatgaacgctattcgtattaggaaagaaaaccaagtttatagtgctgaggataaacgggctttggcgatgtttaactatgaggaaaaggcaaagcgagagcagaaagttatggctgatttgcaacggttggtgcaacgccatattggagaagagactggcccttctcatgatccttttggcggaagtggaagagcaacagaggatcccgatgcttgattgcagg

SEQ ID NO: 5394 - DNA, 1731 bp, Citrus clementina
ttgcaacggtgcaaaagctaaatcaagttacgaaaaagaaaaccatttacattgaccgaccattgcttcttagcttaatcaacaattatgggccgtccatcatccaccatcgaaatcccagacagacgccgccgttccggcggctacccctcggactccgaaaattcacccgtttaccggtaccgctctcccttccgctcccgctcccgttcccgttcccgctcatattcaccgaaatatcgaagccctagacgaagaagaagtccaagccctagacgaagaagaagtccaagccctggacgaagaagaagtcccgtaggcagcaattacgaaaccctagactcgttgccgaaaagatttggcaagagcaaccgagattataggaacgggcatgacgtagagtcggatttcgacgaggaattgaaggggctgaactttatggagtacaggtggcgaaagaggcagaagatgcgtaaatccttgaaacactgtttctggaccgccacgccgagtcctccgagatacgagaacgatgacttggaggacgataaacctgatgagattttggagaaatacggaggtgatgattcgagtgggaaagaaaaagacgattctgaagctgagcattcgaagaggagtgcgtctgcttctgaatctgatgatccgcggtctaggaagaataggaaaaagattgaatccgagtctgaatcggatgattcaaggtctaggaagaagagaaagagtaggagatcgaagccgaagagtagaaaacctagtgaatcagaagatgatgagagcgattctgatgaggaagaggatagacgcaggagaaagagacgaggtagacggcacaagaatagaagcagcagtaaaagaaaggcaagtaggaggaagagtaggtacagtgattcggatgagagcgatagtcggggcagcgaaactgagcaatctgatgccagtcagtcttctgatgatgataatgggaaattgaagaagcccaagctttctctgtctaaacggagtaagaaagagcagaagtcagaaagtgagagtgatgagagtttaggttctgaacagaaaatggacgatggggctaagcaggctgaaatcaatgctgaggtgctcaagtttaaggaaatgattgagtctcagaagaagccagctttagataatgaaccggcggtgggtccaatgccactgcctagagctgaagggcatattagttatggtggtgcacttaggcctggagaaggtgatgccattgcacagtacgtgcagcaagggaagcgtataccacgaagaggtgaagtgggtctatctgctgaggagattcagaaatttgagagtcttgggtatgtgatgagtggtagtaggcatcagagaatgaatgctattcgtattaggaaggaaaaccaggtttatagtgcagaggacaagcgagcattagcaatgtttaactatgaggagaaggcaaaacgcgagcataaggttatggctgatttgcagcgcctggtgcagcgtcatattgggcaggatgttggtcctacccatgatcctttcggtggaaaagacggtggtgaaacttgatgctcttgtacgttcaatattagctatgttgttgctttattattttctgttttatggagtggattatactgaaagaattggatgcagatttcataattaaatgggtggctgtcaactttcctttctatctttactaagcatttg

SEQ ID NO: 5395 - DNA, 1556 bp, Euphorbia peplus
gaagaagaagaaaaagaagaagaggagttctaggcggaggagcaggaggtcgtccgggagcgatagtgaatcagagtcagattcttctgatgagaatcgaaagagcaggaaaaagtcacgcaaaagcagtggtaggaaaaagaagagaagcagtagaaaaccaagtaagaggaagaagacaaggtatactgattcagatgatgaaagtggaagtgaagagtccgagttggattcaaagaagcggagaagatcatcggcctcaggaggctctaaacgtggcaagaagaagaagaaaacctctgaaacagagagtgaaaatttgcatcatagtgagagttcaggttctgaaattgattcaatgggaaaagcaaaggaggtagaggagttgaaaaagattgaacttgatgatgatggagaggctttcatattgaaagagatgattgaagctcaaaagaagaatgctgctttggataatgagcctatagttgggccaatgccattgcccaaagctgagggacatattagctatggaggggcattgaggcctggggaaggtgatgccatagcacagtatgtgcagcaaggaaagcgtattcctcgaagaggagaagtgggtctttctgctgatgagattcagaagtttgagaatcttggatatgttatgagtggaagtaggcaccagaggatgaatgctatccgtatcaggaaagaaaaccaggtctacagtgctgaagacaagcgagctttggccatgtttaactatgaagagaaggctaaacgtgagcacaaggttatggctgatttacagaggctagtccagcgccatattggtcaggatgttggccctactcatgatccctttggggctaaagcatcatctgaagcccctgatgcttgatacttgctaaggaaacaaaatgctctgcaaaaaaatttcatggaactctggaaacctacgggtgacttagttatattatgatagagcttgatcatggtttttacgtggtgaaatttgccgatgacttagatagagatagggtttttacaggaggagcttggctgatacatggaaattaccttactatatgaacctggtctccgagtttcgttccatcaaattctgaagttgataaatccatggtatgggttcgtttccctgaattgccattagcgtaattataatgaggatgtgttattagccatagcgagctctctagggaaatcagtaaaggcttctagcaaaggtcggtttgttagggtttgtattgaaattaatatgctcaaacttttggttactcaatttggtttgaatgggaaggttcaacgccatgtgtatgaagacctccgtatagcttctacttattgtgaacagtatagacacctcaaatcaaactggatctagcttaatgttttagtcttaatcttgttatcttttgtagcagcttgcctaagataaagatgcttggcaaaggtatttgcttactttttaagcttgagaagtttagctcgtatctttataactttgttttgggatgttgatgtagtcataaatttca

SEQ ID NO: 5396 - DNA, 1652 bp, Euphorbia peplus
tatttgagtttacataacctttccatttattttctccgttaatgggcaggccatcttccaccgtcgaaattcccgaccgccgttactttcccgatcgccgtcgcacgccggaatccgacactcccgaagactaccgccgccgccgccgtagtccttcctaccacagctacgatgaacgccatcgagaaaccgaccgcggccgttatagctctcgctcaagccctaggagaagaagtcgaagccctaggcccagaaaaaccctagaagattctttgcccaaaaagttcggcggcggaggagggcgttcctatctcgaccgcggaggcggtggtcatcggaactcaggatctgaatccgatgaggaattaaatggattgcccttcgaggaacgtaggcggattaagaggcagaagatgaggaaaagcatccataggtattgtttttggtcaattacacctagtcctcctagggttgaggatgatgatgaaggtctcgaaggcgaacccgatgaggtttcggataaagatgaggagaagagtgataaagggaagggtaaattggagtctgcgtcggagaaatccggtagtagtgattctgagtcgctgtctgatgaatcagggaagaagaagaggaagaggaggaggagttctaggcggaggagcaggagatcttcggagagcgaaagtgaatcagagtcggattctgaagaggatcgaaagaacaggaagaagcgcagtggtaggaagaagaggagtagcaagagaagcagtagaaaacgaagtaagaggaagacgaggtatactgattcggatgatgatagtggaagcgaagaagaatctgagttggaatcaaagaaacggagaagatcatcaggcaagaagaagaaaacatctgaaagcgagagtgaaaatgtgaatccgagtgagatttcaggttccgaaactgattcaaagggaaaagaaaaggtagaggagttgaaaaggattgaacttgatgcggaagcacttatattgaaagagatgattgaagctcaaaagaagccagctttggataatgagcctatagttggcccaatgccattgcccaaagccgagggacatattagctatggaggtgcattgaggcccggtgaaggtgatgccattgcacagtatgtgcagcaaggaaagcgtattcctcgaagaggagaagtgggtctttccgctgatgagattcagaagtttgagagtcttggatatgtgatgagtggaagtaggcaccagaggatgaatgctattcgtatcaggaaagaaaatcaggtttatagtgctgaagacaagcgagctttggccatgtttaactatgaagagaaggctaaacgtgagcacaaggttatggctgatttgcagaggctagtgcagcgccatattggtcaggatgttggccctactcatgatccttttggggcaaaaacatctgaaggccctgatgcttgatgctaaggtatgcattgctatatgcgttatgatcctaaatgccatccttattcgagctttgtatagtgcctacatagacatactttttctttttctgagaaagtaactactcggtgttctaagttttggggttgtttgcactcgctgattgtttttcaatccaataacctgtatgga

SEQ ID NO: 5397 - DNA, 2014 bp, Fagopyrum esculentum
attgaaaagaacaggattttgggggttttgaaccacgttgaatggctcgtcctgcatccgaagtggtagtccctgaccaccgtcgtcggtactctcctgtttccgacgattccggtgaaaggcaacgccgccgccgcagtcgcagtccatcatacgcccgttactcacccgctgcaaatcaccgcgggcgccgaggaagatcaaaatcgccagatttcgcaaaccctagaagaaatcttagtcgtagttggagccggagtcgaagccctgagtatcgaaaacctaggtacgaggaccggcgaggacgttcgggtggattccttaatcgggatgggtatcggaacgcgagggctccccatgacgattccgacgaagagcttagaggcttgaacaatgaggagtataggaggatgaagagacaaaagttgaggaaatcgcttacgagttgcatttggaacgcgactccaagccccccgaggactgagaatgatgaattcgaccgggaagaggatgaaattgacgatgaggatggtccaggtaaagagaacggcgatgtgagagagaaatctggtaaaggaagcgaagatcgttccggttctgaatcagagtccgagtctgaaactgaatttgattcagatgattcatcatcaaggaagagaagtaaaggtaaaacaaatccaagtccaaaggtggaaataggaaacctaagacagattctgattctgaaactggatctgaatcggtttccgatgattccggttctagaagaaggaagaagagtaggaagttgagctctaggcgaaagagtaagaggctatcagatggtgaatccgaggaggatgaaattgacgaagataggcggcgtaagaagagatcaagtaagagaagaagtagccataagaagaaggcaagcagtagcaagaggagaaggcgaagagatactgattctgatgacagtgatagcgaaccaagcgaagaggaacagtctgacgcgagcatttcttctgaggaactagctaaatcgaggaggaggaagaagagcagttcttcgtcttcccattcgaagaaaagcaagagaaagagacaggagaaatcagattctgagcctgatgacaatggccaaaagggcggtgactcggatcttgaggagaaggctaaagccatttctgaggaggctatgatgaatgatccagaggtattgatgtttaaggaaatgcttgaaatgcaaaagatggctgctttgaataatgaaccagttgttgggcctcaaccattgcctaaggcagagggccatattagctatggtggtgctctaaggcctggtgaaggagatgcaattgcacagtatgttcaacaagggaaacgaattcctcgtagaggagaagtgggtctttcagctgaagagattcagaagtttgaggatcttgggtatgttatgagtggtagtaggcatcagagaatgaatgctattcgtatcagaaaagaaaaccaagtttatagtgctgaggataagagggcattggctatgtttaattacgaggagcgatccaagagagaggctaaggttatgactgatctcaagaggttggtggatcgccatataggacaagatgttggccctaatcatgatccttttggtgcaaaagatgctggtggtgatgcttgatcgatgttggacgaagaagaaaagctatggcaagatctcggttgctagcttcgttttctcgagggaagggttccagaaaatttgacagacatggctacaatttctatatgcacttcaaagctgaaagcacacagtttcttatgtgatatgtttatgttgtattcattgcttgtgcttcccaactataaagaagattagaactgtatcaaagtttcactagttcatgtacatatcaaacatcgcagattcttaactgaccctaaaaaaagtaggcactattttatccaattttccttgcaacaataatcatccatcacaggcaattgaaatgaaattaatgtcgcattc

SEQ ID NO: 5398 - DNA, 1832 bp, Citrus sinensis
gttaatttcctcgctggcggtcgaggaggggatgtcagggcacccgggtcgaggaaggacattcgaccgagtttgcaacggtgcaaaagctaaatcaagttacgaaaaagaaaaccatttacattgaccgaccattgcttcttagcttaatcaacaattatgggccgtccatcatccaccatcgaaatcccagacagacgccgccgttccggcggctacccctcggactccgaaaattcacccgtttaccggtaccgctctcccttccgctcccgctcccgttcccgttcccgctcatattcaccgaaatatcgaagccctagacgaagaagaagtccaagccctggacgaagaagaagtccaagccctggacgaagaagaagtccaagccctggacgaagaagaagtccaagccctggacgaagaagaagtcccgtaggcagcaattacgaaaccctagactcgttgccgaaaagatttggcaagagcaaccgagattataggaacgggcatgacgtagagtcggattccgacgaggaattgaaggggctgaactttatggagtacaggtggcgaaagaggcagaagatgcgtaaatccttgaaacactgtttctggaccgccacgccgagtcctccgagatacgagaacgatgacttggaggacgataaacctgatgagattttggagaaatacggaggtgatgattcgagtgggaaagaaaaagacgattctgaagctgagcattcgaagaggagtgcgtctgcttctgaatctgatgatccgcggtctaggaagaataggaaaaagattgaatccgagtctgaatcggatgattcaaggtctaggaagaagagaaagagtaggagatcgaagccgaagagtagaaaacctagtgaatcagaagatgatgagagcgattctgatgaggaagaggatagacgcaggagaaagagacgaggtagacggcacaagaatagaagcagcagtaaaagaaaggcaagtaggaggaagagtaggtacagtgattcggatgagagcgatagtcggggcagcgaaactgagcaatctgatgccagtcagtcttctgatgatgataatgggaaattgaagaagcccaagctttctctgtctaaacggagtaagaaagagcagaagtcagaaagtgagagtgatgagagtttaggttctgaacagaaaatggacgatggggctaagcaggctgaaatcaatgctgaggtgctcaagtttaaggaaatgattgagtctcagaagaagccagctttagataatgaaccggcggtgggtccaatgccactgcctagagctgaagggcatattagttatggtggtgcacttaggcctggagaaggtgatgccattgcacagtacgtgcagcaagggaagcgtataccacgaagaggtgaagtgggtctatctgctgaggagattcagaaatttgagagtcttgggtatgtgatgagtggtagtaggcatcagagaatgaatgctattcgtattaggaaggaaaaccaggtttatagtgcagaggacaagcgagcattagcaatgtttaactatgaggagaaggcaaaacgcgagcataaggttatggctgatttgcagcgcctggtgcagcgtcatattgggcaggatgttggtcctacccatgatcctttcggtggaaaagacggtggtgaaacttgatgctcttgtacgttcaatattagctatgttgttgctttattattttctgttttatggagtggattatactgaaagaattggatgcagatttcataattaaatgggtggctgtcaactttcctttc

SEQ ID NO: 5399 - DNA, 423 bp, Primula obconica
ggataacgagccgatggtgggcccacagccactgcctaaggccgagggacacatcagctacggtggggcccttaggcccggtgagggtgatgctatcgcacaatatgttcaacaagggaaacgtatcccacgtagaggagaagtgggtctttctgctgatgagatttcgagatttgaggaccttgggtatgtgatgagtgggagtaggcaccagcgtatgaatgctatacgtattaggaaagagaatcaagtatatagtgcggaggataagagggcgttggcgatgtttaattacgaggagaaggccaagcgtgagtcgaaggttatggcggatttgcagaggctggtggagaggcatatggggcaggatactgagccagctcatgacccttttagtgccagggacgatgatgctggtgatga

SEQ ID NO: 5400 - DNA, 1713 bp, Trigonella foenum-graecum
cgatcctttccctcttcacgttcactcatggcaagactatcctccaccatcgaaatctctcaccaccgtagcagacacaacgatcgccgtcgcacccccgactccgatatctctgacgaccgtcctcgctaccgccgtagccctagatacgattcatacgacgatcgtcacacacataaccaccgccgccgttcaaaatcccccgaaaccagaaaccctagacaccacgataacggaaatccaaacggaaaccatctcccaaagaaattcggcaaccgtaacaacggttcctatctcgaccgcggccgcaacgagtccgaatctgatgaagaattgaagggattgagttatgaagaatatcgaaggttgaagagacagaagatgaggaaatcgttgaagcactgtatttggaatgttacaccgagtcctccgagacgtgagaacgatgatctcgaagattatggcaagcctgaagaaatttctgagaaaattgatgtgaagaaggataaggagattaaacagaaagcaaaatctgaatctgaatctaagtctgaggaatctgaatcggattcgaggaagaagagaaggaaaagttctaagaaaatgcgcgaaagcgatagtgtatctgatgaatctgaatcagaagaagaggaggatcggaagcggaggaagaagaagtatagtgatagtgttagcgaatcggaagaagataagaagaggagaaagagaaggaagagtagtagaaggaaaaggaagagtaataggaagaagaggaggtatagtgattcagaagagagtgaaagtgatgatgggtctgactctgatgatagtataagaaggaggaagcgttcgaaacggagcaggaaaagaacgaagaaagattctgaaccggtgagtgaggattcagaggaaattgagttggattctgatacggctgttgcgaagaatacagaagaaattgatgttgacgaggggaagatggctgagatgaatgaggaggctttgaaattgaaggaattgtttgagttacagaagaaaccggctttggatagcgaaccaccggttgggccaatgccgcttccaagagctgaggggcatataagctatggtggtgcacttaggcctggtgaaggagatgctattgcgcaatatgttcaacaagggaaacgtattcctcgtagaggagaagtgggtctttctgcggaagagatttcgaagtttgaggagcttggttatgtgatgagtggtagtaggcatcaaaggatgaatgcaattcgtattaggaaagaaaaccaggtttatagtgctgaagataagcgtgctttggctatgtttaattatgaagaaaaggctaaaagggagcataaggttatggctgatttgcagaggctagtgcagcgtcatattggtcaggatgttggtccaactcatgatccttttggtgcaaaagatggttctgatgattgatattcatgtatgttaacttgtgttctttcgctttatttgtagttgtttttgttctgccggctatgttatttagacaacctgtttagacttagaaaatagcgatacaagaacttattgtcttcattaactttgcatgtggtgtacgattttcaatgagtgactaagtaactactaatatgttaacagcttggtttagttaatactgtgtatatctgtttatgtgaaattactttagaatggtagatt

SEQ ID NO: 5401 - DNA, 2515 bp, Theobroma cacao
gcagcctgtagccgtacataagggtttgtagtgtttcatcgttctttcttttcgcttttgacgttaaacattttccgaagaggatgatctttttcgcgatcttttgagcaagacacaaaacgaccgcttcgaatagcttacgccctttgattagattctgatgggccgcctgacatccaccgtcgaaattccggatcgaagacaccaatccggccgcgaaaacggccgacacacatcagaatccgatgattcccccaactattgtcgccgccgccgtagccctagctacgaagcctatgaacgtgaccatcagagccgcaacgttaaccagcagcgcaaccgttttggttcacctgaattccggaaccctagaagacgaagccctgtcgaaatacctgaaagaagacaccgttttgaccgcgaaaacggtcgctacgcatccgaatcagatgattctaccgattatcgccgccgccgtcacagtcccagttacgacatctataaccgcggccaacctcgaaaacgccatccttccgagtcacctgacggccgaaaccctagaagacgaagccctgtacatgaccgacccctaaactctctgccaaaagaattcggcaagaatcgtaactacctggacagagattatcggaatggaaagcattcggagtccgaatctgatgaggagttgaagggattgaacgttgaagagtataggaggctgaagaggcagaagatgaggaagacaatgaaattctgtgtttgggagaatacgccgagtccgccaaggaatgaagacgatgatttggaggataaagctgatgaaatttcggagaatcatgctgaggagaatgacaatgagaagagcaattcggataaagaaaaagagaagaagagcactaagagagtgaaagtcaagactgagtctgaaaaatctgcaagtagtgagtcagagagccagttggaaagtgattcagaatctgaatccgatggatcgaggtctaggaagaggaagaaggggtcgagttctaagcgtagaagtaggaatagcaaacgtggaagtaggaaatcatcgtcttatagtgatagcgaatctgatgagagcgggagcgaatctgatgatgaggaagataggaggcggagaaggaagtccaggagaaagcagagtaggcaaaataagagtagcaagaaaagcagtagaggaaaaagaagcaggaagaacagtaggtatagttattccgatgagagtgggagtggtgaaagtgaaactgatgtgtctgagatgagtcggtcttctgatgatcgtgtcaagtcaaagaagcggaaaagctcttcaaattcaaggactaggaggagtaagaagaggatacaatcagaaagtgatagtcaaggttcatattcggataagagctcagattctggagttgatgccaagagtaaagtaaaggcagatgaggctaaggtggctgaaattagtgctgaggctcttatgtttaaagaaatgatagaggctcagaagaaacctgaattggataatgaaccaatggttggcccagcgccattgccaagagccgagggacatattagttacggtggtgctttgagacctggtgaaggtgatgctattgcgcagtatgtgcagcaagggaagcgaatcccacgaagaggtgaagtgggtctttctgctgaggagattcaaaagtttgagagccttgggtttgtgatgagtggtagtagacatcagagaatgaatgccattcgtattaggaaagaaaatcaggtttacagtgcagaggacaagagggcattggcaatgtttaactatgaagagaaagcaaaacgtgagcacaaggttatggctgatttacaacggctggtgcagcgccatattgggcaggacgttggtcctactcacaatccttttgctggaaaagatggggctgatgcttgaatctcatgtatgttcaatgatgtgtattctgttggcattattagtttattgctaatttgttagcgcgtttgtgttgcaacagcagcatgattgctaatgctaactgctgagagttgccgatcgaagtgttttttttttttgtgtgtaaacagcagcatttttgctatagtatatggatttgagaaataagaaaattgtgctctgtttgcattttgtgcacatttataatttggttaaggatgttatcaatgttctttgctttgtttggtgttaattacagcgatagaaagtgagaaaaagtagtaatcagtaggtcttgtagagtcttagggtgagaaaggataaaacctaaccgttatgagcaatattcctctcatgtttgccatggatttgtggatagatagattcttgcgcctgtcaccagaacagaacagagtcatcaactgagattgtgacactacacagaccaacgaacgagttcatctcagcaaccctggatgcctgaaactatgtagtgtatgcatggctgatgagtagcaactccaacaatgaaaacttgactgttct

SEQ ID NO: 5402 - DNA, 1982 bp, Citrus sinensis
ttgcaacggtgcaaaagctaaatcaagttacgaaaaagaaaaccatttacattgaccgaccattgcttcttagcttaatcaacaattatgggccgtccatcatccaccatcgaaatcccagacagacgccgccgttccggcggctacccctcggactccgaaaattcacccgtttaccggtaccgctctcccttccgctcccgctcccgttcccgttcccgctcatattcaccgaaatatcgaagccctagacgaagaagaagtccaagccctggacgaagaagaagtccaagccctggacgaagaagaagtccaagccctggacgaagaagaagtccaagccctggacgaagaagaagtcccgtaggcagcaattacgaaaccctagactcgttgccgaaaagatttggcaagagcaaccgagattataggaacgggcatgacgtagagtcggattccgacgaggaattgaaggggctgaactttatggagtacaggtggcgaaagaggcagaagatgcgtaaatccttgaaacactgtttctggaccgccacgccgagtcctccgagatacgagaacgatgacttggaggacgataaacctgatgagattttggagaaatacggaggtgatgattcgagtgggaaagaaaaagacgattctgaagctgagcattcgaagaggagtgcgtctgcttctgaatctgatgatccgcggtctaggaagaataggaaaaagattgaatccgagtctgaatcggatgattcaaggtctaggaagaagagaaagagtaggagatcgaagccgaagagtagaaaacctagtgaatcagaagatgatgagagcgattctgatgaggaagaggatagacgcaggagaaagagacgaggtagacggcacaagaatagaagcagcagtaaaagaaagacaagtaggaggaagagtaggtacagtgattcggatgagagcgatagtcggggcagcgaaactgagcaatctgatgccagtcagtcttctgatgatgataatgggaaattgaagaagccccaagctttctctgtctaaacggagtaagaaagagcagaagtcagaaagtgagagtgatgagagtttaggttctgaacagaaaatggacgatggggctaagcaggctgaaatcaatgctgaggtgctcaagtttaaggaaatgattgagtctcagaagaagccagctttagataatgaaccggcggtgggtccaatgccactgcctagagctgaagggcatattagttatggtggtgcacttaggcctggagaaggtgatgccattgcacagtacgtgcagcaagggaagcgtataccacgaagaggtgaagtgggtctatctgctgaggagattcagaaatttgagagtcttgggtatgtgatgagtggtagtaggcatcagagaatgaatgctattcgtattaggaaggaaaaccaggtttatagtgcagaggacaagcgagcattagcaatgtttaactatgaggagaaggcaaaacgcgagcataaggttatggctgatttgcagcgcctggtgcagcgtcatattgggcaggatgttggtcctacccatgatcctttcggtggaaaagacggtggtgaaacttgatgctcttgtacgttcaatattagctatgttgttgctttattattttctgttttatggagtggattatactgaaagaattggatgcagatttcataattaaatgggtggggggggccccttttccttttcccacctttaaaaaaaaaaaaaaaaaaaaaaaaaaaaggggggggcgcccctctttaaggggttcccaattcttactttgccgcgggggtcttcgaaggcgcttttaaacctctcttttattagggggcctcccaaaatttaatttaacttcttgggggggcgttgctgttttgttgaaagggtgtgtgtgggggggggggaagaagacatccctggg

SEQ ID NO: 5403 - DNA, 2087 bp, Gossypium hirsutum
atgatctgatctctttcgaaaaatttgcgaaaaaacgaattctgatgggccgcctgacatccacggtcgaaattccggaacggagacgccaatctgatcgggaaaacggccggtacacatctgaatccgatggttcccccgattaccgccgccgtcgccgtagccctagctacgaagcctatgaacgcgaccaccagagccgcaaaggtagccaacagcgtgacccttctggttcatctgaatacaggaaccctagaagacgaagccctgtcgaaagtcctgaaagaagacggcgttttgacggccaaaatggtcgctacgcatccgaatcggatgattctgttgattaccgccgtcgtcgccgcagtcccagttacgacgtctacgaccgcgaccaacctcgaaaccaccaccgttcggagtcgcctggagacgaaaatcctagaaggcggaaccctgcacatgacggaaccctaaactctctgcccaagaaattcggcaagaatcgcagctatctggaccgggattatcggaacggaaaacattcagagtccgaatcggacgaggagttgaaaggattgaactttgaagagtataggaggctgaagagacagaagatgagaaaggccttgagattctgtatttgggagaatacgccgagtccgccgaggaatgatggcgatgatttggaggataaaggtgatgaaatttcggagaagtacggtgaggataacggggatgggaagagcgactcagataaagaaagggagaagacaagcaataagagaatcaaatccaagtctgagtctgaaaattctggaagtagcgaatcagagagcgagtcagaaactgaatcagatgattcaaggtctcggaggaggaagaaggggtcgagttctaaaattaaaagtaggaaaagcaaacgtaggagtaggaaaacatcgtcgtacagtgatagcgaatctgatgagagcgagtgtgaatctgatgatgaggaagatagcaagcagagaaggaagtcgaggagaaaggggagtaggcgaaataggaatagcaagaaaagcagtacaaggaaaagaagcaggaagaagagtaggtatagtgattccaatgagagcgcaagtgaaagggaaactgatgaatctgatgtgagtaaatcttctgatgatcgtgtcaagtcaaagaagcggaaaagctcttcaaattcgaggtctaggaagagtaagaaaaggagaggatcagaaactgatagccaagcttcagattctgataagagctcggattctggagttgatgccaagagtaaaacaatggtagatgagcctaagatagctgaaattaatgctgctgaggctcttatgtttaaagaaatgatagaggctcagaagaaacctgcattggataatgagcctatggttggcccagcaccattgccaagagctgagggacatataagttatggtggtgctttgaggcctggtgaaggtgatgccattgcacaatatgttcaacagggtaagcgtatcccacgaagaggtgaagtcggtctttctgctgaggagattcagaagttcgagagccttgggtttgtgatgagtggtagcagacatcagagaatgaatgccattcgtattaggaaagaaaaccaggtttacagtgcagaggacaagagggcattggctatgtttaactatgaagagaaagcaaaacgtgagcacaaggttatggctgatttgcaacggctggtgcagcgtcatattgggcaggatgttggtcctactcacaacccttttgctggaaaggatggggctgatgcttgaatctcatattcttgagcttgccatctgaatttggccaaaccgcgtcatctgaggcgctggagtcaataatggagattgtgaccgtacacggatcaatggacaagttcatccaggcatccgtccccggatgtttgaatctatgtattgtatgcatgtagctgatgaatggcatagcaggcaccaacagtgaaaactagactgttatttgcttgtttttgtgaacaacttttattgcaaaatatgatgtcaatacgattattaaagaaa

SEQ ID NO: 5404 - DNA, 2093 bp, Gossypium hirsutum
cgatgatctgatctctttcaaaaaatttgcgaaaaacgaattctgatgggccgcctgacatccaccgtcgaaattccggaacggagacgccaatctgatcgagaaagcggccggtacgcatctgaatccgatggttcccccgattaccgccgccgtcgccgtagccctagctacgaagcctatgaacgcgaccaccagagccgcaaagattaccaacagcgtaacccttctggttcatctgaatacaggaaccctagaagacgaagccctgtcgaaagtcctgaaagaagacggcgttttgaccgcgaaaatggtcgctacgcatccgaatcggatgactctgttgattaccgccgtcgtcgccgcagtcccagttacgacgtctacgaccgcgaccaacctcgaaaccgccaccgttcggagtcgcctggagacgaaaatcctagaaggcggaaccctgcacatgacggaaccctaaactctctgcccaagaaattcggcaagaatcgcagctacctggaccgggattatcggaacggaaaacattcagagtccgaatcggacgaggagttgaaaggattgaactttgaagagtataggaggctgaagagacagaagatgagaaaggccttgagattctgtatttgggagaatactccgagtccgccgaggaatgatggcgatgatttggaggataaaggtgatgaaatttcggagaagtacggtgaggataacggggatgggaagagcgactcagataaagaaagggagatgacaagcaataagagagtcaaatccaagtctgagtctgaaaattctggaagtagcgaatcagagagcgagtcagaaactgaatcagatgattcaaggtctcggaggaggaagaaggggtcgagttctaaaagtaaaagtaggaaaagcaaacgtaggagcaggaaaacatcgtcgtacagtgatagcgaatctgatgagagcgagtgtgaatccgatgatgaggaagatagcaagcagagaaggaagtcgaggagaaaggggagtaggcgaaataggaatagcaagaaaagcagtactaggaaaagaagcaggaagaagagtaggtatagtgattccaatgagagcgcaagtgaaagggaaactgatgaatctgatgtgagtagatcttctgatgatcgtgtcaagtcaaagaagcggaaaagctcttcaaattcgaggtctaggaggagtaagaaaaggagaggatcagaaactgatagccaagcttcagattctgataggagctcggattctggagttgatgccaagagtaaaacaattatagatgagcctaagattgctgaaattaatgctgctgaggctcttatgtttaaagaaatgatagaggctcagaagaaacctgcattggataatgagcctatggtcggcccagcaccattgccaagagctgagggacatataagttatggtggtgctctgaggcctggtgaaggtgatgccattgcacaatatgtgcaacaggggaagcgtatcccacgaagaggtgaagtcggtctttctgctgaggagattcagaagttcgagagcctcgggtttgtgatgagtggtagcagacatcagagaatgaatgccattcgtattaggaaagaaaaccaggtttacagtgcagaggacaagagggcattggctatgtttaactatgaagagaaagcaaaacgtgagcacaaggttatggctgatttgcaacggctggtgcagcgtcatattgggcaggatgttggtcctactcacaacccttttgctggaaaggatggggctgatgcttgaatctcatattcttgagcttgccatctgaatttggccaaaccgcgtcatctgaggctttggagtcaataacggagattctgaccttacacggatcaatggagaagttcatcgaggcatatccgtccctggatgtttgaatctatgtattgtattatgcatgtaactgatgaatagcatagcaggcaccaacggtgaaaactagactgttatttgcttgtttttgtgaacaacttttattgcaaaatatgatgtcaatacgattattaaagaaa

SEQ ID NO: 5405 - DNA, 570 bp, Actinidia deliciosa
  misc_feature (54)..(54): n is a, c, g, or t
  misc_feature (150)..(150): n is a, c, g, or t
  misc_feature (168)..(168): n is a, c, g, or t
  misc_feature (219)..(219): n is a, c, g, or t
aaagaaacctgtattagagaatgaaccggtggttgggccgatgccattgcctanagctgaagggcatattagctatggaggggcactaaggcctggcgaaggtgatgccattgctcagtatgttcaacaaggtaagcgtatcccacgtanaggtgaagtgggtctttnagctgacgagattcagaaatttgagggtcttgggtatgtgatgagtggtantaggcatcaaaggatgaatgccattcgtatcaggaaagaaaaccaggtttatagtgcagaggacaagcgggcgttggcaatgtttaactatgaggagaaggcgaagcgtgaaacgaaggttatggctgatctgcagcggctggtgcagcgccacatgggacaggatgctggcccttctcatgatccttttgctggtgctggtggcggtgctgatgccgatgctgatgcttaattgctgtcagagagtcgagctctattttgggacctgtgaagagaagagatgtatctagtctggaattacaatgacgttcctcttatcacatgtcccttcgaaggggcgtacgagatcta

SEQ ID NO: 5406 - DNA, 1306 bp, Tropaeolum majus
gaatcagatgacgaaaaagatcggaagcggagaaagaaatctaggaagagtcagaaaaggggaagcaagagcagacggaggagcagtagcagaagagaccgaagtaggaggaagagtagaaaatatagtgattcagatgagagtgagagtgatgaaagtgaaagtgaaagtgatgaatcagggtttcccagcgacgaccggtcaaagaagaagagggtacgttcttcgagttcacggtctaaaaggagtaagagaagtaaaaagtccgaaagcgagaatgaaagttctgaaccagatgagaacttggactttgaagtggatatgaatagtacagcaattgtagaggaggcgcagaaggctgaaattaatgctgaggtgctcaaaatttaaggagttgattgaggcacaaaagaaacctacattaaacaatgaaccagtggttgggccaatgcctttaccgaaagctgaaggtcatattagttatggtggtgccttgaggccaggtgaaggtgatgccattgcgcagtatgttcagcaagggaagcgtattccacgaagaggagaagtgggtctttctgctgacgaaattcagaagtttgagagcctcgggtatgtcatgagtggtagtaggcatcagaggatgaatgccattcgtataagaaaggaaaaccaggtgtacagtgctgaggacaagcgggcactggctatgttcaactatgaggaaaaatcgaagcgtgaacacaaggttatggctgatttgcagcggctggtgcaacgccacattgggcaagatgttggtcctactcatgatccttttgctcccaaagcagacggttctgatgcttgatgctaatgctggtggattggacataattgcttcgggcattttgtaagatgaaggtgcacatagaagcctttcggcagcttctttacatagcaacataccttatccttttgaggtcgatttgtggcgtcaacaactggccatttggttcataccaatcagtgtatgtaacagcaatgaaggtaagagtacagaaatccttccgagatgcaaagtttgatgcactttgttttaaatcaagttgtttatcaacaaaataactcgtttggggaagcacatgcatttcgtaaagatacatctgaactacatgatagacatgttttgttgttatataaagctttgatagtcatcttccaagcctaactgggagaaacttatgtttttgttgagagttgattatattttttacttgcttatggattcgatgaatagatttcaggttgtataaacaatctttgccta

SEQ ID NO: 5407 - DNA, 1893 bp, Arachis hypogaea
ttatttatgttgaagtgaaaccccaccgccaaactcattccaaccgcaatgggaagaccatcttccgcaatcgaagtccctaatgaacgacgccgattcgaccatcgccgcaccactcctgattccgaccactccgacggttaccgccgcagccgccgccgccgaagccctagctatgactcttacgaccgcaaccgggaccgccgccgtgatcgccgccgatcaacttcacctgagcgtagaagccctaggcctaccgcctacaacgacggacttcctaacggcgacgtcctaccgaagaaattcggccgtcgtagcggcggctcgtacctagaccgtgaccgccgcccggattctgattctgacgaggagctgaaaggattgagcttcgaggagtaccggaggctgaagaggcagaagatgcgaaagtcgctgaagcattgcatctggaacgtcacgccgagccctcccaggcgcgagaacgaacaagaatcggaggaagaaagagctgaagagatcactgtgaaatttggtgttgaaaaaggcgattcgagcgacaaggaggttaaacctagcgaaaaatccaaatctgaaccaaaatcggagaatttttccgagtcggaagctgaatcagatgactcgcgttcgaggacaaagaggaggagggtttctggtttgaaacgcaggagaagatcgaatagcgatagtgaatcagaggaaaatgaatccgagtcagaggatagtgaatctgaatcagacgattcgattgcaaggaggaagagaaaaagaagttcaaaatcgaagcataggagaaggagatctaataatgatggtgaatcagagggaagtgatgctgaagaagaggagcgcaaaagtaggaggggtaagaggaagagtggtaagaccagagggaacagaaaaaagagaaggtatagtgattctgatgagagtgaagagagcgaaagcgatgattctgacgacagtggaaggagaaagaggaaacattcttcgcggtcgaagagaagcagaagagaaagaagaaaacgaagaagtagaaaatctgaatcagaaaaagaggtttctgaatcagaagaggaaaagggttttggtgatgcaaaaaacaagcagtagttgaagaggtgatgaaaacagaggtggatcccgaggctttgaaattgaagaactatttgaatctcagaagaaaccggctttagataatgaacccgctgtagggccaatgcctttgccaagggcagagggtcatataaggttatgggggcgcccttaggcccggtgaaggtgatgcaattgcacagtatgttcagcaagggaagcgtatcccacgaagaggtgaagtgggtctttctgcagaggagattcagaagtttgagacccttggttatgtgatgagtggtagcaggcatcagaggatgaatgccattcgtattaggaaggaaaaccaggtttatagtgctgaggacaagcgtgctttggctatgtttaactacgaggagaaggccaagagggagcacaaggttatggctgatctgcagcggctcgtgcagcgccacattgggcaggatgttggcccaactcatgatcctttcgctgcaaaaacctcggatggtgctgatgcttgatttctttcatccatggtcagctagttttactctttatcttgtagtttgttgcacttttagactatattttgattgtgctagctccatgtttttcaccatttgttggtatgtgtagacttggagaatgaggacaatgtttatccttctagtgaatttgtatggaattcctttattggtaggttatatatgtcacaattgcaattttgcttagtatgttactactactattgaaatgagtttcttttgatgcctc

SEQ ID NO: 5408 - DNA, 1369 bp, Cajanus cajan
cagcgctccgattctgagtccgacgaggagctgaagggtttaagctatgaggaataccgaaggctcaagaggcagaagatgaggaaatcgctgaagtactgcatctggaacgtcacgccgagtcctccgaggcgcgacaacgaagatctggaagattatcacaagcccgatgaaatctctgatcgagacgccgccgttgtgaagatcgagaaggcggttaaacctaaaggaaaatcggaattggaatctgattccgaatctgagaaatccgtcagtagtgaatcagaggattcgcgttcgaggaagaagagaaggaagagctctgctggttcttcgaggagatcgtatagcgaaagtgaatcagaatcagaatctgaatctgaatcagattcagaagaagaggagcgtagtagaagaaagagtaggaggaatagaagaaggaggagtaataagaacaagaatagaagatatagtgattcagacgagagtgaagagagcgacagcgatgcctcggatgtcagtataagaaagaggaagaaacgctcttcttcttctaggtcaaaatcgaaacgaagcagaaggcacagaagaacaacaaagaggaactccgaaacggagagcgagaaatctcattcggaggaggagaatggttctggttctggttctggtgatgcagtgaccaaagcagcagttgatgaggcaatgatgactgaaatgaacgcggaggctataaagttgaaggagttgttcgagtctcagaagaaacccgctttggataacgaacccgcggttgggccaatgccgttgcctagagcggaggggcatatcagctatggtggggcacttcggcctggtgaaggtgatgccattgcgcagtatgttcaacaagggaagcgtattcctcgaagaggagaagtgggtctttctgcggaggagattcagaagtttgagagcctgggttatgtgatgagtggtagtaggcatcagaggatgaatgccattcgtattaggaaggaaaaccaggtttacagtgctgaggataaacgtgctttggctatgtttaactatgaagagaaggccaaaagggagcacaaggttatggctgatctgcagcgccttgtgcagcgtcacattggtcaggatgttggtccaactcatgatccttttgctgcaaaagcctccgatggtgctgatgcatgatagctagtatttatgtatgtttagcttctgtactttcctgaactatagttgtgctctgcattttttttctctgctggctatattgttactttcctgtggggtttatagacttggagaatagattagatgacatattaagactgaaaaaatagagagatgatctttgcct

SEQ ID NO: 5409 - DNA, 515 bp, Senecio madagascariensis
aagcagtggtatcaacgcagagtacggggttcaaagaaatgatagaatcgagaaagaaggttgatttggaagaagaaccagaggtaggcccaatgccattaccaagagctgaaggacatataagttacggtggtgcacttagacctggagaaggagatgcaattgcacaatacgttcaacaaggaaaacgtattcctcgcagaggagaagtcggtctttcggctgatgagattagtaagtttgaggatcttggttatgttatgagtggcagtagacatcaaaggatgaatgctattcgtattaggaaagaaaatcaagtttatagtgctgaggataaacgggctttagctatgtttaattatgaggaaaaagcgaagagggaacagaaagttatggctgatttgcagaggttggttcagaggcatattggagaagaaactctacctaatcatgatccgtttggtgggaaagcgacgacttgaggaatcccgtattgtatttgattttaacagagt

SEQ ID NO: 5410 - DNA, 1672 bp, Glycine max
gttacattcatctttccgcgatgggaagaccatcctctaccatcgaaatccctcacgaacgccaccgacataacggccgccggacccctgactccgatatctccgacgactatcgccgtcgccgcagccctagctacgactcatacgaccgccacacggagcgccaccgccgctgttcggaatcgcccgagcacagaagccctaggcacaccaacggaactcacaacgacaacactctgcctaagaaattcggccgccgaaacggcgcgtatctggatcgcgaccgcggggattggcagcgttccgattccgagtcagacgaggagttgaagggtttgaactacgaggaattccgaaggctcaagaggcagaaaatgaggaaatcgctgaagcactgcatctggaacgtcacgcccagtcctccgaggcgcgataacgaagatccggaagattatagcaaacccgatgaaatttctgatcgagacgacggcgctgggaagatcgataaggagattaaagcaaaagcaaaagcaaaatcggaatcagaatctgattccgattctgaatctgagaaatctgtcagtagtgaatcagacggttcgcgttcgagaaagaagaaaaggaagagctctgctggttcttcgagaagatcgtatagcgagagtgaatcggaatcggaatcagagtctgaatctgaatctgaatctgaatcagaagaagaggaacgtagacgaagaaagagtaggaggaatagaagaaaaagaagtaacaggagcaggaagaagagaagatatagcgattcagatgagagagaagacagcgagagcgatgactctgatagcagtggcagaaagaagaagaaacgatcttcttcctcaaagtctcgatccaagcgtatcagaaggagcagaaagagaacaaatagaagccctgaaacagaaggcgagggttctgatttggaggaggagaatggttctggttctggtgatgctaagagtaaaacaaccgttgatgaggtgatgaagacggagattaacgcggaggctataaagttgaaggaattgtttgagtctcagaagaaacccgcattggataacgaacccgcggttgggccaatgccgttgcctagagccgagggacatatcagctatggtggagcgcttaggcccggtgaaggtgatgccattgcacagtatgttcaacaagggaagcgtattccgcgaagaggagaagtgggtctttctgcggaggagattcagaagtttgagagccttggttatgtgatgagtggtagtaggcatcagaggatgaatgccattcgtattaggaaagaaaaccaggtttatagtgctgaggataagcgcgctttggctatgtttaactatgaagagaaggctaaaagggagcacaaggttatggctgatttgcagcgcctcgtgcagcggcacattggccaggatgttggcccaactcatgatccttttgctgcaaaagcctctgatggtgctgatgcatgatccttaattttgatgtatgttttgctcctgttctgtgctttttcttttcttttgctggctatatttgaacttttctatgggatttatagacatggagaatagatatagatggcatactaagactgagaaaatagagagattagtgaactttgttt

SEQ ID NO: 5411 - DNA, 1841 bp, Glycine max
gtaaacgtcccttttgttctattcactctatccgcgatgggaagaccatcctccaccatcgaaattcctcacgaacgctaccgacataacgaccgccgcacccctgaccccgatgtctccgacgactatcgccgccgccgcagccctagctacgactcatatgaccgccacccggagcgccgccgccgccgttcggtatcgcccgagcacagaaaccctaggcacaccaacggaactcacaacgacaacgctctgccaaagaaatttggccgccgaaacggcgcgtatctggaccgcgaccgtggcgattggcagcgctccgattccgagtccgacgaggagttgaagggtttgaacttcgaggaataccgaaggctcaagaggcagaagatgagaaaatcgctgaagcactgcatctggaacgtcacgcctagtcctccgaggcgcgagaatgaagatctggaagattatagcaaacctgacgaaatttctgatcgaaacgacggcgccgggaagatcgatacggaggttaaagcaaaaacaaaagcaaaaccggaatcagaatctgattctgaatctgagaaatctgccagtagtgaatcagacgattcgcgttcgaggaagaagagaaggaagggttctgctggttcttcgaggaaatcatatagcgagagtgaatcagaatcagattctgagtcagaagaagaggaacgtagacggagaaagagtaggaagaatagaagaaaaagaagtaacaggagcaggaagaagagaagatatagcgattcagatgagagtgaagagagcgagagcgatgactctgaaagcagtggaagaaagaagaagaaacgttcctcttcttctaggtctcgatcgaagcgtatcagaaggagcagcaaaagaacaaagggaagctctgaaactgagagcgcgggttctggttcggaggaggaggagaatggttctggtgatgccaagagtaaagcaatggttgatgaggtgaagatgacggagattaacgcggaggctataaagttgaaggaattgtttgagtctcagaagaaacctgctttggataacgaacccgcggttgggccaatgccgttgcctagagctgaggggcatatcagctatggtggagcgcttaggcccggtgaaggtgatgccattgcccagtatgttcaacaagggaagcgtattccgcgaagaggagaagtgggtctttctgctgaggaaattcagaagtttgagaaccttggttatgtgatgagtggtagtagacatcagaggatgaatgccattcgtattaggaaagaaaaccaggtttatagtgctgaggataagcgtgctttggctatgtttaactatgaagagaaggctaaaagggagcacaaggttatggctgatctgcagcgcctcgtgcagcgccacattggccaggatgttggtccaactcatgatccttttgctgctaaagcctctgatggtgctgatgcatgatccttaatgttgatgattggtgatgtaatttttctgatatgcctattggacacatagaggatcacatacagcaaaaaccgaatcattaatttgtagtgaatggtgtcttttctgtcattagtaggtctctgacttcttgtaactcaagcatctgaacagatgtatattgtagtaaatgttgtctttcctcttctcctagagaaggaaaagatctctcaatgtgccatagttgatgcctactattcctcagtaagattgtttggtaatccgattgaaagctacatgtaagcattacaatcccttgtttggtaatctcagtaagatatccatgtgaagaatca

SEQ ID NO: 5412 - DNA, 1020 bp, Picea glauca
  misc_feature (111)..(111): n is a, c, g, or t
  misc_feature (138)..(138): n is a, c, g, or t
  misc_feature (216)..(216): n is a, c, g, or t
aggaagaggagacatattagcgtgagagaacatagcgaggatgatagtgatagtgtatcagaggatgactcgtcctcgtactctagtgaaaatgaaaagctgaagaagcanacgaatcgacgaaggaacagacatganaagcaaaagatatcagcgaagagaatgtctggatctaaaagatcacgagttcaaagttctgaagatgaagagaaaagngagcctccttctgagagtcatgtttcgtcagatgattctttagaacttgaatctggcaagcatgaggaggaagtaggtgatgacgaacctgttgaaatagacaatgaagctctcaggttcaaagagatgattgaatttcagaaaaaatcagtggcagggcttgagaacgaaccacttgtggggccacttccagttccaaaagcagaggggcatataagctatggaggagcacttcggccaggagaaggtgatgcaattgcgcaatatgtccaacaaggaaagcgtatccctcgaagaggagaagttgggctgtctgccgatgagattcaaaagtttgaaaccctgggctatgtcatgagcggaagcaggcatcaacgaatgaatgctattcgtattagaaaagaaaaccaagtgtacagtgctgaggacaaacgagcattggcaatgttcaattatgaggagaagtcaaaacgtgaacacaaggtcatgtcagatcttcagcgtttggtacagaggcacattgggcaagaagttgctccaacacatgatccttttgcaggcaaggcacctgaagtggcagatgtataggtttcttcagagtttgtcataattattattattatctttttttgcaatttcttcagtttattatattcaatgtgaagtgctaagctgtgtatttttgcataaggacgacatgtatcatgtcttgtaaatttatctggcaggattttgaaaatcatctcatcattctgaattcttatggaaaaaggtagtaacaatctggattggtagggattttat

SEQ ID NO: 5413 - DNA, 2085 bp, Euphorbia esula
  misc_feature (402)..(402): n is a, c, g, or t
  misc_feature (406)..(406): n is a, c, g, or t
  misc_feature (431)..(431): n is a, c, g, or t
  misc_feature (549)..(549): n is a, c, g, or t
  misc_feature (561)..(561): n is a, c, g, or t
  misc_feature (656)..(656): n is a, c, g, or t
  misc_feature (723)..(723): n is a, c, g, or t
  misc_feature (726)..(726): n is a, c, g, or t
  misc_feature (740)..(740): n is a, c, g, or t
  misc_feature (755)..(755): n is a, c, g, or t
  misc_feature (772)..(772): n is a, c, g, or t
  misc_feature (779)..(779): n is a, c, g, or t
  misc_feature (802)..(802): n is a, c, g, or t
  misc_feature (857)..(857): n is a, c, g, or t
  misc_feature (861)..(862): n is a, c, g, or t
  misc_feature (885)..(885): n is a, c, g, or t
  misc_feature (894)..(894): n is a, c, g, or t
  misc_feature (948)..(948): n is a, c, g, or t
  misc_feature (955)..(956): n is a, c, g, or t
  misc_feature (992)..(993): n is a, c, g, or t
  misc_feature (1434)..(1434): n is a, c, g, or t
  misc_feature (1466)..(1467): n is a, c, g, or t
  misc_feature (1480)..(1480): n is a, c, g, or t
  misc_feature (1491)..(1491): n is a, c, g, or t
  misc_feature (1523)..(1523): n is a, c, g, or t
  misc_feature (1536)..(1536): n is a, c, g, or t
  misc_feature (1546)..(1546): n is a, c, g, or t
  misc_feature (1554)..(1555): n is a, c, g, or t
  misc_feature (1560)..(1560): n is a, c, g, or t
  misc_feature (1583)..(1583): n is a, c, g, or t
  misc_feature (1616)..(1616): n is a, c, g, or t
  misc_feature (1621)..(1621): n is a, c, g, or t
  misc_feature (1701)..(1701): n is a, c, g, or t
gccggcgtacgcctgaatctgactcttccgatgactaccgccggagccgtcgtagtccgtcctaccacagttacgatgaacgtcatcgacaaaccgaccgcgggagaagaagtcgaagccctaggcccggaaaaaccctagactccttgcccaaaaagttcgggggcggggggcgtgcctacctcgaccgtggcggtcatcgtaatgggaggaactcgggatctgaatccgatgaggaattaaatggattgccctacgaggagcgtagaaggctgaagaggcagaagatgaggaaaagcatccataggtattgtttttggtcaatcacacccagtcctccgagggttgagaacgatgaagaagattttgaagacaaaccagatgagatttcggatgggtatngagnagatgaagagaagagtgattccggngataaagataaggtaaagcagcgtgatggaaagggtaaattggagtctgcatcagagaaatccggtagtagtgattcagagtcgcaatctgatgaatctctctcaaggaagaagaagnaaaaggagaagnggagttctaggcggaggagcaggagatcatccgagagcgatagtgaatcagagtcgtcagattctgatgagaatcggaaaaagtcacgcaaaagnagtggtaggaaaaagaagaatagcaaaagaagcattagaaaacgaagtaagaggaagacaaggtatnctnattcagatgatganagtggaagtgaagantccgagttggattcaangaagcgnagaagatcatcggcctcaggagnctctaaacgtggcaagagaagaagaaaacctctgaaacagagagtgaaaatttgnatcnnagtgagagttcaggttctgaaantgattcaangggaaaagcaaaggaggtagaggagttgaaaaagattgaacttgatgatgatgnagaggcnntcatattgaaagagatgattgaagctcaaaagaagnntgctgctttggataatgagcctatagttgggccaatgccattgcccaaagctgagggacatattagctatggaggggcattgaggcctggggaaggtgatgccatagcacagtatgtgcagcaaggaaagcgtattcctcgaagaggagaagtgggtctttctgctgatgagattcagaagtttgagaatcttggatatgttatgagtggaagtaggcaccagaggatgaatgctatccgtatcaggaaagaaaaccaggtctacagtgctgaagacaagcgagctttggccatgtttaactatgaagagaaggctaaacgtgagcacaaggttatggctgatttacagaggctagtccagcgccatattggtcaggatgttggccctactcatgatccctttggggctaaagcatcatctgaagcccctgatgcttgatncttgctaaggaaacaaaatgctctgcaaaaanntttcatggaactntggaaacctangggtgacttagttatgatagagcttgatcatngtttttacgtggngaaatttgcngatgactnngatanagatagggtttttacaggaggancttggctgatacatggaaattaccttactatangaacntggtctccgagtttcgttccatcaaattctgaagttgataaatccatggtatgggttcgtttccctgaattgccattagngtaattataatgaggatgtgttattagccatagcgagctctctagggaaatcagtaaaggcttctagcaaaggtcggtttgttagggtttgtattgaaattaatatgctcaaacttttggttactcaatttggtttgaatgggaaggttcaacgccatgtgtatgaagacctccgtatagcttctacttattgtgaacagtatagacacctcaaatcaaactggatctagcttaatgttttagtcttaatcttgttatcttttgtagcagcttgcctaagataaagatgcttggcaaaggtatttgcttactttttaagcttgagaagtttagctcgtatctttataactttgttttgggatgttgatgtagtcataaatttca

SEQ ID NO: 5414 - DNA, 1564 bp, Triphysaria pusilla
gaaaccctcaaatgggcagaatctcctcagccgttgaaatccccgaccgacgccgtacatccagccaccaccgagacaatgaccgctattcacccgagcctcgtcgtagctaccaccggcgcgagcgcagctacagccgtagccgtagccccatccgccgccggagccgcagtagaagccctaccaaaaacggccacaacaggtaccatcgttcttctcctgattactcatatcctaatctagctgaaactcaaagacttagcgatagaaataaactcaattacgacaatcggaataaatcatacctagatcgagaccatcgaaatggtcaatttcccgagccggaatctgatgaagagctgaaaagccttccttacgaagagtaccgcaggctcaagcgtcagaaaatgagaaaatcgcttagaaattgcatctggagctgcactcctagtcctcctagggctcctaatgaaaaatccgatgctgagatggatgaggttatcgaagtcgaagaagaaaaacagattagggtttcaaagccggaagttaaaaaatcgcccgagagtgaatctgagtcggtatctgaatctgaatctgaatcagatggttttaggtctaagaagagtagaaaatctcgttccaggcgtaagcgtaagagtagaagatcgaaatctgtttccgagagcgggagtgagagtgaatctgattcgagtgacgaggatgataggaggagaaggagaaagagtgtgaagaagaagaagaagaagagcaagagtagcaagaaaagtaccaggagaaagaaaggcattaagaaaaggcactcatcgagcgaaagcgagagtgaaactgaacattccgatcatgtgaagtcaaaaactcattccgattcagaacctgaagccattacaaaagatgttgttgctctgcccgaggaagatgagctcatgataaccgacgaaatgaacgaagaaatgctgaaatttaaagaaatgatcgagcaacggaataaacccattcttgaagatgagcccgtggtcggcccgatgcctctgccaagagccgacgggcatatcagctatggtggggctcttaggcctggtgagggtgatgctattgctcagtatgttcagcaagggaagcgtatcccacgtagaggtgaggtgggtctttcagctgacgagatttcgagatttgagacgctagggtatgtgatgagtggtagtaggcaccagaggatgaatgcgatccgtattaggaaggagaaccaggtttatagtgcggaggataaacgggctttggcgatgtttaattatgaggagaaggcgaaacgggagcagaaggttatggctgatttgcagaggctggtgcagaggcatatcggggaggatacgggtccttcgcatgacccgtttggtggacgggcggtcgagggtgatgaagattgatgtctcaggtttgtgcttttcttttctgaaattataattttcgtatttgtgatgtatggtatggatatttcatgtttcctgtggtagcagcattgaataagggatgatagtcttgttcg

SEQ ID NO: 5415 - DNA, 506 bp, Scabiosa columbaria
gtggagcgttgaggccaggtgaaggtgatgctattgctcagtatgttcagcaagggaagcgtattcctcgtagaggtgaagtgggtttatctgctgatgagatttcgaagtttgagacgttagggtatgttatgagtggaagtaggcatcaaaggatgaatgccattcgtataagaaaagaaaaccaggtttatagtgctgaggacaagagggctttggctatgttcaactatgaggagaaggcgaagcgagaacagaaagtaatggctgatttgcagcgtttggttcaacgccatattggggaggatactggcccttctcatgacccatttggaggaagagccactgaaggtgctgatacttgaattttgttaggtgtaatatgtatctcgtttgtcttttatacgaatgtgcaaggattttaccgtgcttaaagtatgatgcataccatgaagttttgtcagtttggtttctttaagaattctatgacatcttagccacatctc

SEQ ID NO: 5416 - DNA, 1062 bp, Abies balsamea
gcaggaaatcttctcctcctacaagtgaaagtgattattctgagtcatctgatgatggtgagtcaagaaaggacattaaaggcggtaggtccagtaggaagaaaaggaggaaattaaagcaatctggcaggagcaggaagaggagatatattagcaggagagaacatagcgaggatgatagtgatagtgtttcagatgataactcgtcttcgtactccagtgaagatgaaaagccgaagaagcaaacaaatcgacgaaggaacagacaagaaaaagaaaagaaatcggggaagagaatgtctggatctaaaagatcaggagttcaaagttctgaagatgaagcgacgtctgaacccctttctgagagtcgtgtctcatcggatgattctttagaacttgaatctggcaaggatgaggagaaagcaggcgatgatgaacctgttgaaatagacaaggaagctctcaggttcaaagagatgattgaatctcaaaaaaaagcagcggcagggcttgagaatgaaccacttgtggggccacttccaattccaaaagcagagggccatataagctacggaggagcacttcggccaggagaaggtgatgcaattgcacaatatgtccaacaaggaaagcgtattcctcgaagaggagaagttggactgtctgccgatgagattcaaaagtttgagactttgggctatgtcatgagtggaagcagacatcaaagaatgaatgctattcgtattagaaaagaaaaccaagtgtacagtgccgaggacaaacgagcattggcaatgttcaattatgaagagaaatcaaaacgtgaacacaaggtcatgtcagatcttcagcgcttggtacagaggcacattgggcaagaagttgctccaacgcatgatccttttggaggcaaggcacctgaagtggcagatggataggtttcttaagaggttgtcataattattactatctttttttgcaatttgttcagtttgttatattcaatgtgaagtgctaagctgtgtatttttgcatgagcacaacatttatcgtgtcttgtaa

SEQ ID NO: 5417 - DNA, 2035 bp, Amsonia hubrichtii
tagtatggtcgacccaatccaaggaatcattcctacgatgggtagaccatcatccgccatagaaattcccgaagaacgacgtagccacagggattatagacgctactcttccgagcgctatggttccgaggatttccgcagccggaatcgcagtgttagccgtagccctagcctgagacggagccgcagtagaagctttagcagaagccggactcgcagtcgtagcccaatctacaatggatattcaaggtacgaccaccgtgaccgacgaccttcccctgattattcgtaccccagacgaagccctaggcccgacacaattaagtccgaacgcgcgtatggtgaccggaagaaaccgtttctcgatcgtgactataaaaataatcgtcacgcgggttctgaatctgatgaagagcttaaaggcttgagcttcgaagagtaccggaggctcaaacgccagaagctgagaaagatgctaaagagttgtatttggaactgcacgcctagtcctcccagagatccaaacgaaccggaggatcaagcatttgaggaggatatcgcgggaaaggtcaatgaacaagaggaaaccggtggcaaagagaaaaagaaagatcaaatctccaaggtagataccaaaagctcctcagagagtggaagcgagtctgactctgattccactgagttttctgactctgaatccgatgattcaagacggaggaggaggaaaagcaggaaatcaagttctaggcgtagaaagagaaggtcaaaatctgtgtctgagactgaaagtgaatccaacgattcgagtgaagaatcagaagaaaaagacaggaaggcacgacggaggaagttgaggaaaaaggaaagcaggcgaaacaggagcagtaggagaagcagtaagaggaaaaggaaaagtggacggaaggcttattctgatgaaagtgaaagcaatgatgagagtggaagtgaggattctgaggttagtccgtcttcagatgatcgtgcaactacaaagaagctgaagcattcacagtcaaagcacagcaagaagaagagggaatcagagacagatagggaggtttccgaatcagacaaaagttctgattctatagatgacaaggataaacagatggtgacggaggaagcaaaaatggacgaagttaatagcgaggttcttaaattcaaggagcttattgaggctcggaagaaagctgctttagaaaatgatcctccggttgggccaatgccattgccaagggctgaaggacatattagttatggtggggctcttagacccggtgaaggagatgctattgcacagtacgttcagcaaggcaagcgtatcccacgaagaggagaggtgggtctgtctgccgaggagattcagaagtttgagggtcttggttatgtgatgagtggtagcaggcatcagagaatgaatgccattcgtatcagaaaagaaaaccaggtctacagtgctgaggacaagcgtgctttggccatgtttaattatgaggagaaggccaagcgcgaacagaaggttatggctgatttacagcggcttgtacaacgccatattgggcaggattctggtccttcccacgatccttttggtggaaggtctactgagggggctgaagcctgattaaaatggtttcaagctatcagaagcatgatgaaagaacaacaatggttattgctgtcctactagaaagaaaactgtaacagggtgagatctcaagagctggcttgtggactcttggtgcaagaaagtgattgcctttgtgcttgttagaattaaagatgctaaggacccaatgagttgggaaagatattaagagggtaatgttactgacgaacaagattatcaagttgcggtttagagctgatatctattatccactagaactaaggaatgctgctgctgctgttatgcatgagttatgctgataggagacattatctcgcttattacttgatttgctaccaataatcaaaaaagaaaagatgatgccttagattgatgctccagttc

SEQ ID NO: 5418 - DNA, 1905 bp, Chelidonium majus
ggaaccaaaactctcatccaaggtagagattcctcaaagacgccatcgccgccacgacgactcccctgattcaggtaggtctccatctccttatcactccgattatcatcaccgtcgtaatcatagtcgtagtcctatcaacaatcacagaacaagatcttatcatgaatcaaatcgacgtcgtagccctagtggtagtcgtagtcctatcaacaatcacagaacaaaatcttatcatgaatcaaatcgtcgtcgtagccctagtggtagtcgtagtccgattaacaatcaaaggacaagatatcatcgcgaaccagatcgtcgtcgtgaacgatctctttcgaacggatattcaaaccctaggggaagtcctacttatgaaaacctagacctaggtaatcagagacatggacacacagatcatgaggatcggttggcgccgtttctccatagaggggggagaaacggacggctatctgattctgattcagatgaggaattgaaaggtttggaattcagtgagttccggaggcttaagcgacagaaactgaggaagaggatgaagaattgtatttggaatgtaacacctagtcctcctaggtctgaaagggaaggatcgttggatgagttgcaggaaactgaaatcgtggataagaccgttgaagatgaacggaatggtcgaaacaatgcaattgatagtggtggaaaatctgagtctgatgaatcagggaagagtctatcggaaacagaatccgagtccgagtcggattcggatagctctaggtctagaaggaagaggcgaaaaggaggaaaacatcggcgtaagagtagaaagtcttcgagttctaggaggaagagaagtaagaaggcatcaactgatactgaatctagtgaagatagcgagtctgagagttctgattattcaagtgaagaggataggaaaagtaggaagaaatcaaagagtaggcgtagtagtcaggggaagaaaagaagcaggcgaagtagtaagaaaacaagaggaagtaagaagaggaggaaggacagcgaatctgatgaaagcaagagtgaggagagtggaagtgaggaatccgattcaggcccctctagtgaccgtgcgagaactgggaagaagaaaagctcgaaattgtcttcccattcgaaaagaagcaagaacaagaagcgttctgaatcgggtagtgagagttcagctgagggtgcttctggttcagaagttgatgccaaaaattatactgaattggatgatgctgtgaaagatgagaataatagtgagatgctcatgtttaaagagttgattgaatcacagaagaaacctcccgttgataacgatgcccctgttggaccaatgcctttgccgaaagctgaaggacatattagctatggaggtgcacttaggcctggtgagggtgatgctattgctcagtatgtgcagcaggggaagcgtattcctcgaagaggagaagtgggtctttcagctgacgagattcagaagtttgagagtcttgggtatgtgatgagtggtagtagacatcaaaggatgaatgctatccgtatcagaaaggaaaaccaggtttacagtgctgaggataaacgggcattggctatgtttaactacgaggagaaggcaaagcgtgagcacaaggttatggctgatctgcaaagattggtgcaacgccatattggacaggatgttggtcccacacacgatcctttttcaggaaaagcttccgatgctgccgacgcctgatcctcctgtatgttatgatgttttactgcatttctcttgtacttgtttctctttattgggaatagattttcttacatattttcaaatatgtctgaaaactgtagtgagcaggaactttgatattataatttcgggagtgt

SEQ ID NO: 5419 - DNA, 629 bp, Utricularia gibba
gtggcgaggttcttaagttcaaggaaatgatggagttgaagaagaaaactaatttcgatgacgagcccctagttggcccaatgcctctgccaagagcagaagggcatatcagctacggtggtgcacttagacctggtgaaggtgacgctattgcacaatacgtccagcaagggaagcgtattcctcgtagaggtgaagtgggtctttctgctgaggagatccaaaagtttgagaatctggggtatgtgatgagcggtagcagacatcagagaatgaatgccatccgtatcagaaaagaaaaccaggtttacagtgccgaggacaaacgggcgctggcgatgttcaaccatgaggagaaggcaaagcgcgagcagaaagttatgagtgatttgcaacgtcttgtgcagcgccatatcggccaagatgcagggccttcccatgaccccttcggtggacgggctgctgatgctgccgatgagtaacaggcttctcctttgtgctcccttaaaacatcgtttcgttccagacggcttgtgtacggataatggagcaatgctcaccacttgcatccggacatctatgtatgaaatgctatctgtttttgttacaaggaacgacacctaccactt

SEQ ID NO: 5420 - DNA, 1113 bp, Vinca minor
agtaagaggaaaagcagtagtagaaggaaggcttgttcggatgaaagtgaaagcaaaaatgagactgaaagtgagggctctgaggttgatcgatcacctggcgaccgtgcaaagagtaaaaggagtaggaagcattcacggtcaaagcacggcaagaagaagatggaatcggaggcagatagtgaggtttctgacataaacaaaagttctgattccgctgatgacaagaatacacagaaggtggcagaggaagcaaaaataactgaagttaatagcgaggttcttaaattcaaagagctactagacacccagaagatagcagccttaggaaacgaacctgcagttgggccaatgccattgccaagagctgaaggacatattagttatggtggggctcttagacctggtgaaggagatgctattgctcagtacgttcagcaaggtaagcgtatcccacgaagaggagaagtgggtctatctgctgacgagatttctaagtttgaggatcttggctatgtgatgagtggtagcaggcatcagagaatgaatgccatccgtatcagaaaagaaaatcaggtgtacagtgctgaggacaagcgtgctttggccatgtttaattatgaggagaaggccaaacgtgaacagaaggttatggctgatttgcagcggcttgtacaacgccatattggccaggaacctgatccttcgcatgatcctttcggtggaagatctggtgagggagctgaagcctgacaaaggactcaagctcttacatgcatgacaagagaataaaattgctagtgtttttggagcaactaatatgtacgcctctctaccaagtgagatcacgttatggactcttgtttctgaaattgattgcatttgccagttaaaattgaagatccaagatctcaagtcaagtaaagatgctgagagagtgatattataaaagactagttaagttgtggtttagatgtgacatctatagtatcaactagaaactcaggaaagatgatctgctgtttatgagttatgctgatatttaagacattttctagcacattacctgtttgcttatcaattcgtgaaacacaccactttagagggaaaaag

SEQ ID NO: 5421 - DNA, 1597 bp, Manihot esculenta
ggggagacattgcttgcccttattcccaatcatgggcagaccagcgtcgatgattgaaattcccgatggacggtatcgtccagaacgccgaactgaccgttatacgcctgaatccgacacctccgctgattaccaccgctaccgcgaccggcgaagtccctcttacgaaagctacgatgagcgtctacgaggaaccgctcgcggacgctacggctcaagctcgcccgagtattcaagccctcgtagaagaagcccaagccctaggccgatgaaaaacatggaaactctgccgaaaaagtttggaagggggcgcccctacctcgatcgcggtggctctcgtaatttaaggaactcggaatcggagtccgatgaggaattgatggggctgagctttgaagaacggaggaggctgaagaggcagaagatgaggaagaacatcgctaggtattgtatttggactcttaccccaagtccacccagggatgagaacgaagaagatttggaaggccaagcagatgagatttcggagaggtatggggaagacgaagagaagagtgactttagcgagaaagaaaaaggaaaagcgcgtgatgggaagggtgtttcagagtctgattctgggaaatctctgagcagcgattccaggagcgtttctaagtctgaatctgaatcaaatgattctcggtcaaggaagaagaggggttcgggttctaagcgtaggggcaggaaaacatctgtggattccgatagtgaatcggacgaggatgcgagtgagagtgggagtgaagctgaatctgattctgaagaggatcgaagacgcagaaagaagtcacggaaaagcggcagcagcaggagaaggaagagcagcaagagaagtagcagaaaagggaagagtcagaggaagaggaagagtaggtatagtgattctgatgacattgggtgtgaaggatccgattatgagtctaagaaacggatacgcatttcaggttctaaacgtagcaagaaaaagaggtctgaaacagagagtgcaagttcataccctgataagagttcaggttctgacatagatgcaaaggggaaattgaaggcagatgagatgaagatccctgaaattaatactgagccactcatatttaaagaaaagatggaatcgctgaagatacctgccttggataatgaacctacggttgggccaatgccccttcccagagctgaggggcatataagttatggtggtgcattaagaccaggtgaaggtgatgcaattgcacaatatgtgcagcaaggaaagcgtattcctcgtagaggtgaagtgggtctttctgctgaagagattcaaaaatttgagtatcttgggtatgtgatgagtggcagtaggcaccagaggatgaatgctattcgtattaggaaagaaaatcaggtctacagtgctgaggacaagcgagctttggctatgtttaactatgaagagaaggcaaaacgtgagcacaaggtcatggctgatttacagagattggtgcagcgccatattgggcaggatgttggtcctactcatgatccttttgcaacaaaagcttctgatggtgctgatgcttag

SEQ ID NO: 5422 - DNA, 2237 bp, Ricinus communis
tacaagagtacagaacagcactctgtgccctaggctatttcttctctcatctcttcctaactatccggcgacgacaattcaataggcttaatcttcttccttcttgtctcttttccaattgttttcaatctttttgctgttctcttattgtctttaaaatatcttaaagacggtttgatcttgttttcttgtgctttttttttttgtaatctcgtaatacgagttttattgtattataatttttagagaatagaaaaggagttttaggtttcattagatttattagatttagttgacagggaaaaacaaggtaatcctgaaatccctaataatgggcggcagaccagcatcgacgatcgaattccccgacagacggtaccgtcctgaccgcaataatggccgttacacacctgaatccgacatctctcccaactacaaccgccatggagatcgccgcagtccctcctaccacagttatgatgagcgacaccgagagaccaatcctagacgctaccattcaagatcacctgataattatcctacttctagaagaagcagaagaagcccaagccctaggccactaaaagacctagattctcttcccaaaaagttcggtggcaggggccgcgcataccttgataggaatggaaaggattcagaatcggaatctgatgaggaattgaaaggattgagttttgaggaacggaggaggctgaagaggcagaggatgaggaaaaatattgcaagatattgtatttggaatctcacgcctagtccgcccaggaatgataatgatgaaaatgaggattttgaagataaagctgatgaaatttcagagaagtacggcgaggacgatgagaagaagagctattcgaatgagaaggagaaagtgaaaaaagaaggaaagggtaaaccggagtctgattctcagaattctgagatgagcgattcggagactgattctgagtcggaagacgagtctgaatcggatgattctaggtcatggaagaagagaaggagttcaagttctaagcgtagaactaggagattgtctagcgaaagtgagagtgagccaaacgacgatgagaatgagagtggtgatttaagtgaatcagattctgaaggggatcgaaaacgcagtaagaaatcacggaaaaagagcagcagtagacaaaagaagagtagcaagagaagtgggaggaggaggaggaaaagtaggtacagtgactcggatgatagtgagagtgaagaatctgatcacaagtctaagaagcggagacgcaattcaggttcaaaatctaaaagcagcaagaaaaagaggtctgaaacagagagtgaaaaatcatattctgatgaggattcaggttctgaacttgatgcaaagggaatatcaaacgcagatgaggtacaaactgctgaaattgatgctgaggcactcatttacaaagagatgattgaggcacagaagaagcccgctttggataatgaacctgtagttgggccaatgccattgcctagagctgagggtcatatcagttatggtggagcactaagacctggtgaaggtgatgctattgcacagtatgtgcagcaaggaaaacgtattccacgtagaggtgaagtgggtctttctgctgaagagattcagaagtttgagagtcttgggtatgtgatgagtggaagcaggcaccagagaatgaatgcaattcgtattaggaaagaaaatcaagtttacagcgctgaagataagcgagctttggccatgttcaactatgaagagaaggcaaaacgtgaacacaaggttatggctgatttgcagaggctggtgcagcgccatattggacaggatgtcggtcctacacatgatccttttgcagggaaagcaactgatggttctgatgcctaataggtgacgtgcgcttattattactgttgtaactttgtagtgtcatcacttctcgagctttgtattttaactgatatttagtgaatctttattaagtgcatgcttgctatttacttgcttgggctcaatcctctgtagctatagatgtagcacatttcaagttctctcgaaagtttctgatacatttgtaggaactgaggtttaagaagtgaaagtgattgcttaattttcttgtgccttatttgaattgagattatgtggacttacaatgttgcagaatgaccatattgaaaatttactcggaatgctgccaagatatcagcatatttgg

SEQ ID NO: 5423 - DNA, 2134 bp, Ricinus communis
tacaagagtacagaacagcactctgtgccctaggctatttcttctctcatctcttcctaactatccggcgacgacaattcaataggcttaatcttcttccttcttgtctcttttccaattgttttcaatctttttgctgttctcttattgtctttaaaatatcttaaagacggtttgatcttgttttcttgtgctttttttttttgtaatctcgtaatacgagttttattgtattataatttttagagaatagaaaaggagttttaggtttcattagatttattagatttagttgacagggaaaaacaaggtaatcctgaaatccctaataatgggcggcagaccagcatcgacgatcgaattccccgacagacggtaccgtcctgaccgcaataatggccgttacacacctgaatccgacatctctcccaactacaaccgccatggagatcgccgcagtccctcctaccacagttatgatgagcgacaccgagagaccaatcctagacgctaccattcaagatcacctgataattatcctacttctagaagaagcagaagaagcccaagccctaggccactaaaagacctagattctcttcccaaaaagttcggtggcaggggccgcgcataccttgataggaatggaaaggattcagaatcggaatctgatgaggaattgaaaggattgagttttgaggaacggaggaggctgaagaggcagaggatgaggaaaaatattgcaagatattgtatttggaatctcacgcctagtccgcccaggaatgataatgatgaaaatgaggattttgaagataaagctgatgaaatttcagagaagtacggcgaggacgatgagaagaagagctattcgaatgagaaggagaaagtgaaaaaagaaggaaagggtaaaccggagtctgattctcagaattctgagatgagcgattcggagactgattctgagtcggaagacgagtctgaatcggatgattctaggtcatggaagaagagaaggagttcaagttctaagcgtagaactaggagattgtctagcgaaagtgagagtgagccaaacgacgatgagaatgagagtggtgatttaagtgaatcagattctgaaggggatcgaaaacgcagtaagaaatcacggaaaaagagcagcagtagacaaaagaagagtagcaagagaagtgggaggaggaggaggaaaagtaggtacagtgactcggatgatagtgagagtgaagaatctgatcacaagtctaagaagcggagacgcaattcaggttcaaaatctaaaagcagcaagaaaaagaggtctgaaacagagagtgaaaaatcatattctgatgaggattcaggttctgaacttgatgcaaagggaatatcaaacgcagatgaggtacaaactgctgaaattgatgctgaggcactcatttacaaagagatgattgaggcacagaagaagcccgctttggataatgaacctgtagttgggccaatgccattgcctagagctgagggtcatatcagttatggtggagcactaagacctggtgaaggtgatgctattgcacagtatgtgcagcaaggaaaacgtattccacgtagaggtgaagtgggtctttctgctgaagagattcagaagtttgagagtcttgggtatgtgatgagtggaagcaggcaccagagaatgaatgcaattcgtattaggaaagaaaatcaagtttacagcgctgaagataagcgagctttggccatgttcaactatgaagagaaggcaaaacgtgaacacaaggttatggctgatttgcagaggctggtgcagcgccatattggacaggatgtcggtcctacacatgatccttttgcagggaaagcaactgatggttctgatgcctaataggtgacgtgcgcttattattactgttgtaactttgtagtgtcatcacttctcgagctttgtattttaactgatatttagtgaatctttattaagtgcatgcttgctatttacttgcttgggctcaatcctctgtagctatagatgtagcacatttcaagttctctcgaaagtttctgatacatttgtaggaactgaggtttaagaagtgaaagtgattgcttaatt

SEQ ID NO: 5424 - DNA, 818 bp, Coffea canephora
cgaagatgagagtggcagtgaggattctgatgctagtccatcatcaggagatcgtgtgaattctaaaaagcagaagagcttaaggtccaaacgtagcaagaagaagaggaaaacagaatcggatgatgaggcctcattatcagcaaagagttctgattctgcagttgaggctaagagtaaacctaaggcagcagaggaaaagccaatgttgaatgaagttgatagtgaggtacttcagtttaaggaacttattgagtcgaggaagagagccgcattagagaatgagccagtggttgggccaatgccgttgccaagggctgaagggcatattagttatggtggggcacttaggccaggtgaaggcgatgccattgcacagtatgttcagcaggggaagcgtatcccacgaagaggtgaagtgggtttatcagctgaggagattcagaagtttgagactcttggatatgtgatgagtggtagtaggcatcagaggatgaatgctattcgtattagaaaggaaaaccaggtttacagtgctgaggacaagcgtgcattggccatgtttaactatgaggagaaggccaagcgtgaacaaaaggttatggctgatctacagcggctggtgcagcgccacattgggcaggatgctggtccatctcacgatccttttggcgggaagtccactgagggggctgaagcttgattcaatgaatgatggtttatctatctcattgaactaaactctagtcttggcttcgtcttcctttccttttattatgtttgcttggatttgaaataatgagttgtttttggtactc

SEQ ID NO: 5425 - DNA, 1511 bp, Medicago truncatula
gcgaatattagaacctaaataacaatccaatttgcacatttttaccatggcaagactctcctccaccatcgaaaccccttaccaacgccatagacacaacgatcgccgccgcactcccgactccgatgtctccaacgatcgccctcgctaccgtcgtagccctagctacgactcctacgacgatcgtcacacagaccgccaccgtcgccgttcaatatcccctgaaaaccgaaaccctagacaccacgataacggaaattcaaacggaaaccatcttccaaagaaattcggacaccgtaataacggttcctatctcgaccgcaacgattctcggcgtaacgagtctgaatctgatgaagaattgaagggattgagttatgaagagtatcgcagattgaagaggcagaagatgaggaaatcgttgaagcactgtatttggaatgttacgccgagtcctccgagacgcgagaacgatgatcttgaagattatggtaaacctgaagaaatttctgagataattgatgtgaagaaggataaggagattaaacagaaagcaaaatctgagtctgaatcggaggaatctaaagaatctgattcggaattgaggaagaagaggagaaaaagttataagaagtcgcgtgaaagcgatagtgaatctgagtctgaatcagaagtggaagataggaagaggagaaagagtaggaagtatagtgaaagtgatagcgataccaattccgaagaagaagatcgtaagaggaggaggagaaggaagagtagtagaaggagaaggaagagtagcaggaagaagagaaggtgtagtgattcagatgagagtgaaactgatgatgaatctggctacgatgatagtggaagaaagaggaagcgatcgaaacggagtagaaaaagtaagaagaaaagttctgaaccggttagtgagggttcggaggaaattgagttgggttctgattcggctgttgcgaagattaatgaagaaattgatgatgttgatgaggagaagatggctgagatgaatgctgaggctttgaagttgaaggaattgtttgagtcacagaagaaaccggctttggatgatgatgaaccaccggttggaccaatgccgcttccaagagctgaggggcatataagttatggtggtgcgcttaggccgggtgaaggagatgctattgcgcaatatgttcaacaagggaaacgtattccccggagaggagaagtgggtctttctgcggaggagatttcgaagtttgaggaacttggttatgtgatgagcggtagtaggcatcagaggatgaatgcaattcgtattaggaaagaaaaccaggtttatagtgctgaagataagcgtgctttggctatgtttaattatgaagagaaggctaaaagggagcataaggttatggctgatttgaatcggcttgtgcagcgtcatattggtcaggatgttggtccaattcatgatccttttggtgcaaaagatggttctgattgatatt

SEQ ID NO: 5426 - DNA, 1992 bp, Mimulus guttatus
atgagaattttctatctgttcatattggcttccaagtctacttttttagggaaaattgtctctcaattcgatcctctgagatccctaatgggaagaatttcctcagccgtagaaatccctgaacgccgtcgcccactcagccaccgcgaggatggccgctcttctcccgattcccgctaccatcggcgcaacgttagttacagccggagccggagccccagccttaaccgccaccaccgccgtagccccagccctcgccctaatcgggaccgccgccgtagccctagccctaaccgtgaccggcgccgtatccccagccctaaccgcgtcctccgccgtagcttcagccgaagtaggagccggagtggaagccccataagaaacggacaaaacaggaacttccgttcttctccggattactcgtaccctgttcacggagaaaaccaaatttctgtcgaccaaaagaaattcaattttgataatagaaaacaaccctacctcgaccgagatagtaggaacggacaattccctgagcctgagtctgatgaagaattaaagggtcttccttatgaagaatatcgcaggctcaagcgtcagaaattgagaaaattgatgaggaacagtatttggaattgcacccctagcccccctagggatccaaatgaaaattcggatgcggagctggacgaggatcttgttgccgaagaggaaaaacagaccaaggtgttgaaagctgtggcgaaaaaatcgaaaaagagcgactctgagtccgagagtgaggagtctgaatctgagtcagatgattctaggtcgaagaggggcaggaaatctggctctaggaagaagaagagtaggagagcgaaatcagtttcggagagtgaaagtgtatctgagcaatcgagtgatgaagattcggaggaagataggaagaggaaaaagaagggtggaaaaaagagtaggaaaggaaggagtagcaaacgcagtagtaggagaaagagaagcagcaggaagaagagcttaaccagcgaaagcgagagcgcaagtgatgattccgaaacaagtgctggtgcaaagtcgaagcagcggaaacacaggtcatcttcaaggtcgaaaaagggcaagaaaaagagagaagtcgacagcgagaattctgattcaaacgggagtgcttctgatcaagaagctggtggaaaggagttggtccacaaggcagatgaggtcaaggttaacgatgaaatggatgatgagctactcatctttaaagaaatgatggaactacgaaagaaatccaacaacttggaggaggagcaagtggtcggtccaatgccgctgccgagggcagaaggacatatcagctatggtggtgcactcaggcccggtgagggtgacgctattgcgcagtatgttcagcaagggaagcgtatcccacgtagaggagaagtgggtctttcagcagaggagatttcgaagttcgagacacttggttatgttatgagtggtagtaggcatcagaggatgaatgccattcgtatcagaaaagagaaccaggtttacagtgctgaggacaaacgggctttggctatgtttaactacgaggagaaggcgaagcgcgagcagaaggttatggctgatttgcagaggctggtgcagcggcatattgggcaggatactggtccttctcatgatccgttcggtggaagggctgtcgagggggctgatgattgattctgcgtactactgttgctgtatgcgtatctctactttatcccttttaggatattccttttttctgctttatgatgatgtataagtatgccatgttgttgtgatggatgcatttcgtgacaattattatgcagaaattgtgctaaagctttcggattttgatttttcttttgaaatcttttctttaagtaatgatatagtggagaacgccctcattggaattacgtttggttcttagttttggagatttgtgcttttgtgtgtttg

SEQ ID NO: 5427 - DNA, 1757 bp, Orobanche aegyptiaca
accctatcaaaatccctaatgggcagacttacctcagcggtcgagatccccggccgccaccgttccgcaggcctccgcgaaaatggccgatattctcctcgtagccaccatcggcgcgaccgcagttacagccgcagccgcagccgcagccgaagtcctacaaacaacggctataacaggtaccgtcgttcttctcccgactactcataccctaatctcgatgaaacccaaaaattcggggaccgaaagaaattgaattacgatattcgaaaaaacccctacctcgatcgagataatagaaacggaagacatgcgcagtctgaatctgatgaagaattgaaaggcctaaattacgaagagtaccgcaggctcaagcgtcagaaattgagaaaatcgctcaaaaattgtatttggaattgtacccctagcccccctagggatccaaatgaaaaatcggatggcgaactggaggaaaatatttctaaaggtgaagaagaaaagcagagtaagggttcaagattggatgcgaaaaactcgagagagggtgaatccgagtcggagtctgaggattctgattctgagtccgacgattctaggtcaagaaagggtagaaaatctcgttccaggcgtaagagtaggagattgaaatcagtttctgagagtgaaagtctgtcagatgatgaatctagtgactctgactccgaggaagataggaggaggagaaggagagagcgtgggaagagaaataggagcaaaaggagtagcaagaaaagtagtaagagaaagagaaatagtaagaaaaaacactcgaaaagtgaaagtaagagtgaaagtgaaagtgaggattccgatacaagtgatcgtgtgaaatcgaaaagaaaaaaacagcgttcatcttcacggtccaaacgaagcaaaagtaagagagaatcggacagtggtctgagcgacagtcgtttggattcggaacctgatggaaaggaagttgttcctatggcagacgacgtcaaggtgaacgatgacatgaacgaagagctgcttaagttcaaggaaatgatcgagcaacggaaaaagcccaatatagatgacgagcccgtggtcggtccgatgcctctgccaagggcagagggacatatcagctatggtggtgcacttaggccaggtgaaggtgatgctattgcgcagtatgtccagcaaggtaaacgtatcccacgtagaggtgaagtgggtctttcagctgacgagatttcgaaatttgaggatcttggctatgtgatgagtggtagtaggcatcagaggatgaatgctatccgtattaggaaggaaaatcaggtttatagtgccgaggacaaacgggcactggctatgtttaactatgaggagaaggctaagcgtgagcagaaggttatggctgacttgcagaggttggtgcagcgtcatatcggacaggatacgggtccttctcatgacccgtttagtggaaaagctggagagggaggtgatgattgattcttgtgtgctgacgttgctaggttggtattcagtttgtgctttacttttttgaactaattttctattttggatgtatgaattttgttctctgtgttagaaccatttagtagaggatgataatagaactcgggttcaagtttttggatcttttggaagttcttatttgtcttcaagaagtgatgtagctgtatggagatgaattatagtcttatgttttggagatatgcctatacacatgaaaactt

SEQ ID NO: 5428 - DNA, 2098 bp, Sciadopitys verticillata
ctttctttatttactgtgttcttacttcgtgtgcgatgtgtgctttgattagatataacttttgtgctttggtttgagggagtaataattatgtgtcacgattttaacataatgcatttaagaaatattacagatgatgttatagtggatgtttgagaatagattgattgaattcatgtatgggatactaagatacttattacttttctttgtaaaccttggctttgatcaaatgagggagtttgtgtaattagtgagtgatttgaattttgttaatctgtgtttgactgagatactgtttaaagaatgatttactaagttttgtgaacgtgattggatgtttagttataccagtatgaagagcgacagagatgtccgtcgcagtggcaatgatcagttggagagcgacgatgaggaattgaagggactggattttgcagagtatagaagactgaagcggcagaagttgagaaagaagttgagggattgtatatggagaattactccaagcccgccacgagacgagatggggcgaattgagaatgacaagattgcgaatgttgcggccataaatggaatcaatgaagctgatggaaaatcgaaggttaaaaatgatagagaaatttctgaagaccaaggaaggaaggggggcatagtgaagaaaaaggggtctagaaaatattcagacagtgaaagttctgatgcagaggactccatgtctgaaaagtcttcagatgatgcagtgacgagtgatttggaagataggcggagacggaggaaaaagaagggtaattcgagggggaagagatccaggaattctggcaagagcaggaaacggaaggatcgtagtgagagagaagagagtgaggaaggtagtttatctggagactcttatagcagtggtggtgaagtcgaaaggcctagcaagagcagaaaaggagggaacagacacgcgaagcctaagaagaagttaaggagaaggacaggtaggtcatcgaagagatccagagcaaggggttccaaagatagttcagaaagtgcatctgaatcagaagatggtagtcattctactgagaatgaagggagtggtaggaagaaatccaaatcgtcaagtgtatcaaaacattctgatctcccaaaatgcaagcaaaagtcatcacctgagagcgatgaattctctgatcataggagttctgaatttgaacttgttgggactgaggaggaggagaaaggggatatgagcaaacttgtggaaatcgatgatgaggccctcatattcaaagagatgattgaatctcagaagaaattggcagctgcagggcttgagaatgagccatttgtggggccggcaccggctccaagagctgaggggcatataagctatggtggtgctcttcggccaggagaaggagatgctattgcacagtatgttcagcaagggaagcgtattcctcgcagaggagaagtggggttgtcagctgaggagattcagaagtttgagacactgggttatgtgatgagtggaagcaggcatcaacgtatgaatgcaattcgtatcagaaaggaaaaccaagtttacagtgctgaggacaaacgggctttggcaatgtttaattatgaagagaaggctaaacgtgaacataaagttatgtcagacttgcaacgattggtacagcggcacattgggcaagatgttggtccaacacatgatccttttgcagctaagctccctgaggatgcagatggttaggctttttatgtgggtttagttggattatcaataatccgatcgatcaatcaatcaacttgaggccattcggtatccccgaacttaatgggtgggctgcacttgcttcaattcctttcgaggctaaaagcgatgcgtttatcaaacaataatctcagccacgtgtatctcagcgtttatatactgttccggatcccgaccagaacgtgctggggttcgttgttcttgaagtatggtgtgaagctgaatttttattacggtttgaattactttttgcatgccacattaacaacctaaaaggagaactttccaaatgtaactgatgcaagtaaaaagactctgttaaaagac

SEQ ID NO: 5429 - DNA, 2199 bp, Picea glauca
  misc_feature (106)..(106): n is a, c, g, or t
  misc_feature (111)..(111): n is a, c, g, or t
  misc_feature (133)..(133): n is a, c, g, or t
  misc_feature (168)..(168): n is a, c, g, or t
  misc_feature (203)..(203): n is a, c, g, or t
  misc_feature (493)..(493): n is a, c, g, or t
  misc_feature (654)..(654): n is a, c, g, or t
  misc_feature (657)..(657): n is a, c, g, or t
  misc_feature (674)..(674): n is a, c, g, or t
  misc_feature (1752)..(1752): n is a, c, g, or t
tattcaaaattcccaaatggaagacggaagagcagcggcagacgggtatccgaaggagcgaagaagattggcctcaaaggtcgagtatgcagggcgtagcagcagnaatgnaatcactggtcatccaacagancacgagggtttccgtggccattcaaaaaattatgnccgaagtcgtagccgcagcccagatcaatcgaggnacgaacattaccgttacccctccagcaatggtaacagatcgacttcccattcaaaaaattatggccgaagtcgtagccgcagcccagatccatcgaggtacgaacattaccgttacccctccagcaatggtaacagatcgacttccccttcccgttcacgtggttgttatggcaaagccctaagtccgaaccctagggtttctgatcgttgttacagtccaaatgagattcttgatgaaaaccccaagagagggggagacactcttcggtatgaaagaaggcccagtacnagccctgatttaaaatatgatcaaaggcccaattcaaacctcagccatagacagaggttcgaggaccgaagccctaaccctccgcgaaataataatgggctctatgacagacgccggagtccaaaccctaatgacggacgccggagtccaaaccctaattntgncaatgaaccacggcatngggatcgcagggcgagtcccaattatcatccttacgatccttcttctgggaatcgtcccccagtatttctagacagaggcgatcctcggcgtggtcgtgggaatgaacagcccgaaagcgatgaggacgaggatttgaaggcggtggatttcgcggagtatcggaggttgaaacggcagaggcttagaaagaaattgaagaattgcatatggagaatcactcctagtccgccccgggatgaaattgaacaggcggtggctaggcagatgatggacattgagaaaggtggtaatgggataatgctgggcaatggtgccggagctatagaaaacaaggaagaattccatggaagatcatccaaggggggtaaaggggatgatggggatgcttctcgcagcaaagcttctggggacagtggaaagaaagcaggggatttaacgaagaaaagtggcgggcgcaggaaaccttctcctactaacagtggaagtgattattctgagtcatctgatgatggtgagtcaagaaaggacattaagggcggtagatccagcaggaagaaaaagagtaaatcaaagcattctggcaagaggaagaggagacatatcagcgtgagagaaagtaccgaggatgatagtgatagtgtatcagaagatgactcgtcctcgtgctccagtgaaaatgaaaagatgaagaagcaaacgaatcgacgaaggaacagacaagaaaagcgaaagaaatcgttgaagagaatatctggatctaaaagatcacgagttcaaagttctgaagatgaagagaagtccgaaccccatcctgagagtcatgtcttatcagatgattctttagaacttgaatctggcaagaatgaggagagagcaagtgacgatgaccctgttgaaatagacaatgaagctctcaggttcaaagagatgattgaatctcagaaaaaagtagcggcagggcttgaaaatgaacaaattgtggggccacttccacttccaaaagcggaggggcatataagctatggaggagcacttcggccaggagaaggtgatgcaattgcacaatatgtccaacnaggaaagcgtatccctcgaagaggagaagttgggctgtctgctgatgagattcaaaagtttgagactcttggctatgtcatgagtggaagcaggcatcaacgaatgaatgctattcgtattaggaaagaaaaccaagtgtacagtgccgaggacaaacgagcattggcaatgttcaattatgaggagaagtcaaaacgtgaacacaaggtcatgtcagatcttcagcgcttggtacagaggcacattgggcaagaagttggtccaacacacgatccttttggaggcaaggcacctgaagtggcagatggataggtttgcaggcaaggcatctgaagtggcaggatggataggttttttaagagtttgtcataattattactatcttttttgtaatttcttcagtttattatattcaatgtgaagtgctaagctgtgtatttttgcat

SEQ ID NO: 5430 - DNA, 1926 bp, Taxus baccata
atcacccttcccaaatggcaaagatctatcagtcctcaacatggcaaaaaccccagtccaaaccctagcccaagaagagacttcgatcgttacagcccaaatcctaaccctaattattatcgaaactcgagaagagagagccggaatgaaagggtgcgtagtccgagtccactccctaagacttcaaaaaacgggtaccatgatcgaaattattacgctgtaagagaaaaccgatatgaaaaagaccgtaacgagagtccaaaccctaggtttgaggatcgtcaggatttggactctcgtcagaacgggtacctcgagagagagggccggagtccaagccttaatcatgatcgcagggggagccctagttataatccttacaagcctgtggtgaatcggcaggcatttctggacagggatgtgaagcgccgcggggacaatgagtcggagagtgatgacgaggaattgaaggggctggattatgctgagtatcggaggcttaaacggcagaaattgagaaagaagctgaagaactgtatttggataactacgcccagtccacagcgcggagagatggaatatgatgcagacgaaaagatcgaaaagctttggaatgttgcacgcactaatgagaatatggaaactaatgggaaattgaagggtaaaaatgaaaatcataattcagaggataatgagcaggtaaagaaggcggttgcaatgaagaaaaagaggcctagggagtattctgacagtggcagtgatgataattctgagggctccatgtctggaagagaattagatgatgtcgcttcaagcgattccgatgataggcggaaaggtaggaagaaggggcgcaattccaggaggaagaagagactcaggcatactggcaagggcaggaaaaagaaggctgttagtgagagtgaagaagatgatagtgcgtctgaaggctcattttcatatagtagtgaagagggaaggtcgagaaagaagaagaaacgacggagcaggcgtgaggagcctaaaaagaattcaaagaaaaaggttggcaggtccaaaaggtccaaagcaaggagcaacagagatagttcagagagtgcatcaggatcagaagatggtactggttcttttgataaggaagggagtgacgggcagaaatctaaactgtccgtattaaaaatctccgatagcaggaaacttgtgcaacagtcaccttttgagagtaatgacttgtccgaacatagtaattctgagtctgaacctgttggcgctgaggagggaaagaggataatagccaacctgttgaaattgacagcgaggctcttatgtttaaagaaatgattgaatctcagaagaaatcagcaactggaggtcttgagaatgagccatttgtgggcccagcaccagctccaagagctgaggggcatatcagctatggaggtgcccttcggcctggagaaggagatgcaattgcgcagtatgtgcaacaagggaaacgtattcctcgaagaggagaggtggggctgtcagctgatgagattcagaagtttgagtctctgggttatgtcatgagtggaagcaggcaccaacgtatgaatgctatccgtatcaggaaggaaaaccaagtgtacagtgctgaggacaaacgagcattggcaatgttcaattatgaggagaagtcaaaacgtgaacataaggttatgtcagatctacagcgcttggtgcagaggcatattgggcaagatgttggcccaacacatgatccttttgcagctaaggattcagaggtggcagatggttaggtttttgcagaggatgtcttaaactttaatggtgttttgtacaatttctagatgttttcataaattggacgtaagtgtaactatatccttcacgaactatgcaattttaacccgttcataagac

SEQ ID NO: 5431 - DNA, 1120 bp, Nicotiana tabacum
  misc_feature (58)..(58): n is a, c, g, or t
  misc_feature (494)..(494): n is a, c, g, or t
  misc_feature (566)..(566): n is a, c, g, or t
  misc_feature (572)..(572): n is a, c, g, or t
  misc_feature (584)..(584): n is a, c, g, or t
ccctcatgcggccgctggaagagtcgagcgatgattcagaagaagaagagaggagaanacgaaggaagaagtcgtggagaaagcaaagtagtagaaggagagataaaaggggtaagaagaaaagaagcaaaagaaaaagctattcagatgagagtgagagtaagagccaaagccaagagagtgatagtgatgattctgatgctagtaagaagcaaaagcgcgatttgaagagtaagaaaaagaaggatgatggggatagtgacataccagaaaagagcttggaattggatggggatgctagaattaatgagaaggccgatgaaacaacgatagatgaagttgatagtgagttgcttgaattcaaagaactgattgaggcaagaaaaaagagtaatttggataatgagccgcaagttggtccaatgccattacccagggctgaagggcatataagctatggtggggcacttaggcctggtgaaggtgatgctatngcccaatatgttcagcaagggaagcgtattccgcgtagaggtgaagtgggtctttcagctgatgagatttcnaaattngagggtcttggntatgtgatgagtggtagtaggcatcaaaggatgaatgctattcgtattagaaaagaaaaccaagtttacagcgctgaagacaagcgagccttggccatgtttaactatgaggagaaggctaagcgtgaacagaaggttatggctgatttgcagcgccttgtgcaacgccatattggtcaggataccggtccatctcacgatccgtttggagggaagtctgaagagggtgctgatgcttgatccttttgtatgttgttttactttaattttggtgttactgctgttacatgtagaaattaggttgtttaatagaaaatggagacataaaagttttataattacttctgtgtaagctgataatgtttggtttttactaaatgctgtttcactggtttgtagtttaatgtgattagagtagatctgagcttgctgaaattcgttatgctttcttagatctgctttcacacatgccaacaattctccgtactcgtatgaaagactatgttttgtggttttggttagcggccgcatgaggg

SEQ ID NO: 5432 - DNA, 498 bp, Cedrus atlantica
agcacttaggccaggagaaggtgatgcaattgcacaatacgtccaacaaggaaagcgtattcctcgaagaggagaagtagggctgtctgccgatgagattcagaagtttgagaccctgggctacgtcatgagtggaagcaggcatcaacgaatgaacgctattcgtattagaaaagagaaccaagtgtacagtgccgaggacaaacgagcattggcaatgttcaattatgaggagaagtcaaaacgtgaacacaaggtcatgtcagatcttcagcgcctggtacaaaggcacattggccaagaagttgctccaacccatgatccttttgcaggcaaggcacctgaagtagcagatggataggtttcttaagaagttctcataattattactctttcttccgtttattatattcaatgtgaagtgctaagctgtgtctttttcacgaggacaacatttatcatgtattataaatttatcaggcaggatttgaatatcat

SEQ ID NO: 5433 - DNA, 1839 bp, Malus domestica
atggctctctctctcttctctctctctgcgcctccgctctgtgttcggctggagactgtctgtgtgagaggccatcatccaccatccacataccggagagacgacaccgttccgatcacgagaacggccggtacccaccgcactccgactcatccggcgacaaccgctaccagcgtcgcagccccagctacgaaaactacgaccgctacgataaccgccgccaccgaaacccctctggaacgccccctagacgaagccctaggagcaacggaggaggcccggaatccttggctcggcgtcgcagccccagctatgaggactacgagcggcacgacaaccgccgccaccgaaatcgctcgggctcgcctgattacccgaaccctagacgaagccctagggctaatggggggccagactctctgccgaagaaattcgggcgtggcgggaaccgtatggaccggaatggagggacgggaggagtcggaggactccgacgaggagctgaaggggctgagtttcgaggagtacaggaggctcaagaggcagaagctgaggaaatcggggaagttttgtatttgggaattgacgcccagcccgcctagggttgagaacgatgagttcgaattggtgggtaaggctgatgtgatttcggagcggtatggcgaggaggagaatattgaatcgcaggacaagaagaaagagaaggagaagtccgagtctgaatccgaatccgattctgaatcggaggatttgaggtcgaggaaaaggaagaagagttcgggttcgaagcgcaggagtaggaaatcgaggtatagtgacagtgaatcggagagtgagagcgtaagtgatgatgaatcggatgaagaggaggatcgtagaacgagaaagaaatcgaaaagtaggagtaagagaagcaggagcagaagagaaaggagaagaaagaggaagagcaggcgtagtagcagtagcgagttggatgagagcgaagacagtgaaagtgaggtttcagattcaaagaagaagaagaaacagcgaaagtctcgcagtcggagtaagaagaaagagtcggaaactgaaatggagagtgagatatcggactcggagaagggtttggattctgaggttgatgccaaggctgctactttagtggaagaggagatgatgaaggatgagagtaatgcggaggcattgaagtttaaggagattttcgaggcccagaagaagttgtcattggacgatgaaccagtggttgggccaatgccgttgcctagagctgaagggcatattagttatggtggagctctgaggcctggtgaaggtgatgccattgcacaatatgttcagcaagggaagcgtattccgcggagaggagaagtgggtctttcggctgatgagattcagaagtttgagaaccttgggtatgtaatgagtggtagtaggcaccagagaatgaatgccattcgtattaggaaggaaaaccaggtttacagtgctgaggataagcgggctttggccatgttcaactacgaggagaaagctaagcgcgagcacaaggtcatggcagatttgcagcggctggttcagcggcatattgggcaggatgtcggacctactcatgaccctttttccgggaaggaaaaagagattgctgatgcttagtttcatgtatgtttacttttatctgaaattttgatttcttttctctctttcatgaattatgtcatgtatgttactagttgattttgagcagtattgaattggatgctttggtctgttaacatctagtattgcggtgcttaaagaaattcgctttttatcatggtagatatcaaattgtgg

SEQ ID NO: 5434 - DNA, 1873 bp, Cephalotaxus harringtonia
ttaataggaaaaggtatgcccgaagcagaagccgaagcccagttcgtaccaggtatgaacgccatcaccctttccaaaatgacaacagatctgacagtccttcgcacggcaaatccccaagtccaaaacctagcccaagaaggaactttgatcgttacagcccaaaccctaatcctgactattctcgaaaccctggaagagaaagccggtatgaaagggggcgtagtccgagcgcaaaccctaacacttcaagaaatgggtaccatgatcgaaattattacccagtaagagaaagccgcgaccgtaatcagagtttaaaccctaggtcgagttcaaaccctaggtttgaggatcgtcgggattcgaaccctccacggaatgggtatcatgagagaggggttcggagtccaagcccaaataataatcgcagggggagtcccaattataatccgtacaagcctgctgtgaatcggcaggcgtttttggacagggatgtgaagcgccgcggggataatgagtcggagagtgatgacgaggagttgaaggggctggattttgctgagtatcggaggctcaaacggcagaaattaagaaagaagttgaagaactgtatttggacaaatactcccagtccgcagcatggcgagatggaatatgatcggagtgaaaagattgataagcttggtaatgatacacgcatggatgagaatattgaaactagtgcgaaattgaagggtaaattggaaatcatgattctgaagatagcgggcaggatagaaagatgaagaaaaaggagtactcggaagtattctgacagtggaagtgatgatgattatgagggctccatgtctgcagaagaatcagatgatgttgtatcaagtgattcggatgataggaggaaagggaggaagaggggagcaattccaggagaaagaggagatccaggcattctggaaagagcaggaaaacgaaggctgttagtgagagtgaagaagaagatagttcatctgaaggcttgtcttcatatagtagtgaagaggaaagggtgagaaagaagccgaaacgagggagcaggcgtaaggagcctaagaagaggtcaaagagaaaggtgggtacgtccaaaaggtccaaggcaaggagcagcagagatatttcagagagttcatcaggatcagaagatggtaccggttcatctgatagggaagggagtgttgggcagaaatccacattattgatggtatcaaaaatctctgatagcaggaaaaacaagcaaatttcgccttctgagagtaatgacttctccgaacatagtaattctgagtctgaacctgttgggactgaggaagagaaagaggataatagccaacctattgaaattgacagtgaggctctgatgtttaaagaaatgattgaatctcagaagaaatcagcagccggaggtcttgagaatgagccatttgttggtccagcaccagctccaagagctgagggtcatatcagctatggaggtgcccttaggcctggagaaggagatgcaattgctcagtatgtgcaacaagggaaacgtattcctcgaagaggagaagtggggctgtcagctgaggagattcagaagtttgagacattgggttatgtcatgagtggaagcaggcaccaacgtatgaatgctattcgtatcagaaaggaaaaccaagtgtacagtgcggaggacaaacgagcattggcaatgttcaattacgaggagaagtcaaaacgtgaacataaagttatgtcagacctgcagcgcttggtgcagagacatattgggcaagatgttggcccaacacatgatccttttgcagctaaggcgtcggaggtggcagatggttaggtt

SEQ ID NO: 5435 - DNA, 2235 bp, Distylium racemosum
gccacaagcacagtaggtaattgcaggccagtatatatccacactgctctccgtttcgggcgaaggaaacaaatgaaagaagaaatggataacggcagagcaagcgagaggaatgatagggacgactatcgtgacagaagagatcgaaacccagaccgcagggaaaactctcggaaaatagacgaagattacagagaccgtgcgcacagaagaagccatcgccgaagtcgaagtcgtagtccagatcttcccaggtacgatcgctgtcactcatcccaaaatggtggcaggagatcgaatcccatcccctcccacggcaaagccccaagtccaaatcggaccccgagaggggatttcgatcgatacagcccaaaccctaagtacacccgggatagaaaccctggaagggatcctcgatccgaaaggtaccgcagccagagtcccgacggaaccactcaaaacattaaccctcttcgaaacgggtaccaacatgacagagggcgaagtccaagtcctaaattagatgaagacgggcgatggcctcgggatcgcaggggaagccccaactataatccctacaagcccgccggaaataggccggggtttttggacagagatgtccagtggagcaggaaagatgattccgaggacgatgacgaggaattaagggggctggattttgcggagtatcggaggctgaagcggcagaagctgagaaagaagttgcacaaatgtatttggagaattactcccagcccgccgccgaatgagaggttacgtgattcgaaggaaaagcctggcgatttcggtgatgcggccacgaaaggaaacggtgaagctgccaacggaaaattgcagaccaagaatgatagcgaaggttctggagataaaaaaaaggtaaagaatggtgggtcggtgaagaaaaggggttcgaggaaaaattctcggagggaggattccgaaaatcccatgtcggaaaattcatcggaggacgaggagtcaaacgattccgaggacagccggagagggaggaaaaaggggagttccaggaagaggaggaggacatcaagccgttctgggaagaggaataagagggatgctgtgaacgaagacagcgaagaggacagtgtctccgaagattacagtagtgaagaagatagaccgcggagaaagaggaaacatgagaagcgtaagtcatctaaaaaaaggtgggccgtcgatccaaaagatccaaagcaagggattccaaagatggttctgaaagtgtctctgaatcagacgatagtggtagcactgattctgaatctgaatcgaagggggcgataaaaagaaatccaaggcctccaggggattcaagcgttctgaacgcagaagtcgcaaggaacaggctatcagtgagtcttctggatcccaatctgaatcccaggggaccgcggaggaggaggaggaggaggaggaggaggagttggagttggagttggagttggaggagttggaggataaggggagcccatggaaattgacgatgaggctcttatgttcaaagagatgattgagtctcagaagaaatcagcagccgggcttgagaacgagccgtttgtgggtcctgcgcctgcaccgagggccgatgggcatatcagctatggaggtgccctcaggcctggagaaggagacgctattgcgcagtatgtccagcaggggaagcgtattccgcgaagaggagaagtgggtctgtcggctgaggagattcagaagtttgagtccctggggtatgtcatgagtggaagcaggcaccagcgtatgaatgctattcgtatcagaaaggaaaatcaggtgtacagtgctgaggataaaagggcattggccatgttcaactatgaggagaagtcgaagcgtgagcacaaggttatgtcagatctgcagcggttggtgcagcggcatattgggcaggatgttggtcccacgcatgatccttttgcagcaaaagtccctgaagtcgcagatgggtaacgtttggggaggttcgagttttatttttgtatatgccccaatgatttacttctgtatgcaggaatagtttcatgaattatatgtttccctcggaagcagcgtacattttaagatgcgcattattcgttttgctaaatatgtgttgaagtcctttgaaactttcagtagctttacttgttatgtattatactccatctttgtcaccgtattatattacgctggctc

SEQ ID NO: 5436 - DNA, 1359 bp, Lippia dulcis
agtaccgcaggctcaaacgtcagaaattgagaaaatcgcttgtaaagtgtatttggaattgcactcccagtcctcctaggaatccaaatgaaaagtcggatgacgagctggaggaggatttcgctggtgaagatgaaaaacagaataacggattgaagtcgggcaccaaaaggtcgagtgaatctgcatcggagtttgaggattctgagtctgaatcagaaccagaatcagatgattctaggtcgaggaagagtaggaaatcaggttctaggcggaaaagtaggagatcgaaatctgtttctgagagtgagagtgaatctgaggagtcttccagtgaggaagattcagatgaagaaaggaggcggagaaggagaaaaagtgggaaaaagagtgggagaagaaagagcagcaagagaagcagtaggagaaagaaaagtagccggaagaagagatcaaccagcgaaagtgagagcaatagtgaggattctgatatgagtgatcatgtgaagccaaagaaacggaaacatcgatcaaaaagaaacaaaaagaagagagaaactgacagtgagagttcagataaaagtggcacagattcagatgctgaggtgaaagatgttgctccgatggcagatgaggtcaaggtcaatgatgataatgaagctgagttacttaagttcaaggaaatgattgaatcacggaagaaaaccaacatagatgatgaacctatggttggtccaatgcctctgccgagggcggaaggacacatcagctatggtggtgcacttaggcctggtgaaggtgatgccattgcacagtatgttcagcaagggaagcgtatccctcgtagaggagaagttggtctttcagctgaggaaatttcaaagtttgaaaatcttggttatgttatgagtggtagtagacatcagaggatgaatgccatccgtataagaaaagaaaaccaggtttatagtgctgaggacaaacgagcattggctatgtttaactatgaggagaaggctaagcgcgagcaaaaggttatggctgatttgcagcgtttggtacagcgtcatattggccaggacactggtccttctcatgatccatttggtggaagggctggcgaggctgctgatgactgattctatgttctgttgtttttatataggtattctgtttatgccctttggagttcttttctgtttacatgatgtatgaatatgcctttgtatcgcaattatttggataagtctttggatttggtatattgaacatgtcttcaagtagtgaaatagttgattacggattactagaatgaaatgtggtctcagatttggagatttatccctatatgcagtgaac

SEQ ID NO: 5437 - DNA, 2079 bp, Pteridium aquilinum
ggaacagtctcaccgtggtgtgcacagaagcaggagcaaagcaggagtccaagcaaaagtaggagccctcatagaaatcacagcaggaacagtcttcaaggtggcgtgcacagaagtcgtcatgaggatgccttgcttcaagaagacagtaagcatcggctttctcctgagaatttccacgattcccatgttggaaacaggaaagatggccgtggttatagtgctggcggtgtcgaaaaggaggatcgaagtagttggcaagcaagaaacgcgcaaggtagctttcgagaaacgacagggagaaggggttatgatagttatgacagcgatagagggggaagagccagtcctacgtatctgccctacagggttcctgatcatgagaaggtagctactcgagactatgacagggttagagaatctgacagtgatgaggaggatttgggagatctgagtgcccatgactacaggatggtgaagcgtgaaagattaaggaaaaaaatgaaggtgtgcatatggaaaaccacgccaagtccccctcacgaggagatgaatgctcgatacagaggagggcacacaaatgcaagctctgaggaaagagatgctgatggagttcctgatgtctcaggccagatttctgacaggaatgaatcagttgagaggattcctgtttctgaaggagtacacaataataattttagcgtaggggagaagggtcaggagaccgttacagttaaggatggcaaccttagacagaaggtcaagcctgaatctgacagcagaaatgaggatagcagttcggaagatgaaggttaccaaaaacggaaaaagaagcatgcaagcagaagtgaggatagcagttcaggagatgaaggttatcgaaaacggaaaagaagcatgcaaacagagatgaggacagcagttcagaagatgaggtttaccgaaaacggagaaagaagcatgtaagcaggtcttcgcacaggtaccgctctcgaaagctgtcaaaggagtatgcctcagaggcaagccaagatgaaagtagttctgaaccttttgagagtgaattttcaagttccggaagtgatggtgaactgaagaagagcagcagtaagaaaaaggagaggaaagaaaaaccaaggaagaggcatactacgtcatcgtctggcagaaggaagaaaagcaaggcaagtaagaaacgtcaccatctgagctctgatgacaatgttgaggcagatgatgggaacaaatctcctgtgagacgtgaaaatcctaacatctctccatctatatcttctgacaaagactcgaaggacagtttattacgccagtctgatggggagacagataaagatgatgatactgcagttgagattgacgaggaggcaatgaagttcaaggtgttgctagatgcacagaagaagtccgccgtaggtcttgaaaatgaacccattgttgggcctgctccagctccgaaggcggaaggtcacatcagctatggaggtgcgcttaggcctggagaaggagatgctattgcacaatatgtacaacaaggtaagcgtatccccagaagaggagaagtgggtctttctgcagaagagatccaaaagtttgaaggtctagggtatgtcatgagtggtagtaggcaccaacgcatgaatgccattcgtattagaaaggaaaatcaagtttacagtgcagaggataaacgagcattggccatgttcaactatgaggagaaagcgaaaagagagcataaggtcatgtcagatctgcagcgccttattcagcgacatattgggcaagatgttggcccgactcatgatccttttgcggcaaagcaaccagacgcaccagcagacacctgagtttgaaaggtccaatccaaggtctggttgttacctatgcttcatgcattataatgatggctgtgtttccgtttgggccttgaagccgtggtttctagcaagtaattttaattgactttgtcagaatgaatctttgcctaaggttattgttgtttaagaattgcacacacatgtttgagtagctttcttactgattggtttgtcaaaaaagtaa

SEQ ID NO: 5438 - DNA, 2672 bp, Solanum lycopersicum
aataaatcatacaccttatattttacaatcccgccggccgccttctatcatttacaataacctaattcccaaatgggtaggctttcctccgccgtagaaatcccagacgacaggcatcggagccaccggaacggtgacggcggccggtactcacctcagcggagctcgcactacgacaatcgacgtcgatatcgaagtcctagtcgtagccgtagtcctatcagaaaccgaaaccgaaaccgtagcctgagccgaagtgttagcgggagtcggagtcggagtccggcttatagtccatatagaagccagcaagcgtcacataccaatggacgaagcaaccggcgatcgttttctccagatcgttcttaccgtagaccaagccctacgaatgaacctcctaggagatttggacgggggaagaaaccttaccttgatcgagatcataagagtggaagaactgcagattctgattcggatgaagagcttaaaggtttgagttttgaagagtaccggaggctaaaacgtcagaaattgaggaaacagttgaagaattgtatttggaattgcacaccaagtccacctaggaaagaaaatgagccggaatatgaagaacctgatgaaattgcagaaaaaatcgaagacgagatggtaaagaaggaggatggatccaaaaaggatgtgaagaggtcaaaaactaagtcttccggaagtgagcccgattccgaatccgaatcagatgcatcggattctgactcagaggcttcagattctgaaccgaggaaatctaggaagaggaagaaatccagttctaaacgtaggagtaggagatcgcgaaggaagagtgtgagtgaatcagaggaagagtctactgatgattcatcatccgaagaagaaaggaacaaaagaaggaaaaagtcgaggagaaaagagagtagcaggagacataaaaggggtagtagtagcaggaagaaaagaagcaaaaggaaaagctattcaagtgagagtgagagtaaaagcaagagcgaaagcgaagatggtgaaattgatgattctgatgctagtaagaagcaaaagagtgctttgaagagtaagagaaagaaggaaggggatagtgacataccagagaagagcttggagttgagtgatgacgctggaattaatgagacgaaggctgatgaagcaatgatagatgaagttaatggtgaggtgcttgaatttaaagaactgattgaggcaaggaagaggagtaattttgaagatgaggccccagttggtccaatgcccttgccaagggctgaaggacatatcagctatggtggggcacttaggcctggtgaaggtgatgctattgcccaatatgttcagcaagggaagcgtattccacgtagaggtgaagtgggtctttctgctgacgagatttcgaaattcgagggtcttggctatgtgatgagtggtagtaggcatcaaaggatgaatgctattcgtatcagaaaggaaaaccaagtttacagtgctgaagacaagcgagcgttggctatgtttaactatgaggagaaggctaagcgtgagcagaaggttatggctgatttgcagcgccttgtgcaacgccacattggtcaggatactgaaacttctcacgatccgtttggagggaagtctacagaagcagctgatgattgatccttttgtatgttgtttacttaaattttggtgctattgctgttatgtgtagaaacttgattgtttttctagaaagtggagattgataatatctcgtcattacttttgtgtaagctgataatattatcccattgtcctttgaaatgtagccgagttaccatattttacgtagtagcccctgtccacttcagttcacaagaggttatatcattactgtacaggttcttatgcactactcacccgcccaccactggaaacaccgtttcccatgttccctttttcgacttgcatgtgttaagcatgctgcctttgaacatcatttagttggtgagaatttaggatatattttcttatttttgctttcttgaaattaaaattggctgagtcgtgctcgttgaaccctagttaactttttgctcaagtgtcattctactttagttcattcatgcgtgtattttgctggacttacgagccttgtattatggttctcatctcttatgtgtggactgacatgtgattctaccgtttgattaatttaaatgtgatctagaactcataacatgttattgaatagctgcttgctgttttttagttgttaatgtataagttgcttcttagctggccctaacactataattgttaaaagaggtttcttcttgctttagcacaagttttggtgtattaaactttctgatataagtagtagttgtgctaatctttgcgttgttcatgtattcatagatcaattgcctcattggttgatgcttcatccgttgatatatagttactttgtactttctaaatcagccatctgatcagtcctgttgtgtattcagctatgcagctattcttctgtgccatctttcttgggttgtttgctatttgttcttccaagttaagttagacatatgtaaaatttagcgcagctttgaatatcccgacaaaaatacaatgagatcctcttgttgattttacagcgcttgcactttctc

SEQ ID NO: 5439 - DNA, 2170 bp, Aristolochia fimbriata
ttaataaataataaaatattaataaagctttgaaatgattgttatagctattttgtaataacataagcttttctaacaaaattgaaaacagaggaatgcgatattggagggatattttagaaaattaatatggataaatataaaatgcggtaatggaagaggatcatctattcatctgcagcgcgcatatattgtatagcgtcgagctccctttcccctgtccgatcatgggaagggaagatggggaatacgaaaacggtgattatcggaggtctcggctcgcctcaagggtagagtaccccgatagagatcggcgcgccgactatcgaaacggatctcgtacgccggaaagagggaagcgttcttctcctcgttactcaccttttgatgctgaagacaatcgtcgtcgtcagaatggttacagaaatcactccgtggagatcgaccgccgcagagactatgatgaaggattctcaagtcctagaagaagccctagaagaagccctaggagaagccctgcgcttgaatcacggcgccgccactatgataacagagatggtagggctccatatcttgacaggaacggcggacgacattcggattcggaagatgacgaggaactgaaagggctgacttacgaagaacaccgccggctcaaacgccagaaattgaggagaagcctcaagaattgtgtttggaacgtaactccaagccctccgcaccacgaacgcgggtcattcggtccctctgacgatgaaaaagaagatatagattccccgtccgataatggtaaaaagagtgatatcagagatagaccttctgcatcggaatcagagaggatcttgtcaagtgaaacatcgagatctcaatccgaatctgatactggtcgcactccacccaggaaaacgaagaaagggagaacaatgaggcgaaagaacagaacatcttcacgctcgaggcgatccgatagtagcagtggatcagatgaggaatacagctcttcgaaaagttcaagtgaagaagacgatgcgaaacgcaaaaaaaaacctaaaagaaggcagaggaaaaagagcagccgagatactagaaggagcgctaaacgaagtaggaaggggcggaggggaagaagctcggatgaaagtacgagcacagagactgaaagctcagactactcatctagccaatcatcggattatgaaaaaacaaagaaaaaaaaactttcaactagaagcaagaaaaacaagaatgatagtgagggttcagattcagatgctgatgtggaaactaatgcaaaagtagacgagattaagatacctgaaatcaacactgaagtgctcaagttcaaagaaataattgaactacaaaagaaaccttctttagacaatgaatcatttgttgggcctgtgcctctgccaagggctgagggacatatcagttatggtggtgcacttcgaccaggagagggagacgcaattgcccagtatgtgcaacaagggaagcgtattcctcgtagaggagaggttggtctttcggcagaagagattcagaaatttgagagtcttggttatgtcatgagtggaagtaggcatcagaggatgaatgcaattcgtatccgtaaagaaaaccaggtttacagtgcagaggacaagcgtgcattggctatgtttaattatgaggagaaagcaaagcgtgagcacaaggttatggctgacctacagaaactggtgcaacgccacattgggcaagatgtaggacctacacatgatccctttgggaccaaaggatctgatactgctgatacatagatttgagcagtatgttttcttaggtacgagctatgtgtttttgttctacttcgtggatgatgataacctgttctttatctatgttatcgttttgccgggtgcaaattttaaacactatatgtgaccatgatgtgttgcgtgtgaaatattggcagaaccaaattgttatggtctcttttgattcctgtaaaaaatgttgcttagtagttcatctctgctcatggaacattaatctttggtgttttcctatctgtctaaactttgatgtggctcgccctccttgtttgtgttgctgttattgtgctgccctaagtcttgcaccttttatttactaaactcttctatgtccattttgtgatttgaac

SEQ ID NO: 5440 - DNA, 1169 bp, Cichorium intybus
cggggagagcagagttcagttctaggcgtaggcgtagaagcaggaaatcagtatctgtgactgagagtgagtcaacgaatcctctgatgattctgaagaggaagacaggaggaagaagaagaagccaaagaggaaatccaccaaacgaaagagtagcagcaggagacattctaagaggaagagaagaagcacttcaagaaaaagtaaagacagtgattctgaagaaagcagcgagagtaatgaaggcgaaagatcattgaagtccaagaaaagaagcgaaaagggcagtgagaattcagcatcagacaagaacacagattctgaagatgatcatagaagcaaaccgcaggtggatgatacagagaaaacagaagtggacagtgagttgatcttattcaaagaaatgattgaatcacgaaagaaggccaccatagatgatgatgaaccagaggtaggtccaatgccattgccaagagctgaaggtcatatcagctatggaggtgcactcaggcctggtgaaggtgatgcaattgcacaatatgtccaacaagggaaacgtatccctcgaagaggagaagttggtctttctgctgaagagattagcaagtttgaggatcttggttatgttatgagtggtagtaggcatcaaaggatgaatgctattcgtattaggaaagaaaatcaagtttatagtgctgaagataagcgggctttagccatgtttaactatgaagaaaaggcaaaacgtgaacagaaagttatggctgatttgcaacggttggtgcaacgtcatattggacaagatactggaccttctcatgatccttttggtggacgagttacagaggatcctgatgcttgatcattcacagagtatgattttttttatgctataagatattttgaaccatgttctcttattgatgattctctctgttctgcggattcatgatggaaactgttacactgcaactggtaccttaggttttacttgattatctgctttggttgggcatgagatataaacactacaatgtatgaagtaaagtgccttagcagttttacctgattttatgtttgtcactcaaccaaaccaagttttaacccttttatcaccaccatggactaagtcattgttgactaattggactactttccacatctaaaaa

SEQ ID NO: 5441 - DNA, 427 bp, Festuca arundinacea
gaggcccggtgaaggtgatgctattgcacagtatgtacagcaggggaagcgtatcccacggcgtggtgaggttggtctttctgcagatgagattcagaagttcgaagatttggggtatgtgatgagtgggagtaggcaccagaggatgaatgctatccgtataaggaaggaaaaccaggtttatagtgcagaggataagagggcgctggccatgtttaactacgaggagaagtccaagagagagcacaaagttatggctgatttgcagcgcttggtttcgagaaccattggcgaggagacagggccttcacatgatccatttgctgctacagatgactgagtaattatttctcgctattttacaaagaaaatggttgctgctattagttatgcatgtttttcctcctgctcctgtagtacctgcccg

SEQ ID NO: 5442 - DNA, 736 bp, Nicotiana benthamiana
  misc_feature (391)..(391): n is a, c, g, or t
  misc_feature (614)..(614): n is a, c, g, or t
gatgattctgatgcttgtaagaagcaaaagcactctttgaagagtaagaaaaataacgatgatggggatagtgacataccagaaaaaagcttggaattggatagggaagctggaattaatgagaaggcggatgaaccaaagatagatgaagttgataatgagttacttgaattcaaagaactgattgaggcaagaaaaaagagtaatttggataatgagccgcaagttggtccaatgccattgccaagggctgaagggcatataagctatggtggggcacttaggcctggtgaaggtgatgctattgcccaatatgttcagcaagggaagcgtattccgcgaagaggtgaagtgggtctttcagctgatgagatttcaaaattcgagggtnttggctatgtgatgagtggtagtaggcatcaaaggatgaatgctattcgtattaggaaggaaaaccaagtttacagcgctgaagacaagcgagccttggccatgtttaactatgaggagaaggctaagcgtgagcagaaggttatggctgatttgcagcgccttgtgcaacgccatattggtcaggacactggtccatctcatgatccgtttggagggaagtntgaagagggggctgatgcttgatccttttgtgtgttgttttactttaattttggtgttactgctgttacatgtagaaattatattgtttaatagaaaatggagacataacagttttatgtgt

SEQ ID NO: 5443 - DNA, 1819 bp, Solanum tuberosum
gacaataaatcatacaccttatattttacaatcccgccggccgccttctttcatttacaataccctaattcccaaatgggtaggctttcctccgccgtagaaatccccgacgacaggcatcggagccaccgggacggtgacggcggccggtactcacctcaacggagctcgcactacgacaatcgacgccgctatcgaagtcctagtcgtagccgtagtcctgtcagaaaccgaaaccgtagcctgagccgaagtgttagcggtagccggagtcggagtcggagtccggtttatagtccatatagagtccagcaagcgtcacatactaatggacgaaacaaccggcgatcgttttctccagatcgttcgtaccggagaccaagccctacgaatgaacctcctaggagatttggacgggggaagaaaccataccttgatcgagatcataagagtggaagaactgcagattctgattcggatgaagagcttaaaggcttgagttttgaagagtaccggaggctaaaacgtcagaaattgaggaaacagttgaagaattgtatttggaattgcacaccaagtccacctaggaaagaaaatgagccggaatatgaagaacctgatgaaattgcagaaaaaatcgaagacgagatggtaaagaaggaggatggatccaaaaaggatgtgaagaagtcaaaaactatgtcttctggaagtgaatccaattccaaatatgaatcagatgcatcagattccgactcagaggcttcagattctgaaccgagaaaatctaggaagaggaagaaatccagctctagacgcaggagtaggagatcgagaaggaaaagtgtgagtgaatcggaggaagagtctactgatgattcatcagaagaagaagaaaggaacaaaagaaggaaaaagtcgaagagaaaagagagtagcgggagacataaaaggggtagtagtagcaggaagaaaagaagcaaaaagaaaagctattcaagtgagagtgagagtaaaagcaagagcgaaagcgaagatggtgaaattgatgattctgatgctagtaagaagcaaaagagtgctttgaagagtaagaaaaagaaggaagaggatagtgacataccagaaaagagcttggagttgaatgatgatgctggaattaatgagatgaaggctgatgaagcaatgattgatgaagttaatggtgaggtgcttgaatttaaagaactgattgaggcaaggaagaggagtaattttgaagatgaggccccagttggtccaatgcccttgccaagggctgaagggcatatcagctatggtggggcacttaggcctggtgaaggtgatgctattgcccagtatgttcagcaagggaagcgtattccacgtagaggtgaagtgggtctttctgctgatgagatttcgaaattcgagggtcttggctatgtgatgagtggtagtaggcatcagaggatgaatgctattcgtatcagaaaggaaaaccaagtttacagtgctgaagacaagcgagcgttggccatgtttaactacgaggagaaggctaagcgtgagcagaaggttatggctgatttgcagcgccttgtgcaacgccacattggtcaggatactgaaacttctcacgatccgtttggagggaagtctacagaggcggctgatgattgatccttttgtatgttgtttacttaaattttggtgttattgctgttatgtgtagaaacttgattgtttatctagaaagtggagatgctaataacttgtcgttacttatgtgtaagctgataatatttggattttactg

SEQ ID NO: 5444 - DNA, 1122 bp, Pseudotsuga menziesii
aaagcttctgaagacagcggaaagaaagcgaggggatttaatgaagaaaaacggcgggcgtaggaaatcttctactcctactactggaagtgattattctgagtcatctgatgatgacaggtcaagaagggacattaagggtggtaggtccagtaggaagagaaagaggaaaacaaagcattctggcaagagcaggaagaggagatctattagcgtgaaagaatatagcgaggatgatagtgatagtgtatcagaggatgactcgtcctcgtactccagtgagaatgaaaagtcgaagaagcaaacaaatcgacgaaggaacagagatgaaaagcaaaagaaatcggagaagagaatgtctggatctaaaagatcacgggttaaaagttctgaagatgaagagaagtctgaaacccattctgagagtcatgtctcatcggatgattctttagaacttgaatctatcaagcacgaggagagagcagctgacaatgaccctgtggaaatagacaatgaagctctcaggttcaaagagatgattgaatctcagaaaagagtagcagcaggacttgagaatgaaccgattgtggggccacttccacttccaaaagcagaagggcacataagctatggaggagcacttcggccaggagaaggtgatgcaattgcacaatacgtccaacaaggaaagcgtattcctcgaagaggagaagtcgggctttctgccgatgagattcaaaagtttgagaccctgggctatgtcatgagtggaagcaggcatcaacgaatgaatgctattcgtataagaaaagaaaaccaagtgtacagtgccgaggacaaacgagcattggcaatgttcaattatgaggagaagtcaaaacgtgaacacaaggtcatgtcagatcttcagcgcttggtacagaggcacattgggcaagaagttgctcctacacatgatccttttgcaagcaaggaacccgaagtggcagatggataggataggtttcttatgagtttgtcatgatcgttactatattcttttgtaattccatcggtttattatattaaatgtgatttgctaagctgtgtattttgcacgaggacaacaattacaatgtcttt

SEQ ID NO: 5445 - DNA, 1927 bp, Triphysaria pusilla
gaaataccgccattacggacggagatcattattcggaccctctgaaatccccaaatgggcagaatctcctcagccgtagaaatcccctaccgacgccgtacctccagccaccaccgcgacaacgaccgctattcccccgagcctcgtagaagctacaatcgccgcgaacgcagctacagccgcagccgtagccccatccgccgccgcaccctcagccggagccgcagtagaagccctattaacaacggccacaacaggtaccgccgttattctcctgattactcataccctaatcccgctgaaactcaaagacccagcgatagaaataaactcaattacgataaccggaaaacaccctatctcgatcgagaccacctgaacggtcggtttcccgagcctgagtccaatgaagagctgaaaagcctaccttacgaagagtaccgcaggctcaagcgtcagaaatttagaaagttgctcagatattgtatatggagttgcagccctagccctcctagggctccgaatgagaaatctgatgtcgagattgaggaggactttcaagtggaagaagaaaacgagattagggtttcaaggcctgatgcgaaaaaatcgccggacagtaaatctaagtcggattctgaatctgaatcagaatcagaatcaggagattctagttctaagaaaggtagaaaatctcgttccaggcgtaggagtaagagatcaaaatctgtttccgagagcgagagtgaatctgatacgagtgatagtgattcagaggaagataggaggagaaggagaaagagtagcaagaagaagagaaagagtagcaagaaaagtggccggagaaagaaaagcaataggaaaaagcacttgtcgagcgaaagtgagggttctgatcgtgtgaattcgaaagctcgttctgattcggaacctgacgacaatacagcagaggatgtcgttgcgctgcccgaggccgacgaggtcatgataaatggtgaaatgaacgaagaattgctcatgtttaaagaaatgatagagcaacggaaaacccatgctctggacgaggagcctccggtcggcccgatgcctctgccgagggccgagggacatatcagctacggtggtgcgcttaggcccggtgagggtgatgctattgcgcagtatgttcagcaaggcaaacgtatcccacgtagaggtgaagtaggcctttccgctgaggagatttcaaatttcgagacgctcgggtatgtgatgagcggtagtaggcatcagaggatgaatgcaatccgtattaggaaggagaaccaggtttacagtgcggaggataaacgagctttggcaatgtttaactatgaggagaaggcgaagcgggagcagaaggttatggctgatttgcagcggttggtacagcgacatattgggcaggatacgggtccctcacatgacccgtttggtggacgggcgggcgagggaggcgatgattgatttttctcgcacactctgtgttgctgctgctttgtgcgctattcaattcttttttagagttgaagcaactatgtagttgatatgttcttgttgtaatgacttctagtctgaagttgtttcaagatgcatgcctatgtacattgagcttattttattcctgctgttcagtttaaattgaaactatattttctttcaaaggtgaatacaacaatcatgattgctatggatgaattaattgcagaaacaaaatgtgttagatcatagatgagatatgaggtagctagtgtggagctactgtatattttaaatgcaagtggttattttgaatattgtgatcattaatcggtaacgatgagtgccaatgagatattttctagtgaagatatattgatcagatggcatttagacacagataaataagaaaggcgttgcaagaggtggt

SEQ ID NO: 5446 - DNA, 567 bp, Juglans hindsii x Juglans regia
gcaacgatggttgaaatcgatgcggaggcattgaggtttaaggaaatgattgacgcgcagaagaagctaccggctttggataacgaaccggtggttgggccaatgcctttaccgagagctgaagggcatattagttatggtggtgcacttagacccggtgagggtgatgccattgcacagtatgtgcagcaagggaagcgtatcccgcgtagaggtgaagtgggtctatcagcagaggagattcagaagtttgagggtcttgggtatgtcatgagtggtagcaggcaccagaggatgaatgccattcgtattaggaaggaaaaccaagtttatagtgccgaggacaagagggcgttggccatgtttaactacgaagagaaggcgaagcgtgaacacaaggttatggccgatttacagcggttagtgcagcgccacattgggcaggatgttggtccgactcatgatccctttggtggaaaggcctcagatgatcctgatgcttgattttgcgtttgtgattggtaaccaaactatttttctcgcagttacttatttatattttcttac

SEQ ID NO: 5447 - DNA, 1574 bp, Triticum aestivum
gaagcgtcgaatccgggctcgaccacgcgtcgcccaagccccttccgcgaacgccgccgcgacggtccccaagccccttccgcgaccgccgccgccagtggtcgccctaccataatgagcgcggccgggacatggaccgggttcgggacgtggagcccccggcgcgccgtggcggcggtggaggaggcgaatggtccgcctccgacgacgacgacgaggatctcaagggcctcacctacttcgagtaccgccgcgtcaagcgccagaagctccgcaaaagcctgaagaagtgcatctggaaagtcacgcccagccctcctcgccgtgacgacgaggccgacgagtaccagtacagcgaggaggaggaggagaagaaggaatcgccgaagaaggaatcatctgagaagagcgatgaggagaacaaggattcgtcggaatctgagaccgatgagtctggtagcttatctgattccagtgaatcagattattctaggaagaaaaagaaagggcgtaaggacagacgttctagcagcaagcgtagccgacgtgcacatcgtcgccacaggaagtctgatgtggagagtgagagtgatagcaaggttgatgaggattcagagggttccgatgactctgaagattctagggataagagaaggagcaagagatcgcggaggcacaagaagtctaagaggaggggacggagctctaggaggaagaagagtaagagtctggatgtaccgtctgatgttagctccgaggaggtggaggtgttagtctctagccctatctcaacggacagcaagaaaatgggcaagagctcaaggaagaagagtagcagtcagtctgattctgaagattcgatcccttctgatgccatcattgatgaaaaggaaattgaagagacagatgagcctgagattgacccagaggcaattaagttcaaggaaatgcttgaggcccagaagaaggctgcactggagaatgagatgccggttggaccgatgccactcccgcgtgcagatggtcatattagctatggtggtgcactgagacctggtgaaggtgatgccattgcacagtatgtacagcaggggaagcgtatcccacggcgtggtgaggttggtctgtctgcagatgagattcagaagttcgaagatttggggtatgtgatgagtggaagcaggcaccagaggatgaatgctatccgtataaggaaggaaaaccaggtttatagtgcagaggataagagagcactggccatgtttaactacgaggagaagtcaaagagagagcacaaggttatggctgatttgcagcgcttggtttcaagaaccattggccaagagacaggaccttcgcatgatccatttgctgctacagatgactgagtaattatttctagctattttacaaagaaatggttgccactattagttatgcatgtttttcctgtagtactagtgatgtcgagtttgcatttgtaacttctgttttgtgtcctgtacttagcttatgcttatcagatattactcttttgttctatatgtgttcatgattgttgtcatgtttgtcaa

SEQ ID NO: 5448 - DNA, 1635 bp, Malus domestica
atgtttccaaaacggaaatttcattaccgaacctcttcaaagtctctgatggggaggccatcatccaccatccacatccccgacagacgacgccgttccgatcacgagaacgggcgatacccgcggcactccgactcctccggcgacaaccgctaccagcgtcgcagccccagctacgaaagctacgacaatcgcggccaccgaaacccatcgggctcgccacccagacgaagccctaggggcaacagaggaggcccagactctttggcccggcgtcggagccccagctatgaggactacgaccgacgcacccaccgaaatcggtcgggcacgcctgattacccaaaccctagaagaagccctagggctaatggggggccggactctttgccgaagaaattcgggcggggagggaatatggaccgggggaggcggtcagagtcggaggagtccgatgacgagctgaaggggctgagcttcgaggaatacagaaggctcaagcggcagaagatgaggaaatcagggaagttttgtatttgggaattgacgcccagcccgcctaggtttgagaacgatgagttcgaattggtgggcaaggctgatgagattctggaacggtatggcgaggaggagaagatggaaccgaaggacaagaagaatgagaaggagaaatctgagtccgaatctgaatcggatttggaatcggaggatttgaggtcgagggggaggaagaagagttcgggttcaaagcgtaggagtaggaaatcgaagtatagtgacagcgaatcggagagcgagagcgagagcgaaagcgactatgaatcggatgaagaggaggatcggagacggagaaagaagtcaaaaagtaggagtaagagaagcaggagcagaagagaaaggagaagaaagaggaagagcaggcatggtagcagtagcgagtccgatgagagcgaagacagtgaaagtgagggttcagatttaaagaagaagaagaaacagcgaaagtctcgcagtcggaataagaagaaagagtcggaaactgaaatggagagtgagaaatcggattcggaggagaagggtttggattctgaggttgatgccaaggctgctgctttagtggaagaggaggtgatgaaggatgagagtaatgcggaggcattgaagtttaaggagattttcgaagctcagaagatgctgtcactggacgatgaaccagtggttgggccaatgccgttgcctagagctgaagggcatattagttatggtggggctcttaggcctggtgaaggtgatgccattgcacaatatgttcagcaggggaagcgtattccgcggagaggagaagtgggtctttcggctgatgagattcagaagtttgagaaccttgggtacgtaatgagtggtagtaggcaccagagaatgaatgccattcgtattaggaaggaaaaccaggtttacagtgctgaggataagcgggctttggccatgttcaactacgaggagaaggcgaagcgtgagcacaaggttatggcggatttgcagcgactggttcagcgccatatcgggcaggatgtcgggcctactcacgacccattttcggggaaggaaaaagagattgaatttgctgatacttag

SEQ ID NO: 5449 - DNA, 439 bp, Brassica juncea
cgcggggggaaacgtatcccgcgtagaggagaagtgggtcttaacgctgatgagatccagaggtttgaggatcttgggtatgtgatgagtgggagtaggcatcaaaggatgaattctattcgtatcagaaaggagaaccaggtttacagtgctgaggacaaacgtgccttggctatgtttaactatgaggagaaggccaagcgcgaggctaaggttatgtctgacctttccaggcttgtgcagcgccatatgggacaagacttgggacccaatcatgacccttttggtgctggaaagactgatccacctgatgattgatttcctttgctttcttttcttctgctgcttatgtggctacttatcttatgctttttgttcttgtaaactcttccttattgcatcatagttttttttcctgaacacaaatattgcatcttag

SEQ ID NO: 5450 - DNA, 1924 bp, Amorphophallus konjac
accctaaccctagccgctcccgaagccccctcgacgaccccaggcgcccctccaatggctactccacctacgattgccgccgatccaagagtccccttgacgagccgaggcaccactccaatggccaccccaccttcgaccgccgccgggcgtccaggagccccgaatccctcgtcccgacctccttccgcggccgcgggggcggggagagccgtggcgaccggtacgggcggcgggggtcctatctcgacagggacgcccgcggcggcggcggccgtcggtcgggttctgatgactccgatgacgaggagctgaaggggctggagtaccacgagtaccgccggcttaagcgccagaagctgcggaaaaagctgaagaactgcatctggcgcgtcacgcccagccctccgccgggcgagtggcagccgccgtcggacgcggaggcggaaccggagacgaaggaggaggagaagaaggctggcggcgccggcggcggtagatcggatggttcagaggggagtccctccaaggattcggactctggatctggctctggttctgaatcggagggcgatggttctccaaagaggagcagagacaggaggagcaggagcaggaggcatcggggaaagagaagtagagggacgaagtcttcgtctcgtaggggtaggcgcaggggcagaagtggcgacgagagatcggatgaggactccagcggggagtctgagagttcctacggctccgcaagcgatgaggaggagagaaaaaggcggaagcggaggtcgtcagacaaagggcgaagcagaaagtcgagaaagagttcaaataagaacggcaagcggcggcggagcaggagctctagtctggatgagagtgaagaatctgaggctagccatttttcggatatgtccgacgagccaaagaggcggaaacattcaaagaacagcaagaagaggaagcgcactgagtctgaagcctccgattccgacggggaggcgcgccaggacgatgtgaagatgccagagatcgatcctgaagcactcatgtttaaggaaatgatcgagtcccagaagaaacagatgttggaaaatgagccctttgttgggcctgccccccttctcgggcggaagggcacatacgatatggtggtgctctcaggcctggtgagggagatgctattgcccagtacgtgcagcaggggaagcgtatcccccgaagaggagaagtcggcttgtctgctgaagaaattcagaagtttgagaacttggggtacgtgatgagtggtagcaggcatcagaggatgaatgccattcgtatcaggaaagaaaaccaagtttacagtgctgaggacaagagggcccttgcgatgtttaattatgaagagaaggccaagcgggagcagaaggtcatggcagacctccaacgtttggtgcaacgacatattgggcaggatgtcagtcctacgcatgatcctttcgcagcaaagccttcagatgcgggtgatgcatgaagatctcattgaggttgtgcccaattgcatgcgttttgtgccgtcgcatcacaaaatgatcataaggtcagctggatagtagtattaattttggtattctctgttaatgatccttgatgcataaaaagaacaggtgtatgtggtctttgtaattttgatactccaggttaattatcttggatgcataagaagaacaattgtatgtggttttgtaacgccctaggcatcccttggaatgacattctatgttaatggtccttgtaatgttcttggcattccatgaaatgaatgtgaatggcatttattcaactaggttttcaagagttccaattcctgatttactgtattgaaggtaaatcatatcagaatgaatgggtgttagtataatatattttattattttttattgtcatg

SEQ ID NO: 5451 - DNA, 2056 bp, Eucalyptus grandis
caatcgccgacgatgggaggtccatactccggcgccgtctctggccgccgggaccgctaccacggcgaggacggccgccgccgccacagccccgaatcggatcgccccgccgagtaccgccgccgccgcagcccctcatacgagtccttcgaccgccgcgacgaccgccgcggccgcgagcccgatcgccgcgaccgccgcggccgcagccccagcctcagcccctcgtacgacgatcgctacgacgaccgccgcgacggctcgggccagcggcgccgacggggttcgccccgcgcctcggactccaggaggagccctagggccgacggagccctagattcgttgcccaggcaattcgggaagaagcggccttacctcgatcgcgattatcggggcaacggtaggttctcggagtcggactccgatgaggagctgaaggggctgagtacggaggagtacaggaggctgaagaggcagaagatgaggaaagccatgaagttctgtatctggaattgcaccccgagcccaccgcggtacgagggggatgaaatggaggagaaagcggaggagattgatgagaagtacggggaagatttggagaagagcgactcgagcgggaaagaggatggaaaagcgaaggggaaaggaaaatctaagtccgatagcgaggagtcgagcgacggtggggcggacagcgagtcggagccgagtgcttctggttcgaggaagaagaagaggagttcaagttctaagcgcaggagcagggaattgtctggaactgagagcgaatctgagagcgagagggagagtgagtctgatgatcctgcatcgaagaagaagaagaagggtaagagttcgtctttcgtaaagggaagagtgggaaagtgcgtgataccgagagtgaattggagaaccaaagtgaatcggaggattcctcttcgaggaggaggaagaggaggtcgagttctaaaaggaggagcaagagagagcgcgatagcgagagtggatcggaggtcgagagcgagaaagaatcagatgaggaagaggatcaaaaagggaagaaaagatccaggaaacggtctagtaggcggacaaggagtgggagaagaagtagcaggcgacgaagcagtaggaaaagcaagaggagatatagtgaatctgatgatagcgagggtgaagatagcgaagctgaggattctgatgtcaaaccaaagaaggacaagggctcatcaagattgggcaagaaaagtcgcagtcagagtaagagtggtcttgaggatgatagcgatgtttcgaattcgagcgagagaccacaatctgagcctgatctgaatggtttagacagtgaggtcaaggctgagatcgatgcagaagcactcatgttcaaggagatgatcgagtcccagaagaagccagccttggataacgagccagtggttggtcccatgccgctgccaagagctgaggggcacattagttatggtggggctcttaggcctggtgaaggtgatgctattgcgcagtatgttcagcaagggaagcgtatcccgcggagaggtgaagtcggtctttctgcagaggagattcagaagtttgagggtcttgggtatgtgatgagtggtagcaggcatcagaggatgaatgccatccgtattaggaaagaaaaccaggtttatagcgctgaggacaagcgtgctttggccatgttcaactatgaagagaaggcgaagcgtgagcataaggtcatggctgatttgcagcggttggtgcagcgtcatattgggcaggatattggccctactcatgatccttttgctggaaaagctgctgatggtcctgaggcttgataaacatgtatgttcatgttttcttcttatttcatgtctaaattatgtgatgccctcattagtgtagtgtgtgcccaactctgttggcattctggtcaggtggactcatctttgtgtgttatgtagttgaggcatatctagtacctctcctttgatgctcttattatattgaaataaatgctataagggaatattatttttctttggaa

SEQ ID NO: 5452 - DNA, 1647 bp, Phalaenopsis aphrodite
gttgtttttcctaataatacctagacgaagggatcaccggcaagccgtcctcgctgctcgatgggtcgggaaaattccagggtttctcccgctcctgcacgccacgccgctgacgactggcgctcccgccggaatccaatttccgagacttctcctcgccgccgacggagatggtcaccgtatcacgatcggccgatctctcggcggtccgaaaattcctccgaggaagaggacctgaaaggcctaagctatttcgaatatcgtcggatcaaacgccagcgtctcaggaaaaagcttaagaactgtatatggaaggtcacgcctagccctccaggtagcgatagggagctgtcggagccaccgcaggaagagcccgaacggagcgctgatcttccgtcagatgatgataagaggaagatgaaggagtctggatctgaaggttctgatggtagcggccgttcttctggcgattctgggtccggttctgagagtcctcatcgaaaaagccggagtaggagaagtggaaggacctcgaagaggcgaaggtactcagtttcaagtgatagtgctagtgaaactgatagcgatgcttcatctgattttgattcaaggagttattctgattacttgagcgattcagatgatcaatcgaggcggaggaaaaggagttcagcgaagcgaagagggaggggaacggaaagcgtgcattctagaaacaataggaaacgatcgtctagaagtagtaggaagaagaaaagaaaggaagtaacatcggattacagtgatagttctgactctgagtctagtccttctgctaggaagaagaggaccacaacttcaaagaagaagacgataaataggcagtctaaattggagaacatgtttgaatcggatggtaacgtcggagctcctgatgctaacaaacctgagattgatcccgaagcagtgaaattcatggagatgattgaactccagaagaaacaggccttggacagtgagtcgcttgttgggcctatgccacttccacgtgcagaaggtcacataagctatggaggggctctgcggccaggagaaggagatgccatagcccagtatgtacagcaaggcaagcgtattcctaggagaggagaggttggtctttctgctgaagagattcagaaatttgaaaacttgggctatgtgatgagtggaagcagacaccagaggatgaatgctatccgtataaggaaggaaaaccaagtatacagcgctgaggataaaagggcactggctatgttcaattatgaggagaaggccaagcgggagcacaaggttatggctgacctgcaaaggttggtgcagaggcatattgggccggacatgggtcctacgcatgatcctttcgctcctaaggccttagagggtgatgatgcttgaacttgtttccaggatatatattttttaaattatattgattatgtaggatgtaacctctgattactgctttctttagagttgtaatctaattatgccactggatattggtaggaacaaatctttttcaaacaaattcggatatgtggagaaacaacttagcaaattcttggtttgaatatatatttattacctgtattatccatttatccaggttattagttttcttgttat

SEQ ID NO: 5453 - DNA, 826 bp, Silene vulgaris
agcgagggtgagaggaagaggaagaggaataagaagaagaaggtggttcgagaatcgagtgaggatggtagtggtagtgatagtggtaaagcgaagagcgagttggatattgatgagacgggtttgaagattgttgagacgggtaatgtggatgatgatgagattaatcctgaggtgttgaagtttaaggtaatgttggaagctcagaaaatggaggctgccatggtgaatgagccgattgtgggcccacaacccttgccaaaggcagaagggcatattagctatggtggtgcgcttaggccgggtgaaggtgatgctattgcgcaatatgtgcagcaagggaagcgtatcccacgtcgtggagaagtgggtctttcagctgatgaaatttcgaaatttgaggatcttggttatgtgatgagtggtagtaggcatcaaaggatgaatgccattcgtattaggaaggaaaaccaggtttatagtgctgaggataagagagctcttgcaatgtataactttgaagaaaaggctaagcgcgagggtaaagttatgactgatcttaagagacttgtgcaacgtactattggtcaggatgtcgctcctaatcacgacccttttggtgctaaagatgagggcgatgtggaaccgtagtgttttctttttggtttttgttttcgcaatactatggctatgttttgtcaacaactgattttttacaaaattcagcatacaactttatggtcgatgttcttcatgtaatgtgcactttggaagcttatattgtaagttcttggttttgatctccacatatcttcgtttattgtag

SEQ ID NO: 5454 - DNA, 762 bp, Sorghum bicolor
cgatctgattccgaagaatcagtcccttctgatgccacccctgttgatgcaaaagaaattgaagaaacaatagttccagaaattgatccagaagcaatcaagttcaaggaaatgcttgaggcccagaagaaggctgccttagagaatgatatgcctgttggtccaatgccacttccgcgcgcggaagggcatattagttatggtggtgcattgaggcctggagaaggtgatgctattgcacagtatgttcagcaagggaagcgtatcccacgacgtggtgaagttggtctgtctgcagaagaaattcagaagtttgaggatttggggtatgtgatgagtggcagtaggcaccaaaggatgaatgctatccgtatcaggaaggaaaaccaggtttacagtgctgaggataagagggcgttggccatgtttaactacgaggagaagtcgaagcgggagcacaaggttatggctgatttgcagcgcttggtgcagagaaccattggccacgatgtgggaccttcgcatgatccatttgctactacggatggttgagtaatgatttctggatcaataatcaactatatcgtgtgtgctttacctgtttgtgtttccttctctctgttgtaattagtgatgttgaacttgcctagttatgctgcaaatttcttatgagatattgcatgagaaccaaatttaaaaggagcgtactgttagcttgtatcttgtcttggtagtatttttgttatgatggttcaatgtgct

SEQ ID NO: 5455 - DNA, 1979 bp, Tabernaemontana elegans
gggattatagacgctactctccagagccctatcgttctgaggatttccgccgtcgaaatcgcagtctcagccggagccctagcctaagccgcagtcgcagcagaagttttagccggagcaggagtcgcagccctatctacaatgggtattcaaggtatgaccaccgtgaccgacgaccctcccctgattattcatatcctagacggagccctaagtccgaccgcgggtacggtgaccggaagaaaccattccttgatcgtgactacagaaataatcgtcacacagggtcggaatccgatgaagagcttaaaggcttgaactttgaggagtaccggaggctcaaacgccagaaactgagaaagatgctcaaggattgcatttggaattgtacgcctagtcctcccagggatccaaacgaaccggaggatcaagcgtttgaggaggatctcgtggggaagggcgatgaacaagacgagacccgcgataaagagaagaagaaagatcaaatgtccaagtctgatatcagaagcccctcagagagtggaagcgaacctgactcagagtctaccgaggtttctgactctgaatcggatcattcaggatcaaggaagaagaggaaaagcaggaaatcgagttctaggcgtggaaagagaagatcaaagtctgtatctgagagcgaaagcgagtccgacgaattgagtgaggattcagaagatgatttaggatcgaggaagaagaagaaaagcagggtatcgagttctaggcgtggaaagagaagatcaaagtctgtatctgagactgaaagtgagtccgacgaattgagtgaggattcagaagaagacaggaaagcacgacggaggaagtctaggaaaaagggaagcaggcaaagcaggagcagtaggagcagcagtaagaggaaaaggaatagtagacagaaggcttattctgatgaaagtgaaagcaaagatgagaatgaaagtgacgattctgaggctaatcggtcttcagatgatcgtgcaaagacaaaaaggccgaagcattcacgttcaaagcacagcaaaaagagggaatcagagacagacagcgaggtttcctactcaggcagaagctctggttctccagatgatgagcataaacagaaggtgacggaggaagcacaaataagtgacgtcaatagcgaggttcttaaattcaaagagcttctcgaggctcggaagaaagctactttagaaaacgagcctgcagttgggccaatgccattaccaagggctgaaggacatattagttatggtggggctcttaggcccggagaaggagatgcaattgcgcagtacgttcagcaaggcaagcgtatcccacgaagaggagaagtgggtttgtctgctgaggagattcagaagtttgagggtcttggttatgtgatgagtggtagcaggcatcaaagaatgaatgccattcgtatcaggaaagaaaaccaggtctacagtgctgaggacaagcgtgctttggcaatgtttaattatgaggagaaggccaagcgtgaacagaaggttatggctgatctgcagcggcttgtacaacgccatattggccaggattctggtccttcccacgatccttttggtggaagatcttccgaggggcctgaagcctgatttgaatggattcaaggtgtctggaacatttaagaacaaattgcttattgcttggagctaagtaaaactgtaacctgttgagatctcaacagctggctttcggtacatgaaagtgattgcctttgcgagttagaactaaagaagatgctaaggtccaatgagttggtaaagatgctaaaagagtgatgttatggggcctgcagaactatattattaaattgcggtttagaactggtatccattaagaactgggactagggatgctgctgctatgtatgaattgtgctgatatcagacattatctcacatatcaataattttttt

SEQ ID NO: 5456 - DNA, 1563 bp, Valeriana officinalis
gaaatcatggcgagaagaatttcctccattgtccaagctccggaaaacagaagtcggagctcgagagacaaccgacgcaattcacctgattatgcaccatacgaggatcgccgtcgcatcacttctcgtgactctcgtcggagttatagccggagccgtagtccggtcaacaaccagaaaaggtacgatcactctccagtttatcgcaattcacgttcacctgattacagtaatcgtagaagaagccctagatctgataacctaagatccgaacgaaggtcgaattacgtagaaccaaaaaagacctatttagaccgtgactttaggaatggagatggtccagcttcggagtctgatgaagagttgaaaggattgagctttgaagactatagatggcagaaacggcagaagatgaggaaggttttgaggaattgtatatggaatgttacacctagtcctcctaggaatgatgatgagcttattgattataatgataaggattctagtgatgaggagaaggagaaagaggctaggttgaaactagaatctagtaaagttgtgagtggttcagagtctgacaaatctgaacctgattctgaatcggagttggatgattctgatcgtcgatcacggagaaagaggaagagtaagaggaaaagttcgagttctaagcgtagaagtaagaaatcagtaactgatagcgagggtgaatctgacgatgaatcgagtgatgatgatgatgatacttctagaagacgtaagaggaggtcgagtaagacaaaaagccgacgaagtaagaagagtagtaagaagagtagtagaaggaagagaattaaagactcgtcttctgataaaagcagcgaagacgacgaagaatctgaagaagaagcatcgaaattaaagagaattaaaggtgggtcatcgtcagaatcaagaaagcgaaagaagagaagagactcggtcagtaagagtccatctaaagacgaaaaatcagattcagaacctgaaacaaaaatcataccacatattgacgagccagagagcaacgaagtggatgatgaactaatcatgttcaaagagatgctcgagtctagaaagaaactcgcattggaaactgaacaagtagtgggacccatgccattaccgagagccgaaggacatattagttacggtggagccctcaggccaggtgaaggtgatgcaatagcacaatacgtacagcaaggaaagcgtattccacgaagaggagaagtgggtttatccgcagaagagatttcaaaattcgaaacgttagggtatgttatgagtggaagtaggcatcaaagaatgaacgctattcgtataaggaaagaaaaccaggtttatagtgctgaagataagagggctttagccatgttcaattacgaagaaaaagctaaaagagaacagaaagttatggccgatttgcagaggcttgttcagcgtcatatcggtcaagatactggtccttctcatgatccgtttggtggaagatcaactgccgccgaacctgcagatccttaaaattttcatgtaagtttttcc

SEQ ID NO: 5457 - DNA, 1396 bp, Hordeum vulgare
cggtgggggaggcgaatggtccgcctccgacgacgacgacgaggatctcaagggcctcacctacttcgagtaccgccgcgtcaagcgccagaagctccgcaaaagcctgaagaagtgcatctggaaagtcactcccagccctcctcgccgtgacgacgaggccgacgagtaccagtacagcgaggaggaggaggagaagaaggaatcgcccaagaaggactcgtctgacaagagcgatgaggagaagaataaggattcgtcggaatctgagtccgatgcgtctggtagcttatctgattccagtgaatcagattattctaggaagaaaaagaaagggcgtaagggcagacgttctagcagcaagcgtagccggcgtgcccatcgtcgccacaggaagtctgatatggagagtgagagtgacagcaaggatgaggattcagagggttcctatgactctgaagattctagggataagaagaggagtaagagatcttggaggcacaagaagtctaagaggaggggacggagctctaagaggaagaagagtaagagtttggatgttccatctgatgctagctctgaggaggtggaggttgtaggctctagccctatctcaacggacagcaagaaaacgggcaagagctcaaggaagaagagtagcagtcagtctgattctgaagattcgatcccttctgatgccatcattgatgaaaaggaaattgaagagacagatgagccagagattgacccagaggcaattaagttcaaggaaatgcttgaggctcagaagaaggctgcactggagaatgagatgcctgttggaccgatgccactcccgcgtgcagatggtcatattagctatggtggtgcactgaggcccggtgaaggtgatgccattgcacaatatgtacagcaggggaagcgtatcccacggcgtggtgaggttggtctttctgcggatgagattcagaagttcgaagatttggggtatgtgatgagtggaagtaggcaccagaggatgaatgctatccgtataaggaaggaaaaccaagtttatagtgcagaggataagagagcactggccatgtttaactacgaggagaagtcaaagagagagcacaaggttatggctgatttgcagcgcttggtttcaagaaccattggccaagagacaggaccttcgcatgatccatttgctactacagatgactgagtaattatttctagctattttacaagaaatggttgccactattagttatgcatgtttttcccgttgttcatgtagtactagtgatgtcggctttgcatttttgtaacttctgttttgtgtcgactgtacttaccttatgcttatcagttattactctttattctatatgtgattatgtgttaa

SEQ ID NO: 5458 - DNA, 1771 bp, Brachypodium distachyon
atcggcgatccatcgtcgcgatgtctcgcacgggcagccgcctcgcctccgttgtgcgcctccccgatcgctctagggtttctgcctcgccttccccacaccgtcgtgccctttcccggtcgccctccccgcgccgccaacgccggcgcgaccggtcccccagccccgcccgtgtccgccggcgcgaccggtcccccagcccctcccgtgtccgccggcgcgaccggtcacccagcccctatcaggaccgccgccgcgaccggtcccctagccccttccgtgaccgccgccgccagtggtcgccctaccacaatgaccgcggtcgggaccgagaccgggttcgggacgtggaaccccccgcgcgccgtggcggtgacggaggcggcgcctggtccgcctccgacgacgatgacgaggaactcaagggcctcacctacttcgagtaccgccgcctcaagcgccagaagctccgcaagaacctgaagcggtgcatctggaacatcacacccagcccccctcgccgcgacgacgaggccgacgagtaccattacagcgaagaggaggaggataaggagaagaaggaatctccgaagaaggattcctctgataaaagtgaggatgaggagaacaagaattcgtcagaatctgagtctggcgagtctggtagtttgtccgattccagcgaatcagattattccaggaggaagaagaaagggcgtaagggccatcgtcgcagcagcagtagcaagcgtagccggcgtgcccatcgccaccactcttctgatatggggagtgagagtgacggcaaggtcgatgaggattcagagggttcttctgattctgaggactcgagggataagaggagcaggaagagatcgcggaggcacaagaagtcgaagaggaggggccgtagctctgggaggaagaagaggaagagtctggatttaccctctgatggaagctccgaggaggtggaggtttcaggctctagccctgaaaggaagactggcaagagctcaaggaagaagaggagcaagcagtctgattctgaagattcgatccctcatgatcccaatgctgaaaaggaagttgaagagacagatgtgccagagattgatcctgaggcaattaagttcaaggaaatgctcgaggcccagaagaaggctgccctggagaatgagatgccggttgggccgatgccacttcctcgtgcagagggtcatattagctatggtggtgcactgagacccggtgaaggtgatgctatcgcgcagtatgtacagcaggggaagcgtatcccacgtcgtggtgaggtgggtctgtctgcagatgagattcagaagtttgaagatttggggtatgtgatgagtgggagtaggcaccagaggatgaatgctatccgtataaggaaggaaaatcaggtttatagtgcagaggataagagggcgctggccatgtttaactatgaggagaagtcaaagagagagcacaaagttatggcggatttgcagcgcttggtttccagaaccattggccaagattcaggaccttcacatgacccatttgctaccacggatggttgagtaatgatttctagctattatatacaaagaaatggttgccattattcgctatgcatcattttcttgctgttcctatagtactagtgataccaagtttgctttttctgtgacttctgttttgtattgactgtatgtagcttattatgcttattatgctacatgttatatttgagttcatggttgttgct

SEQ ID NO: 5459 - DNA, 1704 bp, Cucumis sativus
acgattttcaaaactatcaaatgggtaggctaggatctactgtagaaattccagaaagaagacatcgatctgatcgagaaaacggtacccatcgttactctccggattccgatgcttcccgtggcgattaccgacgacgtcgtagccctagctacgaaaattacgatcgatacaatcatcgtcgtcgatctgtttcgcctggctatgaggatgttagacggagccctagggttgatggagatcaaaacggtttgcccaagagatttgggcgtcctggtggccgggcctatcttgataggaatgggagagcgtctgatgagtcggattcggatgaggagttgaaggggttgaactatgaggagtatcgtaggctgaagaggcagaagcttcggaagtcattgaagcattgtatttggagagtgacccctagcccaccaaggaatgggaatgaagagtatgaggagaaatatgaggagattttggaaaaatatggcggtgatggtgatggtgatggtggagttaaaagtgggttgaatgagaaaaagcaacttgaggagaaatatgtatctgataaaactaagaattctgattctgactctgattctgaattatctgatagaaaattggaaaggagggaatcgaagagttcaggttccaggcgaagaagtagaaaatcgtctcctagtgattcagagtcatgcagtgacacggagagcgaaagtgaaagtgaatcagaggaagaaagtaggaggagaagaaagaaatcgacgagtcggaggagcaggaaacataagaatatcaagagtagtaagaagaagaagaataggtacagtgatacagaggatagtgaagaaagtgagacaggtgattctgatgtcagtgatcatgtcaagtcaagaaaaaggagtcgttcaaagaggtccaagaatagtaggaagaggaaatatagtgattcagaggagagtgaggatagtgaaggcgaaaagttgaggaagcggaaaagctcttcaactttatcaaaatccaggagcaagagaaaaagacagtcagaaacggagagtaagagttgctcttccgctgaggaggattctggttctgaagacattgatgataagagtaaattgatggttgatggagagacaatggccgagattaatgctgctgaagctctgaagataaaggaaattttggaggcacaaaagaaacctgcatttgataatgagatgccagttggaccaatgccactgccaagagctgagggccatattagctatggtggtgctcttaggcctggagaaggtgatgccattgcacagtatgttcagcaagggaaacgtattccgcgacgtggtgaagtgggtctttcagctgaggaaattcagacctttgagacgcttggttatgtgatgagtggtagcaggcatcagagaatgaatgctatccgtattagaaaagaaaaccaagtttacagtgctgaagataagagagcccttgcaatgtataactatgaagaaaaagcaaaacgggagcggaaggtgatggatgatcttcagcggcttgttcagcgacacattggtcatgatgttggcccttcacatgatccttttgctgggtaacctcatttggcgccatattgagatgtgtatgtaatctttcttaaggcacgaggaacattttcatataaggatatgtgaattactgcta

SEQ ID NO: 5460 - DNA, 1254 bp, Solanum melongena
aggactgagaatgagcctgaatatgaagaacctgatgaaattgtggaaaaaattgaagacgagatggtaaaggacgatggattcaaaaaggatgtgaaaaggtcaaaaactaagtcttctgaaggtgagtccgattccgaatctgaatcagacgcatcagatactgactcagagtcttcagattctgaaccgaggaaatctagaaagaggaagaaatcaagctccagacgtagaagtaggagatcaagaaggaaaagtgagagcgaatcggcggaagagccgactgatgattcatcatcagaagaagataggagtacaagaaggaaaaaatctaggagaaaagtgactaacaggagacgtaaaaggggtagcagtagcaggaagaaaagaagcaaaaggaaaagctattcaagtgagagtgagagtgaaagcaagagcgaaagcgaagatggtgaaattgatgattctgatgctagtgagaagcaaaagggtgctctaaagagtaagaaaaagaaggatgtggatagtgaggtaccggaaaagagctcagagtcgaatggtgatgctagaattaatgagaagatggttgacaagacaatgaaagatgaagttaatagtgaggtgcttgaatttaaagaactgattgaggcaaggaagaagagtaattttgaagatgaggccccagttggtccgatgcccttgccaagagctgaagggcatatcagctatggtggggcacttaggcctggtgaaggtgatgctatagctcaatatgttcagcaagggaagcgtattccacgtagaggtgaagtgggtctctctgctgatgagatttcgaaattcgaaggtcttggctatgtgatgagtggtagtaggcatcagaggatgaatgctattcgtatcagaaaagaaaatcaagtttacagtgctgaagacaagcgagcattggccatgtttaactatgaggagaaggctaagcgagagcagaaggttatggctgatctgcagcgccttgtgcaacgccacattggtcaggatactgaaacttctcacgatccctttggagggaagtctgcagagggggctgatgcttgatccttttgtatgttgtttacttaattttggtgttattgctgtgatgtgtagaaatttgattgttatctagaaggtggagattgaaaataacttgtagtttacttgtgcgtaagctgataatgtttgcattttactaatagagtttcactgtttgtgtgc

SEQ ID NO: 5461 - DNA, 2208 bp, Vitis vinifera
tagacataagaaggagaagagaatgaaggataattttggactgaagttagtatttcatatgtttgggaatgtatacatactttaccaaagaacgtagaggcggcatcgaaaccttgcaattgtgcgagaggagtggctaaaaatcgattggttacctccggccgccggtacatctctctatatccctacgatttgtgtcttcagttttctatttttcctttacggcgtttccttcgtttagaccgctatgggtaggccttcgtccacggttgagatccctgacaaacgacaccgtatagagaacggtggtcactcgccggattccgactcaccccgcgaccaccgccgtcgtcgaagccccgactatggtaggtacgatcccgattccgagcgccgccatcgccgtcggtccgattcgcctgattatccaaaccctagacgaagccctagatccgacgcccggcgggttggctctggagaccgcaagaatcgttccgctacgtttctagaccgcgattataagaacgggcgatactcggagtcggagtccgatgaggaattgaaggggttgagttttgaagagtatcgcaggctcaagaggcagaagctgaggaggatgttgaggaattgtatatggaacgttacgccgagtcctccgagaaacgcgaatgaagaggaattcgaaccggaaccggaggagttcacagagaaatatgttgtagaagaggacaaacgagaaaacaatgatttgaagaaggagatcaagggaagcgcaaaatccgagttagaacgatcagagagaagtgaatctgagagcgagtcggagtctgactctgaatccgaggattcacggtctaggagaaagagaaagggttcgaggtctaggaggagaactgggaaatcatcctacagtgacagcgaatcggatggtgatgacagtgaaagtgatgattatgaagattcacgatcgaggaaaaaggggaagagctcgagctctaggagaaataaaaaatcatcctacagtgatagtgactcagaggatgatgcaagtgagagtgacgacgagaaagaagataatcggaggaagaagaagtcgagcagaagcagaagtagacgaagtgggagcagtaggaaaagtagcaagaggaaaaggaggagtaggaggagttattcagatgaaagtgatagtgaagtgagtggaagtgacgaatctgataggccaaggtcacagaagcaggggcaagctttgtcaactaaatctaaaaggagcaagaaaaagagcaggtctgaaacatatagtgagagttcatattccgataagagttcagattctgaagttgatgcaaaaagcaaaatgaaggcagaggatgtaatgataaatgaagttaatgcagaggctttaatatttaaagagatgattgaatcacagaagaagcctgcattggataatgaaccgactgttggtccaatgccattgcccagagcagaagggcacattagttatggtggtgcgcttaggccaggtgaaggtgatgccattgcccagtatgttcagcaagggaagcgtattcctcgaagaggagaagtgggtctttcagcagaggagatccagaagtttgagggccttggttatgttatgagcggcagcaggcaccagaggatgaatgcaattcgtatcaggaaagaaaaccaggtttatagtgcagaggacaaaagggcattggcaatgtttaactacgaagagaaggcaaaacgtgagcataaggttatggctgatttgcagcgactggtgcaacgccacattgggcaggatgttggtcccactcatgatccttttgctgtgaaaggtgctgagggcactgatacttgaacctaatgtatgtccaatatcatcttttattgtatgctcttatgttctttgcgagaagaaatgagtttcatttggatgtttttatgttgaacaatgtggagacaaatatatgttaggtttgtcattattgggattgttaaatttcatctctctttcagtgcttatgtgatgcacaatctttgtatagctcatgcaataatgatgaaggttcaggatgcgagctgattaaggtcagtaaccccttcactgtgatagcataattaatcttttcagtgtcatattagttctttgcattatcaaatggttttctagaaagtgaaaatgatatagtgttggag

SEQ ID NO: 5462 - DNA, 1222 bp, Vitis vinifera
aaatccgagttagaacgatcagagagaagtgaatctgagagcgagtcggagtctgactctgaatccgaggattcacggtctaggagaaagagaaagggttcgaggtctaggaggagaactgggaaatcatcctacagtgacagcgaatcggatggtgatgacagtgaaagtgatgattatgaagattcacgatcgaggaaaaaggggaagagctcgagctctaggagaaataaaaaatcatcctacagtgatagtgactcagaggatgatgcaagtgagagtgacgacgagaaagaagataatcggaggaagaagaagtcgagcagaagcagaagtagacgaagtgggagcagtaggaaaagtagcaagaggaaaaggaggagtaggaggagttattcagatgaaagtgatagtgaagtgagtggaagtgacgaatctgataggccaaggtcacagaagcaggggcaagctttgtcaactaaatctaaaaggagcaagaaaaagagcaggtctgaaacatatagtgagagttcatattccgataagagttcagattctgaagttgatgcaaaaagcaaaatgaaggcagaggatgtaatgataaatgaagttaatgcagaggctttaatatttaaagagatgattgaatcacagaagaagcctgcattggataatgaaccgactgttggtccaatgccattgcccagagcagaagggcacattagttatggtggtgcgcttaggccaggtgaaggtgatgccattgcccagtatgttcagcaagggaagcgtattcctcgaagaggagaagtgggtctttcagcagaggagatccagaagtttgagggccttggttatgttatgagtggcagcaggcaccagaggatgaatgcaattcgtatcaggaaagaaaaccaggtttatagtgcagaggacaaaagggcattggcaatgtttaactacgaagagaaggcaaaacgtgagcataaggttatggctgatttgcagcgactggtgcaacgccacattgggcaggatgttggtcccactcatgatccttttgctgtgaaaggtgctgagggcactgatacttgaacctaatgtatgtccaatatcatcttttattgtatgctcttatgttctttgcgagaagaaatgagtttcatttggatgtttttatgttgaacaatgtggagacaaatatatgttaggtttgtcatta

SEQ ID NO: 5463 - DNA, 1778 bp, Zea mays
cccccttcctggccccccacaatccgaggatccgaatccccgacgcaacccttgcgtggtggcgtcaccacccaaatcccaccatccggatctgccgatccgccgccgccatgtcccgctcggagcgccgcctcgcctcggccgtggtgcgccttcccggccgctccagggtctccgcctcgccatccccgcgccgccgctcccagtccccatccccgcgccgcgaccgccgccgccgcgaccgctccccgatcccttaccgcgatcgctccccaagtccatatcgagcccgtcgccgtgaccgctccccgagcccttaccgcgatcgccgcgaccgctccccgagcccttatcgcgatcgccgccgccagtggtcaccctaccacaacgaccgcggccgggaccgtgaccgggtcctgcccgtccgtagcggcgggggcgcctggtccgatgacgacgacgacgacaaggaactccagggcctcagctacttcgagtaccgccgcctcaagcgccagaagcttcgcaagagcaagaaaaggtgcatctggaacatcacgcccagcccgccccgtgttgaaggcgacgaggagaactacggctacagcgacgtggaagaggagaaggtatctccgaaggcctcgccggaggctagcgaggaggagagcaaggatgcgtcggagtcagaatccggtgagtctgatagcctctccgagtccagcggatcggaagcttctatgaggaagaagaaagggaggaataaaagtcgccgtagtagcaagcgcagccggcagcgccaccgccaccgctcatacagttcggagattgaggacgaaagcaagagcgacgatgattctgtgggctcttatgattcggaggagtctagggataggagcaaaaagaggtcgcgcaggcataatagatctaagaagaggagcaggagctccaggaggaagaagaggaggagccaggatacagcatcggagcaaagctctgaggaggaagaggaggaggatagtaagaaaaagaataagggcttgaagaggaagcggagcaagcgatctgattctgaagaatcggtcccttctgatgccactcctgatgatgtaaaagaaattgaagaaactaaagtgccagaaattgatccagaagcaatcaagttcaaggaaatccttgaggcccagaagaaggcttccttggagaacgatatgcctgttggtccaatgccacttccacgcgcagaagggcatattagttatggtggtgcacttaggcctggagaaggtgacgcaattgcacagtatgttcagcaagggaagcgtatcccacggcgtggtgaggttggtctgtctgcagaagagattcagaagtttgaggatctggggtatgtgatgagtgggagtaggcaccagaggatgaatgctatccgtatcaggaaggaaaatcaggtttatagtgctgaggataagagagcattggccatgtttaactacgaggagaagtcaaagcgggagcacaaggttatggctgacttgcagcgcttggtgcagagaaccattggccatgatgtgggaccttcacatgatccatttgctactacagatggttgagtaatgatttcttgttcaactagtcacctgtatcaggtgtgctttacctgtttgtgtttccttccctacattgtaattagtgtttttgaacttgcctagttatgccgcaaattgcttatgacattttgcatgtgaaccatagtaaaaaagagcatattattagcttgt

SEQ ID NO: 5464 - DNA, 1111 bp, Avena sativa
tactacctacagcagcaggcgtagccggcgtgctcatcgccgccgccgctcgtctgacataacgagtgatagtgacggcaatgccgacgaggattcagagggttcttatgattcggaggactctagggataggaggaggagtaagcgatcacggaggcacaggaagtctaagaggagtggacggagctccaggaggaagaagagtaagagtctgaatataccctctgatggaaggtctgaggaggaggagaaggacgtttcaggctccagccctatctcgatggacagtaagaagtcaggcaagagctcaaagaagaagaggagcaaggagtctgattcggaagattcgatcccttctgatgctgttgctagcgctgatgataaggaagttgagaacacagatgagccagggattgacccagaggcaattaagttcaaggaaatgctcgaggcccagaagaaggctgcactggagaatgagatgccggttggaccaatgccgcttccccgcgcagatggtcatattagctatggtggtgcactgagacccggtgaaggtgatgccattgcgcagtatgtacagcaggggaagcgtattccacggcgtggtgaggttggtctgtctgcagatgagattcagaagtttgaagatttggggtatgtgatgagtgggagtcggcaccagaggatgaatgctatccgtataaggaaggaaaaccaggtttatagtgctgaggataagagggcactggccatgtttaactacgaggagaagtcaataagagagcacaaagtaatggctgatttgcagcgcttggtttcgagaaccattggccaggagacaggaccttcacatgatccatttgctgctacagatgactgagtaattatttctagctatttacaaagaaatggttgccaccattagttatgcatgtttttcctgttgtcctatagtactagtgatatcgagtttgcatttttgtaacttctgttttgtattgactgtacttagctcatgatgcttattatcctacatgttggatttgtattcatggtatttgctatgtttgtcaagttgatttttgatccccactatgattcttccctg

SEQ ID NO: 5465 - DNA, 953 bp, Elaeis guineensis
  misc_feature (232)..(232): n is a, c, g, or t
  misc_feature (235)..(235): n is a, c, g, or t
  misc_feature (239)..(241): n is a, c, g, or t
  misc_feature (244)..(244): n is a, c, g, or t
  misc_feature (249)..(250): n is a, c, g, or t
  misc_feature (252)..(253): n is a, c, g, or t
tgagcagcagggccacgacttctgatgagagtgaagaggaatctgattctagcccaagaccaaagaaaaggtcctcaaggaggagcaagaaaagcaaaaggtccatgtctgagagctcttcagatttggatggtgatgcccggcaggctgatgcgaagaaacctgagattgatcctgaagccctcaagttcaaagagatgctagagtcccacaagaagcctgcattggacantgngccnnnttnggcannanncttccacgagctgaaggacacataagctatggtggggcactgaggccaggagaaggtgatgcaattgcacagtatgtgcagcaaggaaagcgtatcccaaggagaggagaggttggtctctcggcagaggagatccagaaattcgagagcttggggtatgtgatgagtggtagcaggcatcagaggatgaatgctattcgtatcaggaaagaaaaccaggtttatagtgcagaggacaagcgggcattggcgatgtttaattatgaagagaaggcaaaacgtgaagccaaggttatggtggacctgcagcggctggtgcacaagcatattgggcaggacatgggccctacacatgatccatttgcaccaaaggcctcagatgctgctgattcttgaatctgtcaaccatatagctttttcatgaatgatcttaagcctggatcagaacacaagcttgtgatgcctttcatgtggtagcttggaaatttcacctcatcagaaaaagcgtgccgttgcctctttgccagctccagttctagacttgcagttataatatgctgagaaccttattcaaacagccttatattaaatgtggtgattattatgtaatgttagccttctagtcacctaaagactatggtaaaaatgtgttctagagcttcaaacagagataatggctcgtaaaatttggcacttcatt

SEQ ID NO: 5466 - DNA, 1992 bp, Podocarpus macrophillus
aggaatcgccgtttcgaggacagaagaaacagggattacgaacgcagaagggatcgaacccccgatactcagaagaagagaagacgaagaagattatggcagaaaaacttatggccgaagccgaagtcgaagccgggatcgatccaggtacgagcgctatatcccctctaaaaatggcaaaagatcgagtactagccctatgttaagaagatcttacagtccaaaccctaaccctaataaccctaattattctcatcgtcgaaaccctcgaagtgaaattcagtgcaatgggaacagaatggagagcaggagtccaagccctaattatgatcgcaggggaagtcccgattataacccttacaaaacctctgggaaccggcagggatttttagacagagagacgcggcgtcgcggggaggattctgatagcgaggatgaggaattgaagggtttggattttgcggagtatagaaggctgaagagacagaagcttagaaagaagctgaagaattgtatttggaggattactccgagcccgccgagggatgggagggtgagttatgacgagtacgagggtgccctgaatggaaatggtgacgtttgtgttgggaaattggaagggaaagaagtcggtgagggttttgaagaggggaaagagggaaagaaggcggatgtggtggtgaaaaaagtgttgaagaaaagttctgggtctgtgtttgatagtgaaagtgaggatgattcggaggatttatcagaggatgaggattctagtgatgggggtgataggaaggtgacgaaaaagaggaggaattactcgaggaaaggtggaaggcatagtggcaagaggaagcacggaaagacgtcagtgagagtgaagacagtagagaggatgatagtcggtctagagattccgagtctgatagtagtgaggatgagaggcatagaaagaggaggaaaggtgggagcaggagtgagaagagtaagaacaagaaaaaggctagaagaaaggttaagggataggggaaggagtttgaggaaacccaaacatagttcagaaagtgcgtctggctctgaagatgacagtgattcttcggaaagtgatgggaatgtgagaaagaaatccagtgtttcgatgctatccgatcgcagaagacacaagagaagaccatcctctgacaatgatttgtctactgataggagcaattctggatttgaaaccgatttaaaggggagtgaggaggagaatgaggataataccaagtctgcggagattgacaatgaggctctcatattcaaggaaatgatcgagtctcagaagaaatcagctgctgcagggcttgagaatgagcccttcgtgggtcctgcacccgctcccagggctgagggacatatcagctatggaggtgcccttcggcctggagaaggagatgcaattgcacagtatgtccagcaggggaagcgtatccctaggagaggagaagtgggtctgtctgctgaggagattcaaaagtttgagtctttgggttatgtcatgagtggaagcaggcatcaacgtatgaatgccattcgtatcagaaaggaaaaccaagtttacagtgctgaggacaagagggcattggcaatgttcaactatgaggagaaggcaaaacgggagcataaagttatgtctgatctgcaacgcttggtacaacggcatatagggcaagatgttggcccaactcatgatccctttgcaccgaagccctctgaggcagttgatgcttagattactgagatgtcgttgttttatatatggtgcaattacttgataatttcatctaattgttatatagtcttcataaatcatgtttttaagcagtctatcgaagaatattcttcagttataaacttgtacatggatgttgctgatttgaaatggtgattttctctttttcctcacattgcattgttaagactaattaagtttgattaattttctagattatagcaagc

SEQ ID NO: 5467 - DNA, 2047 bp, Prunus persica
gacctttttttctaccaatatagcagacgagaagatagcagacgtcgacaataactccgtcgagcaaatcgcgaagacccccaattcgtccgcgaaaaggtctgggctcgaagccgatgtgaggattagggctcaatctgcggcattgattttcagggacctcaatttgaagaagaggtcagacattaagtggttctggtaaaagcttttccaggttagttgctttccaaaataacttcattcgcgacttcgttcaaatcttctctgatgggaaggccatcgtccaccatccatatccccgataaacgacaccgttccgagcacgagaacggccgttacccgccccactccgactcctccggcgacaaccgctaccagcgtcgcagccccagctatgaaagttacgaccgttacaacaataaccgtaaccgccacagaaaccgctccggctcgcccgatcgcccaaaccctagacgaagccctaggaccaatggagacccaggctctttggcgcagcgccgcagccccagctacgaccggtacaacaatcaccgcgaccgaaaccgctccggctcgcccgattacccaaatagaagaagccctagggctaagggaggcccagactctttgcccaacaaattcgggcggggaggcaaccggatggatcggaatggaaggcgatcggagtcggaggagtccgacgaggagctgaaggggttaagcttcgaggagtacagaaggctcaagaggcagaagttgaggaagacgttgaagtattgtatttggaatgtgacgcccagtcctcctagggttgagaacgatgaatttgaattggaggacaaggctgatgagatttctgagcggtatggcgaggaggaaaagagtgaatcgggcgagaaaaagaaagagaaggcaaagtctgaatctgagtcggaatcggaggatttgaggtcgaggaagaggaagaagggtttgagttctaagcgtaggggcaggaattcgaagtatagtgatggcgaatcggagagtgagagcgatgatgaatccgaatccgatgaagaagatgatcgcagacagagaaagaagtcaaaaaagaggagtaagaggagcaagagcagaagagaaaggagaagaagaagaaagagtaggcgtagcagtagtgattctgatgagagtgaaaaaagtgaaagtgagggttcagattctgaatcagaggatcgcttgaggtcgaagaagaagggaaagtcgagcagtcggagtaagacgaagaaagaatccggaatagacagggagagttctgattcagagaagggtttggattctgaggttgatgccaagcctgttactatggtggaagaggaggtgataaaggatgagagtaatgtggaggcattgaagctgaaagatatttttgaggcccaaaagaagcctgcactggatagtgagccggtggttgggccaatgccattgcctagagctgaagggcatattagttatggtggggcgcttaggcccggagaaggtgatgccattgcacaatatgttcagcaagggaagcgtattccgcgaagaggagaagtgggtctttcagcagatgagattcagaagtttgagagtcttgggtatgtgatgagtggtagtaggcaccagaggatgaatgccattcgaattaggaaagaaaaccaagtttatagtgctgaggacaagcgggctttggccatgttcaactatgaagagaaatcaaagcgcgagcacaaggttatggcagatttgcagcggttggttcagcgccatattgggcaggatgttggtcctactcacgaccctttttctggcaaggcctcagagagtgctgatacttagtttcatgtttgcttttgtctaagttgttgttgctttttttatttcctttcattaaccatgtatcatatgtgttactggttgattttgagctgtattgaaactgaatactttggtttgtcaatttctatatgagttcttaaatgtattctcgtttaatgcaattatatgtcaaattgtgggagcc

SEQ ID NO: 5468 - DNA, 760 bp, Pseudoroegneria spicata
  misc_feature (727)..(731): n is a, c, g, or t
aagaagaagagtagcagtcagtctgattctgaagattcgatcccttctgatgccgtcattgatgaaaaggaaattgaagagacagatgagccagagattgacccagaggcaattaagttcaaggaaatgcttgaggcccagaagaaggctgcactggagaatgaggtgccggttggaccgatgccactcccgcgtgcagatggtcatattagctatggtggtgcactgagacctggtgaaggtgatgctattgcacagtatgtacagcaggggaagcgtatcccacggcgtggtgaggttggtctgtctgcggatgagattcagaagttcgaagatttggggtatgtgatgagtggaagtaggcaccagaggatgaatgctatccgtataaggaaggaaaaccaggtttatagtgcagaggataagagagcgctggccatgtttaactacgaggagaagtcaaagagagagcacaaggttatggctgatttgcagcgcttggtttcaagaaccattggccaagagacaggaccttcacatgatccatttgctactacagatgactgagtaattatttctagctattttacaaagaaatggttgccactacccactattagttatgcatgttcctgttgtccctgtagtactagtgatgtcgagtttgcatttttgtaacttctgttttgtgtcgactgtacttagcttatgcttatcagttattacnnnnngttctatatatgttcatgattgttgtcaa

SEQ ID NO: 5469 - DNA, 867 bp, Sequoia sempervirens
ctgatcgcaggaaacacaagcagcagtcaccttctgagaataatgccttgtctgaacctagtaattgtgattctgaacctgtcgggattgaggaggataaagaggataagagcctacctgttgaaattgatgatgaggctcttatgtttaaagaaatgattgaatctcagaagaaatcagcagctgcggggcttgaaaatgaaccatttgtgggtccagcgccggctccaagagctgaggggcatatcagctatggaggtgcccttcggccaggagaaggagatgcaattgcacagtatgtgcaacaagggaaacgtattcctcgaagaggagaagtggggctgtcagctgaggagattcagaaatttgagtcactaggttttgtaatgagtggaagcaggcaccaacgtatgaatgctattcgtatcagaaaggaaaaccaagtgtacagtgctgaggacaaacgagcattggctatgttcaattacgaggagaagtcaaaacgtgagcataaggttatgtcagatctgcaacgcttggtgcagaggcatattggacaagatgttggcccaacacatgatccttttgctgctaaggcttcagaggtggcagatggtaggtttttgtggatggtgtgttaactttatgaacctttgtacaatttctggatgttttcataatttgcacttgtgtgtaacgatattgtcaacgagttctactttttccagcccattataattatgcagatgtttttgcattcatttgatatgtgtatttcttaaggcattcagggctaaatattttacgagatatggcaaatgtaattcagaaatagaaatccttttatctatgtacgtgaacaataat

SEQ ID NO: 5470 - DNA, 1873 bp, Sorghum bicolor
atccgaatccccgacgcaacccttgcgtggtggcgtcaccacccaaatcccaccacctggatccgccgatccgccgccgccatgtcccaccgctcggagcgacgcctcgcctccgccgtggtgcgcctccccggccgctccagggtctccgcctcgccatccccgcgccgccgctcccagtccccatccccgcgccgtgaccgccgccgccgcgaccgctccccgatcccttaccgcgatcgctccccaagcccttatcgaaaccgccgccgcgaccgctccccgagcccttaccgcgaccgccgcggccgctccccgagcccttaccgcgaccgccgccgccagtggtcgccctaccacaacgaccgcggccgggaccgtgaccgggtcccgcccgtccgtagcggcgggggtgcctggtctgacgacgatgacgacgacaaggaactccagggcctcagctacttcgactaccgccgcctgaagcgccagaagctccgcaagagcaagaagcggtgcatctggaacatcacgcccagcccgccccgtgttgagggcgacgaggagaactacggctacagcgacgtggaagaggagaaggcatctccgaagggctcgccggaggctagcgaggaggagagcaaggatgcgtcggagtcagaatccggtgagtctgatagcctgtccgagtccagcgaatccgaagcttctaagaggaagaagaaagggaggaagagcagtcgccatagaagcaagcgcagccgccggcgccaccgccaccgctcatacaattctgagattgaggatgaaagcgagagcgacgatgattctgagggctcttatgattcggaggattctagggataggagcaaaaagaggtcgcgtaggcataatagatctaagaagaggggcaggagctccaggaggaagaagaggaggagccaggatacagcctccgagcaaagctctgaagaggaagaggaggaggaggaggaggaggatagtaagaaaaagagtaagagctcgaagaggaagcggagcaagcgatctgattccgaagaatcagtcccttctgatgccacccctgttgatgcaaaagaaattgaagaaacaatagttccagaaattgatccagaagcaatcaagttcaaggaaatgcttgaggcccagaagaaggctgccttagagaatgatatgcctgttggtccaatgccacttccgcgcgcggaagggcatattagttatggtggtgcattgaggcctggagaaggtgatgctattgcacagtatgttcagcaagggaagcgtatcccacgacgtggtgaagttggtctgtctgcagaagaaattcagaagtttgaggatttggggtatgtgatgagtggcagtaggcaccaaaggatgaatgctatccgtatcaggaaggaaaaccaggtttacagtgctgaggataagagggcgttggccatgtttaactacgaggagaagtcgaagcgggagcacaaggttatggctgatttgcagcgcttggtgcagagaaccattggccacgatgtgggaccttcgcatgatccatttgctactacggatggttgagtaatgatttctggatcaactaatcaactatatcgttctggatcaactaatcaactatatcgtgtgtgctttacctgtttgtgtttccttctctctgttgtaattagtgatgttgaacttgcctagttatgctgcaaatttcttatgagatattgcatgagaaccaaatttaaaaggagcgtactgttagcttgtatcttgtcttggtagtatttttgttatgatggttcaatgtgcttacattttctgctattgttccaagctgcttggtttccca

SEQ ID NO: 5471 - DNA, 1905 bp, Sorghum bicolor
tccgaatccccgacgcaacccttgcgtggtggcgtcaccacccaaatcccaccacctggatccgccgatccgccgccgccatgtcccaccgctcggagcgacgcctcgcctccgccgtggtgcgcctccccggccgctccagggtctccgcctcgccatccccgcgccgccgctcccagtccccatccccgcgccgtgaccgccgccgccgcgaccgctccccgatcccttaccgcgatcgctccccaagcccttatcgaaaccgccgccgcgaccgctccccgagcccttaccaggaccgccgcggacgctctccgagcccttaccgcgaccgccgcggccgctccccgagcccttaccgcgaccgccgccgccagtggtcgccctaccacaacgaccgcggccgggaccgtgaccgggtcccgcccgtccgtagcggcgggggtgcctggtctgacgacgatgacgacgacaaggaactccagggcctcagctacttcgactaccgccgcctgaagcgccagaagctccgcaagagcaagaagcggtgcatctggaacatcacgcccagcccgccccgtgttgagggcgacgaggagaactacggctacagcgacgtggaagaggagaaggcatctccgaagggctcgccggaggctagcgaggaggagagcaaggatgcgtcggagtcagaatccggtgagtctgatagcctgtccgagtccagcgaatccgaagcttctaagaggaagaagaaagggaggaagagcagtcgccatagaagcaagcgcagccgccggcgccaccgccaccgctcatacaattctgagattgaggatgaaagcgagagcgacgatgattctgagggctcttatgattcggaggattctagggataggagcaaaaagaggtcgcgtaggcataatagatctaagaagaggggcaggagctccaggaggaagaagaggaggagccaggatacagcctccgagcaaagctctgaagaggaagaggaggaggaggaggaggaggatagtaagaaaaagagtaagagctcgaagaggaagcggagcaagcgatctgattccgaagaatcagtcccttctgatgccacccctgttgatgcaaaagaaattgaagaaacaatagttccagaaattgatccagaagcaatcaagttcaaggaaatgcttgaggcccagaagaaggctgccttagagaatgatatgcctgttggtccaatgccacttccgcgcgcggaagggcatattagttatggtggtgcattgaggcctggagaaggtgatgctattgcacagtatgttcagcaagggaagcgtatcccacgacgtggtgaagttggtctgtctgcagaagaaattcagaagtttgaggatttggggtatgtgatgagtggcagtaggcaccaaaggatgaatgctatccgtatcaggaaggaaaaccaggtttacagtgctgaggataagagggcgttggccatgtttaactacgaggagaagtcgaagcgggagcacaaggttatggctgatttgcagcgcttggtgcagagaaccattggccacgatgtgggaccttcgcatgatccatttgctactacggatggttgagtaatgatttctggatcaactaatcaactatatcgttctggatcaactaatcaactatatcgtgtgtgctttacctgtttgtgtttccttctctctgttgtaattagtgatgttgaacttgcctagttatgctgcaaatttcttatgagatattgcatgagaaccaaatttaaaaggagcgtactgttagcttgtatcttgtcttggtagtatttttgttatgatggttcaatgtgcttacattttctgctattgttccaagctgcttggtttccca

SEQ ID NO: 5472 - DNA, 2432 bp, Fragaria vesca
agagagaaagagagagatcccaaacgaaactcttttcaaatggcgaggccatcctccaccgttcatgtccccaatcgacgattccgttccgatcacgataacggccgtcgctcaccgccggactatgacaactcacctgacggccgccgccagcgtcgcagccccagctatgaaaggtacgaccgccaccgaaaacgttcttactctcccgatttcccaagccctagacgaagccctaggtccaacggaggtcggagactcggccgggccgggaacgaccgatcttactcgcctgattactcgaatcctcgacgaagccctaggtctaatggagggccggactcgttgccgaggagattcgggcgggccggggacgatagggatcggaatggaaggcggccggagttggaggattccgatgaggagctgaaggggctgaacttcgaggagttcagaaggctgaagaggcagaagctgaggaaggcgttgagaggttgtatatggaatgtgacgccaagcccgccgaggaatgaagatgacgagttcgaattggaggacaaggctgaggagattccggaggggtttggtggagaggatgaggattcaggcgagaaattgaaagagaaaggcaagagtgaatctgagtcggaatcggaatcggaggatttgaagtccagaaaaaggaacaagagttcgggttctaagcgtaggaggaagagttcgaaatatagtgatagtgaatctgagagcgtgagtgatgatgagtcggatgaggaagaggatcgcagaaggagaaggaaatctagaactaggagtaagaggaagaagagcagaagagagaggaggaggaggaggaagagtaggaggagtagcgattcggatgagagcgaagtgagtgatagtgagagttcagattctgatagggtgaagtcaaagaagaagaagcgaaaggtgagcagcaagagtaagaagaagaagtactctgaaacggagagtgaggattctggttcggagaagagtttggattctgaagttgatgccaagcctaaagctctagtggcagtggaggagccggagatggatgagaatagtattgaggcgctgaaactgaaggaaattcttgaggctcagaggaacccttcgttggatttggacaatgaacctgtggttgggccaatgccgttgccgagagctgaagggcatattagttatggtggggcgcttaggcctggtgaaggtgatgccattgcgcagtatgttcaacaagggaagcgtattccgcgaagaggagaagtgggtctttctgccgaggagattcagaagtttgagggtcttggctatgtgatgagtggtagcaggcaccagaggatgaatgccattcgtattaggaaagaaaaccaggtttatagtgctgaggataagagggcattggccatgtttaactatgaggagaaagcaaagcgagagcacaaggttatggctgatttgcagcggctggttcagcgccatattggacaggatgttggtcctactcatgaccccttttcttccaaggcctccgaggatcctgatgatgattaatttcatgtatgttttgctgttatctgagttgtttcttcctcttctttctagaactatgctttcaaagaactattcaactatgtatgttacaaattgatattgagcagtagcacactgttgaaatggatgctatggtgatggttaatatattctgtttcagtgcttgaagttataatctgattagtgttttgtgttcacttatataacagtctctttattggtaatatggattactggaattttaaaaagaaactaaataataatttttatagttgatgtttttgggatcatgaatgctgcttactctattatttattctctgcaaatgaataatttacacctgacattaagttgcttttgacatcagttgttttttgtcactgatcccaattttgggttcgcctgctgaggtttaaaacatttattggaaaattgttctttattcatgtagttctatctgttgctttaataaatttctgttgttcagtgcttgagctctcttacggaacttcaagaagacttgcatagtatatcatttcaaataatgatttgtatctgctgcaaccatggctcagtgttcttttttagatagttttttcatatcatattttttttgatagtttttaattttttttaaaatattttttctaatcttggatcattgcatgaagatctatgccctgccaagtttttttttggcattgtcttggttgttcagatatcattaaagacttaaacagtcctggtacagcttccatggattttgtgagtgagatggtgaggaaggaagcaaaatcttcatatgttccttcaattcaccggggaaaaatttcaaagaggtagcttcttaa

SEQ ID NO: 5473 - DNA, 2222 bp, Eucalyptus grandis
caatcgccgacgatgggaggtccatactccggcgccgtctccggccgccgggaccgctaccacggcgaggacggccgccgccgccacagccccgaatcggatcgccccgccgagtaccgccgccgccgcagcccctcatacgagtccttcgaccgccgcgacgaccgccgcggccgcgagcccgatcgccgcgaccgccgtggccgcagccccagcctcagcccctcgtacgacgatcgctacgacgaccgccgcgacggctcgggccagcggcgccgacggggttcgccccgcgcctcggactccaggaggagccctagggccgacggagccctagattcgttgcccaggcaattcgggaagaagcggccttacctcgatcgcgattatcggggcaacggtaggttctcggagtcggactccgatgaggagctgaaggggctgagtacggaggagtacaggaggctgaagaggcagaagatgaggaaagccatgaagttctgtatctggaattgcaccccgagcccaccgcggtacgagggggatgaaatggaggagaaagcggaggagattgatgagaagtacggggaagatttggagaagagcgactcgagcgggaaagaggatggaaaagcgaaggggaaaggaaaatctaagtccgatagcgaggagtcgagcgacagtgaggcggacagcgagtcggagccgagtgcttctggttcgaggaagaagaagaggagttcaagttctaagcgcaggagcagggaattcgagagtggatcggaggtcgagagcgagaaagaatcagatgaggaagaggatcaaaaagggaagaaaagatccaggaaacggtctagtaggcggacaaggagtgggagaagaagtagcaggcgacgaagcagtaggaaaagcaagaggagatatagtgaatctgatgatagcgagggtgaagatagcgaagctgaggattctgatgtcaaaccaaagaaggacaagggctcatcaagattgggcaagaaaagtcgcagtcagagtaagagtggtattgaggatgatagcgatgtttcgaattcgagcgagagaccacaatctgagcctgatctgaatggtttagacagtgaggtcaaggctgagatcgatgcagaagcactcatgttcaaggagatgatcgagtcccagaagaagccagccttggataacgagccagtggttggtcccatgccgctgccaagagctgaggggcacattagttatggtggggctcttaggcctggtgaaggtgatgctattgcgcagtatgttcagcaagggaagcgtatcccgcggagaggtgaagtcggtctttctgcagaggagattcagaagtttgagggtcttgggtatgtgatgagtggtagcaggcatcagaggatgaatgccatccgtattaggaaagaaaaccaggtttatagcgctgaggacaagcgtgctttggccatgttcaactatgaagagaaggcgaagcgtgagcataaggtcatggctgatttgcagcggttggtgcagcgtcatattgggcaggatattggccctactcatgatccttttgctggaaaagctgctgatggtcctgaggcttgataaacatggatcggtgattctatgacgggcttccttgacgacggtgatgctgctaagatccgtgccttgtcttatgaagctgttctcactcttcgtgatagcgtgtatatctcgacgggaatgttcaagcattgagcagcagcgtacatcatacggaaactgtctgcttcactagattgtcataatatatttcttttggctagttcttgtttttggctagtatggaaggaaataatcaaccaacgtgtaagcccactgtctccgactattttgtgtccttagccccttcctcctgtatttgctgcaacagctatttagctttgcgagtgacgtgatatttttcatgctacagttcagcagtcggcaacaatatttgatgtccccttcccttttatgattttggcattcgatcctcttaaaacacccggccgatctcatccggtcacgagtctccccccaccaccggtgacgggaaactatcaggccaccggaggcggttctgttagttgggctcgaaaactatgatcatggttcttgatggatggtatggcgttgagctcaatctatattctctttgttcatgttgctcgattatgcccgga

SEQ ID NO: 5474 - DNA, 696 bp, Salvia sclarea
gggctcctgatttagaagtcgatactgaggatgtaacagagaagatggcaaatgagatcgtagtcggtgaggatgttaatgatgagatacttaagtttaaggaaatgatcgagttacggaagaaacaaaacatggaagatgaggaagaagtggttggtccaatgcctctgcctagggcggaaggacacattagctatggtggtgcacttaggcctggtgaaggtgatgctattgctcagtatgttcagcaagggaaacgtatccctcgtagaggagaagtggggctttcggctgaggagatttcgaagttcgagactctggggtatgtgatgagtgggagtaggcatcaaaggatgaatgccatccgtatcagaaaagaaaaccaggtttacagcgctgaggacaaacgggccctggctatgtttaactatgaggagaaggctaagcgcgagcagaaggttatggctgatttgcagcggttggtgcagcgtcacattgggcaggacactggtccttctcatgatccatttggtggaagtggaagggctgccgaggtttctgacgattgattctgtgtgctgttattgcaatgtcagtatgggacttgtaccttttagattgccttttctatttggatcatgcattgtattcgtataccttcttgtgttggaatcgtttaatagcaaatattatgct

SEQ ID NO: 5475 - DNA, 1931 bp, Zostera marina
atcgtatgttcccaaccctagattgggaaacacctcttcagcgatcatcgtcgacactccgcatccggctttcgttgaacatcgctgggttctaagaagataaagaagataaagatgggaaggggtgaacacaacagacgtctttcctccaccgtcgaagtatctcgtcgacgtcaatattcctcctcgccagattactctaattatgttaacagcagacaacatcgtcgacgctccccatctccatatcagtcgccgagaaggcacgaaacttttagagaaaacgattctgccagaggtagatcgaagcaggattggagaaatggaaatcattgggagagaatggaagacgagaggaatgaggaagaggaggatgaggagttgaagggattgaattacgaagagtatcggaggttgaagagacacaaattgcggaagactttgaagtgttgtatttggagagctactcccagtcctccacctgacgagggatgggatgacggagaggaggaggaagaagagaaggtagaagagaaggttccgccaattcaggagaagaagaaaatcaaagatcgttccttttcgaataaagtgggcaagcgtgtagattctttttcggactcctcagactctgagtcgtcccagaataaatcagaggaggaaaggaaaagcaagaagagaaatcgccgcaggtctttgtcagatgatgaagatgatcgtaagaagagggggaagaagaggagaaatgatcgccagaggaagagtaaacgttctcataaacacggaagaaatagtagaagaacttcttcttatgatagttcggattattctgaagaagaagatacaaagaagagaagaaatagtagaagtaagacgaaaaggagtaataataagaagaaaattaggatttctgaatcagagagctccaccgatgatcaatcttcctctagctattcgtcctatcgatccagcgagtcaggggctaagatgaaaccatctaaacgggttgagaaggttatgattaatgggcaaggagattccttatgtctagataatgtttcagattctcaaatgggagaaaagattacgcaggagaaggatgaatccaaatcggttgtgtttgctggagttcttgaactgtcacaaaagcaaactgatgttgatattgatgatgacgatgattctgttgttggtccaatgccacttccgagagctgagggacatataagctatggtggtgcacttagacctggtgagggtgatgctatagctcagtacgtgcaacaaggaaagcgtatcccacgaagaggtgaggttggtttgtctgctgatgaaatccagaaatttgagaatttgggatatgtgatgagtgggagtaggcatcaaagaatgaatgctattcgtattaggaaggaaaaccaagtttatagtgcagaagataaacgtgcattggctatgtttaattatgaggagaaggctaagagagagcagaaggttatggttgatttgcaaagattggttcagaggcatattggacaagatgttggtcctactcacgatccattcgcttcgtgagaatcatcacaatgggcttttgagggttaagtgattctgttgaagcagaaaaatgaataattggaggaaagaaggctagctaaattccctttttccatggtgtgtatctgttaattgaagcagaaaaaagagaggatggaggaaagaaatgttcaaaattccaatggtaccgaaggcttagttatatttgtttgtattttttaaattgtattagggcgtggcttcttgataaaaaatttaccttttttagtttctactgttctagtactacttgtcttagttgtctacctgtttgtattttttaaaacatataatgtatttttccttaaatatttatgttattttcacgaatttct

SEQ ID NO: 5476 - DNA, 1893 bp, Pseudotsuga menziesii
cccagatccatcgaggtacgaacgtgaccgttacctctccagcaatggtaagagatcgacttccccttccccttcccgttcacgtgtttgttatagcaaagcactaagtccaagctccagggtttctgatcattattacagtccaaatgagattcttgatgaaaaccccaggagaggggcagacaaccttcggtatgaaagaaggcgcagcaggagccctgatttaaaatatgatccaaggcccaatccgaacctcagccatagacagagtttcgaggaccgaagttctaaccctcctccgcgacataacaatggatcctatgacaggcgccggagtccaaaccctaatgacagacgccggagtcctaatcctaatgacagaggccggagtcctaacctaattgacagacgtcagagtcctaaccctaataacagacgccggagtccaaaccttaattttgacaatgagcagcaacatcgggatcgaagggcgagtcccagttatcatccttacgacccttctactgggaatcgtcccccagcatttctagacagaggcgatgctcagcgtgggcgtgggaatggacaggtcgagagtgatgacgaggatgaggatttgaaggcggtggatttcgcggagtatcggagattgaaacggcagaagcttagaaagaaactgaagaattgcatatggagaatcacccctagtccgccccgggacgaaattgaacaggcggtggctaggcagacgatggataatgaggaaggtgggcatggggtaatgtttggcaatgttggtagggctattgaaagcaaagaagaatcccatggaagatcatccaaggggggtaaaggggatgatggggatgcttctcgcagcaaagcttctgaagacagcggaaagaaagcaggggatttaatgaagaaaaaaggcgggcgtaggaaatcaaagcattctggcaagagcaggaagaggagatctattagcgtgaaagaatatagcgaggatgatagtgatagtgtatcagaggatgactcgtcctcgtactccagtgagaatgaaaagctgaagaagcaaacgaatcgacgaagtaacagacatgaaaagcaaaagaaatcggggaagagaatgcctggatctaaaagatcacgggttaaaagttctgaagatgaagaaaagtctgaaacccattctgagattcatgtctcatcggatgattctttagaacttgaatctatcaagcatgaggagagagcagctgacgatgaccctgtggaaatagacaatgaagctctcaggttcaaagagatgattgaatctcagaaaagagtagcggcaggacttgagaatgaaccgattgtggggccacttccacttccaaaagcagaagggcacataggctatggaggagcactccggccaggagaaggtgatgcaattgcacaatatgtccaacaaggaaagcgtattcctcgaagaggagagtcgggcttctgccgatgagattcaaaagtttgagaccctgggctatgtcatgagtggaagcaggcatcaacgaatgaatgctattcgtataagaaaagaaaaccaagtgtacagtgccgaggacaaacgagcattggcaatgttcaattatgaggagaagtcaaaacgtgaacacaaggtcatgtcagatcttcagcgcttggtacagaggcacattgggcaagaagttgctcctacgcatgatccttttgcaagcaaggaacctgaagtggcagatggataggataaggtttcttatgagtttgtcatgatcattactatttttttgtaatttcatcggtttattatattcaatgcgatgtgctaagctgtgtattttgcatgaggacaacatttacaatgtcttt

SEQ ID NO: 5477 - DNA, 1997 bp, Oryza sativa
tccacacttcttcccccacgcgtgacgcgtccaacccgatctctattctctagcttccccaaatccccaatccgacctaagccggcgatccgccgccatgggtcgcacggagggccgcctcgcgtccgtggtgcacctccccggccgctccagggtctccgcctcgccctcccctcgccgccgccgctccccgtcccggtcgccctccccgcgccgcaaccgccgccgcgaccggtcgcctagcccctaccgcagccgcagggaccggtcccctagcccctaccgcgaccgccgccgccagtggtccccctaccaccgcgaccgtggccgcgacgtggagagggagtgggctcgggaccgagaccaccctgcgccccgtcgcggcggcggcggcgcgggggccggcgcctggtccgcctccgacgatgacgacgacgagcagctcaagggtctcacctacttcgagtaccgccgcgtcaagagagagaagctccgcaagagcatgaagcggtgcatctggaacatcacgcccagccctcctcgccgcgaaggtgaggatgaggattatggctacagcgacgaggaggaggaggaggaggagaaaaaggaatcgccaaagaaggtggcctcctcggataagagcgaagaggaggatagcaagggttcgtcggaatccgactccggtgagtctgatagcttgtccgattccagcaaatcagatgatacccggaggaagaagaaagggcgtaagggtagtcaccgtagcagcaagcgtagccgccaccgccgccgccaccattcatctgatacagagggtgacgacaacagcaaggctgaggaggattcggagggctcttatgattccgaggactctatggataggaggaagaagaagagatcgcggaggcacaagaagtctaagaggaggggaaggagctccaggaggaagaagaggaagagcaatgatacagcttctgagggaagctctgaggaggaggcggtggcagcggcttcaggatcaagccctagccccttgagggacagtaagaagaagagccggagctcacggaggaagaggagcaagcagtctgattcggaagatcaggccccatccgatgccgaccttggtgttaaggaaatcgatgagacaaatgagccagagattgacccagaagcaatcaaattcaaggaaatgctcgaggcccaaaagaaggctgctttggagaatgagatgccggttgggccaatgcctcttcctcgtgcagaaggtcatattagctatggtggtgcactgagacctggagaaggtgatgctattgcacagtacgtacagcaagggaaacgtatcccacgacgtggtgaggttggtctatctgcagaggagattcagaagttcgaggatttgggctatgtgatgagtgggagtaggcaccagaggatgaatgctatccgtataaggaaggaaaaccaggtttacagtgcagaggataagagggcgcttgctatgtttaattatgaggagaagtcgaagcgagagcacaaggtcatggctgatttgcagcgcttagtgcaaagaaccattggaaatgatgtaggaccttcccatgatccatttgctacagcggatggctgagtaaggatttatagctgttatacaatgaatgatcaccactatttccttttctttttatgatccctatagtataggtcatgatctctaagatgccagttagtgctgtggatatcttcacagacattgcacttgaaccgtactattagaacttatttgtaatttctgttttgtgttgagtattgactacttgtgatgcttatcctacttgttctgtttgttcttgtcttttgcttctatgtttgtcgagctacttgagtgcttgatttgcaaatgattctcattggaatgcttgcagatattagttttaccaatattcttcagacatttggttgagaattgagattgattaaatagattttggatc

SEQ ID NO: 5478 - DNA, 763 bp, Saccharum officinarum
cgatctgattcgaaagaatcagtcctttctgatgccacccgtgatgatgtagaagaagttgaagaaacaaaagttccagaaattgatccagaagcaatcaagttcaaggaaatgcttgaggcccagaagaaggctgccttagagaatgatatgcctgttggtccaatgcctcttccacgcgcggaagggcatattagttatggtggtgcattgaggcctgaagaaggtgatgctattgcccagtatgttcagcaagggaagcgtatcccacgacgtggtgaagttggtctgtctgcagaagagattcagaagttcgaggatttggggtatgtgatgagtggcagtaggcaccaaaggatgaatgctatccgtatcaggaaggaaaaccaggtttacagtgctgaggataagagggcattggccatgtttaactacgaggagaagtcgaagcgggagcacaaggttatggctgacttgcagcgcttggtgcagagaaccattggccacgatgtgggaccttcgcatgatccatttgctactacggatggttgagtaatgatttctggatcaactaatcacctatatcatgtgtgctttacctgtttgtgtttccttccctctgttgtagttagtgatattgaacttgcctagttatgctgcaaatttcttatgagatattgcatgagaaccatagtaaaaaagagcttattgttaacttgtatcttgtatgggcaatatttttgttaagatggttcgatgtgct

SEQ ID NO: 5479 - DNA, 1179 bp, Panicum virgatum
  misc_feature (708)..(708): n is a, c, g, or t
  misc_feature (939)..(939): n is a, c, g, or t
tccccaaagaagaaggactcgccggaggcgagcgaggaggacagcaagaactcctcggggtcagagtctggtgagtctgatagcctatccgaatccagcgaatccgagtgttctaggaggaagcggaaagggagaaagagcagtcgccgtagtagcaagcggagtcggcgccgccatcgccgtcgttcatacaattctgagagtgatgtggaaagcgagagcaacgctgatttagagggctcgtttgattctgactctagggataggagcaagaagagatcgcggaggcacacgaaatctaggaggggtaggagctccaggaggaagaagaagagccatgatacagcatctgagcaaagctccgaggaggcggagcattctgaccatagcgccagggacagtaacaaaaagagtaagagctcaaagaggaagaggagcaagcggtcagactctgaagaatcactaccttctgatgccaatcctgatgttaaggaagatgaagaaataaaggagccagtcattgatccggaagcaatcaagttcaaggaaatgcttgaggcccaaaagaaagctgccttggagaacgatatgcctgttgggccaatgcctcttcctcgtgcagaagggcatattagctatggtggtgcactaaggccaggtgaaggtgatgctattgcacagtatgttcagcaaggcaagcgtattccncgacgtggtgaggtcggtctgtctgcagaggagattcagaagtttgaggatttggggtatgtgatgagtggaagtagacaccagaggatgaatgctatccgtatcaggaaggaaaaccaagtttacagtgctgaggataagagggcgctggctatgtttaactatgaggagaaggcgaagcgggaacataaggttatggctgacttgcagcgcttggtgcagagaaccatnggcaatgatgtggggccttcacatgatccgtttgccactactgatagctgagtaatgatttcccgatcttctacaattaaaatggtcacctgtgttgttaggcatgctttacctgtttgtgattccttgcctgcgttgtaagtagtgatgaaatagtcacttccctagctatgctgcagtactcttatgcggatattactcatggaaccttagtaagaaaagagcttattgttagcttgt

SEQ ID NO: 5480 - DNA, 719 bp, Ipomoea batatas
cattgggaaatgaagttacgagcgaggttcttgaattaaaagaattgattgagtcacggatgaagcctcctatggatactgagctcatagttggccctatgcaatgccaagaactgatggacagccggttaactatggtggagcacttaggcctggtgaaggtgatgctattgcccagtatgttcagcaaggaaaacgtattccccgtagaggagaagtgggtctttcagctgaggagatttcaaagtttgaaagtcttggatatgtgatgagcggtagtaggcatcagagaatgaatgctatccgtatcagaaaggaaaaccaagtttacagtgctgaggataagcgggcattggctatgtttaattacgaggagaaggctaagcgtgaacagaaggttatggctgatttgcagcgcctggtgcaacgtcatattggccctgatgttggtccatctcacaatccgtttgctggggttgctggaagatccgctgacatggctgatgcttgatgcttgtgtataattaccattctactatagctactaatatattgtggctctgcaaactggtttcattcgatgcacaagtctgaattttattagcttacaatcctctccccctaatgaatttagcaaacagtattttatgtttcatctatttctgcatttcagaactttaatatccttgattgaatttgtaatggcactataatggctt

SEQ ID NO: 5481 - DNA, 925 bp, Sarracenia psittacina
ttctaagtagacgttaccgagacaactgagatcaatatgaagtgcttatattcaaagaggaatgaattgaatcacgaaataaacctagccgttggagaatgaaccagtggttggaccaatgccattgcccagagctcaaggacacattagctatgaggggcacttagacctggcgaaggtgatgccattgctcagtatgttcaacaaggaaagcgtatcccgcgtagaggtgaagtgggtctttcagccgaggagattcagaagtttgagagtcttgggtatgtaatgagcggtagtaggcatcaaaggatgaatgccatccgtattaggaaagaaaaccaggtttatagtgcagaggacaagcgggattggcaatgttaactagaggagaaggccaagcgtgaacagaaggttatggctgatctgcagcggcttgtgcagcgccacattggacaggatactggcccttcccatgatcctttcgctgtaagggagggcgctgatgcttaataggtcatgtatgttcactatttttattttgtttaccttttttatctgggaaaattagtgagaagttgtttttggtttttttacatatttttttaacgcgcaagattcatatataaatttatgtattgatcacttatgtatatttggatgaaactgatacatttatgtatttatctgtttcaatcaaacatatacatttatttactgatattgcgcttattgttagaagagataaatttatctatggatcttacggatttaaaactttttttcatggactttgcgcgtttaaaacttttaattatgctactttcggctgaaaccccttctcttccttttgtgttctatgcctatttggatgtggagaatatacatggttctaagttgattagttgaacctatacatgcttactaa

SEQ ID NO: 5482 - DNA, 1579 bp, Setaria italica
cgcggtgacggcgggggcgcctggtctgcctccgacgacgacaacgacaaggaactccagggcctcagctacttcgagtaccgccgcatcaagcgccagaagctccgcaagagcaagaagcggtgcatctggaacataacgcccagcccaccacgtgccgagggcgacgacgagaactacggttacagcgacgtggaggaggagaagaaggaatccccggagaagaagagctcgccggaggggagcgaggaggacagcaaggatgcgtcggggtccgagtccggtgagtccgatagcctctctgagtccagcgaatccgagggttctaggaggaagaggaaagggagaaagagcagtcggcgtagtagcaagcggagtcggcgccgtcatcgccgtcgctcataccattctgagagtgaggacgaaagcgtgagcaatgatgattcagagggctcgttggattctgaggactctagggataggaggagcaagaaaaggtcgcggaggcacaggaaatctaggaggggtaggagctccaggaagaagaagaggagccaggatacagcatctgagcaaagctccgaggaggcagagcattctgatcctagccccagggacagtaagaaaaagagtaagacctcaaagaggaagaggagcaagcggtcagactctgaagaatcattaccttctgataccaatcctgatgttaaggaagatgatgaagaaataaaggagccggaaattgatcccgaagcaatcaaattcaaggaaaggcttgaggcccagaagaaagctgccttggagaacgatatgcctgttgggccaatgcctcttccccgtgccgaagggcacattagctatggtggtgcactaaggcctggtgaaggtgatgctattgcacagtatgttcagcaagggaagcgtattccacggcgtggtgaggtcggtctgtctgcagaggaaattcagaagtttgaggatttggggtatgtgatgagtggaagtagacaccagaggatgaatgctatccgtatcaggaaggaaaaccaagtttacagtgctgaggataagagggcgctggctatgtttaactacgaggagaagtcgaagcgggagcataaggttatggctgacttgcagcgcttggttcagagaaccattggcaatgatgtggggccttcacatgatccatttgctactactgatagctgagtaatgatgtcccaatcttctataatgaaatggtcgcctgtgtgtgttaggccttgtttggataaacctattccctctcaatacacatggattggggtggaaaatgaaataatttccctgtcaatgtctcctaacatctatctattagaggagattatgaataatccaaacaaagccttacgcagatagtacacttgaaccttagtcaaaaagagcttattgttagcttgtatttctgtattggctatgttttgtaatatggttatccttccatgtgcttatgttttctattattatggtttcaagctgctcggtttttaacatgatccttggcagattgcttgcaaacatagggtacctgaacttt

SEQ ID NO: 5483 - DNA, 1931 bp, Setaria italica
atccccgacgcaaccctcgcgtcgccgcacaaatccccatccccccactccgatccggcgatccgccgccgccatgtcccgctcggagcggcgcctcgcctccgccgtggtgcgcctccctggccgctcaagggtctccgcctccccatccccgcgccgccgctccccttcccctcccccccgccgggaccgccgccgcgaccgctcccccagcccataccgtgaccgccgccgcaacgaccgctctcccagcccttaccgcgaccgtcgccgcgacgaacgctcccccagcccgtaccgcgaccgccggcgccagtggtcgccctaccacaacgaccgcggccgggaccgcgaccgggctccccccttccgcggcggcggtgacggcgggggcgcctggtctgcctccgacgacgacaacgacaaggaactccagggcctcagctacttcgagtaccgccgcatcaagcgccagaagctccgcaagagcaagaagcggtgcatctggaacataacgcccagcccaccacgtgccgagggcgacgacgagaactacggttacagcgacgtggaggaggagaagaaggaatccccggagaagaagagctcgccggaggggagcgaggaggacagcaaggatgcgtcggggtccgagtccggtgagtccgatagcctctctgagtccagcgaatccgagggttctaggaggaagaggaaagggagaaagagcagtcggcgtagtagcaagcggagtcggcgccgtcatcgccgtcgctcataccattctgagagtgaggacgaaagcgtgagcaatgatgattcagagggctcgttggattctgaggactctagggataggaggagcaagaaaaggtcgcggaggcacaggaaatctaggaggggtaggagctccaggaagaagaagaggagccaggatacagcatctgagcaaagctccgaggaggcagagcattctgatcctagccccagggacagtaagaaaaagagtaagacctcaaagaggaagaggagcaagcggtcagactctgaagaatcattaccttctgataccaatcctgatgttaaggaagatgatgaagaaataaaggagccggaaattgatcccgaagcaatcaaattcaaggaaaggcttgaggcccagaagaaagctgccttggagaacgatatgcctgttgggccaatgcctcttccccgtgccgaagggcacattagctatggtggtgcactaaggcctggtgaaggtgatgctattgcacagtatgttcagcaagggaagcgtattccacggcgtggtgaggtcggtctgtctgcagaggaaattcagaagtttgaggatttggggtatgtgatgagtggaagtagacaccagaggatgaatgctatccgtatcaggaaggaaaaccaagtttacagtgctgaggataagagggcgctggctatgtttaactacgaggagaagtcgaagcgggagcataaggttatggctgacttgcagcgcttggttcagagaaccattggcaatgatgtggggccttcacatgatccatttgctactactgatagctgagtaatgatgtcccaatcttctataatgaaatggtcgcctgtgtgtgttaggccttgtttggataaacctattccctctcaatacacatggattggggtggaaaatgaaataatttccctgtcaatgtctcctaacatctatctattagaggagattatgaataatccaaacaaagccttacgcagatagtacacttgaaccttagtcaaaaagagcttattgttagcttgtatttctgtattggctatgttttgtaatatggttatccttccatgtgcttatgttttctattattatggtttcaagctgctcggtttttaacatgatccttggcagattgctt

SEQ ID NO: 5484 - DNA, 2099 bp, Cucumis melo
cattccctctcttctccatcttcacaccctcccgacgttcttcttctctgttcttccgttcaggtacgattcttcgttagcaatcctctacttatttgcaatcatgaactctttcaataattagagatagtagttatataaagtaaattctcgagctagaatcgacggccgagagacgaattcaacctttgttttgtatacgattttcaaaacaatcaaatgggtaggctaggatctactgtagaaattccagaaagaagacatcgatctgatcgagaaaatggtactcatcgttactctccggactccgatgcttcgcgtggcgattaccgacgacgtcgtagccctagctacgaaagttacgatcgatacaataatcgtcgtcgatctgtttcgcctggctacgagaatgttagacggagccctagggctgatggagatcaaaacggtttgcccaagagatttgggcgtgctggtggccgggcgtatcttgataggaatgggagagcgtctgatgagtcggattcggatgaggagttgaaggggttgaattatgaggagtatcgtaggctgaagaggcagaagcttcggaagtcattgaagcattgtatttggagagtgacccctagcccaccgaggaatgggaatgaagagtatgaggagaaatatgatgacattttggagaaatatggcggtgatggtgatggtgatggtggagataaaagtgggttgaatgagaaaaagcaacttgaagagaaatatgtctctgataaaactaagaattctgattctgactctgattctgaattatctgatagaaaaacggaaaggaggaaatcgaagagttcaggttccaggcgaagaagtagaaaatcatctcctagtgattcagagtcgtacagcaatacggagagtgaaagtgaaagtgaatcagaggaagaaagtaggaggagaagaaagaaatcgaagagtcggaggagcaggaaacataagaatatcaagagtagtaagaagaagaagagtaggtacagtgatacagaggatagtgaagaaagcgagacagatgattctgatgtcagtgaccatgtcaagtcaagaaaaaggagtcgttcaaagaggtccaagaatagtaggaagaggagatatagtgattcagatgagagtgaggatagtgaaggcgaaaagttgaggaagcggaagagctctttgacttcatcgaaatccaggagcaagagaaaagacagtcagaaacggagagtaagagttgctcttctgctgaggagaattctggttctgaagacattgatgataagagtaaatcaatggttgatggagagaaaatggccgagattaatgctgctgaagctctaaaaataaaggaaattttggaggcacaaaagaaacctgcatttgataatgagatgccggttggaccaatgccactgccaagagctgagggccatattagctatggtggtgctcttaggcctggagaaggtgatgccattgcacagtacgttcagcaagggaaacgtattccacggcgtggtgaagtgggtctttctgctgaggaaattcagacctttgagacgcttggttatgtgatgagcggtagcaggcatcagagaatgaatgctatccgtattagaaaagaaaaccaagtttacagtgctgaagataagagagctcttgcaatgtataactatgaagaaaaagcaaaacgggagcggaaggtgatggatgatcttcagcggcttgttcagcgccacattggtcatgatgttggcccttcacatgatccttttgctgcttaacctcatttggccccatgttgaaatgagatgtgtatgtaatctttcttagtgtatgaagaacatattcattcatacaagaatatatgaattactgctatgttctttgacatatgttgcagagatcccttttatcttattaatcttataaggttgtatttatagactgatagtagagtttgatggcatggtacagatctttctattgacttttgagagaattgtttagagttttcaatttccttgtaggataaagtttcaatgatcacaatgagttgcttcacctgt

SEQ ID NO: 5485 - DNA, 1368 bp, Pennisetum glaucum
ggttacagcgacgtggaggagaagaaggaatctccgaagaagaagagttcgccggaggggagtgaggaggacagcaaggatgcgtcggggtctgagtctggtgagtctgatagcctctctgagtccagcgaatcggagggttctaggaggaagaggaaagggagaaagagcagtcgcagtagcagcaagaggagtcggcgccgtcatcgccgtcgctcatattctgagagtgaggatgaaagcgagagcaatgatgattcagagggctcgttggattctgaggactctagggatagaaggagcaagaaaaggtcgcggaggcacaagaaatctaggaggggtaggagttccaggaagaagaagaggagccaggatacagcatctgagcaaatctctgaggaggcagagcattctgacccttgtcccagggacagtaagaaaaagagtaagacctcaaagaggaagaggagcaagagatcagactctgaagaatcattaccttctgataccaatcctgatgttaaggaagatgatgaagaaataaaggagcctgaaattgatccggaagctatcaagttcaaagaaagccttgaggcccagaagaaagctgccttggagaatgatatgcctgttgggccaatgcctcttcctcgtgcagaaggccacattagctatggtggtgcactaaggcctggtgaaggtgatgctattgcacagtatgttcagcagggcaagcgtattccacggcgtggtgaggttggtctgtccgcggaggaaattcagaagtttgaggatttggggtatgtgatgagtggaagtagacatcagaggatgaatgctatccgtatcaggaaggaaaaccaagtttacagtgctgaggataagagggcactggctatgtttaactatgaggagaagtcgaagcgggagcataaggttatggctgacttgcagcgcttggtgcagagaaccattggcaatgatgtggggccttcacatgatccgtttgctactaccgatagctgattaatgattttccaaacttctataatgatgaaatggtcgcctgtgtgtgttaagacttgtttggataacccattcttctcaatacacatggatcggggtggaaatgaaataatttccctgtcaatgcctcctgattcctatcgattggaggggcttctggagaatccaaacaatgccttatgcaggtagtacagttgaaccttagtaaaaaggagcttatcgttagcttgtatttctgtattggctatgttttgtaacacacttatccttccatgtgcttatgttttctattattatgttttccagctgctcgttttttaacaagatccttgcagattgctt

SEQ ID NO: 5486 - DNA, 716 bp, Catharanthus roseus
acccggtgaaggagatgctattgctcagtacgttcagcaaggcaagcgtatcccacgaagaggagaggtgggtctatctgctgaggagattcagaagtttgagagtcttggttatgtgatgagtggtagtaggcatcagagaatgaatgcaattcgtataagaaaagaaaaccaggtgtacagtgcagaggacaagcgtgctttggccatgtttaattatgaagagaaagccaagcgcgagcagaaggttatggctgatttacagaggcttgtgcagcgacatatcggccaggattctggtccttcccatgatccttttggtggaaggtcttccgaggtgcctgaagcctgatctgaagcactcgagcttttagaagcatgatgaaagaacaaagttgcttaatgggctggcttatggactctccacgcaggaaattgattgcatttgccaattagaattaaagttgaaaggtccgaatgagctggtaaacatgctaaaccagtgatgttatgagggctgtagaacaagataaatttggtttagaactgatatctattatcaactagaactccggaaaactgttgctctgtatcattttcttgcacattacttgatttacttatcttttggtggataaccaaaaaaaggaaaaaaaaaagagatgccttttgattgatccaccttgcaactgattgccatgaaaagattgatttgc

SEQ ID NO: 5487 - DNA, 750 bp, Eucalyptus grandis
ggtgatgctattgcgcagtatgttcagcaagggaagcgtatcccgcggagaggtgaagtcggtctttctgcagaggagattcagaagtttgagggtcttgggtatgtgatgagtggtagcaggcatcagaggatgaatgccatccgtattaggaaagaaaaccaggtttatagcgctgaggacaagcgtgctttggccatgttcaactatgaagagaaggcgaagcgtgagcataaggtcatggctgatttgcagcggttggtgcagcgtcatattgggcaggatattggccctactcatgatccttttgctggaaaagctgctgatggtcctgaggcttgataaacatggatcggtgattctatgacagggcttccttgacgacggtgatgctgctaagatccgtgctttgtcttatgaagctgttctcactcttcgtgatagcgtgtatatctcgacgggaatgatcaagcattgagcagcagcgtacatcatacggaaactgtctgcttcactagattgtcataatatatttcttttggctagtttttgtttttggctagtatggaaggaaataatcaaccaacgtttcagcagtcggcaacaatatttgatgtccccttcccttttatgattttggcattcgatcctcttaaaacacccggccgatctcatccggtcacgagtctccccccaccaccggtgacgggaaactatcaggccactggaggcggttctgttcgttgggct

SEQ ID NO: 5488 - DNA, 709 bp, Marchantia polymorpha
tttaggcctggtgagggagatgctatggcccagtacgtgcagcaagggaaacgtatccccaggagaggagaagtgggactgtctgcagacgagatctcgaagtttgaagatctaggttacgtgatgagtggttcccggcatcagcgaatgaacgccatccgtatccggaaagagaaccaagtgtacagtgcagaagataaacgtgctctagctatgttcaactacgaggaaaaagcaaagcgtgaacacaaagttatgtcggatctccagcgtctggtgcagcgtcatattggtgctgatgtgggcccaacccacgatcctttctccaccactaaagcaaataatggggaggctacggaggcatgacaagtaaagacaactctggagggttgcattttttccagaggataagattgaacaatgtggagctctagcacggacagatgggaaaactttcaactgatttgtcgcaacctcatatgttactcgcgtgaagaatggaatatgtacttcaaggaaatactagtcatgtggagctggttgcgtaagcagggtgaagacgggaaaggagcatcttgacagagtctattttgctccttcaaatacgcactgccctgccaactctagctgcgtgcaccagatatttggcccctgtatataatattcacgtcgagtctcgaagtgttctgcatggtgttcttgtgctgag

SEQ ID NO: 5489 - DNA, 1589 bp, Brassica rapa
  misc_feature (395)..(396): n is a, c, g, or t
  misc_feature (400)..(400): n is a, c, g, or t
  misc_feature (403)..(403): n is a, c, g, or t
  misc_feature (407)..(407): n is a, c, g, or t
  misc_feature (720)..(720): n is a, c, g, or t
gtggctcaaacgctagacatagctatccctcctccgcgccctaaacgaaaaccaaacaatccttatcctagaaagaccggaactggatctctccccatctcaaaaccgggtctgaatgatggaaaagagtcccttggatcaggaaaagtttcgcttcctgagacgaccaatgaagatctgcaggaagacaactgctcagactgtctcactcatcaacacctctctgctgcatcaaacgcaagcacttttctagagttcttaccttcacgggaacaggaacaggggaataacaaggagtcaaactcagccaattacagtgaacctcagacttatccaaggcatatccctctgctagttccattggggagctccataacaacctctctgtcacatgnncctnctncagntccagacgagaacagtcatcatccccacacagtttcaggccatcatcagtcctttcctgaccatatcatgtccacccttttacaaacaccagctctatacacagctgcatctttcgcctccacgtttggtggcggcggcccacaagggaacttagccgccatggctgcagccaccgttgcagctgcaagtgcttggtgggccgccaatggaatgctacctctctgcgctccttttagctcaggcggtttgacctgtcaccctccagctactgcttatggaccttccggtgaagtagaccacacaaaaacagtngatcaagaacactctgaggcttcaaaggctagatcttcgttggaatcagaggaggctaaaaatgggagtaaaccagattgtcatcatcatccttgtgcagcgaccgagactgatgcaaagggatcagatggagcgagggacagaaagcaagttgacaggtcttcttgtggctcgaacactccttcgagtagtgacgatgttgaggctgatgctttggtggagaggcaagagaacggtggtaccaccaatgaggaagtgaaagaagtggatggggacactactaacaatccacaaacttcagagtctaatgcgcgacgcagtagaatcagtagctctaacttagctgatccatggaagtctgtttcagatgagggacgaattgcttttagagctctgtttgcaagagaagtgttgccacaaagttttacatataagagagaggagggtcaacaacaaagatatccaatggagcttgatcttaactcagcagctgatgatcaagaagagaacagaaacatagcgtttttgggtgcttcaaagcagcagctattaagtagaggaaggacaggtttcaagccttacaaaagatgttcaatggaagctaaagaaagtagagtcatcagcaacaccaatcctatcatcagtgttgaacagaaagatcctaagcggattcggttggaaacacaaacttcaacatgaaaaaaagttgtaactctattattatatctgttgtttctctattttcattcaagtttcaaagatcactgatacattttcttctgtttttgagggcctgtgtattttgtccatagtcttcttgtaacgtttgactctgtattatcaaacaaatcataatctgtttaatttct

SEQ ID NO: 5490 - DNA, 1267 bp, Brassica napus
ctgctgcatcaaacgcaagcacttttctagagttcttaccttcacgggaacaggtaaaaattacattgctatttgagggtttaagagtattagtacttttcatgaaactataatgtgagggaaggaacagggaataacaaggagtcaaactcagccaattacagtgaacctcagacttatccaaggcatatccctctgctagttccattggggagctccataacaacctctctgtcacatgctcctccttcagatccagacgagagtagtcatcacctccacacagtttcaggccatcaccagtcctttcctgaccatatcatgtcgtctcttttacaaacaccagctctatacacagctgcatctttcgcctcaacgtttggtggcggcggcccacaagggaacttagccgccatggctgcagccacgttgcagctgcaagtgcttggtggccgcaatggaatgctacctctatgcgctcctttacttcaggtcaccctccagctacttatgaagtaaacgccgtcacaaaaacagtggatcaagaacactccgaggcgtcaaaggctagatcttcgttggactcagaggaggctaaaaatgggagtaaaccagattgtcatcatcatccttgtgcagcgaccgagactgatgcaaagggatcagatggagctagagatagaaagcaagttgacaggtcttcttgtggctcgaacactccttcgagtagtgacgatgttgaggctgatgctttggtggagaggcaagagaatggtggcaccaccaatgaggaagtgaaagaagtggatggggacactactaacaacccacaaacgtcagagtctaatgcgcgacgcagtagaatcagtacctctaacttagctgatccatggaagtctgtttctgatgagggacgaattgcttttagtagctctgtttgcaagagaagtgttgccacaaagttttacatataagagagaggagggtcaacaacaaagatatccaatggagcttgatcttaactcagcagctgatgatcaagaagagaacagaaacatagcgtttttgggtgcttcaaagcagcagctattaagtagaggaaggacaggtttcaagccttacaaaagatgttcaatggaagctaaagaaagtagagtcatcagcaacaccaatcctatcatcagtgttgaacagaaagatcctaagcggattcggttggaaacacaaacttcaacatgaaaaaagttgtaactctattattatatct

SEQ ID NO: 5491 - DNA, 1392 bp, Brassica napus
gatgcaaaagagtcccttggatcagcaaaagcttctcttcctgagacgaccaatgaagatctgcaggaagacaactgctcagactgtctcactcatcaacacctctctgctgcatcaaacgcaaggacttttctagagttcttaccttcacgggaacaggaacaggggaataacaaggagtcaaactacagtgatttgaatatagaggcaggaggacctcacacttatccaacgcatatccctctgctagttccattgggtacaacctctctgtcacatgctcctccttcacagccagacgagaatagtcatcagtcctttcctgaacatatcatgtcgacccttttacaaacaccagctctctatacagctgcatcttttgcctcaacgtttggtggcggcccacaagggaacttggctgccatggctgcagccaccgttgcagctgcaagtgcttggtgggccgccaatgggatgctcccactctgcgctcctccttttagttcaggcaaccctccaactacttatgaaagaaacgccctcacaaaacaatggatcaagaacactccgaggcttcaaaggctcggtcttcgttggaatcagaggagactaaaaatgggagtcaaccagattgtcatcatcatacttgtgcagcgactgagactgatgcaaagggatcagatggagctagagatagaaaacaagttgacaggtcttcttgtggctcgaacactccctcgagtagtgacgatgttgaggctgatgctttggtggagaggcaagagaatggtggcaccaccaatgaggaagtgaaagaagtggatggggacactactaacaacccacaaacttcagaatctaatgcgcgacgcagtagaatcagtagctctatcttagctgatccatggaagtctgtttcagatgagggacgaattgcttttagagctctctttgcaagagaagttttgccacaaagttttacatatcagagagaggagggtcaacaacaaagttatccaatggagcttgatcttaactccacagctgatgatcaagaagagaacagaaacatagcgtttttgggtgcttcaaagcagcagctaagtagaggaaggacaggtttcaagccttacaaaagatgttcaatggaagctaaagaaagtagagtcatcaacaacaccaatcctatcatcagtgttgaacagaaagatcctaagcggattaggttggaaactcaaacttcaacatgaaaaaagttgtaactcttattattacatctgttgtttctctgttttcattcaagtttcaagatctcactgatacaatcttcttctgtctttgaggcatttgtattttgtccatagtcttcttgtaacgtttgactctgtatta

SEQ ID NO: 5492 - DNA, 1529 bp, Brassica rapa
  misc_feature (150)..(150): n is a, c, g, or t
  misc_feature (268)..(268): n is a, c, g, or t
  misc_feature (271)..(271): n is a, c, g, or t
  misc_feature (352)..(352): n is a, c, g, or t
  misc_feature (373)..(373): n is a, c, g, or t
  misc_feature (551)..(551): n is a, c, g, or t
  misc_feature (574)..(574): n is a, c, g, or t
  misc_feature (605)..(605): n is a, c, g, or t
  misc_feature (607)..(607): n is a, c, g, or t
  misc_feature (877)..(877): n is a, c, g, or t
  misc_feature (880)..(880): n is a, c, g, or t
  misc_feature (919)..(919): n is a, c, g, or t
  misc_feature (928)..(928): n is a, c, g, or t
  misc_feature (934)..(934): n is a, c, g, or t
  misc_feature (946)..(946): n is a, c, g, or t
  misc_feature (949)..(949): n is a, c, g, or t
  misc_feature (955)..(955): n is a, c, g, or t
  misc_feature (982)..(982): n is a, c, g, or t
  misc_feature (1240)..(1240): n is a, c, g, or t
  misc_feature (1243)..(1243): n is a, c, g, or t
  misc_feature (1255)..(1255): n is a, c, g, or t
  misc_feature (1270)..(1270): n is a, c, g, or t
  misc_feature (1276)..(1276): n is a, c, g, or t
  misc_feature (1279)..(1279): n is a, c, g, or t
  misc_feature (1288)..(1288): n is a, c, g, or t
  misc_feature (1294)..(1294): n is a, c, g, or t
  misc_feature (1297)..(1297): n is a, c, g, or t
  misc_feature (1321)..(1321): n is a, c, g, or t
  misc_feature (1330)..(1330): n is a, c, g, or t
  misc_feature (1351)..(1351): n is a, c, g, or t
  misc_feature (1361)..(1361): n is a, c, g, or t
  misc_feature (1363)..(1363): n is a, c, g, or t
  misc_feature (1424)..(1424): n is a, c, g, or t
  misc_feature (1452)..(1452): n is a, c, g, or t
  misc_feature (1460)..(1460): n is a, c, g, or t
  misc_feature (1463)..(1463): n is a, c, g, or t
  misc_feature (1466)..(1466): n is a, c, g, or t
  misc_feature (1476)..(1476): n is a, c, g, or t
  misc_feature (1485)..(1485): n is a, c, g, or t
  misc_feature (1489)..(1489): n is a, c, g, or t
  misc_feature (1497)..(1499): n is a, c, g, or t
  misc_feature (1503)..(1503): n is a, c, g, or t
  misc_feature (1505)..(1505): n is a, c, g, or t
gagagctgatcggcgatcagcagagtcagccaaattagcggtgaacagtcgggaggaagggaagggatgatgatctctcaattcttcgtcctatctcagcgaggagataacatcgtcttccgtgactatcgagctgaggtaccaaaaggnagtacagagacattcttccgtaaggtcaagttctggaaggaggatggtaatgcagaggcaccacctatcttttaatgtcgatggtgtgaactacttccatgtcaaggttgttggtctntanttcgttgccactacgagggttaacgtctcgccttctctggttttggagcttctacaaaggatcgctcgtgttattaaggantacctcggtgttttgaatgangactctttcaggaaaaactttgtgcttgtctatgagttgcttgatgaagtcattgattttggctacgtgcaaactacatcaaccgaggttttgaaatcctatgtattcaacgagccaattttgattgctcctgcacgccttcaacctatcgatcctgctgccatcttcactcaagganccaaaagaatgcctggaacagcngttacaaagtcggttgtagctaatgatcctngnggtcggaggagagaggaaatttttgtggacatcattgagaaaatcagtgttacttttagttcaagcggttatatactgacttctgagattgatggaaccattcaaatgaagagttatctttctggtaatccggaaattcgtatagctcttaatgaagatctaaacataggaagaggtggaagatcagtatatgattacaggagttcttcaggttcaggggtgatacttgatgattgtaactttcatgagtccgttcgtcttgatagcttngantcggatagaactttgtccctggttccaccagatggtgantttccagtnatgaantaccgtatgacncangagttnaagcctccttttcatgttaataccttnattgaagaggccggacgccttaaggctgaagtgattattaagatacgagctgaattcccttctgacgtagttgcaaacacgattactattcagatgccattgccaaattatacttccagggctagttttgagttagaacttggtgcagctggacagaagacagatttcaaggaaaccagcaaaatgcttgaatggagttttaaaaagattgttggcggggctgaacacacactgcgtgcgaagctgacattttcacangantttcatggtaanatcacaaaggaagcngggccngtnagcatgacnttcacnatnccgatgtacaatgtttctaaactncaggtcaantacttgcagatagcaaagaantcaagtagtnanaatccatatcgttgggtgagatatgtgacacaggccaattcgtacgtggctcggatatganctactttcagataatgttttgtcacttntatgtccnacntancttctctttncttctcganaatntttgttcnnnttcngntcatacttgttctaagttctaaga

SEQ ID NO: 5493 - DNA, 1591 bp, Brassica napus
gagacacgagactgatcgaaccaaatcagcggtgaacagtcgggagggaagggaagggaagggatgatgatctctcaattcttcgtcctatctcagcgaggagataacatcgtcttccgtgactatcgagccgaggtaccaaaggaagtacagagacattcttccgtaaagtcaagttctggaaggaggatggtaatgcagaggcaccacctatctttaatgtcgacggtgtgaactacttccatgtcaaggttgttggtctctatttcgttgccactacgagggttaacgtctcgccttctctggttttggagcttctacaaaggatcgctcgtgttattaaggactacctcggtgttttgaatgaagattctttcaggaaaaactttgtgcttgtctatgagttgcttgatgaagtcattgattttggctacgtgcaaactacatcaaccgaggttttgaaatcctatgtattcaacgagccaattttgattgctcctgcacgccttcaacctatcgatcctgctgccatcttcacccaaggatccaaaagaatgcctggaacagctgtcacaaagtcggttgtagctaatgatcctagtggtcggaggagagaggaaatttttgtggacatcattgagaaaatcagtgttacttttagttcaagcggttatatactgacttctgagattgatggcaccattcaaatgaagagttatcttttcggtaatccagaaattcgtttagctcttaatgaagacctaaacataggcagaggaggagcatcagtatatgattataggagttcttcaggttcaggggtgatacttgatgattgtaactttcatgagtctgttcgtcttgatagcttcgattcagatagaactctgtccctggttccaccagatggtgagtttccagtaatgaactaccgtatgacccaggagttcaagcctccttttcatgttaataccttgattgaagaggccggacgtcttaaggccgaagtaattattaaaatacgcgctgaattcccttcagacgtagttgcaaacacgattactattcagatgccattgccaaattatacttctagggctagttttgagttagaacttggtgcgacgggacagaagacagatttcaaggaaaccagcaaaatgcttgaatggagttttaaaaagattgttggcggggctgaacatacactgcgtgcgaagctgacattttcacaggagtttcatggtaacatcacaaaggaagctgggcctgtcagcatgacgttcacaataccgatgtacaatgtttctaaacttcaggtcaaatacttgcagatagcaaagaactcaactagtcaaaatccgtatcgttgggtgagatatgtgacacaggccaattcgtacgtggctcggatatgacctactttcatataatgttttgtctcttttgtatgtccccaagtaacttttctctttcccttctcaataatgtttgttcggattctgatcatacttgttctaagttctaagatgttgttgaggagatgcttcacagtacgaatgttaactcttctatcttatttctctttata

SEQ ID NO: 5494 - DNA, 834 bp, Brassica juncea
tgattacaggagttcttcaggttcaggggtgatacttgatgattgtaactttcatgagtccgttcgtcttgatagctttgattcggatagaactttgtccctggttccaccagatggtgaatttccagttatgaattaccgtatgacccaagagttcaagcctccttttcatgttaataccttaattgaagaggccggacgccttaaggctgaagtgattatcaaaatacgcgctgagttcccttcagacataattgcaaacacgattactgtccagatgccattgccaaattttacttcgagagctagttttgagttagaacctggtgcggctggacagaagacagatttcaaggaaagcaacaaaatgcttgaatggagtttgaaaaagattgttggtggggctgaacatacactgcgtgcaaagctgacattttcacaggagtttcatggtaatatcacaaaggaagcagggccagttagcatgaccttcaccataccgatgtacaatgtttctaaactccaggtcaagtacttgcagatagcaaagaaatcaagtagttacaatccatatcgttgggtgagatatgtgacacaggccaattcgtacgtggctcggatatgatctactttcagataatgtttgtcacttgtatgtcctagtaccttctcttttcttctcgataatatttgttccttttcggatcatacttgttcaagttctaagacgatccttcaccgtacgtatgctgaatgtgctatttggattttctttacacattttttttggtttgttctctacctggaaacatgaatctgaatgcaacatattcc

SEQ ID NO: 5495 - DNA, 712 bp, Amsonia hubrichtii
aacattggaagaggcgggaggtcaatatatgactatggtggttcctcaggttcaggagcagtgatactggatgactgcaatttccatgagtctgtgcatctggatagttttgacgtggataggaccctgagtcttgtcccacctgatggtgaatttccagtcatgaattaccgtataacccaggaattcaagcctccttttcgcattaacactttgatggaagaagctggacagctaaaggcagaagtgattctgaaaatccgtgctgaatttctttctagcgtcaccgcaaacacaattgtagtccagatgcccttgccaaaatacacaacaagagttagttttgagttggaacctggagcagttggacaaacgactgatttcaaggagtctaatagaagattggagtggagtttgaagaagattgttggtggatctgaacatacactgcgtgccaagcttaccttttcacaggaatcacatggaaacattacgaaggaagcgggtcctgtgagcatgacattcaccatacccatgtataatccttccaggcttcaggtgaaatacttgcagatagcgaagaaatccaaaacttacaacccatatagatgggtgagatatgtcactcaggccaattcttatgtcgctcgcatatgataatagaagagccccttcgactctctctctcttttgagccagacacttggactta

SEQ ID NO: 5496 - DNA, 1278 bp, Silene vulgaris
attttggttatatgcaaacaacatcgacagaagcattgaagtcgtatgtattcaatgaaccaattgtggttgatgctgcacgtatgcctgctctcggtcctggttctattttcatgcaagggaacaacagaatgccaggaactgcagtgacaaagtccgtggtggcgaacgagcccggtggtagaaagcgagaggaaatttttgttgatatcattgagaagataagtgtcaccttcagttccagtggttatatattaacgtcagaaattgatgggacaattcagatgaagagttaccttaccggtaatccagaaattaagttagctctgaacgaggatgttaccattggaagaggcggaagttcagcatatggctatagcagctctggatctggtgcagtgatacttgacgattgtaattttcatgaatctgtgcaccttgataactttgatttagacagaactctaagcttggtacctccagatggggagttcccagtgatgaactatcgcatgacacaggagttcaagcctcctttccgtatcaatgctctgattgaagaagctggatcacttaaggctgaagtaatcctcaaaatacgtgctgaattcccatcaactgctactgccaatactattgttgttcaaatgccactgccaacttataccacaagagttagctatgagttggaacctggcgctgttggacagacaactgattttaaggaagcaaataagaaacttgaatggaatttgaagaagattgtaggtggagctgaacataccctaagagcaaagcttacattttcgcaagaattacacgggaatctcacaaaagaagctgggcctgttagtatgaactttacaatacctatgtacaatgcctccaagcttcaggtaaagtatctgcaaattgcaaagaaatcaaaatcctttaatccatatcgttgggtaaggtacgttacccaggcaaattcctacgtagctcgtatatgatacatcgcctattcaatgtgcgataatcggcaatgcgacaccctctctttcgtgttgatgctcatttctctgcatatggctgcttgctagtggagatgtgtaagagaagtatcagagatcgaatggggaatcatgcaaacattacgtcgttttgagtttattatagtggtgtaccatttcacgtagaacatctttattgtgattccaaaacaagtttcgatagatttgataaccaaacttactttcgtcttccatgtaacatgaaaaatttgacaatccaacc

SEQ ID NO: 5497 - DNA, 991 bp, Euphorbia esula
gtcacgttcagttctagtggttacatactgacatccgaaattgatggcaccattcaaatgaagagctatctttctggaaatccagaaattcggttagcactaaatgaggacctgagcataggaagaggcggtgggcgatctgtctatggtatattcgaacttcatcttttcttttccccttataataatgcctaaatggttcaaaatctgacatttcaggattatgaaacatcatttaggattgagttaccatcattagtactatattttcagtcggtgaattcttgtgtttgaagtgactatcttgcttatgctctcaattgctgcttgccattatagattacaggagttcaggtggttcaggatcagtgatacttgatgattgtaatttccatgaatctgtacgtcttgatagttttgagctggacagaactttgtctctggtacctccagatggtgaatttcctgtcatgaactatcgtatgacccaggaattcaagcctccatttcgcattaatactttgattgaggaagcaggagctcttaaggctgaagtgattcttaagatatcagcagagtttccttctagcattacagcaaacacaattactgtacagatgccactgccaaaatatacaaccagagctacatttgaaatggaagctggagcaattgggcagacaacagatttcaaggaagcaaacaagaggcttgaatggggattaaaaaagattgttggtggatctgaacatacattacgtgcaaagctgacatttttgcaggagtttcatgggaatcttaccaaggaggctggaccagttagtatgacattcacaatccctatgtacaatgcatctcgcctccaggtgaaatacttacaaattgcaaagaagtcgaatacgtataatccataccggtgggtgagatatgtgacgcaggcaaattcatatgttgctcgaatatgatatgatacatatgatgatgggatatg

SEQ ID NO: 5498 - DNA, 806 bp, Solanum melongena
taatactggatgattgcaatttccatgaatctgtgcaacttgatagttttgatgtggacaggaccttgactctggttccgccggatggtgaatttcctgtcatgaattaccggataacccaggaattcaagcctccctttcgtattaatactttgattgaagaagctggatcacttaaggctgaagtcatcttgaaggtccgtgctgaatttccgtcggacattactgcaaatactatcttggtacaaatgccgctgcctacatatacaagcagagtaagctttgagttggaacctggagcagttggtcaaacaactgattttaaggaatccaataagaggctcgagtggagtttgaagaaggttgttggtggatcagaccatacattacgtgccaagctaactttttcacaagagtcgcatggaaatatcaccaaggaagctggaccagtgagcatgaccttcacaatcccaatgtataatccttcaaggcttcaggtgaaatatttacaaatcgcaaagaagtcaaagacatataatccttatcggtgggtgagatatgtgactcaggccaattcctatgttgctcgtatatgatggctatcaaggctttttccagcataattcccctcggtctctttctctgaggtgatcttgagttctaaattgtcttttctaattttccttttgggctttcaaatgtttgtactatagattgtctagataatgatggaaaaacaaaaggaggtctctctggtgattctcaatttgaaaattgtgcaactaatggaaaattttgcttgtacg

SEQ ID NO: 5499 - DNA, 712 bp, Raphanus sativus
  misc_feature (136)..(137): n is a, c, g, or t
  misc_feature (144)..(145): n is a, c, g, or t
  misc_feature (210)..(210): n is a, c, g, or t
  misc_feature (582)..(582): n is a, c, g, or t
  misc_feature (652)..(652): n is a, c, g, or t
  misc_feature (674)..(674): n is a, c, g, or t
  misc_feature (688)..(688): n is a, c, g, or t
  misc_feature (690)..(690): n is a, c, g, or t
cagatggtgaatttccggtaatgaactaccgtatgacccaagagttcaggcctccgtttcatgttaataccttgattgaagaggccggacgccttaaggccgaagtgattattaaaatacgcgccgagtttccttnngacatanntgcaaacacgattactattcagatgccattgccaaattatacttccagggctagttttgagttanaacttggtgcgactgggcagaaaacagatttcaaggaaaccagcaaaatgcttgaatggagttttaaaaagattgttggcggggctgaacatacactgcgtgcgaagctgacattttcacaagagtttcatggtaacatcacaaaggaagctgggcctgtcagcatgacgttcacgataccgatgtacaatgtttctaaacttcaggtcaaatacttgcagatagcaaagaactcaagtagtcacaatccatatcgttgggttagatacgtgacgcaggccaattcatacgtggctcggatatgaccttctttcatataataatgttttgtcactttgtatgtcccaagcaacttttctgtttaccttctcnacaatgtttgttcggattctgatcatacttgttccaagttctaagaggtttttgacaagatgcttcacantacatgtcgaatgttaactctnctatcttatttctntntatatatgttcttgttttggtg

SEQ ID NO: 5500 - DNA, 917 bp, Catharanthus roseus
gttatcttaccggtaatccagaaatcagattagctcttaatgatgatttaagcattgaaagaggcgggaggtcaatatatgaatatggtggctcctcaggagcaggagcagtgatactggatgactgcaatttccatgagtcagtgcatctggagagttttgatgtggataggaccctcagtcttgtcccacctgatggtgagtttccagttatgaattaccgtataacccaagaattcaagcctcctttccgcattaacactttgatcgaagaagccgggcagctgaaggctgaagtgattctgaaaatccgcgctgagtttctttctagcatcactgcaaacacaattgtagtccagatgcccttgccaaaatacacaacgagagttagttttgagttggaaccgggtgcaactggacaaacgactgacttcaaggaatcaaatagaagattggaatggaatttgaagaagattgttggtggatctgaacatacattgcgtgcaaagctcaccttttcacaggaatctcatggaaatatcacaaaagaagcaggtcctgtgagcatgacatttacaatacctatgtataatccttcaaggctccaggtgaaatacttgcagatagcaaagaaatccaaaacctacaatccatatagatgggtgagatatgtcactcaggccaattcttatgttgctcgcatatgatgatagaagagcatgttggagaaaatcccatcccatcccatcccatcccccttatatgtcgctctcttacttgataatcttccctctatgattattctctctgttgtattttgcctggattttgccccgtttttgagtgatggacacttggaataactgtaatatttatgtgttagaaacattaatttggcattaccagtagagatttag

SEQ ID NO: 5501 - DNA, 562 bp, Cleome spinosa
atctggtgcaggagctgtgatactttgtatgattgcaactttcacgaatctgttcggcttgatagctttgatatggatagaactttgtccctggttccaccagatggtgaattcccagtcatgaattaccgtatgacccaggagttcaaagctccttttcatgtgaataccctgatcgaagaagcaggacgcctgaaggccgaagtgattatcaaaatacgtgccgagtttccttcagacgtagttgcaaatacaattactgtgcagatgccgttgccaaaatacacttccagggctagtttcgaggtagaaacaggcgctgctgggcagaggacggatttcaaggaatccagtaagatgcttgaatggaatttgaaaaagatcgttggtggggcagaacacacattgcgtgcaaagctgacatttgcacaggaatcacatggtaatatcacaaaggaagccgggcctgtaagcatgacattcacgataccaatgtacaatgtttccagacttcaggtaaaatacttgcagatagcgaagaaatcgagcacttacaatccgt

SEQ ID NO: 5502 - DNA, 1480 bp, Petunia hybrida
aaaaggaagtgcagaaatcttcttccggaaagtaaagttttggaaagaagacggtggagaggaagcacctcctgtatttaacgtggacggtgtgaactacttccatgtgaaggttgttggtctgctttttgtcgcgacatctagaacaaatacgtcgccttctcttgtgctggagctcttgcagaggattgcacgtgtaaccaaagattacctcggtgttctaaatgaagattcattgcggaaaaattttgtgctggtgtatgagcttcttgatgaagtgattgattttggttatgtgcaaacaacgtcgacggaaatcttgaagtcctacatatttaatgagccaattatggttgatgctggccgtttgccgccccttggtcctgctgccatgttcatgcaaggaaccaaaagaatgccagggacagcaattactaagtctgttgtcgcaaatgaacctggggggagaaagagggaggaaattttcgtggatataattgaaaaaataagcattactttcagctcaagtggatatatattgacttctgaaattgatgggaccatccaaatgaagagctatcttacgggtaatccagaaattagattagctctcaacgaggatctgagcattggaagggctggtgggagatcagtttatgattatggaggttcggctgggtctggagcagtagtactggatgattgcaattttcatgaatctgtgcaccttgatagttttgatgtggataggaccttgtctctggttccaccggatggtgaattccctgtcatgaattaccgcataacccaagaattcaagcctccctttcgtattaatactttgattgaagaggctggttcacttaaggctgaagtcatcttaaagatccgtgccgaatttcctgcagacgtcactgctaatacaatcttggtacagatgccactgcctacttatacaagcagagtaagctttgagttggaacctggagcagttggtcaaacaactgattttaaggaatccaataagaggcttgagtggaatctgaagaaggtactcggtgggacggatcacacattgcgtgccaagctgacattttcgcaatcacatggaaatatcactaaggaagctggaccagtgagcacgaccttcacaatcccaatgtataatccttcaaggcttcaggtgaaatatttacaaatcgcaaagaagtcaaaagcatataatccttatcgatgggtgagatatgtgactcaggctaattcctacgttgctcgtatatgatggctatcaaggccttatttagctttaattccctctagatttgtaattctctctgcttttcacatcttctggaattctagtttttgcccataaaattgaggcgattttgagttctcaattgtctttgctaactctctttttcggctttcaaatgtttggataatctagattatgatcccaaaaggaaaaaaaggttcc

SEQ ID NO: 5503 - DNA, 934 bp, Vinca minor
gttaccaccccttggccctgcttccctctttatgcaaggaaccaaaagaatgcctgggacagctatcacaaaatctgttgtggcaaatgaaccgagggggccgaaagagggaggagatatttgtggacattattgaagaaaatcagcgtcacttttagctctagtggatatatattaacttctgaaattgattggtaccattacaaatgaagagttatctaactggtaatccagaaatcagattagctcttaatgacaatttaaacattggacgaggcgggaggtcaatttacgattatggtgattcctcaggttcgggagcagtgatactggatgactgcaatttccacgaatctgtccatctggatagttttgatgtggataggaccctgagtctcgtgccatctgatggtgaatttccagttatgaattatcgtataactcaggagttcaagcctccttttcgcattaacactttgattgaagaagctggacagctaaaggctgaagttattctaaaactccgggctgagtttctctctagcgtcacagcaaacacaattgcagtccagatgccgttgccaaaattcacaacaagggttagttttgagttggaaactggagcaattggacaaacgactgacttcaaggaatcaaatagacgattagagtggaatttgaagaagattgttggtggatctgaacatacattgcgtgcgaagcttaccttttcacaggaatctcatggaaatatcaccaaggaagcaggtcctgtgagcatgacattcacaatacctatgtataatccttcacggctccaggtgaagtacttgcagatagcaaagaaatcaaaaacctataatccatatagatgggtaagatatgtcactcaggccaattcttacgttgctcgcatatgataatagatgagccc

SEQ ID NO: 5504 - DNA, 1458 bp, Valeriana officinalis
aagttttggaaagaggatggtgaagaggaagcgccacctgtctttaatgtggacggtgtaaattactttcacgtgaaagtggccggattactttttgtcgcaacaacaagagcaaatgtgtccccttctcttgtcttggaacttctacagaggattgcacgtgtcaccaaggattacctcggcgtactcaatgaagattctttaaggaaaaattttgtgctcgtgtatgaattacttgatgaagtcattgattttggttatgtccaaacaacatcaactgaagttttgaagtcttcagtattcaatgagccaattgtggtcgattctgcacggctgcaacctcttggtcctgctggcctttttatgcaaggtactaaaagaatgccagggacagctgtcacgaaatctgttgtagcgaacgaacccgggggaagaaagagggaggaaatctttgtcgatattattgaaaaaataagtgtcacgttcagctccagtggatacatactaacatctgagattgatggtacaatccaaatgaagagttacctttctggaaatcctgaaataagattggctcttaatgatgatctcagcataggaagaagtgggagatcagtatacgattatggtggttcaactggttcaggagcagtgatattagacgattgcaattttcatgaatctgtgcatattgatagttttgacgttgatagaactttaaccctggtcccaccagatggtgaattccctgttatgaattatcgaatgacccaagaatttaaacctccttttcgtatcaacactcttattgaagaagctggagctcttaaggctgaagtaattctgaaaatacgggctgaatttccttcaagcatcacggcaaatacaattgtaatacagatgccgctaccaacatatacaaccagagttagttttgagttggaagctggagctattggacaggtcactgatttcaaagagtcgaataagaaacttgaatggggtcttaagaagattatcggtggatctgaacacacattgcgtgccaagctaacgttctcacaggaagcacacggtaatctgatgaaagaagctgggccagtgagtatgaactttaccataccaatgtacaactgttcaaggcttcaggtgaaatacttgcagatagaaaagaagtcgaaggcgtacaatccatatcggtgggtgagatatgtgactcaagccaattcttacgtcgctcgtatatgaacttgactttcctttttgttacaattttttcattgagctgaatctttctttgcggataaaatgtgtaagttttaccttgaataaactacaaagttacatttgtgccacaagaatcgatttgtaagaataatgaacaaaaagttagacatgtatatatatctcttttcttgcattttactgaatgtaaagggttctagttgatgggatctt

SEQ ID NO: 5505 - DNA, 1370 bp, Cirsium arvense
gttattgtctcagagaggcgataacatcgtgtttcgtgattatcgcgtgatgtgacaaaaaggaagtgcagagtattttctttcgtaaagtgaagttctggaacgaggagggagaagccgaggctccacctgtctttaatgtggatggtgtcaactactttcatgccaaagtagttgggttgctgtttgttgcaacaactagagcaaatgtttcaccttctctcgtcttggagcttctactaagaatagcacgtgttaccaaagattaccttggcatcctcaatgaagattcaatacggaaaaactttgtgcttatgtacgaattacttgatgaagtcattgattttggttatgtgcaaacaacatcaactgaagttctaaaatcatgtgtatttaacgagccaatcatggttgatgctgcacgcatgccacctcttggtccagctgctctctttatgcaagggagcaaaagaatgccagggacggctgtcacgaagtcagttgtagctaatgaacctgggggtaggaagagggaggaaatttttgtcgatataattgaaaaaataagtgttactttcagctccagtggatacatactaacttctgagatagatggcaccattcaaatgaagagttatctttctgggaatccagaaatcaaactagctcttaatgaggagctgaatataggaagcagcagtggcagatcattatatgattacagtggttctactggatcaggagcagttatactagatgattgcaatttccatgaatctgtacgcctagatagttttgatgttgacagaactctgactcttgtgcctcatgatggtgaatttcctgtcatgaattatcgcatgactcaggaatttaagccaccttttcgtattaacaccctgattgaagaagctggatcactcaaggctgaagtgattctgaaaatacgtgctgagtttcctcaaaatattactgcaaatacggttgtcgttcaaatgcctgtgccatcatacacgtccagaattagctttgaaatggaatctggagcagttggacaagtgactgactttaaggaatcaaacaagaaactcgagtgggggttaaagaaggttgttggtggatctgaacatacacttcgcgcaaagctaacattctcacaggaatcacatggtaatataacgaaggaagctggacctatcagcatgaccttcaccataccaatgtacaactgctctagactacaggtgaaatacttgcaaattgcaaagaagtccaaaacttacaatccgtaccgatgggtgagatatgttacccatgccaattcgtatgttgctcgtatatgatcaaacagagcctctacccgtgttgta

SEQ ID NO: 5506 - DNA, 1132 bp, Linum usitatissimum
gtttaaagagaaccttatagtgatacgaggctgtccgttgacctcccatccgttccagttcgcagaccaacctgccagtacgcgtgaacaatttcagtgtccattgggctggcggtagaagaggaaaaatctcttggacctatctgagaaattcagtggaccttcagccccagggagcatacctgacctggaattgatggaacaattcatagaaagagcttctactgatatcccgaaatccgtttagctctcacgagacgtacattggaaccattgaaggagatccaacttgatttcgaagttcatcaggtcaggatccgtgattctagatgactgtatgccatgaatctgtgcgtctgagagctttgactcagacagaccttgtctctggtgcaccagacggtgatttccctgtaatgaattatcgcatgatcccagaattcaaaccacccttccgcattaatactttgattgaagaggcagaaaggcttagagctgaagtgattctcaagttctctgccgagtttccctcaaatattacagcaaacacaattattgtacaaatgccactgccaaaatatactgccagagcaacgtttgagttggaacctggagcagttgggcagacaactgatttcaaggaatcgactaagaagcttgaatggggactaaagaaggtttcaggtggatctgaacacacattacgagcaaagctgacgttttctcaggagttgcatgggaatataacaaaagaagctgggccagtcagcatgacatttacaataccaatgtacaatgtctccaagcttcaggtgaaatacttgcaaatagcaaagaaatcgagctcatacaatccatacaggtgggtgagatatgtaacgcaggccaactcatatgttgcacgcatttgatggggactggttgctctctctctctctcatttccgatcaatcccagtgttgtattttagcaatacttgaaatgaaacaactctcttatgtttatcttgtacaagaagctgatgtacctttctttcaactctcatttgtgttgttaatttaacaagtttgagattctcgctttgatttccattctagctaatgacagggtcgggatggatcttttaatcatg

SEQ ID NO: 5507 - DNA, 779 bp, Vaccinium corymbosum
ggtcacattcagctcaagtggatatatactgacttctgagattgatggcactattcaaatgaagagttatcttagtgggaatccagaaatcaggttagccctcaatgacgatctgagcataggaagaggcgggagatctatctatgactatagcggttcctctggatctggagcggtgattctagatgattgtaatttccatgaatctgttcatcttgatagttttgacgtggacaggactctgtctttggtgccgcctgatggggaatttcctgtcatgaattaccgcataacacaggaattcaagcctccttttcgaatcaacgctttaattgaagaagctgggccacttaaggctgaagttattctgaaagtacgtgctgaatatgcctcaagcatcaatgcaaacactatactagtgcagatgccactaccaacatacaccaccagagtgagttttgagttggaacctggtgctgttggacaagtaactgattttaaggagtccaataagaggcttgaatggggtcttaaaaagattgttggtggatctgaacatacactgcgtgcaaagcttacattttcacaggaatcacatggaaacatcacaaaggaggccggacctgtcagtatgaactttacaataccaatgtataatgcctcgaggcttcaggtgaagtacttgcagatagccaagaaatccaaaacctacaatccttatcggtgggtgagatatgttacccagaccaattcctatgtagctcgtatttaaccgaggg

SEQ ID NO: 5508 - DNA, 1137 bp, Thalictrum flavum
gcactaaacggatgccagggacagctgttacgaaatctgttgttgccaatgagcctggtggtacgaaagagggaggaaatttttgtggacatcatagagaaaataagtgttactttcagctctagtggttacatacttacgtctgagattgatggcacaatccaaatgaagagctatcttactggaaacccagaaattcgtctagctttaaatgaggacctgaacacagggagaggcgggagatctgtatatgattatggtagttcctctagagcaggttcagtgatactagatgattgtaacttccatgaatcagtacatcttgaaagttttgatgtggatcgaactttatcattggtacccccggatggagaatttcctgtgatgaactaccgcatgacacaggagttcaagcctccttttcgtattaatgcattgattgaagaagcaggagccttcaaggctgaagtgatactcaaagtgcgcgctgagtttccctcgtccgtcactgcaaatacaattgtagtacagatggcacttccaaaatataccaccagggttagtttcgagttggaatctggagcagttgggcacacaacagatttcaaggaagcaaataagaaactggaatggggcttgaagaagattgttggtggatctgaacatacactacgggcaaaacttacatttgtacaggaatcacatggaaatatcatgaaggaagcgggacctgtgagcatgactttcacaattcctatgtataatgcttcaaagcttcaggtgcggtacctgcagatagcaaaaaagtcgaagacctacaatccatatcgatgggtcagatatgtcacacaagcaaattcctatgtagctcgtttatgatactcaaattttgctgtacctgttttttgtattttctttgctgaattgctgatgcttaatttgacaagattgaactagttaagacagttacatgtaatataactcctgataaaatgcagttatccttataaaatgcccagagatatgtcatagcacacttgtattttcttaaatttgagtgaaaacattgagtacctgtttaaaagaattcaactgccatgtccagttgtccacttatatgatggcagatttgtgtta

SEQ ID NO: 5509 - DNA, 1352 bp, Phaseolus coccineus
  misc_feature (1129)..(1129): n is a, c, g, or t
  misc_feature (1213)..(1213): n is a, c, g, or t
  misc_feature (1235)..(1235): n is a, c, g, or t
  misc_feature (1251)..(1251): n is a, c, g, or t
  misc_feature (1253)..(1253): n is a, c, g, or t
tgcaactacaagggttaatgtatcaccttctttagtcttggagcttttgcaaagaattgctcgtgttattaaagattaccttgggattctcaatgaagactcgctacgaaaaaactttgtgcttgtgtacgagttactcgatgaagttattgattttggttatgttcaatcaacatctactgagatgttgaaggcctatgttttcaatgagccgcttgttgttgatgctgcacgtctgtcacctcttggacctgcttcaatttttgcgcaagggacaaaaagaatgccagggatagctgtaacaaaatctgttgttgctacagagcctgggggtagaaggagggaagaaatttttgtagatataattgagaaaatcagcatcacttttagctccagtggatacattctgacttctgagattgatggcaccatacaaatgaagagctatctttctggcaatcctgaaattcgattagcacttaatgacgatctctccattggaagaagccagggatcagcttacggttataggagctcatctggctcaggaacagttgtattagatgactgtaatttccatgaatctgttcgtctggacagttttgatattgatagaactctatccctgatcccaccagatggtgagtttccagtcatgaactaccgtatgacacaggaatttaggcctccttttcgtattaatgctctgattgaagaggcagggtcgcttaaggcagaagtaattcttaaagtaagtgccgagtttgcttcaagtgtaacagcaaatactatcaaagtgcagatgccactaccgaaatgtacctccagggttagttttgagctggaatctggagctgttggacaaacaactgattttaaggaagcaaacaagaggctcgaatggagtttaaaaaagattgtcgggggatctgagcatactctgcgggcgaagctaacctttgctcaggaatctcacgttaatataacgaaagaatctggacctgttagcgtgacatttaccataccaatgtataatgcatcacggcttcaggtaaagtatttgcagatagcaaagaagtctgcaacgcatgagccataccggtgggttagatatgttacacaggcaaantcctacgtcgctcgtatatgatgccttcaagaacattgttcaccccctttcgtttttttcattttcctctccctctttctcatnatacatatgctttcttttgttngttttattctttattngnaaattacatctaagtcgaatatagatgacgttagtagttttgccttgtcattcattacacaaactcaagttggatgaattacctacagcacttttttcc

SEQ ID NO: 5510 - DNA, 873 bp, Cucurbita pepo
gatgccaggtacagctgtcaccaagtctgtggttgcaaatgagcctggaggtagaaaagagaggaaattttgttgacataatcgagaagatcagtatcacattcagctcaagtggttatatacttacttcagagattgatggtaccattcaaatgaagagctatcttacgggtaacccagaaatccgtcttgctcttaatgaggatttgagcatggaagaggtggaaagtcaatatatgattatagcagttcatctggtggaggaacagttatccttgatgattgtaattttcatgaatctgtgcatcttgataattttgacattgacagaactttggtcttggtaccaccagaaggtgaatttcctgtcatgaattaccgaatgactcaggaattcaagcctccgtttcgtattaatgccttaattgaagaagcagggtctcttaaggctgaagtaattcttaaagttcgtgctgaatttgcctccaacatcacagcaaacacaataaatattcagatgccactgccaactttcacaacaagagtcagcttcgagttggaacccggagcagttggaaatacaactgattttaaagaagcgaacaagaggcttgaatggggtttgaagaagattgttggtggatctgaacatactctgcgtgcaaggctcacattttcacaagaatcacatggaaacatcgtgaaagaagctggacctgttagtatgacgttcacaattcccatgtacaatgtttcaaggcttcaggttaagtacttgcagattgcaaagaagtctaacacctataatccatataggtgggtaagatatgtgacgcaagcaaattcgtatgtcgctcggttgtgaatgtgaat

SEQ ID NO: 5511 - DNA, 894 bp, Flaveria ramosissima
atacatactaacttctgagatagatggcaccattcaaatgaagagttatcttactgggaatccagaaattcggttagctctcaatgaggacctgaatataggaagaggtggcagatccgtatatgactatggtggttctagtggatcaggagccgttatactagatgattgcaattttcatgaatcggttcatcttgatagttttgatgtggatagaactttgactcttgttccccctgatggtgaatttccggttatgaattatcgcatgactcaggaatttaagccaccttccgtattaacacctgattgaagaagcagggtcacttaaggctgaggtgattctgaaagtacgtgctgaatttcctcaaaatataactgcaaatacagttgtagttcagatgccagtgccaaaatacacttccagagtaagttttgaattggaatctggagcagttggacaagtgactgatttcaaggagccgaataagaaaatcgagtgggggctaaaaaagattgttggtggatctgaacatacgctgcgtgcaaaactaacatttgcacatgaatcgcatggcaatataacgaaagaagcaggtcccgtcagcatgactttcactataccgatgtacaactgctcaagactccaggtgaaatacttgcagattgctaaaaagtcgaaaacttataatccatatcggtgggttagatatgtcacccaagccaattcctatgtcgctcgtatatgattaatttgagcctctacgcttcggttgtaatatcttgtattttcttcatatttttttcctttattaacttgatcatctatcgtgtaatggtaactcttatcaatcttggactgtggattgtgataggagttgcacatgacctatg

SEQ ID NO: 5512 - DNA, 1819 bp, Lippia dulcis
acagcgccacggtaaccgccgctgcagcccagggcccacgcctccccctttctttttccccttctcaccaggccaaacgacacaaccctgctgctctccgcgcagatttgagaacagaaagatttaagcttcatagtcgatccaaaattcagcgagagcttaaactgacgagctgcagtggtagcagtacttcaacatgatctctcagtttttcgtgctttcacaaagaggcgataacatcgtctttcgagactatcgaggtgatgtacagaaaggaagtgcggagatattcttccgcaaagtgaagttctggaaggaagatggcaaagaggaagcaccgcctgtctttaatctggacggtgtaaattactttcatgtgaagatggttggcttgctttttgtttgtccaccacaaggatcaacttgtctcctcctttagccttggagcttctacaaaggattgcacgtgtcatcaaagattaccttggtgttcttagtgagaatcattcgtaaaaattttgtgctgtttatgagttgcgtcgatgaagttattgatttcggttatgttcaaactacatctactgaagtcttgaagtcatatgtattcaatgagcccattgtggtggatgctgcacgcttgccaccccttggtcctgcagctttatttatgcaagggaacaaacgaatgcctgggacagctgttacaaaatctgtagtggcaaatgaacctgggggtagaaagagggaggaaatctttgtcgatataattgagaaaataagtgtcacttttagctcaagtggatatgtattgacctctgaaattgatggcaccattcaaatgaagagttatcttactggaaatccagaaatcagattggctctcaatgacgagctgtacattggaaggaccggggtgcctagttatggctatagttcatcaggggcaggagcagtcatattggatgattgcaattttcatgaatctgtacacatggatagttttgatgtggacagaacattgagtctggtaccacctgatggggaatttcctgtcatgaattatcgtattacgcaagaattcaagccccccttttctgttaacaccttaatagaagaagcaggatcactcaaggctgaagtgattctgaaaatccatgctgagtttcctacaagcatctcagctaacacaattttagtagagatgccactgccaacatgtacaaccagggtaaattttgacttggaacctggagtagttggacagacagctgatttcaaggaatcacagaagaaacttgaatggagcatgaagaagattgttgggggatctgagcacactctacgtgcaaaattaaatttctcacaagagttgcacggaaatataactaaagaagctggacctgtgagtatgaccttcacaataccaatgtataatccttcaaggctgcaggtgaagtatttacagatagcaaagaagaccaaaagtggcaacccgtatcggtgggtgagatatgtcacgcaagctaattcttatgttgctcgcatatgacagcagtcacaggtttccctgttcatatgaggttcatttccttcaacaacatcacgcagtttagtttatagttgttgattaagattttcattatacgaagcttggaaattgcgacaattttcacttttgactgctttttctcaactttgaatgttgttgctgtagcgtgtatcactagcaaattgctcttgttactaaactagaagttgtttcaaaattcttagtttccgtcatcatgtcttggctctgttattgacatcttttaagatg

SEQ ID NO: 5513 - DNA, 1201 bp, Lippia dulcis
attttggatatgttcaaacgacgtctactgaggtattgaagtcttatgtcttcaacgaaccaattgtaattgatgctgcacgcttgccgactctgggccctgcagccttatttatgcaaggaaacaaacgaatgcctggtacagctgttacaaaatcagttgtggcaaatgaaccggggggtcgaaaaaagggaggaaatctttgttgatatcattgagaaaataagtgttacctttagctccagtggatatgtattgacttctgaaattgatggtactattcaaatgaagagttatctatcaggaaacccagaaatcagattagctctcaatgatgaccatagaatagaacctaacacattggaagaggcagcgtaccaagttttgggtacagtcgttcttcagggacaggagcagttattctggatgattgcaattttcacgaatctgtacatatggatagtttcgatgttgacagaacactgagtctggtaccacctgaaggggagtttcctgtcatgaattatcgcattactcaggaatttaagccccccttcacaattaacaccttaattgaagaagcaggatcacttaaggctgaggtgattctgaagatccgtgctgagtttccttcaagcgtcactgctaacacaatattaatagagatgccattaccaacatatacaacgagagtcaattttgacttggaacgcggtatagttggtcagaatgctgatttcaaagaatcgcaaaagaaactcgaatggaatattaagaagattgtagggggatcggaacacacactacgagcaaagttaaacttttcacaggaattgcatgaaatatcactaaagaagctgggcctgtaagcttgaccttcacaatacctatgtacaacccttcaagactacaggtgaaatacttgcagatagcaaagaagagcaaaactagccaacccactatcggtgggtgagatatgtgactcaagctaattcttatgttgctcgcatttgaaaataaacatccctttgcatttgttaattttcttcacgacatgtttactacagtgagatcgattttattagacaatttcccccttccttttctctctttattgtatcgctttgtactttacgagaaatggtttttttcttttaaggtgcgatgaacatgtatttagatcttcgtataagaaagtgca

SEQ ID NO: 5514 - DNA, 1610 bp, Silene vulgaris
gaggcgataatatcgtctttcgcgactatcgaggagatgtcccaaaggggactactgaggtatttttccgtaaggtgaagttctggaaggaggacggagaagaggaggcacctcctgtctttaatgttgatggagtgaactactttcatttgaagattgttggactattttttgttgcaaccacaagagctaatgtatcaccttcgctgctactggagctcctccagcggatatctcgtgttataaaggattatcttggaattctgagtgaagagtctctaagacgaaactttgttctagtttatgagttgctcgatgaaatgattgattttggttatacgcaagcaacgtctacagaggcgttgaagtcatatgtattcaatgagccaattgtggttgatgctgcacgtatgcctgctctgggccctgctgctatgttcatgcaagggaacaaaagaatgccaggaactgcagtaacaaagtctgtaatggcaaatgagcctggaggtagaaagagagaagagatctttgttgacattattgagaagataagtgtcacctttagttccagtggatatattttaacatcagaaattgatggaacaattcagatgaagagttaccttaccggtaatccagaaataaaattagctctgaatgaggatgtgaccattggaagagacgggagttctgcatttggccatagtagctctggatctggtgtggtgatacttgatgattgtaattttcatgaatctgtgaaccttgataactttgatatagatcgaactttaagcttggtacctccagatggggagttcccagtcatgaactatcgcatgacacaggagtttaaacctccgtttcggattactgctctaattgaagaagctggagcacttaaggctgaagtgatcctcaaaatacgtgctgaatttgcagcaagtgctactgccaacactattgttgttcaaatgcctttgccaacttacacgtcaagagttagcttcgagttggaacaaggtgctgttgggcagacaactgatttcaaggaagctaataagagacttgaatggagtttaaagaagatagtaggtggagctgaacatactttaagagcaaaactcacattttcacaggaatcacacgggaatctcactaaggaagctggacccgttacaatgaactttacaatacctatgttcaatgcctccaggcttcaggttaagtatctgcagtttgcaacgaaatcaaagacctataatccatatcgttgggtaaggtacgttacccaagcgaattcttatgttgctcgtttatgaagcactgcctttttaactgttcgataatcagcaatgcaacaccctcttccttttgctgctcacttcccagcattgtggtgtctgctgccttttttttattggcaaatttcattccatatccgatgactgcaacatttttgtgaataaaaatcttgttgtaagactccaaaagtatatttgttcctgaattttctagtaaagttttggactctagattgtgaatctttctttcctggaggaaagcatgtaggcattctcaatctgtctatgaagtattgtgctggaggt

SEQ ID NO: 5515 - DNA, 1208 bp, Manihot esculenta
aatgtggatggggtgaattactttcacgtaaaggttgttggattattttttgttgcaacctcaagagttaatgtgtcaccttctctggtcttggaactcttacaaagggttgcacgcgttatcaaagattaccttgggattctcaatgaagattccttgcggaaaaactttgtgcttgtgtatgaattgcttgacgaagtgatagattttggttatgtacaaacaacatccactgagttgttgaagtcctatgttttcaatgagccaattgtcattgatgctggccgtttgcagcctctgaaccctgctactatttttacgcaagggacaaaaagaatgccaggcatggctgttacaaaatctgtggtggctaatgagcctggaggtaggaagagggaggaaatatttgtggatataattgagaaaatcagtgtcacattcagctctagtggttatatattgacatctgaaattgatggcaccattcaaatgaagtgttatctgactggaaatcctgaaattcggttagcccttaatgaagacctgagcataggaggaggcagtggaagatcagtctatgattctagaagttcatttgggtcaggagcagtgatgcttgatgattgtaatttccatgaatctgtacgtcttgataattttgatctggatagaacattgactttggtacccccagatggtgaatttcctgtcatgaactatcgtttgacccaggaattcaagcctcctttccgcattaatactttgattgaggaagcaggagcactcaaggctgaggtgattcttaaaatatcagccgagtttccctcaagcattactgcaaacgcagtttctgtacagatgccattgccaaaatatactaccagagctacttttgagttggaacctggagcaattgggcaaacaacagatttcaaggaagcaaataaaagacttgaatggggactaaataagattgtcggtggatctgaacatacattacgcgcaaagctggcattttctcgggaattgcatgggaatatcacaaaggaggctgggccagttagcatgacattcacaataccaatgtacaatgcttctaggcttcaggtgaaatacttacaaatagcaaagaagtctaatacctataacccttatcgatgggtgagatatgtcactcaggcaaattcttatgttgctcgattatgaag

SEQ ID NO: 5516 - DNA, 733 bp, Brassica napus
aggttgtacatgatgttgatttgcagaaactaccggtgagatttgcaatggatagagctggacttgtgggagctgatggtccaacacattgtggagcttttgatgttacgtttatggcttgtcttcccaatatgatagtaatggctccatcagatgaagctgagctctttcacatggttgcaaccgcttctgctattgatgaccgtcttctgttccgttaccctagaggtaacggtattggggtggcattacctccaggaaacaaaggtgttccacttgaggttgggaaaggtaggatcttaaaagaaggagagagggttgcgttgttgggttatggctcagcggttcagagctgtttaggagcagcagcgatgctccaagaacgtggcctaaacataaccgtggcagatgcacgtttctgcaagccgttggaccgtgctcttattcgcagcttagctaagtcgcacgaggtactgatcacggttgaagaaggttccattggcgggtttggatcccacgttgttcagtttcttgctcttgatggtcttctcgatgggaagctcaagtggagaccaatggtgttgcctgatcggtacatcgaccacggctcaccagctgaccaaatggctgaagctggactcatgccatctcatatcgcagcaactgcacttaacttaatcggagcaccatgggaagctctgtactgagagtagatatgcaacaattctaagcg

SEQ ID NO: 5517 - DNA, 800 bp, Raphanus sativus
tcttgttccgtaccctagaggtaacggtgttggggtcgcactacctccaggaaacaaaggtgttccaattgaagtcgggaaaggtaggatcttaaaagaaggagagagggttgcgttgttgggttatggctcagcggttcagagctgtttaggagcagcggtgatgctccaagaacgtggactgaacataaccgtagcggatgcacgtttctgcaagccgttggaccgtgctcttatccgcagcttggctaagtcgcacgaggtactgatcacggttgaagaaggttccattggcgggtttggatcccacgttgttcagtttcttgctcttgatggtcttctcgatgggaagctcaagtggagaccaatggtgttgcctgatcggtacatcgaccacggctcaccagctgaccaaatggctgaagctggactcatgccatctcatatcgcagcaactgcacttagcttaatcggagcaccatgggaagctctgtactgagagtagagtcggtggctaaaaaaaagcatatagaaacactctaaatgaatcagagggtttgttttaagtaatgataaatgttcccgccgaaaacaaagcaacagaaaaagttctctggttgttactgagagtatagtgaagagaaactgagaagggttaaaggcgatgtgtgcaaaactgaagattagtatatgtatttttttttttcttttttgtgatgtaactttgtttaggggtgtgatttgagatcgagctgtacaaccatctaacatctttgtaaaatcaaatacatttctattca

SEQ ID NO: 5518 - DNA, 2277 bp, Brassica napus
cattcaaacagaaaggcaaaagtgaatgcttcacttgcagagaagggtgaatactattcaaacagaccaccaactccattacttgacacaatcaattacccaattcacatgaaaaatctttccaccaaggagctgaaacaactctctgatgagctgagatcagatgtgatcttcaacgtctccaaaacaggtggacatttggggtcaagcctcggtgttgtggagctcacagtggctcttcactacattttcaacactccacaggacaagattctttgggatgttggccatcagtcttatcctcacaagattctcaccgggagaagaggcaagatgccgacaatgaggcaaaccaatggtctctccggtttcactaagcgaggagagagcgagcatgattgctttggtacaggacatagctcaaccacaatatctgctggcttaggaatggcggtaggaagggatttgaaagggaagaacaacaatgtggttgctgtgattggtgacggtgccatgacggcagggcaggcttatgaagccatgaacaacgctggttatctagactctgatatgattgtcattcttaacgacaacaagcaagtctcattacctactgccactttggacggtccgagtccacccgttggagcgttgagcagcgctcttagtcggttacagtcaaacccagctcttagagagttgagagaagtcgcaaaggcaagtacattgtcctgatctctatgaagttggataaaagatcttagcttgtgttgtttattgtttgttgtgttatagggtgtgacaaagcaaataggtgggccaatgcatcagttagctgctaaggtagatgaatacgctagaggaatgataagcggaactggatcaacgctgtttgaagaactcggtctctactatattggaccagttgatggacacaacatagatgatttggtagccattcttaaagaagttaagagcgcaagaaccacaggaccggttcttatccatgtcataactgagaaaggtcgtggttatccttacgctgagagagctgatgacaaataccatggtgttgtgaaatttgatccagcgactggtaaacagttcaaaactactaacaagactcagtcttacacaacctactttgcggaggcgttagtggcggaagcagaggtagacaaagacgtggttgcgatccatgcagccatgggaggtgggacagggctgaatctcttccaacgtcgcttcccgacaagatgtttcgatgtcgggatagcggaacagcatgcagttacttttgctgctggtttagcgtgtgaaggccttaagcccttttgcgcaatctattcttctttcatgcagcgtgcttatgaccaggttgtacatgatgtggatttgcagaagttaccggtgagatttgcgatggatagagctggactagtgggagctgatggtccaacacattgtggagcgtttgatgtgacgttcatggcttgtcttcctaacatgatagtgatggctccatctgatgaagctgagctttataacattgttgcaaccgctgctgctattgatgaccgtccttcttgtttccgttaccctagaggtaacggtattggcgttgcgttgcctcccggaaacaaaggtgttcctgttgaggttgggaaaggtaggatcttaaaagaaggagagagggttgcgttgttggggtatggctcagcggttcagagctgtttaggagcggctgtaatgctccaagaacgtggactaaacgtcaccgtggcagatgcgcggttctgcaagccgttggaccgtgctctcattcgcagcttagctaagtctcacgaggtgctgatcacggttgaagaagggtccattggagggtttggatcgcatgtggttcagtttcttgcattggatggtcttctcgatgggaagctcaagtggagaccaatggtattgcctgataggtacattgaccatggttcaccagctgatcaaatggctgaagctggacttatgccgtctcatatagcagcaactgcacttaacttaatcggagcaccaagggaagctctgtactgagtgtagaatctgtggaaaacatatacaagaaggaagtcatttggctgagatggtaaagacaatgtgtgtgcaaagattagttgtaatgtaaactttgttaaggggtgtgtgtgattgagatcgagctgtacaaccatatctaacatctttgtaaaaatcaaatattccctctgtttttaatagataacgttt

SEQ ID NO: 5519 - DNA, 821 bp, Brassica juncea
ttcaacatggttgcaaccgctgctgctattgatgaccgtccttcttgtttccgttaccctagaggtaacggtattggcgtcgcattacctcctggaaacaaaggtgttcctattgaggttgggaaaggtaggatcttaaaagaaggagagagggttgctttgttggggtatggatcagcggttcagagctgtttaggagcggctgtaatgctccaagaacgtggattaaacgtaaccgtggcagatgcacggttctgtaagccgttggaccgtgctctcattcgcagcttagctaagtctcacgaggtgctgatcacggttgaagaagggtccatcggagggtttggatcgcatgtggttcagtttcttgcattggatggtcttctcgatgggaagctcaagtggagaccaatggtattgcctgataggtacattgaccacggttcaccagctgatcaaatggctgaagctggactcatgccgtctcatatagcagcaactgcacttaacttaatcggagcaccaagggaagctctgtattgaggagtagaatcggtgtaaaacatatacaagaagcaagtcatttcgctgagatggtaaagacaattatgtgtcaaaaatttagttgtaatgtaactttgtttaggggtgtgtgtgattgagatcgagctgtacaaccatatctaacatctttgtaaaaatcaaatattccctctggtttttaatagatgaagtttttagaaaaaaaacactaagatgtagataatatgatgtatcagaggataaggggccataaaccgattacatcacacacccccgcg

SEQ ID NO: 5520 - DNA, 823 bp, Brassica juncea
ttgtggagcatttgatgttacgtttatggcttgtcttcccaacatgatagtaatggctccatcagatgaagctgagctctttcacatggttgcaaccgcttctgctattgatgaccgtccttcttgtttccgttaccctagaggtaacggtattggcgttgcgttgcctcccggaaacaaaggtgttcctgttgaggttggaaaaggtaggatcttaaaagaaggagagagggttgcgttgttggggtatggctcagcggttcagagctgtttaggagcggctgtaatgctccaagaacgtggattaaacgtcaccgtggcagatgcgcggttctgcaagccgttggaccgtgctctcattcgcagcttagctaagtctcacgaggtgctgatcacggttgaagaagggtccatcggagggtttggatcgcatgtggttcagtttcttgcattggatggtcttctcgatgggaagctcaagtggagaccaatggtattgcctgataggtacatcgaccatggttcaccagctgatcaaatggctgaagctggacttatgccgtctcatatagcagcaactgcacttaacttaatcggagcaccgagggaagctctgtattgagtgtcgaatctgtggaaaacatatacaagaagcaagtcatttggatgagatggtaaagacaatgtgtgtgcaaagattagttgtaatgtaaactttgttaaggggtgtgtgtgattgagatcgagctgtacaaccatatctaacatctttgtaaaaatcaaatattccctccgtttttaatagataacgttttagaaaaaa

SEQ ID NO: 5521 - DNA, 1525 bp, Raphanus sativus
  misc_feature (110)..(110): n is a, c, g, or t
  misc_feature (134)..(134): n is a, c, g, or t
  misc_feature (136)..(136): n is a, c, g, or t
  misc_feature (151)..(151): n is a, c, g, or t
  misc_feature (172)..(172): n is a, c, g, or t
  misc_feature (1516)..(1516): n is a, c, g, or t
gtcaaatccagctctcagagagttgagagaagtcgcaaagggtgtgacaaagcaaataggtgggccaatgcatcagttggctgctaaggtagatgaatacgctagagggntgataagcggaactggatcaacantntttgaagaactcggnctctactatattggaccagtngatggacacaacatagatgatttggtagccattcttaaagaagttaagagtgcaagaaccacaggaccagtgcttattcatgtcataacagagaaaggtcgtggttatccttacgcagagagagctgatgacaaataccatggtgttgtgaagtttgatcctgctacgggtaaacagttcaaaactactaacaagactcagtcttacacaacgtactttgcggaggcattagtggcggaagcagaggtagacaaagacgtggttgctattcatgcagccatgggaggtgggacagggttgaatctcttccaacgtcgcttcccaactagatgtttcgatgtgggaatagcggaacagcatgcagttacttttgctgctggtttagcatgtgagggacttaagcccttctgtgcaatctattcctctttcatgcagcgtgcttatgaccaggttgtacatgatgtggatttgcagaagttaccggtgagatttgcgatggatagagctggactagtgggagctgatggtccaacacattgtggagcgtttgatgttacgtttatggcttgtcttcctaacatgatagtgatggctccatcggatgaagcagagctgtttaacattgttgcaaccgctgctgctatcgatgaccgtccttcttgtttccgttaccctagaggtaacggtattggcgttgcgttacctccaggaaacaaaggtgttcctattgaggttgggaaaggtaggatcttaaaagaaggagagagggttgctttgctggggtatggctcagcggttcagagctgtttaggagcggctgtgatgctccaagaacgtggattgaacgtaaccgtagcagatgcacggttctgtaagccgttggaccgtgctctcattcgcagcttagctaagtctcacgaggtgctgatcacggttgaagaaggttctattggagggtttggatcgcatgtggttcagtttcttgcattggatggtcttctcgatgggaagctcaagtggagaccaatggtattgcctgataggtacattgaccacggttcaccagctgatcaaatggctgaagctggactcatgccgtctcatatagcagcaactgcgcttaacttaatcggagcaccaagggaagctctgtattgagagtataaaacatatacaagaagcaagtcatttggtggctgagatggtaaagacaatgtttgcaaagattagttgtaatgtaactttgtttaaggagtctgattttgagatcaagctgtacaaccatatctaacatctttgtaaaaatcaaatattctctcccttttttaatagatgatgttgcanaaaaaaaaa

SEQ ID NO: 5522 - DNA, 1751 bp, Brassica napus
aatgtggttgctgtgattggtgatggtgctatgacagcagggcaagcttatgaagcaatgaacaacgctggatatctagactctgatatgattgtcattctcaatgacaacaagcaagtctcattacctactgctactttggatggacctagtccacctgttggagccttgagcagtgctcttagtcggttgcagtcaaacccagctctcagagagttgagagaagtcgcaaagggtgtgacaaagcaaataggcgggccaatgcaccaattggctgctaaggttgatgagtatgctcgaggaatgataagcgggactggttcaacactgtttgaagaacttggtctgtactatattggtccagttgatgggcacaacatagatgatatggtagccattcttaaagaagttaagagtgccagaaccacaggacctgtacttattcatgtcgtaacagaaaagggtcgtggctatccttacgcagagagagctgatgataagtaccatggtgttgtgaaattcgatccagctacgggtaaacagttcaaaagtagtaacaagactcagtcttacacaacttactttgctgaggctttggttgcggaagcagaggtagacaaggacgtggttgcgattcatgcagctatgggaggtgggactggcttaaacctcttccaacgtcgcttcccgacaagatgtttcgatgtgggaatagcggagcaacatgctgttacttttgctgctggtttagcatgtgaaggtcttaagcccttctgtgcaatctattcttctttcatgcagcgtacttatgaccaggttgtacatgatgttgatttgcagaaactaccggtgagatttgcaatggatagagctggacttgtgggagctgatggtccaacacattgtggagcttttgatgttacgtttatggcttgtcttcccaatatgatagtaatggctccatcagatgaagctgagctctttcacatggttgcaaccgcttctgctattgatgaccgtccttcttgtttccgttaccctagaggtaacggtattggggtggcattacctccaggaaacaaaggtgttccacttgaggttgggaaaggtaggatcttaaaagaaggagagagggttgcgttgttgggttatggctcagcggttcagagctgtttaggagcagcagcgatgctccaagaacgtggcctaaacataaccgtggcagatgcacgtttctgcaagccgttggaccgtgctcttattcgcagcttagctaagtcgcacgaggtactgatcacggttgtagaaggttccgattgcgggtttggagtccacgttgttcagtttcttgctcttgatggtcttctcgatgggaagactcaagtggagaccaatggtgttgcctgatcggtacatcgaccacggctcaccagctgaccaaatggctgaagctggactcatgccatctcatatcgcagcaactgcacttaacttaatcggagcaccatgggaagctctgtactgagagtagatatgcaacaattctaagcggatcagagggtttgttttaagtaatgataaatgttcccgccgaaaagaagcaatagagataagttctttggttatatgataactgagatggtgaagagaaactgagaagggtaaaggcgatctgtgtaaaaaagaagattagtatatgtattttatttttgtgatgaaactttatttagtggtgtgactgagacagagct

SEQ ID NO: 5523 - DNA, 1370 bp, Thellungiella halophila
  misc_feature (360)..(360): n is a, c, g, or t
  misc_feature (901)..(901): n is a, c, g, or t
cacacatcttttatttggtagccattctgaaagaagttaagagtgcaagaaccacaggaccggtacttattcatgtcataacggagaaaggtcgtggttatccttacgcagagagagctgatgacaaataccatggagttgtgaaatttgatccagcgactggtaaacagttcaaaagtagtaacaagactcaatcttacacaacttactttgcggaggcattagttgctgaagcagaggtagacaaagatgtggttgcgattcatgcagccatgggaggtggtaccggtttaaatctcttccaacgtcgctttccaacaagatgtttcgatgtcggaatagctgaacaacacgcggttnctttcgctgcgggtttagcttgtgaaggtcttaagcccttctgtgctatctactcgtctttcatgcagcgtgcttatgaccaggttgtacatgatgttgatttgcagaagttacctgtgagatttgcgatggacagagctggacttgtgggagctgatggtccaacacattgtggagcttttgatgtgacgtttatggcttgtcttcctaacatgatagtaatggctccatctgatgaagcagagctctttaacattgttgcaaccgctgctgctattgatgatcgtccttcttgtttccgttatccaagaggtaacggtattggcgtcgcgttacctcccggaaacaaaggtgttccaattgagattgggaaaggtaggattttgaaagaaggagagagagttgctctgttgggttatggctcagcggttcagagttgtttaggagcggccatgatgctccaagaacgtggattgaacataaccgtggcagatgcaagattttgcaagccgttggacggtgctctcattcgcagcctagntaagacgcatgaggttctgatcactgttgaagaaggttcgataggagggtttggatcgcacgttgttcagtttcttgctctcgagggtcttcttgatgggaagctcaagtggagaccaatggtattgcctgatcggtacattgaccatggctcaccagctgatcaaatggctgaagctgggctcatgccgtctcacattgcagcaacggctcttaacttaatcggtgcaccaagggaagctctgttttgagagtagttaatcatatacaaacactctacatgcaaccgaaggtttcttctttgcaaagattagttatatgtttggtttttgtaatgtaactttgtttaggggtgtgattgagatcgagctgtaacaaccatctaacatcttgtaaaaaaaaaatcaaatacatttctttgtctatcttcattaaccttttgttggaatagttgagattctagattcaat

SEQ ID NO: 5524 - DNA, 900 bp, Eutrema halophilum
ctttccaacaagatgtttcgatgtcggaatagctgaacaacacgcggttactttcgctgcgggtttagcttgtgaaggtcttaagcccttctgtgctatctactcgtctttcatgcagcgtgcttatgaccaggttgtacatgatgttgatttgcagaagttacctgtgagatttgcgatggacagagctggacttgtgggagctgatggtccaacacattgtggagcttttgatgtgacgtttatggcttgtcttcctaacatgatagtaatggctccatctgatgaagcagagctctttaacattgttgcaaccgctgctgctattgatgatcgtccttcttgtttccgttatccaagaggtaacggtattggcgtcgcgttacctcccggaaacaaaggtgttccaattgagattgggaaaggtaggattttgaaagaaggagagagagttgctctgttgggttatggctcagcggttcagagttgtttaggagcggccatgatgctccaagaacgtggattgaacataaccgtggcagatgcaagattttgcaagccgttggacggtgctctcattcgcagcctagctaagacgcatgaggttctgatcactgttgaagaaggttcgataggagggtttggatcgcacgttgttcagtttcttgctctcgagggtcttcttgatgggaagctcaaggttttacaaagtggagaccaatggtattgcctgatcggtacattgaccatggctcaccagctgatcaaatggctgaagctgggctcatgccgtctcacattgcagcaacggctcttaacttaatcggtgcaccaagggaagctctgttttgagagtagttaatcatatacaaacactctacatgcaaccgaaggtttctt

SEQ ID NO: 5525 - DNA, 546 bp, Brassica juncea
tacgcgggaggttggaaaaggtaggatactaagggaaggtgagagggtagctctgttaggctacggatcagcggttcaaaactgtttagaggcttcttctatcctcgataaacgaggattaaagataactgtagcagatgcaaggttttgcaagccattagatgttgctctcattcgaaacttagctaggtctcacgaggttctgatcacggttgaagaaggttccattggagggtttggatcacatgtggtacagtttctagcactagatggtcttcttgacggaaagctcaagtggagaccgatggtactacctgaccggtatatcgagcatggatcaccactagaccaactggctgaagctggcctcacggcttctcacattgcagccaccgtacttaacttaattgggacaccccgagaaaccttgtattggaagtaatcgggtatccaatagaagggaaaagttccccaccattatctaacatattgtataaagttcttgttcttaaaagtttctcagtaaaaaaaactgaattatcccgc

SEQ ID NO: 5526 - DNA, 1123 bp, Brassica napus
ggtcatggatatcattatgcagagagagcagatgacaagtatcacggagttgtgaaatttgatccagaaactggtaaagagttcaaaacatttctgaaactaagtcttacacgacctattttgcggaggccttgattgcagaagcagaggcacataaagatgttgttgccattcatgcagccatgggaggtgggactgggttgaatctcttccaacgccgcttccctacacgttgtttcgatgtcggtatagcagaacaacatgccgttactttcgctgctggtcttgcatgtgaaggtcttaagccattttgtgcaatctactcgtctttcatgcaacgagcttatgaccaagttgtacatgatgttgatctacaaaaactacctgtgagatttgcaatggatagagcaggacttgtgggagcagatggtccaacgcattgtggagcatttgatgtgacgtttatggcatgtcttccaaacatgatagtgatggctccatctgatgaagcagaactttttaacatggttgcaaccgctgcagctatagatgaccatccttcttgctttcgatatcctagaggaaacggtgttggtgtttcacttcctcctggaaacaaaggtgtccctcttgaggttggaaaaggtaggatactcagggaaggtgagagggtagctctgttaggctacggatcagctgttcaaaactgtttagaggcttcttctatactcgataaacgaggattaaagatgactgtagcagatgcaagattttgcaagccattagatattgctcttattcgaaacttagctaaatctcatgaggttctgataacggttgaagaaggttcaattggagggtttggatcacatgtggtacagtttctagcactagatggtcttcttgcggaaagctcaagtggagaccaatggtactacctgaccggtatattgagcatggatcaccactagaccaactggctgaagctggcctcacggcttctcacattgcagccaccgtacttaacttaattgggacacccagagaaaccttgtattggaagtaatctggtatccaacagaagggaaaagttccccaccaattatctaacatattgtataaa

SEQ ID NO: 5527 - DNA, 2059 bp, Eutrema halophilum
atgactctctctgcatttggatttcctttttacttaagtagagaaacttccatagattattgcaaatccacttctttatcttcttctcaatctttggctacatatcttacatcactatgccggagaagtaccatttctctttcaaaaataaggacaagagtaaatggctcacttgtagagaagggtgaatatgattccattagaccaccaactcctatattagacacaatcaaccatccaattcacatgaaaaatttgtccatcaaggaactcaaagttctttcggacgagcttaggtctgatattatctttcatgtttctaaaaccgggggacatttaggttccaatctcggtgttgttgagcttacagtggctcttcattacatcttcaatactcctcatgataagatcctttgggatgttggtcatcagatcctaacggggagaagagaaaagatgaagacactgagacaaaccaatggcctgtccggtttcaccaagcgaggagagagtgagcatgattcctttggcactggacatagttcaaccacaatatctgctggcttagggatggctgtgggaagggacttgaagggtaggaataacaacgtggttgcagttataggcgatggtgccatgacagctggacaagcttatgaagccatgaacaatgctggctacattgactctgacatgattgtgattctcaatgaaaacaagcaagtctctctgcctactgctaacttggatggaccaactccacctgttggagctctgagtagtgctcttagtaagttacagcctaaacgtcctcttagggaactgagagaagctgcaaagggcgtgacaaagaaaattgggggatcaatgcaccaactagcttcaaaagtagatgaatatgctcgtagagtgattagtggaaccggttcaacactatttgaagaacttggtctctactatattggtccagttgatggacacgacatagatgatttggtcaccattctcaaagaagtaaagagaaccagaaccataggaccggttcttctcgttgtgaaatttgatccagcaacaggtaaacagtttaaaaacattggtgagactcagtcttactctacatattttgccgaggccttgattgcagaagcagaggaagacaaaaatgtggttgctattcatgcagctatgggaggtgggactggtttaaatctcttccaacgccgtttccctacaaggtgtttcgatgtcggtatagcagaacaacatgcagttactttcgctgctggtcttgcctgtgaaggccttaagccattttgtgcaatcaactcgtctttcatgcaacgagcttatgaccaagttgtacacgatgttgatttacagaaactacctgtgagatttgcgatagacagagcaggacttcattttgatgtgatgtttatggcttgtcttccaaacatgatagtgatggctccatctgatgaagcagagctttttaacatggttgcaaccgctgcagctatagatgaccgtccttcttgcttccgatatcctagaagaaacggtattggcgtttcacttcctcatggaaacaaaggtgtccctcttcagattggaaaaggtaggatactaagggaaggagagagggttgcactcttaggatacggatcagctattcagaattgtttagaggcttcttctatacttgataaacgcggattaaagataactgtagcggatgcaagattttgcaagccgttagatattgctctcattcgcaacttagctaaatctcatgagcttttgatcacggttgaagaaggatctattggagggtttggatcccatgtggtacagtttctagctcttgatggccttcttgatgggaaactcaagtggagaccaatggtactacctgatcggtatatcgagcacggatcaccactggatcaactagctgaagctggcctcacagcttctcacattgcagccaccgtacttaacttaatcgggacacctagagaagccttgttttgggagtaatgagatctccaataggtgg

SEQ ID NO: 5528 - DNA, 1749 bp, Nicotiana benthamiana
  misc_feature (998)..(998): n is a, c, g, or t
  misc_feature (1007)..(1007): n is a, c, g, or t
  misc_feature (1040)..(1040): n is a, c, g, or t
  misc_feature (1047)..(1047): n is a, c, g, or t
  misc_feature (1049)..(1049): n is a, c, g, or t
  misc_feature (1055)..(1055): n is a, c, g, or t
  misc_feature (1139)..(1139): n is a, c, g, or t
  misc_feature (1150)..(1150): n is a, c, g, or t
  misc_feature (1162)..(1162): n is a, c, g, or t
  misc_feature (1166)..(1166): n is a, c, g, or t
  misc_feature (1175)..(1175): n is a, c, g, or t
  misc_feature (1202)..(1202): n is a, c, g, or t
  misc_feature (1232)..(1232): n is a, c, g, or t
  misc_feature (1241)..(1241): n is a, c, g, or t
  misc_feature (1251)..(1251): n is a, c, g, or t
  misc_feature (1256)..(1256): n is a, c, g, or t
  misc_feature (1270)..(1270): n is a, c, g, or t
  misc_feature (1277)..(1277): n is a, c, g, or t
  misc_feature (1286)..(1286): n is a, c, g, or t
  misc_feature (1313)..(1313): n is a, c, g, or t
  misc_feature (1343)..(1343): n is a, c, g, or t
  misc_feature (1508)..(1508): n is a, c, g, or t
  misc_feature (1529)..(1529): n is a, c, g, or t
  misc_feature (1553)..(1553): n is a, c, g, or t
  misc_feature (1600)..(1600): n is a, c, g, or t
  misc_feature (1633)..(1633): n is a, c, g, or t
  misc_feature (1640)..(1640): n is a, c, g, or t
  misc_feature (1643)..(1643): n is a, c, g, or t
  misc_feature (1649)..(1649): n is a, c, g, or t
  misc_feature (1655)..(1655): n is a, c, g, or t
  misc_feature (1659)..(1659): n is a, c, g, or t
  misc_feature (1664)..(1664): n is a, c, g, or t
  misc_feature (1672)..(1673): n is a, c, g, or t
  misc_feature (1716)..(1716): n is a, c, g, or t
  misc_feature (1718)..(1718): n is a, c, g, or t
  misc_feature (1721)..(1723): n is a, c, g, or t
  misc_feature (1725)..(1725): n is a, c, g, or t
  misc_feature (1728)..(1728): n is a, c, g, or t
  misc_feature (1731)..(1731): n is a, c, g, or t
  misc_feature (1736)..(1736): n is a, c, g, or t
ctggccacagttcaaccaccatctcggcaggcctagggatggctgttggaagagatctgaaaggaaagaacaacaatgttatagctgtaataggtgatggtgcgatgacggcaggtcaagcttatgaagccatgaataatgccggttacctagactctgatatgattgttattttgaacgacaatagacaagtttcattacctactgctactctagacgggccggcccctcccgttggagctctaagcagtgctttgagcaggttgcaatctaatagacctctcagagaactaagagaagtcgctaagggagttactaagcagattggtggaccaatgcatgagcttgctgcaaaagttgatgaatatgctcgtgggatgatcagtggttccggatcaacattgtttgaagaacttggactttattatattggtcctgtggatggtcacaacattgacgatcttatttcgattctcaaagaagttagaagtactaaaacaacaggtccagtactgatccatgttatcactgagaaaggcagaggttatccatatgccgagagagctgcagacaagtatcacggagttgccaagtttgatccagcaacaggaaagcaattcaaagtcagtgccaagactcagtcctatacgacgcactttgcggaggctttaattgcagaagcagaagcagataaggatattgttgcaatccatgctgctatgggtggtgggactggtatgaacctattccaccgtcgcttcccaacgcggtgttttgatgttggaatagcagaacagcatgctgtaacctttgctgctggtttggcttgtgaaggcctcaaacctttttgtgcaatttattcatctttcttgccaagggcttatgaccaggtagtgcatgatgttgacttgcaaaagctgccagtgagatttgcaatggacagagctggacttgttggagcagatggtccgacgcattgtggtgcatttgatgttacnttcatggcntgtcttcctaacatggtagtaatggctccttcngatgaancngagctntttcacatggtagcaactgctgctgccattgatgacagaccaagttgtttcagatacccaagaggaaatgggatcggtgtagancttccggttgnaaacaaaggcantccncttgaggtnggtaaaggcaggatattggttgaaggngagagagtggctctactaggatatggctcngcagtacanaactgtttgnctgcngctgctgtgttagnaacccgnggtttacangtaacagttgcagatgcacgcttctgnaaaccactggacggtgctctcataaggagnctcgcaaaatcacacgaggtgcttatcaccgttgaagaaggatcaattggaggtttcgggtctcatgttgctcagtttatggccttagatggacttcttgatggcaagttaaagtggaggccgatagtacttcctgatcgatacattgaccacggatctcctgcngatcaattggcagaagctggncttacgccatctcacattgcagcnacagtgtttaacattcttggacaaaccagagaagctctagaggttangacataagattgtaataactgtaaaatgtctcnttgtaanatntagttntagganaagncaccngctaaggnnagaatagttgtaagctgatataactaccataaacaagtttgananatnnnangtntcntctanaagacctatgatt

SEQ ID NO: 5529 - DNA, 702 bp, Cleome spinosa
cgactcattgcggagcttttgacgtgtacgtttctattggtcatgtctcccgaacatggtagtgatggctccatccgatgaagccgagcttttccacatggttgcaactgccgctgctatagatgaccgtcctcttgcttccgttacccgagaggaaatggcatcggtgtcccacttccccctgggaacaaaggtgttcctctcgagatcgggagaggtaggatactgatggaaggcgacagggtggcgctattgggctatggctcggcggttcagaactgtttagcggctgcatccatgctcaaggaacgggatgtgaaaataactgtggcagatgcgaggttttgcaagcctttagaccgtgatctcattcgaagcctggctaaatctcacgaggttctaattacagtcgaagaaggttcgattggcgggttcggatctcacgtagtacagttcctcgccctcgatggccttctcgatggaaaactcaagtggaggccgatcgtgcttccggaccgatacatcgagcatggatcgccggtggatcaactggcggaggccggcctgacaccatcgcatattgcagccactgtaatgaacttgctcggcagcccaagagaagctctgttttgaaggccgtggcctgaagaacagaaaaaagtgttcttacagcaacagaaactggatttaactgtgattggg

SEQ ID NO: 5530 - DNA, 608 bp, Brassica napus
ggttggcgttgtgggttacttggctcagcggttctagagcgtttaggagcagccagcgatgctcctaagaacgtaggcctaaacataaccgtggcagatgcacgttctgcaagccgttggaccgtgctcttattcgcagcttagctaagtcgcacgaggtactgatcacggttgaagaaggtccattggcggtttgatcccacgttgttcagtttcttgctcttgatggtcttctcgatgggaagctcaagtggagaccaatggtgttgcctgatcggtacatcgaccacggctcaccagctgaccaaatggctgaagctggactcatgccatctcatatcgcagcaactgcacttaacttaatcggagcaccatgggaagctctgtactgagagtagatatgcaacaactctaagcggatcagagggttgtttaagtaatgataaatgttcccgccgaaaagaagcaatagagataagttctttggttatatgataactgagatggtgaagagaaactgagaagggtaaaggcgatctgtgtaaaaaagaagattagtatatgtattttatttttgtgatgaaactttatttagtggtgtgactgag

SEQ ID NO: 5531 - DNA, 844 bp, Solanum tuberosum
ttacttacatggcatgtcttcctaatatggttgtaatggctccttccgatgaagcagagctatttcacatggtagcaactgctgccgccattgatgacagaccaagttgttttagatacccaagaggaaatgggattggtgtagagcttccggctggaaacaaaggaattcctcttgaggttggtaaaggtaggatattgattgagggggagagagtggctctattgggatatggctcagcagtacagaactgtttggatgctgctattgtgctagaatcccgcggcttacaagtaacagttgcagatgcacgtttctgcaaaccactggaccatgccctcataaggagcctcgcaaaatcacatgaggtgctaatcactgtggaagaaggatcaattggaggttttggatcgcatgttgttcagttcatggccttagatggacttcttgacggcaagttgaagtggagaccaatagttcttcctgatcgatacattgaccatggatctcctgttgatcagttggcggaagctggcctaacaccatctcacattgcagcaacagtatttaacatacttggacaaaccagagaggctttagaggtcatgacataagatggaagaagcgtagaaagatggtatattgtaaaatatagttttaggtcatgacataagcagattaacatatacttatcctccaaaatatgtttaagtttccatggctgagttcaagccctcctcttagtctcctacatgacttgtgattaactcatatggtttctgattgtgtaaccggtgcttgatttttcgagttatgaaagataaatgaaaatgaaagattttac

SEQ ID NO: 5532 - DNA, 2124 bp, Flaveria ramosissima
cctttcgggtagtgttggtcatcagtcttacccgccataaaatacttgactggaagaagagaccgaatgcataccattagacagacaaacgggctggcgggcttcaccaaacgctctgaaagcgagcatgattgttttggcacgggtcatagctctaccaccatttctgcagggttaggtatggctgtgggaagggatctaaaaggtggaacaaacgacgtagttgctattataggtgatggtgctatgaccgcaggacaagcttatgaagccatgaacaacgcaggctatctagattcagatatgattgttatccttaacgacaacaaacaagtctcactaccaactgcaacacttgacgggcctatacctcccgtcggagctttaagcagtgctctcagtaggctacaatccaaccgccctcttagggaactgcgtgaagttgccaaagaagttaccaaacaaattggcgggcccatgcatgaactcgctgctaaagttgacgaatatgctcgtggtatgattagtggttcagggtcgacgctgtttgaagaacttggtttgtattacatcgggccagttgatggtcatagcattgatgaccttgttgccattcttaaagaggttaagagtactaaaacaacgggtccggttttaatccatgttattacagagaaaggtagaggatatccatatgctgagaaagctgctgataagtaccatggtgtagcgaaatttgaccctgcaacagggaaacagttcaagtcaagtgcagcaactcaatcttacactacttactttgcagaggcattgattgctgaagctgaggtggataaaaagattgtgggtatccatgctgcaatgggcggtgggaccgggatgaacctatttcaccgccggttcccgagccggtgttttgatgtcgggattgctgaacaacacgcggtcacttttgctgctggtttggcctgtgaaggccttaaaccattttgtgccatttactcatcattcttgcaaaggggttatgatcaggtggtgcatgatgtagacttgcagaagttgcctgtgaggtttgctatggaccgtgctgggctcgttggcgcagatggaccgacacattcgggctcgtttgatgtgacttacatggcgtgcctcccgaacatggtggtcatggctccttctgatgaggctgagctttttcacatggtggcaaccgctgctgccattgatgacagacctagttgcttccgttatccccgtggtaacgggataggcgcgcccttgccacctggcaacaaaggcgttcctctcgaggttggaaaaggtagaatattgattgaaggagaacgcgtcgctctgctagggtatggaaccgcggttcagagttgcttggtagcagcccgtttggtacaagaacgaggcttaaacataacagttgcagatgcccgtttttgcaaaccgttggaccataatctcatccgggcccttgcaaagtcacacgaggtcttgataacagttgaagaaggatcgatcggcgggttcggctcacatgttgctcacttcatggctctagatggtcttctagatggaaaactaaagtggagaccattggtgcttccggaccgttacatagaccatggtgcaccagctgaccagctagccgaagcgggtctgactccatcgcatatagctgcaaccgtattcaacgtactcgggcaaacgagagaggctctggaggttatgtcatagagtaatcttgtgtgttcagtgatgtgcacaaatggatataagtatatgcatagatgtacaacagttgctgctgaatttgtaagagtctgaaaatagagtcaaccctttgtaaaaagtcaactgatatagtcaactgatttgggttgggcttgtaaagttatggatagtttggtgcatcttcagagaaaccaatattccttgatatttataaaacccgacccgattagtaattaaatatttaaattgttgactttaggtggtaaggaaattggtccgggttaataataaaagcccatattagaaccgttatctaaactggaggccaataaccagttcaatgggtaggttatccgttatagcttataggtatacaaa

SEQ ID NO: 5533 - DNA, 864 bp, Cucurbita pepo
caggttgttcatgatgttgatttgcaaaagttgcctgttagatttgcaatggatagagcaggcttggttggagccgatggcccgactcattgtggttcgttcgatgttacgtttatggcatgcctgcctaacatggtggtgatggccccgtccgatgaggccgagctctttaacatggttgctacagctgcagccatagatgaccgacctagttgtttgcggtatccacgaggtaatggtattggcgtcgagctgccaccagggaataaaggcattcctattgaggttgggaaaggaaggattttactagaaggggaaagagtggctctgttgggctacggaacagcagttcaaaactgtttggctgctgcatcgatgctcgaacgccatggcttacgaataaccgtagcagacggacgtttctgcaagccactcgaccgagcccttatccgaaatctcgctaaatcacatgagattttaatcacagtggaagaaggatccatagggggattcggctctcatgtcatccagttcctagcactcgatggcctccttgatggctccttgaagtggcgaccgctagtccttcccgaccgatacatcgaccacggatcaccagccgaccaattggctgaagcaggccttactccatctcatattgctgctaccgtattcaatatgcttggacaaaccagggaagctcttgagatcatgtcatagaagagaactttacgatgagtcgtggcgctcccccttcgatgtaatgtacaaatccgaaaatcacgtatcgagtttggtcatatttacgtatacgtttaactatacattatcagtctaggctgtataaacaaatacttcttatac

SEQ ID NO: 5534 - DNA, 1661 bp, Linum usitatissimum
tgaacaatgctggttaccttgattctgacatgattgtaattctcaatgacaacaaacaagtttccttaccaactgctaatcttgatgggccaataccacccgttggagctctaagtagtgcgctcagcaggctgcaatcgaaccggccgctcagagaactcagagaagttgctaagggagtcacgaaacaaattggtggaccgatgcatgaattggcagctaaggttgatgagtatgctcgtggaatgataagtggttcaggatcaaccctgtttgaggagcttggcctttattatattggtccagttgatggccacagtatagatgacattgtggccattctcaaagaggttaaaagtaccaaagctaccggtccagtattgatccatgttgtgactgagaaaggcagaggatatccatatgctgaaaaggctgctgacaagtaccatggagtggccaagtttgatcctgcgaccggacagcaattcaagtccagcgctcctactcaatcttacactacatattttgcggaagctttgattgctgaagcagaagcggacaaagatgttgtagcaatccatgctgcaatgggaggcggaacaggcttaaatcagtttcttcgccggttcccaacaaggtgctttgatgtcgggattgcagaacagcatgctgtgacatttgctgcagggcttgcttgtgaaggacttaaaccattttgtgcaatatattcatctttcctgcaaagggcttatgaccaggtagtccatgatgttgatcttcaaaagctacctgtaaggtttgccatggaccgggcagggctagttggagctgatggaccaacacattgtggagctttcgatgtaacgttcatggcttgtcttcctaacatggtggtgatggccccttcagatgaggcagagctttttcacatggttgctactgctgctgccattgatgatcgtcctagctgtttccggtatccaagaggtaacggtttgggcgttgagttgccacctggaaataaaggagtccctcttgaggttggtcaaggaaggatcctgatagaaggtgaaagagtggcactgttaggatatggagcggcagtccaaagttgtttggctgctgcatctttagttgaacctcatggtctcaaggtaacagttgcagatgctcgattctgcaagccgttagatcaggcattgatcaggagcttggcgaaaacccacgaggttctgatcacggtcgaagaaggatcaattggtgggtttggttcccatgttgtacagttcctagcactggatggacttctcgatggcaatcttaagtggcggccactggttcttcctgaccggtatatcgaccatggatcaccagcagaccaaatgttggaagctggacttacaccatcacacattgcagcaactgtattcaacatacttggacaaaagagggaagctttgcagattatgtcatgaagtgtttgcagaattagtacttaaagaaacaatgtatagagaagtcggagctaaagtggaagtttaggatgtaggatgtcatttgtaaagcttccagctttgatgtaaagagaaaaatggagttctgcaatacaagaacaaggattcagagttcgttcagggttccaaattaaagctagttggttg

SEQ ID NO: 5535 - DNA, 975 bp, Pteridium aquilinum
ccatccatgctgcaatgggaggtggaacaggattaaatctcttccttcgccgtttcccagagagatgttttgatgttgggatagcagaacaacatgctgtcacttttgccgcaggtctggcctgtgaaggcctcaaaccattttgtgcaatctactcatcatttatgcaaagggcttatgaccaggttgtacatgatgttgatctgcagaagctgcctgtaagatttgcaatggacagagctggccttgttggtgcagatggtcccacgcattgcggggcttttgatgtcacttttatggcatgcctccccaacatggtggtcatggctccctctgatgaagctgagctttttcacatggtagccacggctgctgccatagatgaccgtcccagctgtttccgttacccaagaggaaatgggttgggagttcaggtgccacctggaaacaaaggagttccacttgagattggaaaaggcagggtactgattgaaggggaaagagtggcactattaggctatggatcagcagttcagagctgtttaggtgctgcctctttattggcatcacatggcttacggttgacagttgcagacgcccgattttgtaaaccattggatcacactctcatccgcaagctggcaaaatcacatgaggttctcattacagtggaagaaggatcaatcgggggctttggttctcatgtcgcacagttccttgcccttgacggtcttcttgatggcacagtaaagtggaggccacttgttcttcctgatcggtatatagaccatggatcaccagctgaccagttggccgaagctggtcttacaccatcacacattgctgcgacagtattcaatgtactcggacaaaaaagagaggctcttgagattatgtcctcaagaaactgaagaaccccatcagcttgaatttcccataatgtacaaaattttgttttcctgttacattgatgta

SEQ ID NO: 5536 - DNA, 2318 bp, Cucumis sativus
gcaggtcaagaaaaggccaggtgggatctgtgcatcactttcagagacaggagagtatccttctcagaggccaccaactcctcttttggatacaataaactatccaattcatatgaaaaatctatccgtcaaggagctttatcaactagctgatgaagtaagatccgatgtcatcttcaacgtttctaaaactggtggtcacttgggttccagccttggcgtggtggagctcacggtggctcttcactatgtcttcaatgctccacaggacagaattttgtgggatgttggtcatcagtcttatccacacaaaattctaactggaaggagggacaaaatgtcaactattagacagacgaatgggttgtcgggattcacgaaacgctctgagagtgagtttgatagctttggtgcagggcacagctccaccaccatctcagcaggcttaggaatggctgtgggccgggatctcaagggaagaaagaataatgtgattgcggttataggtgatggtgccatgactgcagggcaagcttatgaagccatgaacaatgccgggtaccttgactcggacatgattgttattcttaatgacaacaaacaagtctctttaccaactgcaaccctcgacgggcctgtaccacctgtgggagctttgagcagtgctctcagcaggctgcagtcaaacaggcctctcagagaattgagagaggtagccaagggtgtcacgaaacaaattggtggtcctatgcatgaattggctgcaaaagttgatgaatatgctcgtgggatgattagtggttctggatcaacattatttgaggagctcgggctctattatatcggccctgtcgatggtcataacgtggatgatcttgtctccattcttaaggaagttaagagtacaaaaaccactggtccagtcctcatccatgttgtcaccgagaaaggacgaggctatccatatgctgaaaaggctgcggacaagtaccatggagtcacaaagtttgaccctgctactgggaagcaacaaaaagccaaggctccaacgcagtcgtacacaacgtactttgcagaggcattgattgcagaagctgaaagggacaaagatattattgcaatccatgctgcaatgggaggaggcacaggcttaaatctctttcaaagacgttttccaacaagatgctttgatgttggcatagctgaacagcatgctgttacatttgctgctggtttggcttgtgaaggccttaaaccattttgtgcgatatattcatcattcatgcaaagggcgtatgatcaggcaagcattggcttcatgcctatccttgatactccattagcaaagggaattaaatttatctgttttctcaaaaaattccaacgaaatttatctgttttcaaattgcaggtagttcatgatgttgatttgcaaaagttgcccgtgagatttgccatggatagagcaggcttagttggagcagatggccccactcattgtggttctttcgatgttacctttatggcatgcctgcctaacatggtggtcatggctccatctgatgagaccgaactctttaacatggtcgctacagctgcagctatagatgaccgacccagttgcttccggtatccacgaggtaatggtatcggtgtagagctgccaccagggaataaaggcattcctatcgaggttgggaaagggaggattttacttgaaggggaaagagtggccctgttgggctatggaacggcagttcaaaactgtttggctgctgcatctatggttgaacgccatggcttacgaataactgttgcagatggacgtttctgcaagccacttgaccgagccctcatccgaagtcttgctaaatcgcacgagattctaatcacagtggaagaaggatcgattggaggatttgggtctcatgtcattcagtttctagcccttgatggccttcttgacggctccttgaagtggagaccgctagtccttcccgaccgatacatcgaccacggatcgccagcagaccaactggcggaagcaggtcttactccatcacatattgctgctacagtattcaatatgctaggacaaaccagggaagctcttgagatcatgacatagaagagaactttatgagtcgcagcgttccacttcaatgtaatgtacaaatttgaaaatcgcatatccagtttcgtcatacttatgtatacttacaactacacattatcaatctaggctgtataaacaaatacttctcgtacaattctagaaagtatatgatctaatgcaagattcttaattttcttcgtga

SEQ ID NO: 5537 - DNA, 1971 bp, Panicum virgatum
tgcactacgtcttcaacgcgccgcaggaccgcatcctctgggacgtcggccaccagtcgtacccgcacaaaatcctgacgggacggctcgacaagatgccgacgatgcggcagaccaacgggctggcggggttcacgaagcgcgccgagagcgagtacaactgcttcggcacggggcacagctccaccaccatctcggcggcgctgggcatggcggtggggcgggacctcaggggcggcaagaacagcgtggtggcggtgatcggcgacggcgccatgacggcggggcaggcgtacgaggccatgaacaacgccggctacctcgactcggacatgatcgtcatcctcaacgacaacaagcaggtctcgctgccgacggccacgctcgacgggcccgtgccgcccgtcggcgcgctcagcagcgcgctcagcaagctgcagtccagccgcccactcagggagctccgggaggtggccaagggcgtgacgaagcagatcggcgggtcggtgcacgagctggcggccaaggtggacgagtacgcccgcggcatgatcagcggccccggctccacgctcttcgaggagctcggcctctactacatcggccctgtcgacggccacaacatcgacgacctcgtctccatcctcaacgacgtcaagagcaccaacaccacgggccccgtcctcatccacgtcgtcaccgagaagggccgcggctacccctacgccgagcgcgccgccgacaagtaccacggcgtcgccaagttcgacccggcgacggggaggcagttcaagtcccccgccgcgacgctgtcctacaccaactacttcgccgaggcgctcatcgccgaggccgagcaggacggcagggtcgtcgccatccacgccgccatgggcggcggcacggggctcaactacttccaccgccgcttccccagccgctgcttcgacgtcgggatcgccgagcagcacgccgtcacgttcgcggccggcctcgcctgcgagggcctcaagcccttctgcgccatctactcctccttcctgcagcgcggctacgaccaggtggtgcacgacgtcgacctccagaagctcccggtgaggttcgccatggacagggccgggctggtcggcgccgacgggccgacccactgcggcgcgttcgacgtcacctacatggcgtgcctgcccaacatggtcgtcatggccccggccgacgaggccgagctctgccacatggtcgccaccgccgcggccatcgacgaccgcccgtcctgcttccggtacccgaggggcaacggcgtcggcgtcccgttgccgcccaactacaaaggcactcccctcgaggtcggcaagggcaggatcctgcgagagggcgaccgggtggcgctgctggggtacgggtcggcggtgcagtactgcctggccgcggcggcgctggtggagcgccacggcctcagggtcaccgtcgccgacgccaggttctgcaagccgctggaccacgccctgatcaggagcctcgccaagtcccacgaggtgctcatcaccgtggaggaaggctccatcggagggttcggctcgcacgtcgcgcagttcatggccctggacggccttctcgacggcaaactcaagtggcgcccactggtgcttccggacaggtacatcgaccacgggtcgccggcggatcagctggccgaggccgggctgacgccgtcgcacatcgccgcgacggtgttcaacgtcctggggcagaacagggaggccctggccatcatggcagtgcccaacgcttaggatttgcggcgagattccggcctaggcctgtagagacgctttgtacatttggttgttattgtagatgtcagcagggagattagtctgctttggatgaaaatgtcgcggggaacgagtcaacgatggcagtttttgctgtttattctgatgatatattaaagtacagatatgttcttgcggc

SEQ ID NO: 5538 - DNA, 999 bp, Euonymus alatus
gggttggcatgtgaaggcctcaaaccttttgtgcaatatactcatccttcttgcagaggggatacgaccaggtggtacatgatgtggacctacagaagctgcctgtaagatttgcaatggacagggccggactggtcggtgcagatggtccaacacattgtgggtcgtttgatgtcactttcatggcatgccttcctaatatggttgtgatggctgctgctgatgaggcagagctttttaacatggttgctaccgctgctgccataaatgatcggcctagttgtttccgatatccaagaggtaacggaataggcgttcagcttcccccaggaaacaaagggattccacttgaggttgggaagggaaggatattgattgaaggggagagagtggcattattgggttacgggacagcagttcagagctgtttagctgctgcctctctggttgtacctcatggcttgaagattactgttgcagatgcacgattctgcaaaccattggaccgtgaccttattcgcagcctagcaaaatcacatgaagtcttgattacagtagaagaaggatcaattggtggctttggatctcatgttgctcagttcatggctcttgatggtcttctcgatggcaaattaaagtggagaccaattgttctacctgatagatatattgagcacggatcaccagctgaccagtttgctgaagccggtctcacaccaaaccacattgcagccacagtgttcaacatacttggacaaacaagggaggctctagaaaccatgtcattgagaagttgaagtgcatagcgatttcaaatcctctgattaacgtgtggtacagtgatagagttgtagtgatgcatgattcgagtgcactgcagcctcttgtgcactgaaggtttacctttattagggtaaaagttttgcagaccaaccatccacatagccatcacatatagtcgcatcactatcttgattacaaataatgcaataaattttc

SEQ ID NO: 5539 - DNA, 2512 bp, Flaveria ramosissima
ttttctccactcaattcgctcaatcaccgtccaaatcgaccctttttcaatggccctttgtgggttcgcatttccggcgaatatgaaccaccgggcgattggttctcacgctccggtggtgcagcattgcttctttggtaaagatctgcaacacccgcaatcgtcccacaagcccttcaatcagttgagtaaaagggtaggtgtggttcaagcgacaatggctgatagaggtgagtatcactcgcagagacccccgactccactgttggacaccattaattacccaattcacatgaagaatctctcgatcaaggaactgaagcaactagccgatgagctgcggtctgatgtaatatttaatgtttctaagactggtggtcatttgggttcgagcctcggtgtggtggagctcactgtggctcttcattatgtgttcaatacgccgcaagataagatcctttgggatgttggtcatcagtcttacccacataaaatattgacgggaagaagagaccgaatgcataccattagacagacaaatgggttggcgggcttcactaaacgctctgaaagcgagcatgattgttttggcacgggccatagctctaccaccatttctgcagggttaggtatggctgtgggaagggatctgaaaggtggaacaaatgatgtagttgctattataggcgatggtgctatgaccgcaggtcaagcctatgaagccatgaacaacgcgggctatctagattcagatatgatagtcatccttaacgacaataaacaagtctcattaccaactgcaacacttgacgggcctatacctcctgttggcgctttaagcagtgctctcagtaggctacaatctaaccgccctcttagggactgcgtgagttgccaagaagttaccaaacaaatagcgggcccatgcatgaactcgctgctaaagttgacgaatatgctcgtggtatgattagtggttcagggtcaacactgtttgaagaacttggtttgtattacatcggccccgttgatggtcatagcattgatgatcttgttgccattcttaaagaggtcaagagtactaaaacaacgggtccagttttgattcatgttattacagagaaaggtagaggatatccatatgcagagaaagctgctgataagtaccatggtgtggcgaaatttgaccctgcaactgggaaacagttcaagtcaagtgcagcaactcaatcttacactacttactttgcagaggcattgattgctgaagctgaggtggataaaaagattgtgggtatccatgctgcaatgggtggtgggaccgggatgaacctatttcaccgccggttcccgaaccggtgttttgatgttgggatcgctgaacaacacgcggttactttgtctgctggtttggtcctgtgaaggccttaagccattttgtgcaatttactcatcattcctgcaaaggggttatgatcaggtggtgcatgatgtggacctgcagaagttgcctgtgagatttgcaatggaccgggctgggctcgttggcgcagatggcccgacacattcgggctcatttgatgtgacttacatggcgtgccttccgaacatggtggtcatggctccttctgacgaggctgagctttttcacatggtggcaaccgctgcagccattgatgacagacctagttgcttccgttatccccgtgggaacgggataggcgcacccttgccacctggcaacaaaggcgttcctctcgaggttggaaaaggtagaatattgatcgaaggagagcatgtcgcgctcttaggatatggaaccgcggttcagagttgcttggtagcagcccgtttggttcaagaacgaggcttaaacataacagttgcagatgcccgtttttgcaaaccgttggaccataatctcatccgggcccttgcaaagtcacacgaggtcttgataacagttgaagaaggatcaatcggtgggttcggctcacacgtggctcacttcatgctctagatggtcttctagatggaaaactaaagtggagaccactggtgctcccagaccgttacatcgaccatggtgcgcctgatgaccaactagccgaagcgggcctgactccatcgcatatagctgcaaccgtattcaacgtactcgggcaaacaagagaggcactggaggttatgtcatagagtaatcttgtgtgttctgtggtgtgcacaaatggatataagtatatgcatagatcatgtacaacagttgctgttgaacttgtaacagtcaaaatgtagggtcaaccctttgtaaaaagtcaactgatttgtgttgggtttatatagttatggatagtttggtacatcttcagaaaccaatattccttgatatttatcaaacccgacccgagtttagtcattagattgttgacttttaggtggtatggaaatgggtccgggttaatgatataagacccatattagaaccggttatttaaactggaggcccaataac

SEQ ID NO: 5540 - DNA, 768 bp, Olea europaea
ttacttttatggcatgccttcctaacatgatagtgatggctccttctgatgaggctgagctatttcacatggttgcaactgcggccgctattgatgatagaccaagctgtttccgctatccaagaggaaacggtgtgggcgtggagctacccctggggaacaaaggcattcctcttgaggttggaaagggccggatattgattgaaggagagagagtggctcttttggggtatggatcagccgttcaaagctgtttggctgctgctgccttagtagaatcccgtggtttacagttaactgttgcagatgcacgcttctgcaagccactagatcactctcttatacgcagcttggcaaaatcacacgagatcttgatcactgtggaggaagggtcaattggaggttttggatctcacgtagctcagttcatggccctggatgggcttcttgatggcaatttgaagtggaggccggtggttcttgcagatcggtacattgatcatggatccccagctgaccaactgatggaagcggggctgacaccatctcatatcgcagcaacagttttcaatataattgggaaagctcgagaggctttggagattatgtctgaaagtgtaagaagtttataaattgagtacataattgtttcgactcttaaagatagtcttaggatggactctggctcttttgtaatcacgttgtaattcaactaactgaaaaagctgagaaatcttgatgacatatatagaaaatataaaaaaaagg

SEQ ID NO: 5541 - DNA, 1064 bp, Tripterygium wilfordii
tggaacaggattgaatcttttccttcgccaattccccacaagatgctttgatgttgggatagcagagcagcatgcagttacttttgctgcagggttggcatgtgaaggcatcaaacctttttgtgcaatatactcatccttcttgcagagggcatacgaccaggtggtacatgatgtggacctacaaaagctgcctgtaagatttgcaatggacagggccggactggtcggtgcagatggtccaacacattgtgggtcgtttgacgtcactttcatggcatgccttcctaatatggttgtcatggctcctgctgatgaggcagagctttttaacatggttgctactgctgctgccataaatgatcggcctagttgtttccgatatccaagaggtaatggggtaggcgttccgcttcccccaggaaataaagggattccacttgaggttgggaagggaaggatattgattgaaggggagagagtggcactattgggttacgggacagcagttcagagctgtttagccgctgcctctctggttgaacctcatggcttgaagttaactgttgcagatgctcgattctgcaagccattggactgcgcccttattcgcagcctagcaaaatcacatgaagtcttgattacagtagaagaaggttcaattggtggctttggatctcatgttgctcagttcatggctcttgatggtcttctcgatggcaaattaaagtggagaccccttgttctacctgatagatatatcgaccatggatcgccagcttaccagtttgccgaagcaggtctcacaccatcccacattgcagccacagtgtttaacatacttggacaaacaagggaggctcttgcaatcatgtcattgagccacagtgtttgacatactcttgacaatctaaatctcttgtaatttttgtctttgattagtgtaaaaaattgttcatataccaaccatctcatgaagtagcatcagtatactgtaataaaatttcttctctctttcatatccaacagcactagaaatatatagatccgtaaggcttatgaat

SEQ ID NO: 5542 - DNA, 2229 bp, Arabidopsis thaliana
attgatactaccactatatatacgttggaatgtcatatcaaacacagattaacaaattctctcaaatggctctctccgtatttgcctttccttcttacataaataggaatccttcactaaaatatcttaaaccttcttctatgtcttctacaaaatattcaaaagtaagagcaacaacattttcagagaaaggtgaatattattcaaacagaccaccaactcctttattggacacaatcaaccatccaatgcacatgaaaaatctctccatcaaagaactcaaagttctttcggacgagttgagatctgatgttatttttaatgtttcgaaaactggaggacacttgggttcgaatcttggtgttgttgagctcaccgtggcccttcattacatcttcaatactcctcatgataagatcctttgggatgttggtcatcagtcttatcctcacaagattctaacgggaagaagaggaaagatgaagacaataaggcagaccaatggcctctccggctacaccaagcgaagagagagtgagcatgactcttttggcaccgggcacagttcgaccacactatctgcaggcttagggatggctgtagggagggatttgaaggggatgaacaacagcgtggtttcggttataggcgatggtgctatgacagctggacaagcttatgaagcaatgaacaatgctggctacttacactccaacatgattgtgattctcaacgacaacaaacaagtatctttgcctactgctaacttggatggaccaactcaacctgttggagctctgagctgtgctcttagtaggctgcaatctaattgtggaatgattagagagactagttcaacactgtttgaagaacttggttttcactatgttggtccagttgatggacacaacatagatgatctggtctccattcttgaaacattaaagagcaccaaaaccataggaccggttcttatccatgtcgtgactgagaaaggtcgtggatatccttacgcagagagagctgatgacaagtatcatggagttttaaaatttgatccagaaacaggtaaacagttcaaaaatatttccaagactcagtcttacacttcctgttttgtggaggccttgattgcagaagcagaggcagacaaagatattgttgccattcatgcagccatgggaggtggaaccatgttgaatctcttcgaaagccgctttcctacaaggtgtttcgatgtcggcatagcagaacaacatgcagttaccttcgctgctggtcttgcttgcgaaggacttaagcccttttgtacaatctactcatctttcatgcaacgggcatatgatcaagttgtacatgatgttgatctacagaaactgcctgtgagatttgcaatagatagagcaggacttatgggagcagatggtccaacacattgtggagcatttgatgtgacgtttatggcatgtctaccaaacatgatagtaatggctccatctgatgaagcagagctttttaacatggttgcaaccgctgcagctattgatgaccgtccttcttgctttcgatatcatagaggaaatggtattggtgtttcacttcctcctggtaacaaaggtgtccctcttcagattgggagaggtaggatactaagggacggcgagagggttgcgcttttgggctatggatcagcggtgcaaagatgtttagaggctgcatctatgctaagcgaacgcggattaaagataacagtagcggatgcaagattctgtaagccgttagatgttgctctcattcgtagcttagctaaatcacacgaggttttgatcacggttgaagaaggttccattggaggatttggatcgcatgtggtacaatttcttgcacttgatggccttcttgatggaaagctcaaggtatatcgaacatggatcaccaatggatcaactagctgaagctggcctcacagcgtctcacattgcagccactgcacttaacttaatgggaacacctagagaagcattgttttgggagtaacgggatctccatgagagtgctctttccacaaaaaacctatatcgagagaacccgcttagaagaaggatatattatagttatataacatcttgaataaattcattcacattcaagaatgattttgtgtgtattgcttatatctcgtttcaactaggctaagaaatagaacaaatggctttgacgttttcatca

SEQ ID NO: 5543 - DNA, 667 bp, Curcuma longa
attcgggggcgttcgacgtggcctacatggcctgcctgccgaacatggtggtcatggcgccgtccgacgaggcggagctgttccacatggtggccacagcggcagccatcgacgacaggccgtcgtgcttccgctacccgagaggaaatggcatcggcgttcctcttcctccgggaaacaagggcgttcctctagaaattgggaaggggaggattctgattgaaggcgaaagggtggcgctgctcggatatgggacgtcggtgcagagttgcttggcggcggcttccatggtggagctccaaggcctcaagatcacggtggccgacgcaaggttctgcaagccacttgaccggagcttgattcgaagcttggctaagtcgcatgaggtactcatcaccgtcgaagaaggatcaatcggcggctttggctctcacgtagctcagttcatggctctggatggtctcctcgatggcaaactcaagtggaggcctttggttcttcctgatagatatatcgaccatggatcgcccagtgatcagctagcggctgcgggattgacaccttctcatatcgcagcgagtgtgttcaacgtcatcggacaaactagggaggctcttaaaatgatgtcgtaggaagacacattaaaactagtgttaattttattttt

SEQ ID NO: 5544 - DNA, 515 bp, Ipomoea batatas
tcgaggttggtagaggccggatattgatggaaggagagagagtggctctcgtgggatatggaacagcagtgcagagctgcttatctgcagctgccttattggaaactcgtggtttacgagtaactgttgcagatgcaaggttttgcaagcctttggaccatgctcttatacgcagcttggcaaagtcgcacgaggttatgatcactgtggaagaaggatcaatagggggctttggatctcatgtggctcagtttatggctctagatggtctccttgatggcaatttaaagtggaggcctgtggttcttccagatcgttatattgatcatggagctcccgctgaccaattggcagaagctggtctcacgccatcccatatcgctgccacagtatttaacattctgggacaagcaagagaggctctggagatcatgacgacatagcagtagtaaactcactgtaatgacttccctagtgtaaaaagggcagctcgtgcccgattcctgcaagccggg

SEQ ID NO: 5545 - DNA, 1894 bp, Pennisetum glaucum
cggggttcaccaagcgcgccgagagcgagtacgacagcttcggcacgggccacagctccaccaccatctcggcggcgctcgggatggccgtgggccgggacctcaagggcggcaagaaccacgtcgtcgcggtgatcggcgacggcgccatgacggccgggcaggcgtacgaggccatgaacaacgccgggtacctcgactccgacatgatcgtcatcctcaacgacaacaagcaggtgtccctaccgacggccaccctcgacgggcccgcgccgcccgtcggcgcgctcagcagcgccctctccaagctgcagtccagccgcccgctcagggagctccgtgaggtggccaagggcgtgacgaagcagatcggcgggtcggtgcacgagctggcggcgaaggtggatgagtacgcccgcggcatgatcagcggccccggctcgtcgctcttcgaggagctcggcctctactacatcggccccgtcgacggccacaacatcgacgacctcatctccatcctcaacgacgtcaagagcaccaagaccaccggccccgtcctcatccacgtcgtcaccgagaagggccgcggctacccctacgccgagcgcgccgccgacaagtaccacggcgtcgccaagttcgacccggcgacggggaagcagttcaagtcgccggccaagacgctgtcctacaccaactacttcgccgaggcgctcattgcggaggccgagcaggacagcaagatcgtggccatccacgcggccatgggcggcggcacggggctcaactacttcctccgccgcttccccaaccgctgcttcgacgtcgggatcgcggagcagcacgccgtcacgttcgccgccggactggcctgcgagggcctcaagcccttctgcgccatctactcctccttcctgcagcgcggctacgaccaggtggtgcatgacgtggacctgcagaagctcccggtacggttcgccatggacagggccgggctggtcggcgcggacgggccgacccactgcggcgcgttcgacgtcacgtacatggcgtgcctgcccaacatggtcgtcatggcgccggccgacgaggccgagctctgccacatggtcgccaccgccgcggccatcgacgaccgcccgtcctgcttccggtacccgagaggcaacggcgtcggcgtgccgctgccgcccaactacaagggcactcctctcgaggttggcaaggggaggatcctgcaggagggcgaccgggtggcgctgctggggtacgggtcggcggtgcagtactgcttggctgccgcgaccctggtggagcgccacggcctcagggtcaccgtcgccgacgccaggttctgcaagccgctggaccaagccctgatcaggagcctcgccaagtctcacgaggtgctcatcaccgtcgaggaaggctccatcggagggttcggctcgcacgtcgcccagttcatggccctcgacggcctcctcgacggcaaactcaagtggcgtccgctggtgcttccggacaggtacatcgaccacggatcgccggccgatcagctggccgaggccgggctgacgccgtcgcacatcgccgcgacggtgttcaacgtcctggggcagaacagggaggcccttgccatcatggcagtgccgaacgcgtaggaaatgggtcgattccggccaatagatatgcttgtacatttgtcattagatgttaatagggagattaattagtctgctttggatgatgaacatgccgtgggggccaacgagcgctttcgttatgtattttgacactgacatccaaaattccagcgctgcgcaaacttaccatcgttctcgatggatgtcgtgtataaggacgtgacaccacaagagggggatgaattggg

SEQ ID NO: 5546 - DNA, 680 bp, Arachis hypogaea
cttgagattggaaaaggtaggatattgatggaagggaaagagtggccttattgggctatggagcagcagtccagagctgtctggctgcagcttccttagtggagcatcatggcttgcgcataactgttgctgatgcacggttctgcaagccattggatcgttccctcattcgcagcctagcaaaatcacacgaagttttgatcactgtcgaagaaggatcgattggaggattcgggtctcatgttgttcagttcatggcccttgatggtcttctagatggaaaattgaagtggaggccaatggttcttccggatcgttatattgaccacggatcgcctgctgatcaattgtctgaagctggccttgctccaactcagatagcagcaactgtgttcaacatacttggacaaacacgggaggcactagaggttatgtcataaaaagagaatatcaagaggggttaaattttcactccccacaatatacacatgttaacaatataaatcaccttgtgtaacacaaacaaggtaatattagaatgtgaattatgtaaatgttagtaacaatgtagtttatcaaatagtagtatcagctggttacaacttgcaaggaagaaataatgtcaatttttcaatgctgaggaagttggttcatgaaatggccaaatttaaatagttttt

SEQ ID NO: 5547 - DNA, 1188 bp, Tragopogon dubius
gcgatgggcggcggaaccggaaatgaatctattccttaaggcggttcccaaatcggtgcttcgatgtcggaattgcagaacaacacgcggttacttttgctgctggtttagcatgtgaagggcttaaaccattttgcgcaatttactcctcgtttttacagaggggttatgatcaggtggtgcacgatgtggatttgcagaagcttccggtgagatttgcaatggatcgagcgggtcttgttggcgcagacggcccaacacattcagggtcatttgatgtcactttcatggcatgcctcccaaacatggtggtgatggctccttccgacgaggctgagctttttcacatggtggcaaccgctgctgccattgatgacagaccgagctgtttccgatacccacgagggaatggcataggcgcgcccttgccacccggaaacaaaggcattcctctcgagatcggaaaagggcgaatagtgattgaagggcaacgagtggcgctgttgggctacggatcggcggttcaaagctgcttggctgcagccgctttggtacaagatcgggggttaagtataacggttgcagatgcgcggttctgcaaaccgttggaccatagtcttattcgtgcacttgcaaagtcacatgaggtgttgataaccgttgaagaagggtcaattggagggttcgggtctcacgttgcacatttcatggcattagacggccttcttgacggaaagttaaagtggagaccgttggtgcttccagatcgttacatagagcatggagcacctgctgaccaattagccgaagccgggctgaccccatcacatatagcagcaactgtattcaatgtgctcggccaaacccgagaggctctggaggttatgtcatagagggttcttgtgtataaatacaagtacagataatatttatctgtatagatatacaacacttgttgctcaacttctaactgcctgaaaatatagagtgaaaagtcgaattgtagacgttgggtagtctaatattagagcagttgctattgggtggtttattttatgtccaaaaatctataaatttggttcaagatttagagtttgtgaggttcgatggagagggatgattaaggaatggaatgtagggttaatgatttgtataatgagctattgtatttgtatatatatgtatctc

SEQ ID NO: 5548 - DNA, 1197 bp, Ambrosia trifida
tatccatgctggcgatgggtggtgggacggggagtgaatctattccaccgccgaattcccaagtcggtgttttgatgttgggattgccgaacaacacgcggtcacttttgcagctggcttggcgtgtgaaggccttaaaccattttgcgcgatatactcatcgtttctgcaaaggggttatgatcaggtagtgcatgatgtggatttgcagaagttgcctgtgagatttgcaatggatcgggctgggcttgttggtgccgatggcccaacacattcgggctcgtttgatgtcacttacatggcatgcctaccgaacatggtggtcatggctccttctgacgaggctgagctttttcatatggtggcaactgctgctgccattgatgacagacctagctgcttccgttatccacgtgggaacgggataggcgttcccttgccacctggcaacaaaggcattcctctcgaggttggaaaaggtcgaattatgcttgaaggagaacgtgttgcgctcctaggatatggaacagcagttcagagttgcttagctgcagccggtttagtaaaacaacgaggtttaaacataacagttgcagatgctcgtttctgcaaaccattggaccatcatctcatccgggcccttgcaaagtcgcacgaggtcttgatcacagttgaagaaggatcgataggtgggttcggttcacacgttgctcatttcatggcactagatggtcttcttgatggtaaactgaagtggagaccactggtgcttccagaccgttacatcgaccatggtgcaccagatgaccagctagccgaagcggggttgactccatcgcatatagctgcaaccgtattcaatgtacttgggaaaacaagagaggctctggaggttatgtcatagagggttcttgtatggtaagtgatgtgcacaaatagatatatttatctgcatagagggttcttgttgctcaacttttaacagtgtgaaaatagagttgaaatcatctgtataaagtcaaccgaaacgtattgggtttcttgacttattacgtggtacgggtcaatactaaaagacccgtcttagaacccgatcgtttaaactggagacccggtaaaagttcaatgggtatgtatacaaaattttctgtctgtgtttgttgttgtattattatttggaattatgttaaaaaagaa

SEQ ID NO: 5549 - DNA, 507 bp, Cirsium arvense
tgccattgccacctggcaacaaaggcgttcctctcgagattgggaaaggtcggataatgatcgaggggcagcgagtagcgctcctaggctatggaacggctgttcagagttgcatggctgcggctgctttagtacaagaacgcggtttaaacataaccgttgccgatgcccgtttctgcaaaccattggatcattctcttatccgaacccttgcaaagtcgcacgacgtcttgatcaccgttgaagaaggatcgatcggaggattcggctctcacgtcgcacatttcatggccttagacggccttcttgacggaaacttaaagtggaggccattggtgcttccggaccgttacattgaccacggtgcgcctaacgaccaattagccgaagctgggctgactccatcgcatatagccgcaactgtattcaacgtaattgggcaaacgcgagaggctctggaggttatgtcatagagggttcctatgtgctcaccggtgtataaataca

SEQ ID NO: 5550 - DNA, 1826 bp, Fagopyrum esculentum
gtatctcagcaggcctgggtatggcttgttcggaaaggggatctaaagggaagagaaaacaatgtggttgccgttattggtgatggggccatgacagcagggcaagcatacgaggccatgaataatgcaggtttcttagattctgacatgattgttattctaaatgacaacagacaagtttcattaccaaactgctacactagacgggcctgcagctccagtgggagctcttagcagtgctcttagtagacttcaatcaaacagacctcttagagaactaagagaggttgctaagggcgtgactaagacgcttggaggacctatgcatgaactggctgcaaaagttgatgaatatgctagggaatgattagtggctcaggatcaacccttttcgaagagcttggtctttactatattggccctgttgatggtcataatatagatgatctcgttgctattcttaaagaagttaaaagtaccaacacaactggtccagtccttatccatgtggtcaccgagaaaggaagaggatatccgtatgcagagaaagctgatgacaaatatcatggagttgttaagtttgatccggccaccggaaagcaattcaagtctcagtcattgaccaagtcttacacgacttatttcgcagaggctttgattgcagaagctgaggcggacaaagatgtcgttgcaatccatgcagccatggggggtgggaccgggttgaacctctttcaacgtcgtttcccctcacggtgttttgatgttggcatagccgagcaacatgctgctacttttgcagctggtttggcatgtgaaggccttaagccattttgtactatttactcatctttcatgcagagggcttatgatcaggtggttcatgatgtggacttgcaaaagctgcctgtgaggtttgctatggacagggcaggtttggttggagcagacggtccaacgcattgtggcgcgtttgatgtcactttcatggcttgccttccaaatatggtggtgatggctccttcagacgaagcagagcttttccatatggttgcaactgctactgctattgatgataggccttcttgtttccgttatcctagaggaaacgggattggtgtcgaattgcctccaggaaacaaagggattcctcttgagattgggaagggccggattctgaaggagggcgagagagttgcgcttttaggatacggaacagctgtacaaagctgtttagctgcatcagctctagtggaagcccgagggcttcgtttaaccgttgtagacgcgagattctgcaagccactggaccaggctctaattcgaagcttggcaaagtctcatgaggtgttgatcacagttgaggaaggctccataggcggcttcgggtctcatgtagcccagttcatggctcttgatggccttcttgatggcaatctcaaatggaggccaatggtgctcccagacagatacatcgagcacggggcaccggcggatcagatggctgaagcgggtcttacgccggcacatatcgctgcaaccatattcaacatcttagggcaaacaagggaggctcttgaagtgttggcctacaagtgaaaaggaagttcatgtgtttaatgtttgtactttgtgggctatgtaatgtggatgctttggtttgtcaagtttgtacagattagtttagaaaggaaaggggaatagcatgatatttgtgtaatctgcatgtcatcatagatacatcagtttcaatattgataataataaaaagatacatcagtttggaaataaaaagtaggactggagtattgatagttgtatgatac

SEQ ID NO: 5551 - DNA, 671 bp, Fraxinus spp
gaccaagctgtttccgctatcccagagaaacggggggctagagctgcccccgggaaacaaaggcatacctctcgaggttggaaggggccggatattgattgagggagagagagtggctcttttggcatatggatcagccgttcaaagctgtttggctgccgccgccttagtagaaccccgtggtttacggttaactgttgcagatgcacgcttctgcaagccactagatcactctcttatacgcagcttggcaaaatcacacgagatcttgatcactgtggaggaagggtcaattggcggttttggatctcatgtagctcagttcatggccctagatgggcttcttgatggcaatttgaagtggaggccgctggttcttccagatcggtacattgatcatggatccccagctgaccaactgatggaagcagggctgacgccatctcatatcgcggcaactgtttttaatatacttgggaaagctcgagaggctttggagattatgtccgaaagtgtaagaattgcataagccgaatacttcataattgtttcgactctaaaagagtcctaggatggactcgctcttttataatcaggttgcaattcaacaaactgaaaaaactgagaacttgttagtgacatatatatgaaggattatattccctgtactg

SEQ ID NO: 5552 - DNA, 906 bp, Pisum sativum
aggacattatcgcaatccatgctgcgatgggaggtggaactggcatgaatctcttccatcgccgattcccaacaagatgctttgatgtcgggatagcggaacagcatgccgttacatttgctgcaggccttgcttgtgaaggccttaagcctttctgtgcaatttactcgtcgttcttgcagagggcctatgatcaggtggtccatgatgtggatttgcagaagctgcctgtaagatttgcaatggacagagctggattagttggttcagacggtcctacgcatagtggtactttcgatgtgacttttatggcatgccttcccaacatggtggtgatggctccttctgatgaagcagagctttgccacatggttgccactgcagcagccattgacgatcgacccagttgtttccgatacccgaggggaaatggcgttggtgttgaactcccagctgagtacaaaggcatccctcttgagattgggaaaggtaggatactaattgaaggtgaaagagtagccctcttgggatatggatcagccgttcagagctgtttagccgcagcttccttagtggaacgtcacggcctgcgcttaaccgttgccgatgcacgtttctgcaagccactggatcgatccttgattcgtagcctggcaaagtcgcacgaggttttgatcacagtagaagaaggatcaatcggaggatttggttctcatgttgctcaattcatggcacttgacggccttctagatggaaaattaaagtggaggccggtggttcttccggaccgttacatcgaccacggatcacctaatgaccaattgtctatggctggtcttacaccctctcacatagcagcaacagtgttcaacatacttggccagacaagagaggcactagaggtca

SEQ ID NO: 5553 - DNA, 1115 bp, Trigonella foenum-graecum
gatgctttgacgtggggatagcagaacagcatgccgttacatttgctgctggtctagcttgtgaaggccttaagcctttctgtgcaatttactcatcattcttgcaaagggcctatgaccaggtggtacatgatgtggatttgcagaagcttcctgtaagatttgcaatggacagagctggattagttggatcagacggtcctacgcattgtggttcttttgacgtcacttttatggcatgcctccccaacatggtggtgatggctccttctgatgaagcagagctttgccacatggttgccactgcagcagccattgacgatcgaccgagttgtttccgatacccgaggggaaatggcattggtgttgaacttccaaccgagtacaaaggcaatcctcttgagattgggaaaggtaggatactaattgaaggggaaagagtagccctattgggctacggatcagccgttcagagctgtttggctgcagcttccttagttgaacatcatggcttgcgcttaaccgttgccgatgcacgttttctgcaaaccattagatcgatccttgattcgcagcctggcaaaatcacacgaggttctgatcaccgtagaagaaggatcaattggaggatttggttctcatgttgctcagttcatggcccttgatggtcttttagatggaaatttgaagtggaggccggtggttcttcctgaccgatatattgaccatggatcacctgctgaccaattgtctatggctggtcttacaccctctcacatagcagcaacagtgttcaacatacttgggcagacaagagaggcattagaggtcatgtcataagaaaaatacaaaggggttcaatttgtcattcccctcaatatacacgatacaacatttttgtgattaattcatcttgtctaacgtgaagtagtaatgatgtaaatgatttaactagataatgcagattgtcaaatagtttcatgtatggaatcacggtgtgacaaatttccaaattcccagtgacaccgtaattttgttgaagttccaaagtgtaacttatgacaaattacggtttcttttgttatctaaactgaaatttgaactgtatcgcataa

SEQ ID NO: 5554 - DNA, 556 bp, Citrullus lanatus
gaaagagttgccctgttgggctatggaacggcagttcaaaactgtttggctgctgcatctatggttgaacgccatggcttacgaataacagttgcagatggacgtttctgcaagccactcgaccgagccctcatccgaagtctagctaaatcacatgagattttaatcacagtggaagaaggatcgattgggggatttgggtctcatgtcatccagtttctggctcttgatggccttcttgacggcaccttgaagtggagaccgcttgtccttcccgaccgatacatcgaccatggattgccagcagaccaactggctgaagcaggtcttactccatctcatattgctgctacggtatttaatatgctaggacaaaccagggaagctcttgagattatgtcatagatgacaactttacgagtcgtagcgttccacttcaatgtaatgtacaaatttgagaatcgcgtatttagttcggtcatacttgcgtatacttataactataccttatcagtctaggctgtatcaacaaatacttctcatacaaggcttctag

SEQ ID NO: 5555 - DNA, 1350 bp, Artemisia annua
ttcatgttattactgagaaaggtcgaggatacccctatgctgagaaagctgccgataagtatcacggtgtgggcaagttcgatccggcaaccggaaagcaattcaagtcaagcgcaccaactcaatcttacacaacgtactttgctgaagcattgattgcagaggctgaagcagataaaaagattgtcgggatccacgctgcaatgggtggtgggaccggaatgaatctattcctccgtcggtttccgactcgatgttttgatgttggcattgcggaacaacatgcggttacatttgctgcaggattggcgtgtgaaggacttaaaccattttgtgcaatttactcttcgtttttgcaaagggggtatgatcaagtggtgcacgatgtagatttgcagaagttacctgttagatttgctatggatcgagcagggttagttggggcagatgggcccacacattcggggtcatttgatgttacttttatggcgtgtttaccaaatatggtggtcatggctccttctgatgaagctgagctttttaacatggttgctactgcagctgctattgatgatagaccgagctgtttccggtacccgcgtggaaacgggattggggttccattaccacctggtaacaaaggtgttccacttgaggttggaaaaggtagaataatgctcgaagggcaacgagtagcacttctaggttatggaacagccgttcagagttgcatggctgcagccacaatagtacaagaacgtggtttaaacataaccgttgcagatgctcgtttttgcaagccattagaccattctcttatccgagcccttgcaaagacgcacgaggtcttgatcactgttgaggaagggtcaattggagggttcggctcccatgttgctcatttcttggcattagatggtctccttgacggaaacttgaagtggagaccgctagtgcttccagaccgttacattgaccatggagcgcctgcagaccaattagccgaagctgggttgactccatcacatatagctgcaaccgtatttaacgtacttgggcaaacacgagaggctttggaggtcatgtcatagaagagtcttgtgtgtgctcatcaatgtatacaaacagataaatatctatctgcatagagatttaaaacacttgttgctgtctttctaacagtctgtagtgtaaagtcaaaaaccctttgtataaagtcagccgatttaagctaattgaatcgggtcgggtttttaagcatttcgatactttaacattacatggtttggaaaacgttactcatgggacttgaacacaaaaccttttggttgataaactgcacttttcata

SEQ ID NO: 5556 - DNA, 1662 bp, Castanea mollissima
ttgctgttataggtgacggtgccatgactgcagggcaagcatatgaagccatgaacaacgctgggtaccttgactcggacatgattgttattcttaatgacaataaacaggtttcgttacctactgctactctagatgggccaataccacctgtaggagctttaagcagtgctctcagtaggttgcaatcgaacaggcctctcagagaactaagagaggttgccaagggagttactaaacaaattggtggtcccatgcatgaactggctgctaaagttgatgaatatgcccgtgggatgatcagtggttccggatctacacttttcgaagagcttggactctattatataggtcctgttgatggtcacaacatagatgatcttatttccattctcaaagaggtcaaaagtaccaaaacaacgggtccagttctgatccatgttgttactgagaaaggccggggatacccatatgcagagaaagcagcagacaagtatcatggagtggccaaatttgacccagcaactggaaagcaattcaaaaccaaggcacccacacagtctttcacaacatactttgcagaggctttgattgcagaagcagaaattgacaaagatattgttgcaatccatgctgcaatgggaggcggaacaggcttgaatctctttttacgccgtttcccaacaagatgctttgatgttgggatagcagaacaacatgcagttacttttgctgcaggtctggcctgtgaaggtgttaaacctttctgtgcaatttattcatctttcatgcaaagggcttatgaccaggtagtacatgatgtggatttgcagaaattgccagtgagatttgcaatggacagagctggactggttggagcagatggtcccacacattgtggggcttttgatgtcacctttatggcctgcctccccaacatggtggttatggctccttctgatgaggcagagctctttcacatggttgccactgccgctgcaatagatgaccggcccagttgtttccgatacccaagagggaatggggttggtgttcagctaccacctgggaataaaggcattccccttgaggttggaaaaggcaggatactgatagagggtgaaagagtggcacttttgggctatggaacagcagttcagagttgtttggctgcagcatctttagtggaatcccgtgacttaagagtcacagttgcagatgcgcgcttctgcaaaccattggatcgagcccttattcgcagcttagcaaaatcacatgagtacttaattacagttgaagaaggatcaattgggggatttgggtctcatgttgctcagttcctggcccttgatggccttcttgatggcgaagtaaagtggagacctctggttctgcctgatcggtacattgaccatggatcacccgctgatcaattgactgaagcgggccttacaccatatcatattgcagcaacagtgttcaatataattggaaaaacaagagaggcactggagatcatgtcgtaaagaaaactttaaaagaggtcctggttttacacttccaccaatgtacaaattaaagctgtaatgtaactttcttctatcattttttgtaaagtagtgtcaacttataaatgtaacctatattggacctatccaatcc

SEQ ID NO: 5557 - DNA, 591 bp, Cynodon dactylon
gccgggggcgaccgtgtggcgctgctggggtatgggtcggcggttcagaactgcctagccgccgcttccctcgtggagcagcacggcctcaaggtcaccgtcgccgacgcgaggttctgcaagccgctcgatcacgccctgattaggagcctggccaagtcccacgaggtgctcatcaccgtagaggaaggctccatcggagggttcggctcccacgtcgcacagttcatggctttggacggcctacttgacggcaaactcaagtggcggccgctggtgcttccggataggtacatcgaccatggatcgccggccgaccagctggccatcgccgggctgacgccgtcacatatcgctgcaacggtgttcaacatcctggggcagaacagggaggcccttgccataatggcaacgccgagtgtgtagacgtggggcgatcctagcttatagagatcctttgtacatttctgtcattagatgtctcgccaggggacactaattagtctgctttcgataaaattaagacgttgaggaacaatgactacattagttcttttattttgacatgaaagtacatatttattctcttga

SEQ ID NO: 5558 - DNA, 803 bp, Mesembryanthemum crystallinum
cgggctgcacgaattcggcacgagggcatcggtgtgcaattaccaccaggaacaaaggcacaccacttgagatcgggaaaggtcggattttgttggagggagcgagagtggcacttttagcatatggatcagcagttcacagctgtttggctgcagcagctttggttgaatcccgtggcttacgtgtgactgtggcagatgcccgtttctgcaaaccgttggatcatgcacttatccgaagtctagcaaagtcacatgaaattctaattacagtggaggaagggtccatcggaggtttcggatcccatgttgtacaattcatggctcttgatggtcttcttgatggcaaactaaagtggagaccaattgtccttcctgatcgatacattgagcatggctcaccagcagaccagttggcagaagctggacttacacctggccatattgccgctactgtattcaatatccttgggcaaacaagagaggctcttgaagtcatgtcataagagtgcaaatttcttcaacccttgtacaaatatagcgtacagaattcagaaacaattgaaagattgggtagctgagagttgaagtcaagcacctacttgaaatccaagtttccaactccaaagataagccaacatcctttaccatatgatgaaacttagagacaggactatgaaagaagatgggatgatcaatatttttaaggagatgcaaccttagtcacgtcatgtctgggacagggaatcgtcaaagattgatcatcagaatgcagctttaaatggatccgaagcagaatcaca

SEQ ID NO: 5559 - DNA, 795 bp, Lotus japonicus
atgtgttccatgtcctttccaaggtggtgcatgatgtggatctttcagaagctgcctgtaagatttgcaatggacaagaactggattagttggagcagatggtccaacccactgtggtgcttttgatgtcacttttatggcatgtctcccaaacatggttgtgatggctccttctgatgaagcagagcttttccacatggttgctactgcagctaccattgatgatcgacctagttgcctcagatatccaaggggaaatggggttggtgttgaattaccacaatggaacaaaggcactcctcttgagattggaaaaggtaggattttgattggaggggaaagagtggccctcttgggctatggatcagctgttcagagctgtgtggctgcagcttccttattggaacaccatggcatgcatgtaacagtggctgatgcacgtttctgcaaaccattggatcattcccttattcgtagcctagcaaaatcacatgagattttgatcactgtagaagaaggatcaatagggggatttgggtctcatgttgttcagttcatggcccttgatggtcttcttgatggaaaattgaagtggaggccaatggttcttcctgattgttacattgatcatggatcacctgctgatcaattgtctcaagctggtcttacaccatctcacatagcagcaacagttttgaacatgcttggacaaacaagagaggcactagaggtcatgtcatgaaagaaaatgcaactgggatgtctttcattcccccttagtatacagagtagcat

SEQ ID NO: 5560 - DNA, 1036 bp, Lotus japonicus
atgtgttccatgtcctttccaaggtggtgcatgatgtggatctttcagaagctgcctgtaagatttgcaatggacaagaactggattagttggagcagatggtccaacccactgtggtgcttttgatgtcacttttatggcatgtctcccaaacatggttgtgatggctccttctgatgaagcagagcttttccacatggttgctactgcagctaccattgatgatcgacctagttgcctcagatatccaaggggaaatggggttggtgttgaattaccacaatggaacaaaggcactcctcttgagattggaaaaggtaggattttgattggaggggaaagagtggccctcttgggctatggatcagctgttcagagctgtgtggctgcagcttccttattggaacaccatggcatgcatgtaacagtggctgatgcacgtttctgcaaaccattggatcattcccttattcgtagcctagcaaaatcacatgagattttgatcactgtagaagaaggatcaatagggggatttgggtctcatgttgttcagttcatggcccttgatggtcttcttgatggaaaattgaagtggaggccaatggttcttcctgattgttacattgatcatggatcacctgctgatcaattgtctcaagctggtcttacaccatctcacatagcagcaacagttttgaacatgcttggacaaacaagagaggcactagaggtcatgtcatgaaagaaaatgcaactgggatgtctttcattcccccttagtatacagagtagcatgattcattcaccctgtataatacagagataagagatgttagcataaaattagttagtacaggaggaaaatgcagattatcactccaattggttgtaatcgaccaagaatatcaaattttaatgggtgtacagaaatgcattttgttttcggttatctatagatgctaaaattatttatttttgtataaagaagtttaggagaaagaatttagggcatgcacgaatttggttttaagtggta

SEQ ID NO: 5561 - DNA, 1671 bp, Arachis hypogaea
tgatagagcggattgttattctaaacgacaacaaacaggtctctttacctactgctacacttgatggaccgataccaccagtaggagctttgagcagtgctctcagtaggttgcagtcgaacaggcctcttagagaattgagagaggttgccgagggtgttactaaaagcattggaggccctatgcatgaattggctgcaaaagttgatgaatatgctcgtggcatgattggtggttccggatcaacactttttgaagagcttggactctactacattggccctgttgatggtcataacatagatgatcttatctccattctcaatgaagttaaaagtactaaaaccactggtcctgttctgatccatgttgtcactgagaaaggccgaggatacccatatgcagaaaaagcagcagacaagtaccatggagttgctaagtttgatccaaagactggaaagcaattcaaggctaatgctagcacccagtcttacacaacatactttgcagaggctttgattgcagaagcagaagccgacaaagacatcgttgcaatccatgctgcaatgggaggtggcactggcatgaatctcttccttcgtcgattcccaacaagatgctttgatgtggggatagcagaacagcatgctgttacatttgctgcaggtctagcttgtgaaggtctcaagcctttctgtgcaatttactcatcattcatgcagagggcttatgaccaagtagtgcatgatgtcgacttgcagaagcttcctgtaagatttgcaatggatagagctggattagttggtgcagatggccctacacattgtggttcttttgatgtcacttttatggcatgtcttcctaacatggtggtgatggctccttctgatgaagcagagcttttccacatggttgccactgcagcagccattgatgatcgccctagttgtttccgatacccaaggggaaacggcattggtgttgaactaccactagggaataagggaattcctcttgagattgggaaaggtagaatattgatggagggggaaagagtggccttattgggctatggagcagcagtccagagctgtctggctgcagcttccttagtagagcatcatggcttgcgcataactgttgctgatgcacggttctgcaagccattggatcgttccttcattcgcagcctagcaaaatcacacgaagttttgatcactgtcgaagaaggatcaattggaggattcgggtctcatgttgttcagttcatggcccttgatggtcttctagatggaaaattgaaatggaggccaatggttcttccggatcgttatattgaccacggatcgcctgttgatcaattgtctgaagctggccttgctccaactcaaatagcagcaactgtgttcaacatacttggacagacaagggaggcactagaggttatgtcataaaaagagaaatatcaagaggggttaaattttcactccccacaatatacacatgttaacgatataaatcactttgtgtaacacaaacaaggtaatattagaatgtgaattaatcactttgtgtaacacaaacaaggtaatattagaatgtgaattatgtaaatgttagtaacaatgtagtttatcgaatagtagtatcagctagttgcaacttgcatgc

SEQ ID NO: 5562 - DNA, 1492 bp, Cajanus cajan
tatttgaagagcttggactttactatataggttccttgttgatggtcataacatagatgatattattgccattcttgaagaagttaaaaatactaaaacaactggtcctatactgatccattttatcactgaaaaaggccgtggatacccatatgcagaaagagcaccagacaagtaccatgcagttagcaagtttgatccagcaactggagaacaattcaaggcaaaggctgccacccagtcatacacaacatgctttgctgaggcattgattgtggaagcagaaactgacaaaagcatcattggaatccatgctgcaatgggggtggaaccggcatgaatatcttccatcgccgtttcccaacagatgctttgatgtagggatagcagaacagcatgctgttacatttgcagcgggtctggcttgtgaaggtctcaagcctttttgtacaatttactcatcattcatgcagagagcttatgaccaggtggtgcatgatgtggatttgcagaagctgcctgtaagatttgcattggaccgagccggattagttggagcagatggtgcaacacactgtggtgcatttgatgtcacttttatggcatgcctcccaaacatggtggtgatggctccttctgatgaagcagagctttgtcacatggttgcaactgcagttgccattgatgaccgacccagttgtttccgatacccaaggggaaatggtattggtgttgaggtaccaccagggaataaaggcactcctcttgagattggaaaaggtaggatactaattgaaggggaaagggtggccttgttgggctatggtgtagctgttcagagctgtgtggctgctgcttccttgttggaacatcatggattgcgcgcaacagttgccgatgctcgtttctgcaagccattggaccgtaacctcattcgcagccttgcaaaatcacatgaggttttgatcacagttgaagaaggatcaataggaggatttggctctcatgttgctcatttcatggccttggatggcctccttgatggaaaattgaagtggaggccaatggttcttcctgattgttacattgatcatggatcgctggctgaccaattgaatgaagctggtcttacaccatctcacatagcagcaacagttttcaatttacttggacaaacaagagaggcacttgaggtcatgtcatgagagaaatgctaagggttcagttttcattccctgcaatgtacaaagtagagtcattcacctagggtactacaaaatgtctgtataaaaataatacaaatggaagatgcagatcgacaaataatagttccatgtagttagctagcatctccatttttctatgtgtatgcaaaagccttttgagttccgttgtctgtgctgaaattaatcaagcagtttggttggtacaaaagaagtttaggtgaggactgaggatttaagttatggtcattaattatatttgatctagc

SEQ ID NO: 5563 - DNA, 669 bp, Saccharum officinarum
tcgacgaccgcccgtcctgtttccggaaccggagaggcaacggcattggcgtcccgttgccggaaactacaaaggcactcccctcgaggtcggcaagggcaggatcgtgctggagggcgaccgggtggcgctgctggggtacgggtcggcagtgcagtactgcctggccgccgcgtccctggtggagcgccacggcctcaaggtcaccgtcgccgacgcgaggttctgtaagccgctggaccacgccctgatcaggagcctggccaagtcccacgaggtgctcatcaccgtggaggaaggctccatcggaggcttcggctcccacgtcgcccaattcatggccctggacggcctcctcgacggcaaactcaagtggcgaccgctggtgcttcctgacaggtacatcgaccatggatcgccggccgatcagctgggcgaggctgggctgacgccgtcccacatcgccgccacggtgttcaacatcctggggcagaacagggaggctcttgccatcatggcagtgccgaacgcgtagaaatctgatgtgatctggtactatagagatgcttgtacattttgtcgttaattacacggagattagtcttctttggatgcaaatgtcgcgggaacaacagtcactgttttcgttatgtattcttcactgacatt

SEQ ID NO: 5564 - DNA, 1477 bp, Brassica napus
ctgaatgagctttgatgtctggaatccagacccagaacaatcaagctaccgctgtgaactggtgtacattcgtatggagtcactaaggaacaccgacaccgttagtcgtaggtgtatcgtagacgttctcaggcttcctcctggcttacccgaagactgaccctcgtcgaatagcatcacggcgacggatcgatgtgatcgaccttgagatgactcacttgatggcttgaggatcctcgaattccaactggcagtgaccgtaatgtaacacttcctacaccgctcttcggaaacagcaacccatctgcacttcgtgaaaactgttgttggaggttccgtaatagttttctttgggtatgacattggaggtcttgagaaatgtcaagagagagctccaggagactgtccaataccctgtggagcacccagagaagtttgagaagttcggtatgtctccgtcaaagggagtccttttctacggtcctcctggatgcggtaaaacccttttggccaaagctatagccaacgagtgccaagccaacttcatcagcgtcaaaggtcctgagcttctcaccatgtggtttggtgagagtgaagccaacgtccgtgaaatctttgacaaggctcgtcagtctgctccatgtgttctcttctttgacgagctcgactccattgccactcagagaggaggtggaggcggaggtgatgccggcggcgcagcggacagagtcctgaaccagcttttgaccgagatggatgggatgaacgctaagaagaccgtcttcatcatcggagcgaccaacagacccgacattatcgactctgctcttctccgtccaggaaggctcgaccagctcatttacattccgctcccagacgaggattcacgtctgaacatcttcaaggcctgcttgaggaaatcacctgttgctaaagatgttgacatcaacgctctggctaagtacacgcaggggttcagtggtgctgatatcactgagatttgccagagggcttgcaaatacgccattagagaaaacatcgagaaggacattgaaaaggagaagaggaggagcgagaaccctgaggccatggaagaagatggagtggatgaagtgtctgagatcaaagctgcacactttgaggagtcgatgaagtatgcacgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaattttattatcctttttatttaagttttcaatcggattctctctactttcacaaccttatgtttctttaaaaagttatcggaattatgttcattgcttttaatcaatgtacctgctt

SEQ ID NO: 5565 - DNA, 1403 bp, Brassica napus
gattggacgtcttgaagttctcaggatccacacaaagaacatgaagcttgctgaagatgtggaccttgagaggatctcaaaggacacacacggctatgttggtgctgatcttgcagctctgtgcacagaagctgccctgcagtgcatcagggagaagatggatgtgattgatttggaagatgactccatagatgctgaaatcctcaactccatggcagtgaccaatgagcacttccacactgctctcggcaacagcaacccatctgctcttcgtgaaactgttgttcctaatgtttcttgggatgacattggaggtcttgagaatgtcaagagagagctccaggagactgtccaatacccagtggagcacccagagaagtttgagaagtatgtctccatcaaagggagtcctcttctacggtcctcctggatgtggtaaaacgctattagccaaagctatagccaacgagtgccaagcaaacttcatcagtgtcaaaggtcctgagcttctcaccatgtggtttggtgagagtgaagccaacgtccgtgaaatctttgacaaggcacgtcagtctgctccctgtgtgctcttctttgacgagctagactccattgccactcagagaggaggtggaggcggaggtgatgcaggtggcgcagcggacagagtcctcaaccagcttttgaccgagatggatggaatgaacgccaagaagactgtctcatcatcggagcaaccaacagacccgacattattgattctgctcttctccgtccaggaaggctcgaccagctcatttacattccgctcccagacgaggattcacgtctcaacatcttcaaggcctgcttgaggaaatcacctgttgctaaagatgttgacatcaacgctctggctaagtacacgcaggggttcagtggtgctgatatcactgagatttgccagagggcttgcaagtacgccatcagagaaaacatcgagaaggacattgaaaaggagaagaggaggagcgagaaccctgaggcgatggaggaagatggagtggatgaagtgtctgagatcaaagctgcacattttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaaatttattatcctttttatttaagttttcaatcggattctctttcaaccttatgtttccttaaaaagttatcggaattatgttcattgcttttaatcaatgtac

SEQ ID NO: 5566 - DNA, 1901 bp, Brassica napus
ggggtctggaaagactctgattgctcgtgctgtggctaacgaaactggtgcctttttcttctgtatcaatggtcctgagatcatgtctaagcttgctggtgagagtgagagcaatctcaggaaagcgtttgaggaggctgagaagaacgctccttcgattatatttattgatgagattgactccattgcacctaaaagagagaagactaatggagaggttgagaggaggattgtgtctcagctccttacgcttatggatgggcttaagtctcgtgctcacgttattgtcatgggagcaaccaatcgccccaacagtattgatccagctttgagaaggtttggaagatttgatagggagattgatattggtgttcctgacgagattggacgtcttgaagttctcaggatccacacaaagaacatgaagcttgctgaagatgtggaccttgagaggatctcaaaggacacacacggctatgttggtgctgatcttgcagctctgtgcacagaagctgccctgcagtgcatcagggagaagatggatgtgattgatttggaagatgactccatagatgctgaaatcctcaactccatggcagtgaccaatgagcacttccacactgctctcggcaacagcaacccatctgctcttcgtgaaactgttgtggaggttcctaatgtttcttgggatgacattggaggtcttgagaatgtcaagagagagctccaggagactgtccaatacccagtggagcacccagagaagtttgagaagttcggtatgtctccatcaaagggagtcctcttctacggtcctcctggatgtggtaaaacgctattagccaaagctatagccaacgagtgccaagcaaacttcatcagtgtcaaaggtcctgagcttctcaccatgtggtttggtgagagtgaagccaacgtccgtgaaatctttgacaaggcacgtcagtctgctccctgtgtgctcttctttgacgagctagactccattgccactcagagaggaggtggaggcggaggtgatgcaggcggcgcagcggacagagtcctcaaccagcttttgaccgagatggatggaatgaacgccaagaagactgtcttcatcatcggagcaaccaacagacccgacattattgattctgctcttctccgtccaggaaggctcgaccagctcatttacattccgctcccagacgaggattcacgtctcaacatcttcaaggcctgcttgaggaaatcacctgttgctaaagatgttgacatcaacgctctggctaagtacacgcaggggttcagtggtgctgatatcactgagatttgccagagggcttgcaagtacgccatcagagaaaacatcgagaaggacattgaaaaggagaagaggaggagcgagaaccctgaggcgatggaggaagatggagtggatgaagtgtctgagatcaaagctgcacattttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaaatttattatcctttttatttaagttttcaatcggattctctcaactttcaaccttatgtttccttaaaaagttatcggaattatgttcattgcttttaatcaatgtacctgcttcactcttgttcattcgtactaaccaccaagggaaaactaaagaccacaatctgtcctatttctcatggattataatatttcactactatatccc

SEQ ID NO: 5567 - DNA, 773 bp, Brassica napus
gtgttctcttctttgtacgagctcgactccattgcgactcagagaggaggtggaagcggaggtgatggtggcggcgcagcagatagagtcctgaaccagcttttgactgagatggatggaatgaacgccaagaagaccgtcttcatcatcggagcaaccaacagacccgacattattgattctgctcttctccgtccaggaaggctcgaccagctcatttacattccactgccagatgaggattcccgtctcaatatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacatcgagaaggacattgaaaaggaaaagaggaggagcgagaacccagaagccatggaggaagatatggatgaagtatcagagataaaagctgcacactttgaggagtcgatgaagtatgcacgcaggagtgtgagtgatgcagacatcaggaagtaccaagcctttgctcagacgctccagcagtctagagggtttggttccgagttcaggttcgagactaatgctggttcaggtgcaaccactggagtcgctgatccttttgccacgtctgcagctgctgctgcggacgatgatgatctctacaattagtgatcaagtttatcatactttgttatttaagttttcaatcggattctctctacttctggtataccttg

SEQ ID NO: 5568 - DNA, 888 bp, Brassica juncea
aaccagcttttgactgagatggatggaatgaacgccaagaagaccgtcttcatcatcggagcaaccaacagacccgacattattgattctgctcttctccgaccaggaaggctcgaccagctcatttacattccactaccggacgaggattcacgtctcaatatcttcaaggcatgcttgaggaaatctcctgttgctaaagatgtggacatcaatgctctcgctaagtacacgcaggggttcagtggtgctgatatcactgagatttgccagagggcttgcaaatacgccatcagagagaacattgagaaggacattgagagggagaagaggaggagcttgaacccagaggcgatggaggaagatggagtggatgaagtgtcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggtgcaaccactggagtcgctgatccttttgccacctctgcagctgctgctgcagatgatgacgatctctacaattagtgattccttatttaccatccttttttataaagttctcaatcgaattctcttcttttggatgactgagggcaagtgatactgatacttttccttgtgttttaagttaatcagaatcgtttatgtttaatactcgagatccttagcaacctctagatattgaagagaggaaaaataaattatacagaagatcatcacaaacacatttttagtactaaaaccaattccgtacatacaaaaaaaaacagtctctgatagtgattactttcacttctc

SEQ ID NO: 5569 - DNA, 765 bp, Brassica juncea
ggatggaatgaacgccaagaaaactgtcttcatcatcggagcgaccaacagacccgacattattgattctgctcttctccgtccaggaaggctcgaccagctcatttacattccactgccagacgaggattcccgtctcaatatcttcaaggcctgcttgaggaagtcacctatcgctaaagatgtggacatcaacgctctcgctaagtacacacaaggattcagtggtgctgatatcactgagatttgccagagggcttgcaaatacgccatcagagaaaacatcgagaaggacattgaaaaggagaagaggaggagcgagaacccagaagccatggaggaagatatggatgaagtatcagagatcaaagctgcacacttcgaggagtcgatgaagtatgcacgcaggagtgtgagcgatgcagatatcaggaagtaccaagcctttgctcagacgctgcagcagtctagagggtttggttccgagttcaggttcgagactaatgctggttcaggtgcaaccactggagtcgctgatccttttgccacgtctgcagctgctgctgcggacgatgatgatctctacaattaagtgatcaagtttatcatactttgttatttaagttttcagtcggattctctctactacttctggataccttgtgtttcttttaagttatcagaattatgttggtgctcttttaatcaatgttctcaattgactcttgttcattcgtactgacaaagggaaatctacaaacttga

SEQ ID NO: 5570 - DNA, 1772 bp, Brassica rapa
  misc_feature (852)..(852): n is a, c, g, or t
  misc_feature (1062)..(1062): n is a, c, g, or t
  misc_feature (1074)..(1074): n is a, c, g, or t
  misc_feature (1098)..(1098): n is a, c, g, or t
  misc_feature (1130)..(1131): n is a, c, g, or t
  misc_feature (1158)..(1158): n is a, c, g, or t
ggaaagactttgatcgctcgtgctgttgctaacgaaacaggtgccttcttcttctgtatcaatgggcctgagatcatgcccaagctggctggtgagagtgagagcaacctcaggaaagcgtttgaggaggctgagaagaacgctccttcgatcatattcattgatgagatcgactctattgcaccgaaaagggagaagacgaatggagaggttgagaggaggattgtgtctcagctccttacgctaatggatggacttaaatctcgtgctcatgttattgtcatgggagcaaccaatcgtcccaacagtatcgacccggctttgagaaggtttggaagatttgatagggagattgatattggtgttcctgatgaaattggacgtcttgaagttctcaggatccacaccaagaacatgaagctcgctgaagaggttgatcttgagaggatctcaaaggacacacacggttatgtcggtgctgatcttgcagctctctgcacagaggctgccctgcaatgcatcagggagaagatggatgtgattgatttggaagatgactccattgatgctgagatcctcaattccatggctgtgactaatgaacacttccacaccgctcttgggaacagcaacccatctgcacttcgtgaaactgttgtggaggttcctaatgtttcttgggatgacattggaggtcttgagaatgtcaagagagagctccaggagactgttcaataccctgtggagcacccagagaagttcgagaaattcggtatgtctccatcaaagggagtcctattctacggtcctcctggatgtggtaaaacccttctggccaaagctatagccaangagtgccaagccaacttcatcagtgtcaaaggtcctgagcttctcactatgtggtttggagagagtgaagccaatgtccgtgaaatcttcgacaaggctcgccagtccgctccgtgtgttctcttctttgatgagctcgactccattgcgactcagagaggaggtggaggcggaggtgatgctggcggtgcggctgatagagtcctcaancagcttttgacngagatggatggaatgaacgccaanaagactgtcttcatcatcggagcgaccaacanncccgacattattgattctgctcttctncgaccaggaaggctcgaccagctcatttacattccactaccggacgaggactcacgtctcaatatcttcaaggcatgcttgaggaaatctcctgttgctaaagatgtggacatcaatgctctcgctaagtacacgcaggggttcagtggtgctgatatcactgagatttgccagagggcttgcaaatacgccatcagagagaacattgagaaggacattgagagggagaagaggaggagcttgaacccagaggcgatggaggaagatggagtggatgaagtgtcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggtgcaaccactggagtcgctgatccttttgccacctctgcagctgctgctgcagatgatgacgatctctacaattagtgatccttatttaccatccttttttataaagttctcaatcgaattcgcttcttttggatgactgagggcaagtgatactgatacttttccttgtgttt

SEQ ID NO: 5571 - DNA, 2610 bp, Brassica napus
cgctaatctcgcttccattatgtcgaacccagctgaatcttcagactcgaaaccgaagaaggatttcagtactgctattcttgagaggaagaagtctccgaacagactcgtcgtcgatgaggccatcaacgatgataactccgtcgtgtctctccaccctgctactatggagaagctccagctcttccgtggtgataccattctcatcaagggtaagaaaaggaaggacaccatctgcatcgctcttgctgatgaatcatgtgaggagccaaagatcaggatgaacaaagtggtcaggtctaacttgagggttagacttggtgatgttatctctgttcaccaatgccctgatgtcaagtacggaaagcgtgtgcacatcttgcctgttgatgacactgttgaaggagtcactggaaacctctttgatgcttacctcaaaccttatttcttggaggcataccgtccggtgaggaagggcgatctcttcctagtgagaggaggaatgaggagtgtggagttcaaggttattgagacggatcctgctgagtactgtgtggttgctccggacactgagattttctgtgagggtgagccagtcaagagagaggatgaagaaaggcttgatgaagtgggttatgatgatgttggtggagtcaggaagcagatggctcagatcagggaacttgttgagcttcccttgaggcatccacagctgttcaagtcaattggtgttaagccgccgaagggaattctgctttacggaccacctgggtccggaaagactttgatcgctcgtgctgttgctaacgagactggtgcatttttcttctgtatcaatggacctgagatcatgtccaagctggctggtgagagtgagagcaacctcaggaaagcgtttgaggaggctgagaagaacgctccttcgatcatattcattgatgagattgactctattgcaccgaaaagggagaagacgaatggagaggttgagaggaggattgtgtctcagctccttacgcttatggatgggctgaaatctcgtgctcatgttattgtcatgggagcaaccaatcgccccaacagtatcgacccggctttgagaaggtttggaagatttgatagggagattgatattggtgttcctgatgagattggacgtcttgaagttctcaggatccacacaaagaacatgaagcttgctgaagatgtggatctagaaaggatctcaaaggacacacacggttatgtgggtgctgatcttgcagctctgtgtacagaagctgccctgcaatgcatcagggagaagatggatgtgattgatttggaagatgactccatagatgctgaaatcctcaattccatggcagtgaccaatgaacatttccacactgctctcggcaacagcaacccatctgcacttcgtgaaactgttgttcctaatgtttcttgggatgacattggaggtcttgagaatgtcaagagagagctccaggagactgttcaatacccggtcgagcacccagagaagtttgagaagtatgtctccatcaaagggagtccttttctacggtcctcctggatgtggtaaaacccttttggccaaagctatagccaacgagtgccaagcaaacttcatcagtgtcaaaggtcccgagcttctcaccatgtggtttggagagagtgaagcaaatgtccgtgaaatctttgacaaggcccgtcagtctgctccatgtgttctattctttgacgagctcgactccattgcgactcagagaggaggtggaagcggaggtgatggtggcggtgcagcggatagagtcctgaaccagcttttgactgagatggatggaatgaacgccaagaagaccgtctcatcatcggagcaaccaacagacccgacattattgattctgctcttctccgtccaggaaggctcgaccagctcatttacattccactgccagacgaggattcccgtctcaatatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacatcgagaaggacattgaaaaggaaaagaggaggagcgagaacccagaagccatggaggaagatatggatgaagtatcagagataaaagctgcacactttgaggagtcgatgaagtatgcacgcaggagtgtgagtgatgcagacatcaggaagtaccaagcctttgctcagacgctccagcagtctagagggtttggttccgagttcaggttcgagactaatgctggttcaggtgcaaccactggagtcgctgatccttttgccacgtctgcagctgctgctgcggacgatgatgatctctacaattaagttatcaagtttatcatactttgttatttaaggtttcagtcggattctctacttctggataccttgtgtttcttttaagttatcagaattatgttggtgccctttcaatcaatgttctcaattgactcttgtttattcgtactgactactacggggaaatctacgaacttgagggc

SEQ ID NO: 5572 - DNA, 2548 bp, Brassica napus
caattatgtcaaacccagctgaatcttccgactcgaaatcgaagaaagatttcagcactgctattctcgagaggaagaagtctcctaacagacttgtcgtcgatgaggccatcaacgatgataactccgtcgtctctctccaccccgacaccatggagaagctccagctcttccgcggcgataccattctcatcaagggtaagaagaggaaggacactgtctgcattgctcttgctgatgaatcatgtgaggagccaaagatcaggatgaacaaagttgtcagatctaacttgagggttagacttggagatgtcatctctgttcaccagtgccctgatgtcaagtacgggaagcgtgtgcacatcttgcctgttgatgataccgttgaaggagtcaccggaaacctctttgatgcttacctcaaaccttatttcctggaagcataccgcccggtgaggaagggcgatctcttcctagtcagaggaggaatgaggagtgtggagttcaaggttatagagacggatcctgctgagtactgtgtggttgctccagacactgagattttctgtgagggtgagcctgtgaagagagaggatgaggaaaggctagatgaagtgggttatgatgatgttggtggtgtgaggaagcagatggctcagatcagggagcttgttgagcttcccttaaggcatccacagctcttcaagtcgattggtgttaagccaccgaaggggattctgctttacggaccacctgggtccggaaagactttgattgctcgcgccgtggctaacgaaaccggtgcgtttttcttctgtatcaatgggcctgagatcatgtctaagttggctggtgagagtgagagcaacctcaggaaagcgtttgaggaggctgagaagaacgctccttcgatcatattcattgatgagattgactctattgcacccaaaagagagaagacgaatggagaggttgagaggaggattgtgtctcagctcctcacgctgatggatggtctgaagtcacgtgctcatgtcattgtcatgggagcaaccaatcgccccaacagtattgatccggctttgagaaggttgggaagattggatagggagattgatatcggcgttcctgatgaaatgggacgtcttgaagttctcaggatccacaccaagaacatgaagctcgctgaagatgttgatcttgagaggatctcaaaggacacacacggttatgtaggtgctgatcttgcagctctctgcacagaagctgccctgcaatgcatcagggagaagatggatgtgattgatctggaagatgactctattgatgctgagatcctcaattccatggcagtgactaatgaacacttccacaccgctcttggaaacagcaacccatctgcacttcgtgaaactgttgttcctaatgtttcttgggatgacattggaggtcttgagaatgtcaagagagagctccaggagactgttcaataccctgtggagcacccagagaagttcgagaagtatgtctccttcaaagggagtcctattctacggtcctcctggatgtggtaaaacccttctggccaaagctatagccaacgagtgccaagcaaatttcataagtgtcaaaggtcctgagcttctcactatgtggtttggagagagtgaagccaatgtccgtgaaatcttcgacaaggctcgtcagtccgccccgtgtgttctcttctttgacgagctcgactccattgctactcagagaggaggtggaggcggaggtgatgctggcggtgcggctgatagagtcctcaaccagcttttgacagagatggatggaatgaacgccaagaagactgtctcatcatcggagcgaccaacaggcccgacattattgattctgctcttctccgaccaggaaggctcgaccagctcatttacattccactaccggatgaggactcacgtctcaatatcttcaaggcatgcttgaggaaatctcctgttgctaaagatgtggacatcaatgctctcgctaagtacacgcaggggttcagtggtgctgatatcactgagatttgccagagggcttgcaaatacgccataagagagaacattgagaaggacattgagagggagaagaggaggagcttgaacccagaggcgatggaggaagatggagtggatgaagtgtcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggtgcaaccactggagtcgctgatccttttgccacctctgcagctgctgctgcagatgatgacgatctctacaattagtgatccttatttaccatccttttttataaagttctcaatcgaattctcttcttttggatgactgagggcaagtgatactgatacttttccttgtgttttaagttaatcagaatcgtttatgttta

SEQ ID NO: 5573 - DNA, 2575 bp, Brassica napus
cgctaatctcgattcaattatgtcgaacccagctgaatcttcagactcgaaatcgaagaaggattttagtactgctattctggagaggaagaagtctcccaacagacttgtcgtcgatgaggccatcaacgatgataactccgttgtatctctccaccctgctaccatggagaagctccagctcttccgtggtgataccattctcatcaagggtaagaaaaggaaggacactatctgcatcgctcttgctgatgaatcatgtgaggagccgaagatcaggatgaacaaagtggtcaggtctaacttgagggttaggcttggtgatgttatctctgttcatcaatgccctgatgtcaagtacggacagcgtgtgcacatcttgcctgttgatgacaccgttgaaggagtcactggaaacctctttgatgcttacctcaaaccttatttcctggaggcataccgtccggtgcggaagggcgatctcttcctagtgagaggaggaatgaggagtgtggagttcaaggttattgagacggatcctgctgagtactgtgttgttgctccggacactgagattttctgtgagggagagccagtcaagagagaggacgaagagaggcttgatgaagtgggttatgatgatgttggtggtgtcaggaagcagatggctcagattagggagcttgttgagcttcccttgaggcatccacagctgttcaagtcaattggtgttaagccaccgaagggaattttgctttatggaccacctgggtctggaaagactttgatcgctcgtgctgttgctaatgaaactggtgcctttttcttctgtatcaatgggcctgagatcatgtccaagctggctggtgagagtgagagcaacctcaggaaagcgtttgaggaggctgagaagaacgctccttcgatcatattcattgatgagattgactctattgcaccgaaaagagagaagactaatggagaggttgagaggaggattgtgtctcagctccttacgctaatggatggacttaaatctcgtgctcatgttattgtcatgggagcaaccaatcgtcccaacagtatcgacccggctttgagaaggtttggaagatttgatagggagattgatattggtgttcctgatgagattggtcgtcttgaagttctcaggatccacacaaagaacatgaagcttgctgaagatgtggatctagaaaggatctcaaaggacactcacggttatgtcggtgctgatcttgcagctctgtgcactgaagctgccctgcaatgcatcagggagaagatggatgtgattgatttggaagatgactccatagatgctgaaatcctcaattccatggcagtgaccaatgaacacttccacactgctctagggaacagcaacccatctgcacttcgtgaaactgttgtacccaatgtttcttgggatgacattggaggtcttgagaatgtcaagagagagctccaggagactgttcaatacccggtcgagcacccagagaagtttgagaagtatgtctccgtcaaagggagtccttttctacggtcctcctggatgtggtaaaactcttctggccaaagctatagccaacgagtgccaagcaaacttcatcagtgtcaaaggtcccgagcttctcaccatgtggtttggagagagtgaagctaatgtccgtgaaatctttgacaaggcccgtcagtctgctccatgtgttctcttctttgacgagctcgactccattgcgactcagagaggaggtggaagcggaggtgatggtggcggcgcagcagatagagtcctgaaccagcttttgactgagatggatggaatgaacgccaagaaaaccgtctcatcatcggggcaaccaacaggcccgacattattgattctgctcttctccgtccaggaaggctcgaccagctcatttacattccactgccagacgaggactcacgtctcaacatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacatcgagaaggacattgaaaaggagaagaggaggagcgagaacccagaagccatggaggaagatatggatgaagtatcagagatcaaagctgcacacttcgaggagtcgatgaagtatgcacggaggagtgtgagcgatgcagacatcaggaagtaccaagcctttgctcagaccctgcagcagtctagagggtttggttccgagttcaggttcgagactaatgctggttcaggtgcaaccactggagtcgctgatccttttgccacgtctgcagctgctgctgcggacgatgatgatctctacaattagtgatcaagtttatcatactttgttatttaagttttcaatcggattctctacttctggataccttgtgtttctttaagttattggatttgatacttaataaaaaaaaaaagaaaaaactcctcgtccgaatccgcagcccgg

SEQ ID NO: 5574 - DNA, 784 bp, Raphanus sativus
gaaccagcttttgactgagatggatggaatgaacgccaagaaaaccgtcttcatcatcggagcaaccaacagacccgacatcattgactctgctcttctccgaccaggaaggctcgaccagctcatttacattccgctgccggacgaggattcacgtctcaatatcttcaaggccgccttgaggaagtctcctattgctaaagatgtagacatcaacgctctcgctaagtacacacagggattcagtggtgctgatataactgagatttgccagagggcttgcaaatacgccatcagagaaaacatcgagaaggacattgagaaggagaagaggaggagcgagaacccagaagccatggaggaagatggagttgatgaagtgtcagagataaaagctgcacactttgaggagtcgatgaagtacgcacgcaggagtgtgagcgatgcagacatcaggaaataccaagcttttgctcagacgcttcagcagtctagagggtttggttccgagttcaggttcgagactaatgctggttcaggtgtaaccactggagtcgctgatccttttgccacgtctgcagctgctactgcggacgatgatgatctctacaattagtgatccagtttatcatactttgttatttaagttttcagttggattctctcttgcttctggataccttgtgtttctttaagttatcagaattatgttggtgcttttaatcaatgttctcaattggacgactcttgttcattcgtattgactatgatttacaaatcaata

SEQ ID NO: 5575 - DNA, 2725 bp, Brassica rapa
  misc_feature (241)..(241): n is a, c, g, or t
  misc_feature (271)..(271): n is a, c, g, or t
  misc_feature (280)..(280): n is a, c, g, or t
  misc_feature (284)..(284): n is a, c, g, or t
  misc_feature (286)..(286): n is a, c, g, or t
  misc_feature (307)..(307): n is a, c, g, or t
  misc_feature (337)..(337): n is a, c, g, or t
  misc_feature (346)..(346): n is a, c, g, or t
  misc_feature (367)..(367): n is a, c, g, or t
  misc_feature (379)..(379): n is a, c, g, or t
  misc_feature (415)..(416): n is a, c, g, or t
  misc_feature (768)..(768): n is a, c, g, or t
  misc_feature (834)..(834): n is a, c, g, or t
  misc_feature (849)..(849): n is a, c, g, or t
  misc_feature (870)..(871): n is a, c, g, or t
  misc_feature (877)..(877): n is a, c, g, or t
  misc_feature (891)..(891): n is a, c, g, or t
  misc_feature (904)..(904): n is a, c, g, or t
  misc_feature (908)..(908): n is a, c, g, or t
  misc_feature (940)..(942): n is a, c, g, or t
  misc_feature (974)..(974): n is a, c, g, or t
  misc_feature (986)..(986): n is a, c, g, or t
  misc_feature (1217)..(1217): n is a, c, g, or t
cagatccatctctctcacagataaccctaaaagctctcaaactctctcaatcgctaatctcgattcaatcatgtcgaacccagctgaatcttcagactcgaaatcgaagaaagacttcagtactgctattctggagaggaagaagtctccgaacagactcgtcgtcgacgaggccatcaacgatgataactccgtcgtgtctctccaccctgccaccatggagaagctccagctcttccgnggcgataccattctcatcaagggtaagaanaggaagganactntntgcattgctcttgctgatgantcatgtgaggagccaaagatcaggatgaanaaagttgtnagatctaacttgagggttagncttggagatgtnatctctgttcaccagtgccctgatgtcaagtacggnnagcgtgtgcacatcttgcctgttgatgataccgttgaaggagtcactggaaacctctttgatgcttacctcaaaccttatttcttggaggcataccgcccggtgaggaagggagatctcttcctagtgagaggaggaatgaggagtgtggagttcaaggttattgagacggatcctgctgagtactgtgtggtggctccggacactgagattttctgtgagggtgagccagttaagagagaggatgaagaaaggctagatgaagtgggttatgatgatgttggtggtgtcaggaagcagatggctcagatcagggagcttgcagggagcttgttgagcttcccttgaggcanccacagctgttcaagtcgattggtgttaagccaccgaagggaattttgctttatggaccacctggntctggaaagactttnatcgctcgtgctgttgctaannaaacangtgcttcttcttcngtatcaatgggcntganatcatgtccaagctggctggtgagagtgagannnacctcaggaaagcgtttgaggaggctgagaanaacgctccttcnatcatattcattgatgagatcgactctattgcaccgaaaagggagaagacgaatggagaggttgagaggaggattgtgtctcagctccttacgctaatggatggacttaaatctcgtgctcatgttattgtcatgggagcaaccaatcgtcccaacagtatcgacccggctttgagaaggtttggaagatttgatagggagattgatattggtgttcctgatgagattggncgtcttgaagttctcaggatccacacaaagaacatgaagcttgctgaagatgtggatctagaaaggatctcaaaggacactcacggttatgtcggtgctgatcttgcagctctgtgcactgaagctgccctgcaatgcattagggagaagatggatgtgattgatttggaagatgactccatagatgctgaaatcctcaattccatggcagtgaccaatgaacacttccacactgctctagggaacagcaacccatctgcacttcgtgaaactgttgtggaggtacccaatgtttcttgggatgacattggaggtcttgagaatgtcaagagagagctccaagagactgttcaatacccagtcgagcacccagagaagtttgagaaattcggtatgtctccgtctaagggagtccttttctacggtcctcctggatgtggtaaaacccttttggccaaagctatagccaacgagtgccaagcaaacttcatcagtgtcaaaggtcccgagcttctcactatgtggtttggagagagtgaagccaacgtccgtgaaatctttgacaaggcccgtcagtctgctccatgtgttctcttctttgacgagctcgactccattgcgactcagagaggaggtggaagcggaggtgatggtggcggcgcagcagatagagtcctgaaccagcttttgactgagatggatggaatgaacgccaagaagaccgtcttcatcatcggagcaaccaacagacccgacattattgattctgctcttctccgtccaggaaggctcgaccagctcatttacattccactgccagatgaggattcccgtctcaatatcttcaaggcctgcttgaggaagtcacctatcgctaaagatgtggacatcaacgctctcgctaagtacacacagggattcagtggtgctgatatcactgagatttgccagagggcttgcaagtacgccatcagagaaaacattgagaaggacattgaaaaggagaagaggaggagcgagaacccagaagccatggaggaagatatggatgaagtatcagagatcaaagctgcacacttcgaggagtcgatgaagtatgcacgcaggagtgtgagcgatgcagatatcaggaagtaccaagcctttgctcagacgctgcagcagtctagagggtttggttccgagttcaggttcgagactaatgctggttcaggtgcaaccactggagtcgctgatccttttgccacgtctgctgctgctgctgctgcggacgatgatgatctctacaattaagtgatcaagtttatcatactttgttatttaaattttcagtcggattctctctactacttctggataccttgtgtttcttttaagttatcagaattatgttggtgctcttttaatcaatgttctcaattgactcttgttacattcgtactgccaaaagggaaatctaccaaaccttgagggtcctttgcctaatgtgaaggaccttccaaaaggca

SEQ ID NO: 5576 - DNA, 979 bp, Brassica oleracea
  misc_feature (196)..(196): n is a, c, g, or t
  misc_feature (209)..(210): n is a, c, g, or t
  misc_feature (216)..(216): n is a, c, g, or t
  misc_feature (225)..(225): n is a, c, g, or t
  misc_feature (249)..(249): n is a, c, g, or t
  misc_feature (261)..(261): n is a, c, g, or t
  misc_feature (270)..(270): n is a, c, g, or t
  misc_feature (279)..(279): n is a, c, g, or t
  misc_feature (297)..(297): n is a, c, g, or t
  misc_feature (312)..(312): n is a, c, g, or t
  misc_feature (318)..(318): n is a, c, g, or t
  misc_feature (321)..(321): n is a, c, g, or t
  misc_feature (375)..(375): n is a, c, g, or t
  misc_feature (384)..(384): n is a, c, g, or t
  misc_feature (390)..(390): n is a, c, g, or t
  misc_feature (408)..(408): n is a, c, g, or t
  misc_feature (423)..(423): n is a, c, g, or t
  misc_feature (450)..(450): n is a, c, g, or t
  misc_feature (534)..(534): n is a, c, g, or t
  misc_feature (540)..(540): n is a, c, g, or t
acccttttggccaaagctatagccaacgagtgccaagcaaacttcatcagtgtcaaaggccctgagcttctcaccatgtggtttggagagagtgaagcaaatgtccgtgaaatctttgacaaggcccgtcagtctgctccatgtgttctcttctttgacgagctcgactccattgcgactcagagaggaggtggangcggaggtgatgnnggcggngcagcgganagagtcctgaaccagcttttgacngagatggatggnatgaacgcnaagaagacngtcttcatcatcggagcnaccaacagacccganattatngantctgctcttctccgtccaggaaggctcgaccagctcatttacattccactaccngacgaggantctcgnctcaatatcttcaaggcntgcttgaggaaatcncctgttgctaaagatgtggacatcaangctctcgctaagtacacgcaggggttcagtggtgctgatatcactgagatttgccagagggcttgcaaatacgccatcagaganaacatngagaaggacattgagagggagaagaggaggagcttgaacccagaggcgatggaggaagatggagtggatgaagtatcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggggcaaccactggagtcgctgatccttttgccacctctgcagctgcttctgcagatgatgatgatctctacaactagtgatcaaacttatcatcctctttatttatttttattaagttcgaattctctacttttggatgactgagggaaagtgatactgatacttttccttgtgtttttaagttaatcagaatcgtttatgtttaat

SEQ ID NO: 5577 - DNA, 1493 bp, Brassica napus
aggtttggaagatttgatagggagattgatatcggtgttcctgatgaaattggacgtcttgaagttcttaggatccacacaaagaacatgaagctcgctgaagatgtagatcttgagaggatctcaaaggatacacacggttatgtaggtgctgatcttgcagctctctgcacagaggctgccctgcaatgcatcagggagaagatggatgtgattgatttggaagatgactccattgatgctgagatcctcaattccatggcagtgactaatgaacacttccacaccgctcttgggaacagcaacccatctgcacttcgtgaaactgttgttccaaatgtttcttgggatgacattggaggtcttgagaatgtcaagagagagctccaggagactgttcaataccctgtggagcacccagagaagttcgagaagtatgtctccttcaaagggagtcctattctacggccctcctggatgtggtaagacccttttggccaaagctatagccaacgagtgccaagcaaacttcatcagtgtcaaaggtcctgagcttctcaccatgtggtttggtgagagcgaagccaatgtccgtgaaatcttcgacaaggctcgtcagtccgctccgtgtgttctcttctttgatgagctcgactccattgcgactcagagaggaggtggaggcggaggtgatgctggcggtgcggctgatagagtcctcaatcagcttttgactgagatggatggaatgaacgccaaaaagactgtctcatcatcggagcgaccaacagacccgacattattgattctgctcttctacgtccaggaaggctcgaccagctcatttacattccactaccggacgaggactctcgcctcaatatcttcaaggcatgcttgaggaaatctcctgttgctaaagatgtggacatcaatgctctcgctaagtacacacaggggttcagtggtgctgatatcactgagatttgccagaggtcttgcaaatacgccatcagagagaacattgagaaggacattgagagggagaagaggaggagcttgaacccagaggcgatggaggaagacggagtggatgaagtgtcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggggcaaccactggagtcgctgatccttttgccacctctgcagctgctgctgcagatgatgatgatctctacaactagtgatcaaacttatcatcctcttttttttttttttattaagttcgaattctctacttttggatgactgagggaaagtgatactgatacttttccttgtgtttttaagttaatcagaatcttttatgtttactactccaaatattgagcacccatcccat

SEQ ID NO: 5578 - DNA, 2649 bp, Brassica napus
aaacaaagagatataatctcttctgctctttcagatctctcagataaactcccaaaagctctcaactttctcatcgatctcaaatccaattatgtcaacccagctgaatcttccgactcgaaatcgaagaaagatttcagcactgctattctcgagaggaagaagtctcctaacagacttgtcgtcgatgaggccatcaacgatgataactccgtcgtctctctccaccccgacaccatggagaagctccagctcttccgcggcgataccattctcatcaagggtaagaagaggaaggacactgtctgcattgctcttgctgatgaatcatgtgaggagccaaagatcaggatgaacaaagttgtcagatctaacttgagggttagacttggagatgtcatctctgttcaccagtgccctgatgtcaagtacgggaagcgtgtgcacatcttgcctgttgatgataccgttgaaggagtcaccggaaacctctttgatgcttacctcaaaccttatttcctggaagcataccgcccggtgaggaagggtgatctcttcctagtcagaggaggaatgaggagtgtggagttcaaggttatagagacggatcctgctgagtactgtgtggttgctccggacacagagattttctgtgagggtgagccggtgaagagagaggacgaggaaaggctagatgaagtgggttatgatgatgttggtggtgtgaggaagcagatggctcagatcagggagcttgttgagcttcctttaaggcatccacagctcttcaagtcgattggtgttaagccaccgaaggggattctgctttacggaccacctgggtccggaaagactttgattgctcgtgccgtggctaacgaaaccggtgcgtttttcttctgtatcaatgggcctgagatcatgtctaagttggctggtgagagtgagagcaacctcaggaaagcgtttgaggaggctgagaagaacgctccttcgatcatattcattgatgagattgactctattgcacccaaaagagagaagacgaatggagaggttgagaggaggattgtgtctcagctcctcacgctgatggatggtctgaagtcacgtgctcatgtcattgtcatgggagcaaccaatacgcccaacagtatgatcggcttgagaaggttggaagattgataggagattgatatcggcgtcctgatgaaattggacgtcttgaagtctcaggatccacaccaagaacatgaagctcgctgaagacgttgatcttgagaggatctcaaaggacacacacggttatgtaggtgctgatcttgcagctctctgcacagaagctgccctgcaatgcatcagggagaagatggatgtgattgatctggaagatgactctattgatgctgagatcctcaattccatggcagtgactaatgaacacttccacaccgctcttggaaacagcaacccatctgcacttcgtgaaactgttgtggaggttcctaatgtttcttgggatgacattggagtcttgagaatgtcaagagagagctccaggagactgttcaataccctgtggagcacccagagaagttcgagaaattcggtatgtctccttcaaagggagtcctattctacggtcctcctggatgtggtaaaacccttctggccaaagctatagccaacgagtgccaagcaaatttcataagtgtcaaaggtcctgagcttctcactatgtggtttggagagagtgaagccaatgtccgtgaaatcttcgacaaggctcgtcagtccgccccgtgtgttctcttctttgacgagctcgactccattgctactcagagaggaggtggaggcggaggtgatgctggcggtgcggctgatagagtcctcaaccagcttttgacagagatggatggaatgaacgccaagaagactgtcttcatcatcggagcgaccaacaggcccgacattattgattctgctcttctccgaccaggaaggctcgaccagctcatttacattccactaccggatgaggactctcgcctcaatatcttcaaggcatgcttgaggaaatctcctgttgctaaagatgtggacatcaatgctctcgctaagtacacacaggggttcagtggtgctgatatcactgagatttgccagaggtcttgcaaatacgccatcagagagaacattgagaaggacattgagagggagaagaggaggagcttgaacccagaggcgatggaggaagacggagtggatgaagtgtcagagatcaaagctgcacactttgaggagtcgatgaagtatgcacgcaggagtgtgagtgatgcagacatcaggaagtaccaagcctttgctcagacgctgcagcagtctagagggtttggttctgagttcaggtttgagactaatgctggttcaggggcaaccactggagtcgctgatccttttgccacctctgcagctgctgctgcagatgatgatgatctctacaactagtgatcaaacttatcatcctctttttttttttttattaagttcgaattctctacttttggatgactgagggaaagtgatactgatacttttccttgtgtttttaagttaatcagaatcttttatgtttactactccaaa

SEQ ID NO: 5579 - DNA, 1446 bp, Raphanus sativus
  misc_feature (1265)..(1265): n is a, c, g, or t
  misc_feature (1304)..(1304): n is a, c, g, or t
ctgatgaaattggacgtcttgaagttctcaggatccacacaaagaacatgaagctcgctgaagatgtggatctagaaaggatctcaaaggacacacacggttatgtaggtgctgatcttgcagctctgtgcacagaggctgccctgcaatgcatcagggagaagatggatgtgattgatttggaagatgactccattgatgctgagatcctcaattccatggcagtgactaatgaacacttccacaccgctctcgggaacagcaacccatctgcacttcgtgaaactgttgtggaggttcctaatgtgtcttgggatgacattggaggtcttgagaatgtcaagagagagctccaggagactgttcaataccctgtggagcacccagagaagttcgagaaatttggtatgtctccatcaaagggagttctattctacggtcctcctggttgtggcaaaacccttttggccaaagctatagccaacgagtgccaagcaaacttcatcagtgtcaaaggtcccgagcttctcactatgtggtttggagagagtgaagccaatgtccgtgaaatctttgacaaggctcgtcagtctgctccatgtgttctcttctttgatgagctcgactccattgcgactcagagaggaggtggaggcggaggtgatgctggcggtgcagcggatagagtcctgaaccagcttttgacagagatggatggaatgaacgccaagaaaaccgtcttcatcatcggagcgaccaacagacccgacattattgattctgctcttctccgtccaggaaggctcgaccagctcatttacatccctttaccagacgaggattcacgtctcaatatcttcaaggcatgcttgaggaaatctcctgttgctaaagatgtagacatcaatgctctcgctaagtacacacagggattcagtggtgctgatatcactgagatttgccagagggcttgcaaatatgcaattagagaaaacatcgagaaggacattgaaagggagaagaggaggagcttgaacccagaggcaatggaggaagatggagtggatgaagtatcagagatcaaagctgcacactttgaggagtcgatgaagtatgcacgcaggagtgtgagtgatgcagacatcaggaagtaccaagcctttgctcagacgctgcagcagtctagagggtttggttctgagttcaggttcgagactaatactggttcaggtgcaaccactggagtagctgatccttttgccacntctgcagctgctgctgcagatgatgatgatctctacaantagtgatcaaacttatcatccatccttccttttttcttaagttcgctatcgaattctctacttttggatgactgagggaaagtgatactgatacttttccttgtgttttttttaagttaatcagaatcgtttatgtttgata

SEQ ID NO: 5580 - DNA, 792 bp, Thellungiella halophila
  misc_feature (178)..(178): n is a, c, g, or t
tcctgaaccagcttttgactgagatggatggcatgaacgctaagaaaaccgtcttcatcattggagcaaccaacagacccgacattatcgatgcggctcttctccgtccaggaaggctcgaccagctcatttacattccactaccagacgaggattcgcggctcaatatcttcaaggnctgcttgaggaaatctcctgttgccaaagatgtagacatcaatgcactcgctaagtacacacagggattcagtggtgctgatatcactgagatttgccagagagcttgcaagtacgccatcagagaaaacatcgagaaggacattgaaaaggagaagaggaggagcgagaacccagaggcgatggaggaagatggagaggatgaagtgtcagagatcaaagctgcacactttgaggagtcgatgaagtatgcgcgcaggagtgtgagtgatgcagacatcaggaaataccaagcctttgctcagacgctgcagcagtctcgagggttcggttctgagttcaggttcgagaatactgctggttcgggcgcaaccactggagtcgctgatccttttgccacatctgcagctgctgccgcggacgatgatgatctctacaactgatgatcaaatttatcacatcctttttttttttttttcaaatttaagaagttttaaatcgaattctctactgttggatgactaggaaagtgatactgatcctttccttgtggttttatcgttttataaagtattcggaatcagtcatgttggtaacttttaatcaatgttcttc

SEQ ID NO: 5581 - DNA, 711 bp, Brassica napus
gctcgacgtccgattgctactcagagaggaggtggcggcggaggtcggatgctggcggtgcggctagactagagtcctcaaccagctttgacagagatggatggaatgaacgacctagaagactgcttcatcatcggagcgaccaacaaggcccgacattattgattctggctcgttctccgtaccaggaaggctcgaccagctcatttacattccactaccggatcacggactcacgtctcaatatcttcaaggcatgcttgaggaaatctcctgttgctaaagatgtggacatcaatgctctcgctaagtacacacaggggttcagtggtgctgatatcactgagatttgccagagggcttgcaaatacgccatcagagaaacatgagaaggacattgaaaaggagaagaggaggagcgagaaccctgaggccatggaagaagatggagtggatgaagtgtctgagatacaaagctgcacactttgaggagtcgatgaagtatgcacgcaggagtgtgagtgatgcagacatcaggaagtaccaagcctttgctcagacgctgcagcagtctagaggtttggtctgagttcaggtttgagacttaatgctggttcaggggcaaccactggagtcgctgattccttttgccacctctgcagctgctgctgcagatgatgatgatctctacaactagtgatacaaacttat

SEQ ID NO: 5582 - DNA, 2059 bp, Brassica napus
tattgagacggatcctgctgagtactgtgtggtggctccggacactgagattttctgtgagggtgagccagttaagagagaggatgaagaaaggctagatgaagtgggttatgatgatgttggtggtgtcaggaagcagatggctcagatcagggagcttgttgagcttcccttgaggcatccacagctgttcaagtcgattggtgtgaagccaccgaaggggattctgctttacggaccacctgggtctggcaagactttgattgctcgtgccgtggctaatgaaactggtgcctttttcttctgtatcaatggtcctgagatcatgtctaagctggctggtgagagtgagagcaatctcaggaaagcgtttgaggaggctgagaagaacggctccttcgattatatttatcgatgagattgactctattgcacctaaaagagagaagactaatggagaggttgagaggaggattgtgtctcagctccttacgcttatggatggacttaagtctcgtgctcacgttattgtcatgggagcaaccaatcgtcccaacagtattgatccagctttgagaaggtttggaagatttgatagggagattgatattggtgttcctgatgagattggacgtcttgaagttctcaggatccacactaagaacatgaagcttgctgaagatgtggatcttgagaggatctcaaaggacacacacggctatgttggtgctgatcttgcagctctgtgcacagaagctgccctgcagtgcatcagggagaagatggatgtgattgatttggaagatgactccatagatgctgaaatcctcaactccatggcagtgaccaatgagcacttccacactgctctcggcaacagcaacccatctgctcttcgtgaaactgttgtggaggttcctaatgtttcttgggatgacattggaggtcttgagaatgtcaagagagagctccaggagactgtccaatacccagtggagcacccagagaagtttgagaagttcggtatgtctccatcaaagggagtcctcttctacggtcctcctggatgtggtaaaacgctattagccaaagctatagccaacgagtgccaagcaaacttcatcagtgtcaaaggtcctgagcttctcaccatgtggtttggtgagagtgaagccaacgtccgtgaaatctttgacaaggcacgtcagtctgctccctgtgtgctctctttgacgagctagactccattgccactcagagaggaggtggaggcggaggtgatgcaggcggcgcagcggacagagtcctcaaccagcttttgaccgagatggatggaatgaacgccaagaagactgtcttcatcatcggagcaaccaacagacccgacattattgattctgctcttctccgtccaggaaggctcgaccagctcatttacattccgctcccagacgaggattcacgtctcaacatcttcaaggcctgcttgaggaaatcacctgttgctaaagatgttgacatcaacgctctggctagtacacgcaggggttcagtggtgctgatatcactgagatttgccagagggcgtgcaagtacgccatcagagaaacatcgagaaggacatgaaaggagaagaggaggagcgagaacctgaggcgatggaggaagatggagtggatgaagtgtctgagatcaaagctgcacattttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaaatttattatcctttttatttaagttttcaatcggattctctcaactttcaaccttatgtttccttaaaaagttatcggaattatgttgattgtcttttaatctaatgtacctgcttcacttcttagtt

SEQ ID NO: 5583 - DNA, 690 bp, Eutrema halophilum
gaaccagcttttgactgagatggatggcatgaacgctaagaaaaccgtcttcatcattggagcaaccaacagacccgacattatcgatgcggctcttctccgtccaggaaggctcgaccagctcatttacattccactaccagacgaggattcgcgtctcaatatcttcaaggcctgcttgaggaaatctcctgttgccaaagatgtagacatcaatgcactcgctaagtacacacagggattcagtggtgctgatatcactgagatttgccagagagcttgcaagtacgccatcagagaaaacatcgagaaggtcagagatcaattgaaaaggagaagaggaggagcgagaacccagaggcgatggaggaagatggagaggatgaagtgtcagagatcaaagctgcacactttgaggagtcgatgaagtatgcgcgcaggagtgtgagtgatgcagacatcaggaaataccaagcctttgctcagacgctgcagcagtctcgagggttcggttctgagttcaggttcgagaatactgctggttcgggcgcaaccactggagtcgctgatccttttgccacatctgcagctgctgccgcggacgatgatgatctctacaactgatgatcaaatttatcacatcctttttttttttttttcaaatttaagaagttttaaatcgaattctct

SEQ ID NO: 5584 - DNA, 556 bp, Brassica juncea
ttcagtggtgctgatatcactgagatttgccagagggcttgcaagtacgccatcagagaaaacatcgagaaggacattgaaaaggagaagaggaggagcgagaaccctgaggcgatggaggaagatggagtggatgaagtgtctgagatcaaagctgcacattttgaggagtcgatgaagtatgcgcgcaggagtgtgagtgatgcagacatcaggaagtaccaagcgtttgctcagacgctgcagcagtctagagggtttggttctgagttcaggttcgagactaatgctgctggttcaggtgcaaccactggagtcgccgatccttttgccacctcggcagctgctgctgcggacgatgatgatctctacaattagtgtgatcaaatttattatcctttttatttaagttttcaatcggattctctcaactttcaaccttatgtttccttaaaaagttatcggaattatgttcattgcttttaatcaatgtacctgcttcactcttgttcattcgtactaaccaccaagggaaaactaaagaccacaatctatc

SEQ ID NO: 5585 - DNA, 504 bp, Brassica juncea
gttcagtggtgctgatatcactgagatttgccagagggcttgcaagtacgccatcagagaaaacatcgagaaggacattgaaaaggagaagaggaggagcgagaacccagaggccatggaggaagatggagtggatgaagtgtcagagatcaaagctgcacactttgaggagtcgatgaagtatgcgcgcaggagtgtgagtgatgcagacatcaggaagtaccaagcctttgctcagacgctgcagcagtctagagggtttggttctgagttcaggttcgagactaatgctggttcaagtgcaaccactggagtcgctgatccttttgccacgtctgcagctgctgctgcagatgatgatgatctctacaattagtgatcaaacttatcatcctcttcttttttttttaagctctctacttttggatgactgagggaaagtgatactaaatatttttccttgtgtttctttaagttaatcagaatcgtttatgtttgatacta

SEQ ID NO: 5586 - DNA, 1861 bp, Primula obconica
ttaagccacccaaaggaatcctactctatggacctcctggatctggaaagactctaatagctagggctgttgccaatgaaactggtgcgttctttttctgtattaatggcccggaaattatgtctaagatggctggcgagagtgaaagcaatcttaggaaagcttttgaagaagcagagaagaatgcgccttccatcatctttattgatgagattgattccattgctcccaagagagataaaactaatggagaagttgagaggaggattgtttcgcagctcttgacacttatggatgggctcaagtctcgtgctcatgttattgttatgggggctacaaaccgtcccaatagtattgaccctgctttgagaagattcggtagattcgatagggaaatcgatatcggcgttccggatgaagtcggtcggcttgaggttcttcgcatccataccaaaaacatgaagttagctgaagatgttgacttggagaaaatttcgaaggagactcatggctatgttggtgctgatctagctgccctgtgcactgaagctgcactgcaatgcattagagagaagatggacgtgattgacttggaagatgagtccattgatgcagagatactcaactccatggctgtttcgaatgagcacttcacaactgctctcggaacaagcaatccttctgctctgcgagagactgtggttgaggtgcctaatgttagctgggaggatatcggaggccttgagaatgttaaaagagaacttcaagagactgttcaatatcccgtggaacatcctgagaagtttgagaagtttggcatgtctccctcgaagggagttcttttctatggtccacctggttgcgggaagaccttgctggctaaggctattgctaacgaatgccaggctaatttcattagtattaagggcccagagttgcttaccatgtggttcggagagagtgaggctaatgttagagagatatttgacaaagctcgccaatctgctccttgtgttctcttctttgacgaactcgactccattgctacccagagaggtggcagtgttggagatgctggtggtgctgccgacagggtgctgaatcagctcctcacagaaatggatgggatgtctgctaagaaaactgttttcataattggagcaaccaacagacccgatattatcgactctgctcttctgcgtcccggacgtctcgatcagctaatttatatccctctccctgatgaggagtcgcgctttcagatcttcaagtcctgcctgaggaaatctcctgtgtcgaaagacgtcgacattagagcccttgctaagtacacccagggtttcagtggtgctgatatcacagaaatatgccaacgtgcttgcaaatatgctatcagggagaatatcgagaaggatattgagaaggaaaggaggatgagtgagaacccagaggcaatggaggaagacgttgatgatgaggtgtcggagatcaaggccgcccattttgaagagtcgatgaaatttgctcgaaggagtgtaagcgatgctgatattcgcaagtaccaggcgtttgctcagacacttcagcagtcgcgaggttttggctctgagttccgatttgaaacaagtgctgctaccaccggtgctgacccatttgcttctgctgctggtggcgctgacgaagatgacctgtatagttaggttatttatcgttagcgcttgatgcgtttgacttttattttgttatgttaaactatttccagtgggtttatgtactgaacaaagttgtataatcgggcggagcgtgcatcacgccccatgtggactgtcggtggagaattgttttaagttgtttcttgctg

SEQ ID NO: 5587 - DNA, 1583 bp, Thalictrum flavum
tgttattgttatgggtgcgacaaatcggccaaatagcatagatcctgcactgagaaggtttgggaggtttgatagggaaattgatattggtgttcccgatgagattggacgtctagaggtccttcgcatccatacaaagaacatgaagctctctgacgatgttgatctagagagaatttcaaaggatactcatgggtacgttggtgctgatcttgctgctctatgcactgaagctgcacttcagtgcatcagagagaagatggatgtgattgacttggaagatgagtctatagatgctgagatacttaactccatggctgttacaaatgaacatttcaaaactgcccttgggacaagcaatccatctgctttgcgtgaaacagttgttgaggtacccaatgtcaactgggaagacatcggcgggcttgaaaatgttaagagggaactccaagagactgtgcaatatccagtggaacatcctgaaaagtttgagaagtttggaatgtcaccttcaaagggagttcttttctatggaccccctggttgtggtaaaactcttttggctaaggctattgcaaatgaatgccaagctaattttattagtatcaagggccctgagctacttactatgtggtttggagagagtgaggctaatgttagagaaatttttgacaaggctcgtggatctgctccctgtgttctgttctttgatgaacttgattccattgctactcagagaggaagcagcgttggtgatgcaggtggtgccgctgatagagttctgaaccaacttttgactgaaatggatggaatgtctgcaaagaaactgtattcattattggcgccaccaacaggccagacattattgatcctgccttacttagacctggtcgccttgatcagctgatatatatccctttgccagacgaggcatctcgctattcaatcttcaaggccgccctgaggaagtcacctgtatctaaagatgtagacctgaatgccctggctaagtatactcaaggctttagtggagctgatatcacagaaatatgccagcgggcttgcaagtatgccattagggagaacattgaaaaggatattgaaagggagaagaggagaagcgagaacccagaggcaatggaagaggatgtcgaggacgaagtggctgaaatcaaggctgcccactttgaggagtccatgaaatatgctcgtaggagtgttagtgatgctgacattcgcaaatatcaggcctttgcacagactttgcaacaatctaggggctttggaagtgagtttaggtttgcagatacagcaggagcaggtactactacggctgacccatttgcagctgctgcaggagcggatgatgatgacctgtatagttgataatcctgtttgttaacattatctgtaatttatgattcccttaatcatggaaacaagtcaacaaccaagccttaaactttgtgtggcttgggagttgggacatcccaaggaaggttaaatacttttatattcctaaattgtttattttgcaatacattagggggattcaggatccttggtctatttatgatttttgt

SEQ ID NO: 5588 - DNA, 1257 bp, Cleome gynandra
agatgttgatctcgagaagatatccaaggagacacatggttacgttggtgctgatcttgcagctctgtgcacagaggcggctcttcaatgcattagggagaagatggatgtgattgatttggaagatgactccatagatgctgaaatcctaaactcaatggcagtgactaatgaacacttccagactgctcttggaaacagcaatccgtctgctcttcgtgaaaccgttgttgaggtgcccaacgtctcgtgggaggatattggaggtcttgagaatgtcaaaagggagcttcaagagactgtccagtaccccgtggagcacccggagaaattcgagaaatttggaatgtctccatcaaagggagttctcttctacggccctcctggatgtggaaaaacccttttggccaaagctattgctaacgagtgccaagcaaacttcatcagtgtcaagggtcccgaacttctcacaatgtggtttggagaaagtgaagcgaatgttcgtgaaatctttgacaaagcccgtcaatccgctccttgtgttctcttctttgatgagcttgactccattgctactcagagaggtagcagcgtaggtgatgcaggtggtgcggctgacagagtgttgaaccaactccttactgagatggatggaatgaatgccaaaaagactgtttttatcattggagccaccaataggcctgacatcatcgaccccgctctcctccgtcctggtaggctcgatcaactcatctacattcccctccccgatgaagaatctcgtctccagatcttcaaagcttgcctgcggaaatcccccgtggctaaagatgttgacatcagggccctcgccaaatacacccaaggattcagtggtgctgatattactgaaatctgccagagggcttgcaaatacgcaatcagagaaaacatcgagaaggacatcgagagggaaaggagaagaagcgaaaacccggaagcgatggaagaagacgtggaggatgaagtagcggaaatcaaagccgcacactttgaagaatcgatgaaatacgcacgtagaagtgtgagtgatgcggatattcgcaaataccaagctttcgcgcagacgctgcagcaatcgagaggctttggaactgaatttaggtttgcggagactactggcactgcggccacaaccggaacggcagacccttttgcgacagctgcgggagctgcggatgatgatgatctctacagttaattccgacaaaaatcata

SEQ ID NO: 5589 - DNA, 861 bp, Scabiosa columbaria
tcctcactatgtggtttggggagagtgaagccaatgttcgtgaaatctttgacaaggctcgtggatctgctccttgtgttctattcttcgacgaacttgactccattgccactcagaggggaagcagtgtgggagatgctggtggtgcagccgacagggtcttgaaccaacttttgacagaaatggacggaatgtcagccaagaagacagttttcataattggggcaaccaacaggcctgatattattgatcctgccctcttgcgtccgggtcgtttggatcagttaatttatatccctctgcctgacgaagaatcccgcttcaatatatttaagtcttgcctgaggaaatctcctgtttctaaagatgttgatcttagtgctctagccaagtacacccaaggcttcagtggcgctgatatcactgaaatttgccaacgtgcttgtaaatatgccattcgcgagaacattgagaaggatattgaaaaggaaaggaggagaagtgagaatcctgaggcaatggaggaagatgacgctgacgatgaggtggcagaaatcaaagcagcccactttgaggagtcaatgaagtacgcacgaaggagtgtaagtgatgctgatattcgcaagtaccaagcttttgcacagacacttcagcaatcccgagggtttggctctgagttccggtttgctgagaccagtggagcagggaccactgctgcagccgatccatttgcaacttcggctgctgcagctgacgaagatgacctatacagttaaacattatgtgttaaccgtgttagttttacttccaatctttcttattaagactttcttaatttgtactatgcgccgttgagtctag

SEQ ID NO: 5590 - DNA, 1684 bp, Amaranthus tuberculatus
accggtgatgaatgatgattgatgaaggtcgaaaataatcaaaatataaaaatggtgagactcttcatcttcagtgaagataaagagtgcggcgcaaatgaagagaaagaggtgcctctaatcgtcccaacagcattgaccctgcactgagaaggtttggtcggtttgacagagaaatagatattggtgttcctgatgaaattgggagacttgagattctccgcattcacactaaaaacatgaagctctccgatgaagtcgatttggaaaggatttccaaggacacacatggttatgttggtgctgacttagctgccttatgtaccgaagctgcacttcaatgcatcagagagaagatggatgtaattgatctggaagatgagactattgatgctgagatccttaactccatggctgttacgaatgaacacttccagactgctcttgggcaaagcaatccatccgcactccgtgaaacggttgtggaagttcctaatgtctcatgggatgacattggtggtcttgaaaatgtcaaacgggagcttcaagagactgtacaatatcccgtggagcaccccgagaaatttgagaaatttgggatgtcgccctctaagggagttcttttctatggacctcctggatgtggaaaaacattgctggcaaaggctattgctaatgagtgtcaggctaacttcatcagtgtgaagggtcctgaactactaacaatgtggtttggagagagtgaggctaatgttcgagagatttttgacaaggcccgtgggtcagctccctgtgttttgttctttgatgagcttgattcaattgcaactcagaggggaagcagtgttggtgatgctggtggtgccgctgaccgggttttgaatcaactgctgactgaaatggatggtatgtcggccaaaaagactgttttcatcattggagccacaaatagaccggatattattgatccagctcttctgagacccgggcgtcttgatcaactaatttacattcctcttccggatgaggaatctcgcttgtccatattcaaggcagccttgaggaagtcccctattgccaaagatgttgatcttagagcgcttgccaagtacactcagggcttcagtggtgcagatatcactgaaatatgtcagcgggcttgcaaatacgccatccgagaaaatattgaaaaggacattgaacgagagaagaggagaagtgaaaaccctgaagcaatggaggaggacgacgtagaagacgaagttgctgaaatcaaggctgctcatttcgaggaatcaatgaagtatgctcggaggagtgttagcgacgctgatattcgtaaatatcaggcgttcgctcagacattgcagcagtcaagaggattcggcactgagttccggtttaacaacacgagttctggtgctacgactggtgctgatgcatttgctgcctcagctggtggagctgatgaagatgatctctataattagcttctctttggtttcctttctattttcacattactcccaatataatacttctattatttttattttcaagatgacatttgtttatgtggttcagcccatctttttttcacctgttgactgtagaatcacatcctgatgttggaattttattcaaatgtttaagttaatctctagacgttaatactatttactat

SEQ ID NO: 5591 - DNA, 955 bp, Amaranthus tuberculatus
cccgtgggtcagctccctgtgttttgttctttgatgagcttgattcaattgcaactcagaggggaagcagtgttggtgatgctggtggtgccgctgaccgggtgttgaatcaacttttgactgaaatggatgggatgtcggccaaaaagactgttttcatcattggagccacgaacagaccggatattattgatccagctcttttgagacccggacgtcttgatcaactaatttacattcctcttccggatgaggaatctcgcttgtccatattcaaggcagccttgaggaagtcccctattgccaaagacgttgatcttagagcgcttgccaagtacactcagggcttcagtggtgcagatatcactgaaatatgtcagcgggcttgcaaatatgccatccgagaaaacattgaaaaggacattgaacgagagaagaggagaagtgaaaaccctgaagcaatggaggaggacgacgtagaagacgaagttgctgaaatcaaggctgctcatttcgaggaatcaatgaagtatgctcgaaggagtgttagcgacgctgatattcgtaaatatcaggcatttgctcagacattgcagcagtcaagaggattcggcactgagtttcggtttaacaacacgagttctggtgctacgactggtgctgatgcatttgctgcctcagctggtggagctgatgaagatgatctttataattagcttctctatggtttcctttctattttcacattactcccaatataatacttttctttatttttattttcaagatgacatttattaatgtggttcagcccatctttttttcacctgttgactgtagaatcacatcctgatgttggaattttactcaaatgttgaagttaatctttagacgttaatactatctacttctgtttactataattgtcggttttcttttaatgggtatactcttc

SEQ ID NO: 5592 - DNA, 1386 bp, Cleome gynandra
gctgaagatgttgatcttgaaaggatttccaaggaaacacacggttacgttggtgctgatcttgctgctctgtgcacggaagctgcccttagtgtatcagggagaagatggatgtgattgatttggaagatgactccatagatgcggaaatccttaactcaatggcggtgaccaatgaacacttccagactgctcttggaaacagcaacccgtctgctcttcgtgaaactgttgtcgaggtgcccaacgtttcttgggaggatatcggaggtcttgagaacgtcaagagggagcttcaggagactgtacagtatcctgtggagcacccggagaaattcgagaagtttggaatgtctccatcaaagggagtccttttctatggccctccgggatgtggaaaaacccttttggccaaagctattgctaatgaatgccaagcaaacttcatcagtgtcaaaggtcctgaactccttacaatgtggttcggagaaagtgaagctaatgttcgtgaaatctttgacaaggcccgtcaatctgctccttgtgttctcttcttcgatgagctcgattctattgctactcagagaggtagcagtgtgggtgatgcaggtggtgctgctgatagagttctgaatcagctccttactgagatggatggcatgaatgccaagaagactgtctttatcattggagccaccaatagacctgacattatcgacccggctcttctccgtcctggtaggctcgatcagctcatctacattccccttcccgatgaagaatctcgtctccagatcttcaaggcttgcctgcggaaatctcccgtggctaaagatgtcgatatcagagccctcgctaaatacacccagggattcagtggtgctgatatcaccgaaatctgccagagggcttgtaaatatgccatcagagaaaacatcgagaaggacatcgagagggagaggagaagaagtgacaacccagaggcgatggaggaagatatggatgacgaagtggcggaaatcaaagccgcccattttgaggaatcgatgaaatatgctcgtagaagtgtaagcgacgcagatatccgcaagtaccaagctttcgcacaaaccctacagcaatctcgaggctttggaactgagtttaggtttggagagagtactaataccactggtggcaccacaggtacagccgatccctttgccacttctgctgcggctgcagacgatgacgatctttacagttgatcgcctctcgttttatttactcgattcaatcgaatttctctttaatgttgtgtacgatgaatggatgatcattgaacgctttgacatcaaatttcagacattcccttgtatgtctgcttttatttctctttctaatatc

SEQ ID NO: 5593 - DNA, 877 bp, Euphorbia peplus
tccgagaaattttcgacaaggctcgccaatctgctccttgtgtcctcttctttgatgaacttgattccattgctactcagagaggaagcagtgtaggagatgccgggggtgcagctgatagggttttgaaccagcttttgacggaaatggacgggatgtccgctaagaaaactgtttttattatcggggcaactaataggcctgatattattgacccggcacttctgcgtccaggtcgtctggatcagttgatctatattcctcttccagatgaggattctcgccatcaaattttcaaggcttgtttgaggaaatcacccgtttctaaagatgttgaccttagagctcttgccaagtacacccagggctttagtggtgctgatattactgagatttgccagcgtgcttgcaaatatgctatccgagaaaatatcgaaaaggatattgagagggagaggagaaggagagacaacccggaagccatggaggaagatgtggaggatgaggtggcagagatcaaggcagctcatttcgaggagtcaatgaagtatgctcgaagaagtgtgagtgatgcagatatccgcaagtaccaggcctttgcccaaacccttcaacaatctcgaggctttggaagtgaattcaggttctccgaagctagcggtggggccactactggaggagctgatccttttacttcaactgctgctgcagctgatgatgatgatctctacagttaaatttatttatcttcaaacgggcgcgcttttaagttagtttctatatggatgtgtatttgtttatttccgtcctttgttgtagttttaattaaggattattttatgtttgggcaagttggagataacacattctctttact

SEQ ID NO: 5594 - DNA, 1375 bp, Euphorbia esula
  misc_feature (482)..(482): n is a, c, g, or t
  misc_feature (626)..(626): n is a, c, g, or t
  misc_feature (669)..(669): n is a, c, g, or t
  misc_feature (698)..(698): n is a, c, g, or t
  misc_feature (990)..(990): n is a, c, g, or t
  misc_feature (1220)..(1220): n is a, c, g, or t
ccgttgctgtcggtgctgacttggcagctctttgtactgaggcggctcttcagtgtattagggaaaagatggacgtgattgacttggaagatgagtccattgatgctgagattctaaactccatggcagttactaatgaacacttccatactgcactttcaaatagcaacccatctgctttgcgtgaaacagtggttgaagtgcctaattgcagttgggaagatattggaggtcttgaatatgttaagcgggagcttcaagagactgttcaatacccagtggagcacccggagaaattcgaaaaattcgggatgtctccctccaagggagttcttttctatggacctcccggatgtggaaaaacccttcttgctaaagctattgccaatgaatgtcaggcaaatttcatcagtgtcaagggtcctgagttgcttactatgtggtttggagagagtgatgctaatgtccgagaaattttcganaaggctcgccaatctgctccttgtgtcctcttctttgatgaacttgattccattgctactcagagaggaagcagtgtaggagatgccgggggtgcagctgatagggttttgaaccagcttttgacggaaatggacgggatgtcngctaagaaaactgtttttattatcggggcaactaataggcctnatattattgacccggcacttctgcgtccnggtcgtctggatcagttgatctatattcctcttccagatgaggattctcgccatcaaattttcaaggcttgtttgaggaaatcacccgtttctaaagatgttgaccttagagctcttgccaagtacacccagggctttagtggtgctgatattactgagatttgccagcgtgcttgcaaatatgctatccgagaaaatatcgaaaaggatattgagagggagaggagaaggagagacaacccggaagccatggaggaagatgtggaggatgaggtggcagagatcaaggcanctcatttcgaggagtcaatgaagtatgctcgaagaagtgtgagtgatgcagatatccgcaagtaccaggcctttgcccaaacccttcaacaatctcgaggctttggaagtgaattcaggttctccgaagctagcggtggggccactactggaggagctgatccttttacttcaactgctgctgcagctgatgatgatgatctctacagttaaatttatttatcttcaaangggcgcgcttttaagttagtttctatatggatgtgtatttgtttatttccgtcctttgttgtagttttaattaaggattattttatgtttgggcaagttggagataacacattctctttactggttctataatggatgactttttaaacccccac

SEQ ID NO: 5595 - DNA, 1199 bp, Thellungiella halophila
aatgaacactttagaccgctcttggaaacagcaacccatctgcacttcgtgaaaccgttgtggaggttccaaatgtctcctgggaggatattggaggtcttgagaatgttaagagagagctacaggagactgttcaataccctgtggagcatccagagaaattcgagaaatttgggatgtctccatcaaagggagttcttttctacggtcctcctggatgtggaaaaacccttctagccaaagcgatagcaaacgagtgccaagcaaacttcatcagcgtcaagggacctgagcttctcactatgtggtttggagaaagtgaggccaacgtccgagaaatctttgataaggctcgtcagtctgctccttgcgttctgttctttgatgagctcgactccattgctactcagagaggaagcagcgtgggtgatgcaggcggtgcagctgatagagttttgaatcagcttttgacagaaatggatggaatgaatgcgaagaagacggtcttcattattggagcaactaacagacctgacattattgatccagctcttcttcgacctggaagactcgaccagcttatctacattcctctacccgatgaggattcccgtctcaacatcttcaaggcgtgcttgaggaaatctcctgttgctaaagatgtcgatgtgactgcactcgccaagtacactcagggattcagtggtgctgatatcactgagatttgccagagagcttgcaagtacgccatcagagagaatatcgaaaaggatatcgagagggagcgtagaaggagcgagaatccagaggccatggaggaagatttggtggacgatgaagttgcagagattagagctgctcatttcgaagaatcgatgaagtatgcaaggaggagtgtgagtgatgctgatattcgcaagtaccaagcttttgctcagacgctgcagcagtcgagaggatttggaactgagttcagatttgacccaaccgccgctgctggacgcaccactggtggtgctgccgccgatccctttgccacttctgcagctgctgccgatgacgacgatctttacagttagattatggattcgtcaatgtagttttttttttttttttttctaagtgtttttaagttaagttgtgaacttttgaatgatgtcgagagagattatgtcgatgttattttcacctttttttac

SEQ ID NO: 5596 - DNA, 1442 bp, Cleome spinosa
gaagatttgaccgggagatcgatattggtgttcctgatgaaattggacgtctcgaagtcctcagaatccacacgaagaacatgaagctagcagaagatgttgatcttgagaggatttccaaggacacacacgggtatgttggtgctgatcttgcagctctatgcacggaggctgcccttcaatgcatcagggagaagatggacgtgattgacttggaagatgactccatagatgctgaaatcctcaactcaatggcagtgactaatgaacacttccagactgctcttggaaacagcaacccctctgctcttcgtgaaaccgttgttgaggtgcccaatgtctcttgggaggatatcggaggtcttgagaacgtcaagagagagcttcaggagactgttcaatacccagtggagcaccctgagaagtttgagaagtttggaatgtctccatcaaagggagtcctcttctacggccctcctggatgtggaaaaactcttctggccaaagctattgctaatgagtgccaggctaacttcatcagtgtcaaaggtcctgagcttctcaccatgtggttcggagaaagcgaagctaatgttcgtgaaatctttgacaaggcccgtcagtctgctccttgtgtcctgttcttcgatgagctcgactctattgccactcagagaggaagcagtgtcggtgatgcgggtggagctgcggatagagtgctgaaccagctccttactgaaatggatggaatgaacgccaaaaagacggtctttatcattggagcgaccaacaggccagacatcatcgacccggctctcctccgtcctggaaggcttgatcagctcatctacattccccttcccgacgaagaatctcgtctccagatcttcaaggcttgcctgaggaaatcccccgtggctaaagatgtggacatcatggcacttgccaaatacacacagggattcagtggtgctgatatcactgagatctgtcagagggcttgcaaatacgctatccgaagaaaacatcgagaaggacattgagaaggagaggaagaggagcgaaaacccggaggcgatggaggaagacgaggctgaggatgaggtggcggagattagagcggctcattttgaggaatcgatgaaatatgcacgcagaagtgtgagtgatgctgatatccgcaagtaccaagctttcgctcagacactgcagcaatcgagagggtttgggaccgagttcaggttttcggaagctaccggagcgggtgccaccactggagcagccgacccttttgccacttccacggtggctcccgacgatgacgacctctacagttgatttggcctcaataacttattcagtggcgagtctcttcttttacgtatcttgctatggaaaacgttatacggttcccaagttaactcaactctctctctctctct

SEQ ID NO: 5597 - DNA, 1597 bp, Actinidia deliciosa
cattgaccctgctttgagaaggtttgggagatttgatagggaaatagatattggtgttccagatgaagttggccgacttgaggttcttcgtatccatacaaagaatatgaagcttgctgaagatgttgacttggaaagaattgcaaaggacacacacggttatgtaggtgctgatcttgcagctttgtgcactgaggctgcacttcaatgcattagagagaagatggacgtgatcgacttggaagatgaatccatagatgcagagatactcaactctatggctgttacaaacgaacactttcagactgctcttggaacaagcaatccttcggctctccgtgaaactgttgttgaagtgcccaattgcagttgggaagatattggagggcttgagaatgtcaaaagggagcttcaggagactgttcaatatcctgtggagcatcctgagaagttcgagaagtttggtatgtcaccttcaaagggagttcttttctatggcccacctggatgtgggaaaactctgctggccaaggcaattgccaatgaatgtcaggcaaacttcattagtgtcaagggccctgaattgcttactatgtggtttggagaaagtgaggctaatgtgcgagaaatatttgacaaggctcgccaatctgctccttgtgtcctattctttgatgaacttgactcgattgctacccagagaggaagcagtgtaggagatgctgggggtgccgccgacagggttttgaatcaacttctaactgaaatggatgggatgtctgcaaagaagactgttttcattattggggccactaacaggcccgatataattgaccctgcacttctgcgaccgggccgtctcgatcagttaatttacatccctttgcctgatgaggattctcggcaccagattttcaaggcctgcctgaggaaatctcctatttccaaagatgtcgacctaagagccctcgcgaaatatactcaaggcttcagcggtgcagatattacagaaatatgccaacgtgcttgcaaatatgccattagggagaacattgagaaagatattgaaagggagaggaggaggagtgagaaccctgaggctatggaggaggatgttgaagatgaggtggcagagatcaaggctgcccattttgaagaatcaatgaagtatgcccgaaggagtgtgagtgatgccgatattcgcaagtaccaggcgttcgctcagacattgcagcagtctagagggtttgggagcgaattccgattttcggagaccagtgccggggccaccactggatctgacccttttgcagcttctgccggtggacccgatgaagatgacctctatagttagattctctctgttgtgtttcgtcgtttatgtcatgtttaaaacatttcttactctttaaaactatttatgtagtttctgggtcttattattttgaattctgctgcgtatcaaggccttagttgggttttgattagcccacctccagtttaaagttctcatattgtttctattaatctgacgagtacagtaacgaaaaccttacaggatttaatttaaattttagttattgtgaaaaaaaaaaaa

SEQ ID NO: 5598 - DNA, 1879 bp, Quercus alba
agagcaacctcaggaaagcatttgaggaagcagagaagaatgcaccatccatcatctttattgatgagatcgattcaattgctcccaagcgagagaagacacatggagaagttgagaggagaattgtttcccagctcttgacacttatggatggactgaaatctcgtgctcatgttattgtcatgggggctacaaatcgtcccaacagcattgaccctgccttgagaaggtttggaagatttgacagggaaatagatattggagttccagatgaaattgggcgtcttgaagttctccgtattcacacaaagaatatgaagctttctgaagatgttgacctagaaagaattgctaaggacacacatggttatgttggtgctgatctagcagctctgtgtactgaggccgctcttcaatgcatcagagagaagatggatgtgatcgatttggaagatgagacaatagatgcggagatactaaattcaatggcagtttcaaatgagcacttccagactgctcttggaacaagcaacccatctgctctccgtgaaactgttgttgaagtgcccaattgcagttgggaagatattggaggtcttgagaatgttaagagggaacttcaagagactgttcaatacccggtggagcatcctgagaaatttgagaagtttggaatgtcaccatcaaagggtgttcttttctatggccctcctggatgtgggaaaaccctcctggccaaagctattgctaatgaatgtcaggcaaactttatcagtgtcaagggtcctgagttgcttacgatgtggtttggagagagtgaagccaatgtaagggaaatattcgacaaggcacgccagtctgctccttgtgtcctattctttgatgaacttgactcaattgctactcagagaggtagcagtgtaggagatgctggaggtgctgctgatagggttttgaaccaactcttgactgaaatggatggcatgtctgcaaagaaaactgttttcatcattggggccaccaacagaccagatatcatagaccctgcacttctgcgtccaggtcgtcttgatcaattgatctacatccctctccctgacgaggactcccgccatcagatatttaaggcatgcttgaggaaatctcctatctccaaagacgttgatctcagagcccttgccaagtatactcaaggctttagcggtgctgacattactgagatatgccagcgtgcatgcaaatatgccataagagagaacattgagaaagatattgagagggaaagaaggagaagggataatcctgaggcaatggaggaggatgttgaggatgaagtagcagagatcaaggcagcccattttgaggaatcaatgaagtatgctcggaggagtgttagcgatgctgacatccgcaaataccaggcatttgctcaaacattgcagcagtcaagagggtttggatccgaatttaggtttgctgataatacttcttctggagccactgcatctgaccctttcgcgacggctgctgccggggctgatgaagatgacctatacaattaggttcttaaaatgggtgtttgtcttatttatgttagacattcctttcttacatatgtcattgtaatgatatgtttaaggctcttattgaattgcccttgtgtccaaggaggccttgggttttgccagcggatgatcccctggctacactgaagtttaaagaacagtttttattttgatagttataatggataattttaaactctacaagttttaagttgaaattattgtttgctttaatatcttgtttacttgtggtgaggcttttgttatccacttgtgagtaatgttaggaacataaattttttcataatgcttat

SEQ ID NO: 5599 - DNA, 2012 bp, Malus domestica
ctgagtactgtgtggtcgctcccgacactgaaatcttctgtgagggggaacctgtgagaagggaggatgaggaaagaactttaaatgaggttggctatgacgacgttggtggagtgaggaaacagatggctcagattcgtgaattggtggagctgccactgaggcatcctcagctgtttaaatcaattggtgtgaagccgccaaagggcattctgctgtatggacctcctggaactggcaaaactctaattgcccgagctgtggctaatgaaactggggcattttttttctgcatcaatggaccagaaatcatgtcgaagatggcaggagagagtgaaagcaacctcaggaaagcttttgaggaagcagagaagaatgcaccatccattatctttattgatgagattgattcaattgctcccaacagagagaagacacatggagaagttgagaggaggattgtttcccagctcttgacactcatggatggactcaaatctcatgcacatgtaattgttatgggggctacaaatcgtccaaatagcagtgatccggctcttagaaggtttggaagatttgatagggaaatagatattggtgtgcccgatgaagttggacgtcttgaggttctgcgcattcataccaagaacatgaagcttgctgaagatgttgatttggaaaagatagctaaggacacacatggttatgttggtgccgatctagctgctttgtgtactgagggtgcgcttcaatgcatcagagagaagatggatgtgattgacttagaagatgaggaaatagatgctgagattattaattcaatggcagttacaaaccagcacctaaagactgctcttagcacaagcaacccttctgctcttcgtgaaacagttgttgaagtgccgaatgttagttgggaagatattggaggtctcgagagtgttaagagggaacttcaagagacggttcaatatcctgtagagcatcctgagaaatttgagaaatttggaatgtcaccttcaaagggagttcttttctatggcccttcgggatgtggtaaaactcttctcgccaaagctattgccaatgagtgtcaagcaaacttcatcagtatcaagggacctgaattgcttaccatgtggtttggagagagtgaggccaatgtacgtgaaatctttgacaaggcccgtggatctgctccatgtgtcctgttctttgatgaacttgattccattgctactcagagagggagtagtgtaggtgatgctgggggtgctgctgatagggttttgaatcaactcctcacagaaatggatggaatgtctgcaaagaaaactgttttcattatcggggccaccaacagacctgatattatagaccctgcacttttgcgtccaggccgtctggatcagttgatttacattcctctccctgatgaggaatcccgatttcaaatattcaagtcttgcttgaggaagtctccagtttccaaagatgtggacatcagagcccttgctaagtacacccaaggatttagtggtgctgatataacagaaatatgccagcgtgcttgcaaatatgccattagagagaatattgagaaggatattgagaaggagaggaggagaaatgagaatcctgaggcaatggaggaggatgttgaggatgaaattgcagagatcaaggcagctcattttgaggagtcgatgaagtatgctcgcaggagtgttagcgatgctgatatccgcaaataccaggcatttgcacagacattgcagcagtcgagagggtttggaacagagttcaggtttgcagacaatccttctggcacaactgctgcagccgacccttttgcaactgctgctgctggggcagatgaagatgacctttacaattaggatggttttcattaatctctttcgtgcttgaatttcaactttgcattttgtatttccgtatgtgttagaaggtagaaacgttgaagtgtccatttaatcgttgttgtacccaaa

SEQ ID NO: 5600 - DNA, 1108 bp, Brassica napus
gggaagacactcttagccaaagccatagcgaacgagtgccaagcaaacttcatcagcgtcaagggacctgagcttctcaccatgtggtttggagaaagcgaagccaacgttcgtgagatcttcgacaaggcgcgtcagtccgcgccttgcgttctcttcttcgacgagctggactcaatcgctactcagagaggaagcagcgtgggggacgcgggaggggcggccgatagagttttgaaccagcttttgacggagatggatgggatgaacgccaagaagacagtcttcatcatcggagcgacgaacaggcccgacattatagatccggctcttctccgaccgggaaggctcgaccagctcatctacattcctctccccgatgaggagtcccgtctcagcatcttcaaggcgtgtttgaggaagtctcccgttgctaaagacgttgacgtgagggccctcgctaagtacactcaggggttcagcggcgctgacatcactgagatttgccagagggcgtgcaagtacgctattagagagaacatcgagaaggatattgagagggagcgtaggaggggggagaatccagaggcgatggaggaggatttagtggatgatgaggtggcggagattagagctgctcatttcgaggagtcgatgaagtatgcgaggaggagtgtgagtgatgctgatattcgcaagtaccaggcctttgctcagacgctgcagcagtctagagggattgggagtgagttcaggtttgatccgaccgcgtctgctggacggaccactggtggtgcatctgctgatccctttgctacttcagctgctgctgcagatgatgatgatctctacagttaagattatggtttctcaaagttagttgtttttttctttcctaagtttaaaagttgtgaactaatggatggtgtcgagagtgatacagagaacactccttcgggcttgttatgtgatattattgcgatgttatttctctctttcacgataccttttttttttttttgtcagcttattttgcttctcaatttatttatttgagttttgaagtaagcatttatggtgagagcaaacagtcgtaaagtgagaattt

SEQ ID NO: 5601 - DNA, 2110 bp, Brassica napus
caagagagaggacgaagagaggctggatgaatcggttatgatgatgttggtggcggtcagaaaacagaatggctcagattagtagaacttagttgtagctcctttcgtaggcatccgcagctcttcaagtccatcggtgtgaagccgccgaagggtatcttgctctatggacctcctggttccggaaagacactgatcgctcgcgccgtggctaacgaaacgggagcgtttttcttctgtatcaatggaccggagatcatgtcgaaaatggccggtgagagtgagagcaacctcaggaaagcgtttgaagaggctgagaagaacgctccttccattatctttattgatgagattgactctattgcaccaaagagagataagactaatggtgaggttgagaggaggattgtctctcagctcctcacgcttatggatggtttaaagtcacgtgcgcatgttatcgtcatgggagctaccaaccgtcccaatagtattgaccccgctttgagaaggtttgggaggttcgacagggagattgacatcggtgttcctgatgagattgggcgtcttgaggttcttaggatccacaccaagaacatgaagctagctgaagatgttgatctcgaaagaatctccaaggacacgcatggatacgttggtgctgatcttgccgctctgtgcactgaagctgctcttcagtgtattagagagaagatggatgtgattgacttggaagatgagtctatcgacgctgagattctcaactccatggcggtgtctaacgaacacttccacaccgctcttgggaacagcaacccgtctgcactccgtgagaccgtcgtggaggtaccaaacgtctcctgggaggatattggaggtcttgagaatgttaagagagagctgcaggagactgttcagtaccctgtggagcatccagagaagttcgagaaatttgggatgtctccatcgaagggagttttattctacggtccacctggatgtgggaagacactcttagccaaagccatagcgaacgagtgccaagcaaacttcatcagcgtcaagggacctgagcttctcaccatgtggtttggagaaagcgaagccaacgttcgtgagatctttgacaaggcgcgtcagtccgcgccttgtgttctcttcttcgacgagctggactccatcgctactcagagaggaagcagcgtgggggacgcaggaggcgcggcggatagagttttgaaccagcttttgactgagatggatgggatgaacgctaagaagactgtcttcatcatcggagcgactaacagacccgacattatagatccagctcttctccgaccgggaaggctcgaccagctcatctacattcctctccccgatgaggagtcccgtctcagcatcttcaaggcgtgtttgaggaagtctcccgttgctaaagacgttgacgtgagggccctcgctaagtacactcaggggttcagcggcgctgacatcactgagatttgccagagggcgtgcaagtacgctattagagagaacatcgagaaggatattgagagggagcgtaggaggggggagaatccagaggcgatggaggaggatttagtggatgatgaggtggcggagattagagctgctcatttcgaggagtcgatgaagtatgcgaggaggagtgtgagtgatgctgatattcgcaagtaccaggcctttgctcagacgctgcagcagtctagagggattgggagtgagttcaggtttgatccgaccgcgtctgctggacggaccactggtggtgcatctgctgatccctttgctacttcagctgctgctgcagatgatgatgatctctacagttaagattatggtttctcaaagttagttgtttttttctttcctaagtttaaaagttgtgaactaatggatggtgtcgagagtgatacagagaacactccttcgggcttgttatgtgatattattgcgatgttatttctctctttcacgataccttttttttttttttgtcagcttattttgcttctcaatttatttatttgagttttgaagtaagcatttatggtgagagcaaacagtcgtaaagtgagaattt

SEQ ID NO: 5602 - DNA, 1768 bp, Fagopyrum esculentum
tatcttcattgacgaaattgattccattgctccgaagagagagaaaacgaatggtgaagttgagaggagaattgtttcccagctattgacacttatggacgggcttaagtcccgagctcatgtcattgttatgggtgccaccaatcgtcccaacagcattgatcctgctttgagaaggttcggaaggtttgacagggagatagatattggtgttccggatgaagttggaagacttgagattcttcgtattcacacgaagaacatgaagcttgctgaagatgttgatttggaaaagatctgcaaggagacacatggatacgttggtgctgatttggctgctttgtgcactgaagctgcactgcagtgcatcagggagaagatggatgtcattgatctagagacgacaccatcgatgcagagatttgaactccatggcagttctaatgaacacttctcgactgctttgggccaaggcaatccttctgctttgcgtgaaactgttgttgaagtgcccaagtttcatggaatgacatcggtggtcttgagaacgtcaagagagagcttcaagagactgtacaatatcccgtggaacatcctgagaagtttgaaaagttcggaatgtctccctcaaagggtgtttgttttacggccctcctggatgtggtaaaactctacttgccaaggccattgctaatggatgtcaggcaaattttatcagtatcaagggacctgaattgctcacaatgtggtttggagagagtgaagcgaatgtcagagagatttttgacaaggctcgtggatctgctccttgtgttttattctttgacgagcttgactcaattgccacacagagaggcagtagtcaaggtgatgcaggtggtgcagctgatagggttcttaatcaacttttgactgaaatggatggcatgtctgccaagaaaaccgtctttattattggtgccaccaaccggcctgatattattgatcctgccctcctccgtccaggtcgtcttgaccagctaatctacatccctctccccgacgaggagtcccgtctacaaatcttcaaggccaacctaaggaagtctcctattgcaaaggatgtagatctgagagctcttgccaagtacacccagggcttcagtggtgctgatattaccgaaatctgtcagcgtgcttgcaaatatgctatcagagaaaacattgagaaggacattgagaaggagaagagaagaagcgaaaacccagaggccatggaagaggatatggaagatgaagtgtctgaaatcagagctgcacatttcgaagagtcaatgaaatacgctcgtaggagtgtcagcgacgctgacattcgtaagtaccaggcttttgctcagacattgcagcaatctagagggttcggtagcgagttccgattctctgaagctagcggagctgctggtggtgcaacagggtctcaaccttttgcagcctctgcaggtggagctgatgaagatgacctctacaattaattatgcttgtggtcatgatattgaaccattttctatcacttattctgtttttattttaggaatcagttttcaatacttgccagaattgttgtgatgggttttacctgcccactgcacacaatgtttttcaactatgtcttatgtatcattgttggaggactaggacaaaggaaacccaactggatttgcttccctaattttttctgttgcccttttcccttaatttgctcaactttcgcattgcccattctactatc

SEQ ID NO: 5603 - DNA, 1002 bp, Primula obconica
gtcaaaagagagctccaggagactgttcaatatcctgtggaacatcctgagaagtttgagaagtttggtatgtcaccttcaaaaggagttctattctacggcccacctggatgtggaaaaactctattggctaaagcgattgcaaatgaatgccaagcaaactttattagcatcaagggaccagaactacttaccatgtggtttggagaaagtgaggccaatgtgcgagaaatctttgataaggctagagggtctgctccttgtgtccttttctttgatgagctcgactcaattgccacccagagaggaagcagcagtggtgacgcagggggtgctgctgatagggttttgaatcaacttctcacagaaatggacggaatgtctgcaaagaaaaccgttttcattatcggtgctacaaacaggcctgatattatcgaccctgcccttttgaggcctggtcgtcttgatcagttgatttacatccctctccctgatgaggaatcccggttccaaatcttcaagtcttgcctgagaaaatctcccatttctaaagaagttgacctcagagcccttgcaaagtacactcagggattcagtggcgctgatattacagaaatttgccaacggtcttgcaaatatgccattcgcgaaaatatcgaaaaggatatcgagaaggaaaaaaggaggagcgagaacccagaggccatggaagaggacgttgatgatgaggtggcggagatcaaggccgctcacttcgaggaatcaatgaagtacgcgcgaaggagtgtaagcgatgcagatatacgcaagtatcaatcctttgcccagacattgcagcagtccagagggtttggctctgaattccgattctccgaggccagtggaggaggaggagccacaactgggtctgacccttttgcagcgcctgccggtggggccgacgaagacgacctctatagttaattaattctttagaaaaactgtggtgttcatcttgggctt

SEQ ID NO: 5604 - DNA, 645 bp, Sarracenia psittacina
tgggatataattgaccctgcacttttgcgacctggccgtctagatcagttagtttatatccctctgcccgatgaggattctcggcatcagattttcaaggcctgtctgaggaaatctcccgtttccaaagacgttgacctaagagccctcgccaagtacacacaaggcttcagcggtgcagatattacagaaatatgccaacgtgcatgcaaatatgccattagggagaatatcgagcaagatattgagaaggagaagaggaggaaggagaatcccgaggcaatggaggaggatgttgaagacgagttgtcggagatcaaagccgcccatttcgaggaatcgatgaagtatgctcgaagaagtgtgagcgatgccgacattcgtaagtaccaggcatttgctcaaacattgcagcaatcaagagggttcgggactgagttccggttctcggagaccagtgccgggacggctgccgccactggatctgacccttttgccgcctctgctggtggtgctgatgaagatgacctctatagttaagtttcgtctctttgctgtgtgttttgttatcatatgatttgttaaaacattgatttctgtctatctaaatatttatgtgaccatggagtgaaacctaccatgcat

SEQ ID NO: 5605 - DNA, 2267 bp, Medicago truncatula
cttatttcttggaggcatatcgaccagtgaggaaaggtgacttcttccttgtgagaggtgggatgagaagtgtagaattcaaggttattgaaaccgacccacatgagtactgtgttgttgcccctgacacggagattttctgtgaaggagagcccattaaaagggaagatgagaatcgcttagatgaggttggttatgatgacgttggtggtgtgagaaagcagatggcacagattagggaactggttgaattgccactgaggcacccacaattattcaagtctattggtgtcaagccaccaaaggggattctcttgtatggaccccctggttctggaaagactttaattgctcgggcagttgcaaatgaaacaggtgccttctttttctgcattaatggccctgagataatgtcgaaacttgctggtgagagtgaaagcaatctaaggaaggcatttgaggaagctgagaagaatgcaccttccatcatctttattgatgagatagattccatagctcctaagcgagagaaaactcacggtgaagtagagaggaggattgtctcccaactcttgacccttatggatggtcttaaatcacgtgcacatgtaattgttatgggagccacaaataggcccaatagcattgaccctgcacttaggaggtttggaaggtttgatagggagattgatattggtgttccagacgaggttgggcgtcttgaggttcttcgaattcatacaaagaatatgaaactcgccgaagatgttgatttagaaaagatttctaaggagacacatggctatgttggtgctgatttagctgctttgtgtaccgaagcagcacttcaatgcatcagggaaaaaatggacgtgattgacttggaagatgagacaattgatgctgaaatattgaactccatggcagtgacaaatgagcatttcgcgactgcgctcggatcaagcaatccttctgctctccgtgaaacagttgttgaagtgcctaattgcagctgggatgatatcggcggtcttgaaaatgttaagagggaactccaagagactgtccaatatccagtggaacaccctgaaaagtttgagaagtttggaatgtcgccttcgaagggagttcttttctatggtcctcctggatgtggtaaaacactattggcaaaagctattgccaatgaatgccaggcaaactttatcagtatcaaaggtcccgagctactcacaatgtggtttggagaaagtgaggcaaacgtgagggaaatttttgacaaggcccgtggttctgctccatgtgtcctattctttgatgaacttgactccattgcaactcagagaggtagtagtgtaggagatgctgggggtgctgccgacagggttttgaaccagttgctaacagaaatggatgggatgtcagcaaagaaaactgtgttcatcattggcgcaactaatcgaccggacattatagatccagctcttctgcgtccaggccgtctagaccagttgatttatatccccctcccagatgaagattcccgtcatcagatatttaaagcttgcttgagaaaatctcccatctctaaagatgttgacattagagctcttgcaaagtacacccaaggctttagtggtgctgatattactgagatttgccagcgtgcttgcaagtatgccataagagagaacattgagaaggacattgaaaaagagagaaagagaagcgagaaccccgaggccatggaagaggacattgaagatgaagtagctgaaatcaaggcagctcattttgaggaatcgatgaaatacgctcggaggagtgtaagcgacgctgacattcgcaagtaccaggcattcgcccaaacattgcagcagtccagagggtttggaaccgagtttcggtttgcagattctggcaccagtggtgctgctgctgcaggtgcatctgatccattttcatctgctgctggagctgatgatgatgatctttacaattaggtcaaacttgtatgtgtgtagttcgttttaagaattccagtgctgtcttatttatgtacttgtcaaaggctttctttggattattattgtcattgcttcttaaaagcatttgtttatatggcaagcattaggtgcgagccacttcctaagttagaaaaaaaagttatccagtttcttgtataatctgacagcttttgaagctttgctgctcaattctgaagcgcgacatttcacatgaacaaaattttacagatttcactcgtg

SEQ ID NO: 5606 - DNA, 983 bp, Momordica charantia
ttctgaaccaacttctgacggaaatggacggaatgtcagcaaagaaaactgtctttataattggggccaccaacagaccagatattatagatcctgcgcttcttcgtccaggacgtcttgatcaattgatttatattccgctccccgatgaggattctcgtcaccaaattttcaaggcttgcttgaggaagtcgccagtatcaaaagatgtagaccttagagcccttgctaagtacactcaaggctttagtggtgccgatattacagaaatctgccagcgtgcctgcaaatatgctatcagagagaatattgagaaagatattgagaggagaggaggagaagagataatcctgaggctatggaagaggatgatgtagaagatgaggtagcagagattaaggctgctcatttcgaggagtcgatgaagtttgctcgtagaagtgtgagcgacgccgacattcgtaaataccaagcatttgcccaaacactgcagcagtcaagagggttcggttccgaattcaggttctcagaaaacacttcaggaactgcggctgctgacccgtttgcaacttctgctggcggagctgacgatgacgatctttacaactaggttcgtatatgtcatgtatgtttagaacatttctccctcttctctagcaccgcaaatttgtgtcccgtttcccatataaagatctgtgggggaggaggagccttaagttggagggctgtttggtcccaaacttggcttcatggccccccttgggtagtgatacttgcctataatgtagacttcagttgtttatttcctttactgctttaaaatggagaatttaggacaccataagattgctcttcgggcattactgaatcccttccctccatttggttcttgtgaatgatgaactcagttctatcttccaaaccattgaaaatattttagaaactaatgttgtgtttggttatataatctattggaaatctac

SEQ ID NO: 5607 - DNA, 770 bp, Avena sativa
aggtgcagctgacagagtgctgaaccagctgctcactgagatggatggcatgaacgccaagaaaacgtcttcatcattggtgctacaaacaggcccgacatcatagacctgcctgcttaggccagggcgtcttgatcagcttatctacatccctcttcctgatgtcgactcgaggcaccagatcttcaaagcctgcctcaggaagtcccccttggccaaggatattgatcttagtgctctagccaagtacacccaagggttcagcggtgctgatatcacggaaatttgccagcgtgcttgcaaatacgccatcagggagaatatcgaaaaggacattgagagggagaggcggaggaaggacaaccctgaagccatggaggaggatgaggtggacgaggttgctgagatcagggctgcacacttcgaggagtcgatgaagtatgcacgccggagtgtgagcgatgctgacatccgcaagtaccaggcctttgcccagactctacagcagtctcgaggttttggcagcgagttccgtttccctgatcagccggcggcgggtgctgccactaccgccgcggccgatccttttgcatccgctgccgcaacggccgatgatgatgatttatatagctaaattctccttctcgttgttgtgccattaacttaccgtgatttcgttcgtatactgttatgttttgctctggtatgcaatgcacggtcaaactatgtacttaaaaattaatattgggatgcactgatattagttaccc

SEQ ID NO: 5608 - DNA, 740 bp, Avena sativa
aggtgcagctgacagagtgctgaaccagctgctcactgagatggatggcatgaacgccaagaaaacgtcttcatcattggtgctacaaacaggcccgacatcatagacctgcctgcttaggccagggcgtcttgatcagcttatctacatccctcttcctgatgtcgactcgaggcaccagatcttcaaagcctgcctcaggaagtcccccttggccaaggatattgatcttagtgctctagccaagtacacccaagggttcagcggtgctgatatcacggaaatttgccagcgtgcttgcaaatacgccatcagggagaatatcgaaaaggacattgagagggagaggcggaggaaggacaaccctgaagccatggaggaggatgaggtggacgaggttgctgagatcagggctgcacacttcgaggagtcgatgaagtatgcacgccggagtgtgagcgatgctgacatccgcaagtaccaggcctttgcccagactctacagcagtctcgaggttttggcagcgagttccgtttccctgatcagccggcggcgggtgctgccactaccgccgcggccgatccttttgcatccgctgccgcaacggccgatgatgatgatttatatagctaaattctccttctcgttgttgtgccattaacttaccgtgatttcgttcgtatactgttatgttttgctctggtatgcaatgcacggtcaaactatgtactttaaaata

SEQ ID NO: 5609 - DNA, 657 bp, Petunia hybrida
tctcgtccatcaaattttcaaggctgtttgaggaaatcacctctttctaaggatattgatctaagagctcttgcaaaggtacactcaagggttcagtggagctgacattacagaaatctgccaacgtgcatgcaaatatgcaatccgagagaacattgagaaagatattgagagggagaaaaggagaagcgagaacccagaagccatggaggaagacgtcgatgatgagatagcagagatcaaggctgcacactttgaggaatcaatgaagtatgctaggaggagtgtcagtgatgctgatatccgcaagtaccaggcttttgcgcagacgttgcagcagtcgagaggttttggttctgagttccggttcgcagataccaacacaagtgccactggagctgctgatccttttgcaactgctgttggtggagcagcagatgatgacgacctgtatagttagattatcaaagtttgttcctctcaatgtcggaaaaccttatatttcacaacttatatttacagcttacaaaatggctatttattcagctgaagaaactttggagttagcagattgactattcccatttaatccccaagagtaagtaatattacttggatatccgacagcttcaggtaaaatactatgcagtcattcat

SEQ ID NO: 5610 - DNA, 1893 bp, Ambrosia trifida
aatcggttatgatgatgtcgtgggtccgcaaacagatggcacaaatccgtgagttggtggagttgcctttaagacatccacagcttttcaagtcaattggggtcaaaccacccaagggaattcttctttacgggcctcctgggtcaggtaagactttgatagccagggctgttgcaaatgaaactggtgccttcttcttctgtataaacgggccagaaatcatgtcaaagatggctggagaaagtgagagtaatctcaggaaagcttttgaggaagctgagaagaacgctccgtcgattatttcatcgatgaaattgattcgattgctcccaaaagagataaaacaaacggagaagttgaaagaagaattgtctcgcagcttttgactcttatggacggactgaaatcacgggctcatgttattgtcatggtgcaccaaccgtcccaacagcattgaccctgccctgaggagattcggcaggtttgaccgggaaattgatatcggtgttcctgatgaagtgggccccttgaggtgctccgcattcacaccaagaacatgaagctggctgaggatgtggacttggaaaagatttctaaagagacacatggatatgtcggggctgatctggctgctttgtgtactgagtcagcactccagtgtattcgtgagaagatggatgtgatcgatttggaagatgagtcgattgatgctgagattcttaactccatggcggttacaaatgagcacttccaaactgcccttggtacaagtaacccgtctgctcttcgtgaaactgttgttgaagttcctaatgttagttgggaagatattggtgggcttgaaaatgttaaaagagagctccaagagactgtacaatatccagtcgaacaccctgaaaagttcgagaagtttggcatgtcgccatctaaaggagttctgttttacgggccacctgggtgcggtaaaactcttctagctaaggccatagccaatgaatgccaagctaacttcatcagcatcaagggtccagaattgctaaccatgtggtttggtgaaagtgaagctaatgttcgtgagatcttcgataaggcccgtggctccgccccttgtgtcttttttttttatgagctggactccattgctacccagagagggagcagccaaggagatgcaggaggtgcagctgatagggttctcaatcagcttttgactgaaatggacgggatgtcggctaaaaagactgttttcattatcggtgcaactaaccgtcctgacatcattgatccagctcttttgaggcctggtcgtcttgatcagttgatttacattcctctccctgatgaagagtcgcgttattcgattttcaaatcagctttaaggaagtcacctgttgctaaggacgttgatcttcacgctcttgctaagtacactcagggattcagcggtgctgacatcactgaaatctgccagcgtgcgtgtaaatacgccatccgtgagaacattgagaaggatattgagagggagaagagaaggagcgagaacccggaggctatggaggaggacgtggaagatgacgtgccggagatcaaggcggcgcattttgaagagtcgatgaagtttgcacgaagaagtgttagtgatgctgacatacgcaagtaccaggcgtttgctcagacactgcagcagtctagagggttcgggtctgagtttaggttctctgagactagcggtgcagccgctagtgctggtgggtcagacccgtttgctgcttcagctggtgcggcggatgatgacgatttatacaactagcgttaaagcacactcgtcgtatcttttacttttgtaatttatgtaaaacttgatgcttttgctttacaagacttaatcccctt

SEQ ID NO: 5611 - DNA, 1343 bp, Cucurbita pepo
tgtcagctaggaagacattggaggtcttgagaatgtcaaaagggaacttcaagagaccgtacaatatccagtggaacatccggagaagttcgagaaatttggcatgtcaccctcaaagggagttctttttatggccctcctggatgtggaaaaactcttctggccaaagctattgcaaatgagtgccaggctaacttcataagtgtaaagggtcctgaattgcttacaatgtggtttggagaaagtgaggccaatgttcgtgaaattttcgataaggcgcgccagtctgcaccttgtgttctgttctttgatgagcttgactctattgccactcagagaggcagcagcgtgggagatgctggaggtgctgctgatcgagttctaaaccaacttctgacggaaatggacggaatgtccgcaaagaaaactgtcttcattattggggcgaccaacagaccagatattatagatcctgcacttcttcgtccgggacgtctcgatcaattgatttacattcctcttcccgacgaagattctcgtcaccaaattttcaaagcttgcttgaggaagtcgccgatctcgaaagatgtagaccttagagcccttgctaagtacactcaaggttttagtggtgctgatattacagaaatctgtcagcgtgcttgcaaatatgctatcagagagaatattgagaaagatattgagagggagaggaggagaagagataatcctgaggctatggaagaggatgtagaggacgaggtggcagagattaaagctgctcatttcgaggagtcaatgaagtttgctcgtagaagtgtgagcgacgccgatattcgcaaataccaggcatttgctcaaacactgcagcagtcgagagggtttggttctgaattcaggttctcagaaaacacgtctggaactgcagccgccgacccgtttgcaacatcagctggcggggctgatgatgatgatctttacaactaggggtttccatatgtgatgtatgtttagaacagttcttctaacactgcaaatttgtgtccgtttctcatagaaagatctgtgggggaagaaggagccttcagttggaggggcgttcggtcccaaagatggcttcagggcgcccccttgggtagtgatacttgcctataatgtagacgtatcagttggttatttcctgttactgctttaaaaatggatacttcagaacaccgtaggattgctgtttggcctctactacttaactaagtgcaggacttttaaagccttatccgtggcagcttttctttctaagaaagtccgagatgctttagtcaattcttattgttcacgcttagttg

SEQ ID NO: 5612 - DNA, 1874 bp, Malus domestica
aatgaaactggcggcgattctttttctgcatcaagtggacccagaaatcatgttaaaattggctggggagagtgaaagcaacctcacgaaagcttttgaggaggctgataagaatgcaccatcaatcatcttcattgatgagattgattcaattgctcccaagagagagaagacgcatggagaagttgagaggaggattgtttcacagctcttgacactcatggatgggctaaaatctcgtgcccatgtgattgttatgggggctacaaatcgtccaaacagtattgatccagctctcagaaggtttggaagatttgatagggaaatagatattggtgtgccagatgaaattgggcgtcttgaggttgtccggattcatacgaagaacatgaagcttgccgaagatgttgatttggagaagatagcgaaggatacacatggttatgttggtgccgatctagctgctttgtgtactgaggctgcccttcaatgcatcagagagaagatggatgtaattgacttggaagatgaggaaatagacgctgagatactcaattcaatggcagttacaaacgagcacttcaagactgctctaggcacaagcaacccatctgctcttcgtgaaaccgttgttgaagtgcccaatgttagttgggaagatattggtggtcttgagaatgttaagcgtgaacttcaagagactgttcagtatcctgtcgagcatcctgagaagttcgagaaatttggaatgtcaccctccaagggagttcttttctatggccctcctggatgtggtaaaactcttctcgccaaagctattgccaatgagtgtcaagcaaacttcatcagtgtcaagggacctgaattgcttaccatgtggtttggagagagtgaggccaatgtgcgggaaatttttgacaaggcccgcggatctgcgccatgtgtcctgttctttgatgaacttgattccattgctactcagagaggtagtagcgtaggtgatgctgggggtgctgctgatagggttttgaaccaactcctcacagaaatggatggaatgactgcaaagaaaaccgttttcattatcggggccaccaacagacctgatattatagaccctgcacttttgcgtccaggccgtctggatcagttgatttacattcctctccctgacgaggaatcccgatttcaaattttcaagtcttgcttgaggaagtctccagtttccaaagatgtggacatcagagcccttgctaagtacacccaaggatttagtggtgctgacataacagaaatatgccagcgtgcttgcaaatatgccattagagagaatattgagaaggatattgagaaggagaggaggagaaatgagaatcctgaggcaatggaggaggatgttgaggatgaaattgcagagatcaaggcagctcattttgaggagtcgatgaagtatgctcgcaggagtgttagcgatgctgatatccgcaagtaccaggcatttgcacagacattgcagcagtcgagagggtttggaacagagttcaggtttgcagacaatccttctggcacaactgctgcagccgacccttttgcaactgctgctgctggggcagatgaagatgacctttacagttaggatggttttcattaatctctttcgtgcttgaatttcaactttgcattttgtatttccgtcgatgtggtagaacctttgaagtgtccatttaatcgttattgtacccaaagaagccttggggtttccagccattggattcaccccaggatactacgaagttaaaaacagtgttaattatttcataagattataatggagaatttaggaactcaagatgttttgtttcagaaaaaaaaaa

SEQ ID NO: 5613 - DNA, 1848 bp, Solanum tuberosum
tcaactcctaaggaattttgttgtatggacctcctggatcagaaagactttaatacccgagctgttgcaaatgaacggtgcgtcttttctgcattaatggtccagagatcatgtctaaattggcgggagaaagtgaaagtaatctcaggaaagcatttgaagaagctgagaagaatgcaccatcaattattttcattgatgaaattgattcaatagctcctaaacgtgagaagacaaatggagaggtggagaggaggattgtctcccagcttttgacacttatggatggacttaagtcacgtgcccatgtaattgttatgggtgccactaatcgccccaacagcattgaccctgccttaagaaggtttggtagatttgaccgggaaatagacattggtgttccggatgaagtggggcgtcttgaggtgcttcgtatccatacaaagaacatgaagctcgctgaagaagttgatttagaaagaatttgcaaagacactcatggttatgttggagctgatttagcagctttgtgtaccgaggctgcactccaatgcatcagagagaagatggacgtgatagatttggaggatgagaccattgatgcagagattctgaactctatggctgtgacaaatgagcacttccaaactgctcttgggacgagcaatccttctgccttgcgtgaaaccgttgttgaagttcccaatgtttcatgggaggatattggaggactagagaatgttaagcgtgagctccaagagactgttcaatatccggtggaacatcctgagaaattcgagaagtttggtatgtctccctcaaagggagtccttttctatggcccacctggatgtggaaaaactttgctcgcaaaggccattgcaaatgaatgccaggctaacttcatcagtatcaagggtccagagctgcttaccatgtggtttggagagagtgaagccaacgttagagaaatatttgacaaggcccgccaatctgctccgtgtgtcctattttttgatgaactggactcgattgccacacagagaggaagtagttcgggagacgctgggggagctgctgacagagttttgaatcaactccttactgaaatggatgggatgaacgctaagaagactgtgttcattattggtgcaaccaataggccagacattattgatcctgcacttctgcgtcctggtcgtcttgaccaattgatttatattcctctccctgatgaagattctcgtcaccaaattttcaaggcatgcctgaggaaatcaccgctttctaaggacatcgatctaagagcacttgcaaagtatacacagggctttagtggagctgacattacagagatctgtcaacgtgcttgcaaatacgctatcagagaaaacattgagaaagatatcgaaagggagaaaaggagaagtgagaatcctgaagccatggaggaagacgttgaagacgaggtacctgagatcaaggctgctcattttgaggaatcaatgaagtatgctaggaggagtgtcagtgacgctgatatccgcaagtaccaggctttcgctcagacgttgcagcagtccagaggtttcggttctgaattccgattttccgagaccagcactgcagggacaactggaactgctgctgacccctttgcaacttcagctggtggagcagatgaagatgacctgtatagttaggttgtccaagttttacttacatattttacatacatttggaattctgtattaattcagtttaaaaacttgtgagtagcaaattgaaatctctcctttgctgctctcaatttataattcatgtttggatctttttgctctcagttta

SEQ ID NO: 5614 - DNA, 1637 bp, Solanum tuberosum
attgtttctcagctcttgactctcatggatggtctcaaatcacgtgcccacgtaattgtcatgggtgccactaatcgccctaatagtattgaccctgccctaagaaggtttggcagatttgatagggagatagatattggtgtcccggatgaagttgggcgtcttgaggtgcttcgtatccacacaaagaacatgaagctcgccgaagatgttgatttggaaagaattggcaaagaaacacacggttatgttggtgcggatttggcagctttgtgtaccgaggctgcacttcagtgcatcagagagaagatggatgtgattgatttggaagatgaatctattgatgcagagatattaaactccatggctgtgactaatgagcacttctcaactgcccttgggacaagcaatccatctgccctgcgcgaaactgttgttgaagttcctaatgtttcctgggaggacattggaggccttgagaatgtcaagcgtgagctccaagagactgttcaatatcctgtggaacatcccgagaagttcgagaagtttggtatgtctccttctaagggtgttctcttctatgggccacctggatgtgggaaaactttgttggcgaaggctattgcaaatgaatgccaggccaattttattagtatcaagggtccagaattgcttaccatgtggtttggagagagcgaagccaatgttagagaaatattcgacaaggctcgagggtctgctccttgtgtcctgttttttgatgagttggactcgattgctactcagagaggtggtagcagtggagatgccgggggagctgctgatagagttttgaatcaactcctcactgaaatggatggtatgaatgccaagaagacggttttcatcatcggtgccaccaacaggcctgacattattgatcctgcacttctacgtcctggtcgtcttgaccaattgatttacattcctcttcctgacgaggattcccgccatcaaattttcaaggcatgcctgcggaaatcacccctttctaaggatatcgatctcagagctcttgcaaaatatacgcaagggttcagcggagctgacattacagagatctgccaacgtgcatgcaaatacgctatccgagagaacattgagaaagatattgagagggagagaaggagaagggataatccggaagccatggaggaagacgttgacgatgaggtatccgagatcaagcctgctcactttgaggaatcaatgaagtatgctaggagaagtgtcagtgatgctgatatccgcaagtaccaggcgtttgctcagacgttgcagcagtcccgagggtttggttctgagttccggtttgcagaggccaccaccggtcccaccaccggaactgctgatccctttgcaacttctgctggtggtgcagatgaagatgacctgtatagctagagtgtctttaacttattttttactatttacaactttgctaatatgagtaattattttgaagaaactttgaaagttagaaaaattcagtatatttccattcattgtctagagtttgtaattttattttgatttttctcagctctacataaaaatattctgtagctattattttatctaaatgaaaagttatagat

SEQ ID NO: 5615 - DNA, 1124 bp, Helianthus annuus
tgaaacggttgtcgaagtccctaacgttagctgggaagatatcggtgggctcgaaaacgttaaacgagagctccaagagactgtgcaatatccggttgaacaccctgaaaaattcgagaaattcggtatgtcaccatctaaaggagttctgttttacgggccacccgggtgtggtaaaacgcttctagccaaggctatagccaatgaatgccaagctaacttcatcagcatcaagggtccagaattgctaaccatgtggttcggtgaaagtgaagctaatgttcgtgagatctttgataaggcccgtgggtccgccccttgtgttctgtttttcgatgagctcgactccattgctacccagagaggaagtagtcaaggagatgcgggaggtgcagctgatagggtgttgaatcaacttttgactgaaatggacgggatgtcagctaaaaagacggttttcattatcggtgcaactaaccgtcctgacatcatcgatccagctcttttgaggcccggtcgtcttgatcagttaatttacattcctctccctgacgaggaatcacgttactcgatctttaaatctgctttaaggaagtcacccgttgcgaaagaagttgatcttcacgcacttgctaagtacactcagggattcagtggggctgacatcaccgaaatctgccagcgtgcagttaaatacgctatccgtgagaacattgagaaggatattgagagggagaaacggaggagtgagaacccggaggcgatggaggaggacgtggaggatgaggtgccggagatcaaggcggcgcattttgaagaatcgatgaagtttgcacgaaggagtgttagtgatgctgacattcgtaagtaccaggcatttgctcagactctgcagcagtctagaggtttcgggtcggagtttaggttctctgagactagcggtgcggcggctggtgccggtggctcagacccttttgctgcttctgctggtgcggctgatgatgatgatttatataactagctttaaagcatgacactctttatcttgaacttttgtaatttatgtaaactttatgcttttgttttacaagactaattctcccttgtttcatgctttggttatt

SEQ ID NO: 5616 - DNA, 597 bp, Zinnia violacea
taaggaaatcacctgttgcaaaagatgttgatcttcgtgcccttgctaaatacactcagggactcagtggtgctgacatcaccgaaatctgccagcgtgcatgtaagtacgcaatccgtgagaacattgagaaggatattgaaagggagaagagaagaatctgagaacccggaggctatggaggaggatgtggaagatgaggtgccagagattaaggctgcacacttcgaagaatcaacgaagtttgcgcgaagaagtgttagtgatgctgacatacgcaagtacccaggcgtttgctcagacactgcagcagtctagagggttcggatctgaatttaggttctctgagactagcggtgcagccgctggtggtggtggggcagacccttttgctgcttctgctggtgcagccgatgatgatgatttatacaactagttttaaagcacaaatctatctttgaacttttgtaatttatgtaaaactttatgcttttgttttacaagacttgttcctccttggttcttgcattggttatcacgttacgtttaacgagaatgttttcgtaatgttttcttgaatttatggatcaactttgc

SEQ ID NO: 5617 - DNA, 436 bp, Brassica rapa
tgccagagggcttgcaaatacgccatcagagaaaacatcgagaaggacattgaaaaggagaagaggaggagcgagaacccagaagccatggaggaagatatggatgaagtatcagagatcaaagctgcacacttcgaggagtcgatgaagtatgcacggaggagtgtgagcgatgcagacatcaggaagtaccaagcctttgctcagacgctgcagcagtctagagggtttggttccgagttcaggttcgagactaatgctggttcaggtgcaaccactggagtcgctgatccttttgccacgtctgcagctgctgctgcggacgatgatgatctctacaattaagtgatcaagtttatcatactttgttatttaagttttcaatcggattctctctacttctggataccttgtgtttctttaagttattggattt

SEQ ID NO: 5618 - DNA, 1383 bp, Brassica oleracea
ggtgttcctgatgaggttgggcgtcttgaggttcttaggatccacaccaagaacatgaagctagctgaagatgttgatcttgaaagaatctccaaggacacgcacggatacgtcggctctgatcttgcggctctgtgcactgaagctgctcttcagtgtatcagagagaagatggatgtgattgacttggaggatgagtctatcgacgcggagattctcaactccatggcggtgtctaatgaacacttccacaccgctcttgggaacagcaacccgtctgctctccgtgaaaccgtcgtggaggttccaaacgtctcctgggaggatatcggagggcttgagaatgttaagagagagctgcaggagactgttcagtaccctgtggagcatccagagaagtttgagaagtttgggatgtctccatcgaagggagtgctcttctacggtccacctggatgtgggaaaacgctcttagccaaagccatagcgaacgagtgtcaagcgaacttcatcagcgtcaagggacctgagcttctcacaatgtggttcggagagagcgaagccaacgtccgtgagatcttcgacaaggctcgtcagtccgctccttgcgttctcttcttcgacgagctggactcaatcgctactcagagaggaagcagcgtgggggacgcgggaggggcggccgatagagttttgaaccagcttttgacggagatggatgggatgaacgccaagaagacagtcttcatcatcggagcgacgaacaggcccgacattatagatccggctctcctccgaccagggagattggatcagctcatctacattcctcttcccgatgaggattcgcgtctcagcatcttcaaggcgtgtttgaggaagtctcccgttgctaaagacgttgacgtgagggccctcgctaagtacactcaggggttcagcggcgctgacatcactgagatttgccagagggcgtgcaagtacgctattagagagaacatcgagaaggatattgagagggagcgtaggaggggggagaatccggaggccatggaggaagatatggtggatgatgaggtggcggagattagagctgcgcatttcgaggagtcgatgaagtatgcgaggaggagtgtgagcgatgctgatattcgcaagtaccaggcttttgctcagacgctgcagcagtcgagagggattgggagtgagttcaggtttgatccaaccgcggctgctggacgtactactggtggtgcagctgctgatccctttgctacttcaggggctgctgcagatgatgatgatctctacagttaagattatgttcctcaatgtagctgttttttttttctttctaagtttaaaagttgcgtactgaatgag

SEQ ID NO: 5619 - DNA, 704 bp, Brassica napus
gagattggatcagctcatctacattcctcttcccgatgaggattcgcgtctcagcatcttcaaggcgtgtttgaggaagtctcccgttgctaaagacgttgacgtgagggccctcgctaagtacactcaggggttcagcggcgctgacatcactgagatttgccagagggcgtgcaagtacgctattagagagaacatcgagaaggatattgagagagagcgtaggaggggggagaatccggaggccatggaggaagatatggtggatgatgaggtggcggagattagagctgcgcatttcgaggagtcgatgaagtatgcgaggaggagtgtgagcgatgctgatattcgcaagtaccaggcttttgctcagacgctgcagcagtcgagagggattgggagtgagttcaggtttgatccaaccgcggctgctggacgtactactggtggtgctgctgctgatccctttgctacttcaggggctgctgcagatgatgatgatctctacagttaagattatggttcctcaatgtagttgtttttttttctttctaagtttaaaagttgcgtactgaatgagtgatgtcgagagtgatacagagaacacttcttcgggcttgttatgtgatgtcgagagtgatacagagaacacttcttcgggcttgttatgtgatattattgcgatgttatttttctttcacggc

SEQ ID NO: 5620 - DNA, 755 bp, Cichorium intybus
gtgctacaaaccgaccggacataatcgaccccgcgcttttgagacccggtcgactcgaccagttgatttacattcctctccccgatgaagaatcgcgctatcagatcttcaaatccgctttgagaaaatcccccgttgcaaaagacgtcgaccttcacgcgcttgccaagtacacccaaggcttcagtggcgccgacatcaccgaaatctgtcaacgcgcatgcaaatacgccatccgtgaaaacatcgaaaaagatattgagagggagaaaaggaggagtgagaacccggaggcaatggaggaggatgtggacgatgaggtggcggagattaaggcggcgcattttgaagagtcgatgaagtttgcacgaaggagtgtcagtgatgcggatattagaaagtatcaggcgtttgcgcagacgttgcaacagtcgagagggattgggtcggagtttaggtttgcggaggcgagcggtggtgcgacggcagctggtggtggtgctgacccgtttgcagcgacgggtgcggcggatgaagacgatctttataactaagtagcgtatccaataatcgtaaccagatggtgactttgttatgtcttttaacaacttaaaaagttaaaatataaaatactttcttcttgaatttctgtaatttatataagttaataccttggttctatgacattggtttttaaccatgtaccttgcataggtaatacattaaaactataatatatttttgtaatatatctc

SEQ ID NO: 5621 - DNA, 598 bp, Ipomoea nil
ctggccgtcttgaccaattgatttacattcctcttcctgacgaagactcccgccatcaaattttcaaggcgtgcctgaggaagtctcccgtttccaaggacgtagacctcagagctcttgccaaatacactcaaggcttcagcggggccgacatcacagaaatctgccagcgctcttgcaaatatgccatcagagagaacattgaaaaggatatcgagagggaaaagaagaggagggagaaccccgaggccatggaggaggacgttgaagatgaggtagccgagatcaaggctgctcattttgaagaatcaatgaagtacgctcgcaggagcgtgagcgatgctgatatcaggaagtaccaggcatttgcacaaaccctgcagcagtcccgaggtttcggttctgaattccgattctcagaggccagcacagggggaggagctgccactggatctgatccttttgcaacttcagccggtggagctgatgaagatgacttatatagttagttaggttgtcaggttgttagttatattcgaacatatatttaagttcgttttgttgctgctttttattcatctgtaattttaactctgtt

SEQ ID NO: 5622 - DNA, 2077 bp, Leymus cinereus x Leymus triticoides
  misc_feature (791)..(791): n is a, c, g, or t
  misc_feature (902)..(902): n is a, c, g, or t
cagagtattgcattgtcgcaccagacactgagatattctgtgatggtgagcctgttacgagggaggatgaggagaggctcgacgatgttggctatgatgatgttggtggagttaggaagcaaatggcccagatcagagaactggttgagctcccactgcgtcaccctcagcttttcaagtctatcggtgtgaagcctccaaagggcatattgctgtttggaccacctggctctggcaagacccttattgctagagctgttgccaatgaaacaggtgcattcttctttctaatcaatggcccagaaattatgtccaagttagcaggagaaagtgagagcaatctcagaaaggcatttgaagaagctgagaagaatgcaccatccatcattttcattgatgagattgattcaatagccccgaagagagagaagaccaatggagaagttgaaaggcgtattgtttcacagctgttgactcttatggatgggcttaaatcccgtgcacatgttattgtcatgggtgctacaaaccgcccaaacagtattgatcctgctctcagaagatttggtaggtttgaccgggagattgacattggagtccctgatgaagttgggcgccttgaggttctccgcattcacaccaaaaacatgaagttggctgaagatgtggaattggaacatatttcaagagatactcatgggtatgttggttctgaccttgctgctctttgcactgaggctgctctccaatgcattcgtgagaagatggatattattgatcttgaggacganacaatagatgctgagatactcaactctatggctgtgacaaatgaccatttcaagaccgcgctgactacaagcaacccgtctgctctccgggaaactgttgttgaagttccnaatgtctcttgggaagatattggtggtctggagaatgtcaaaagggagttgcaggagactgtccaataccctgtggagcatcccgagaaatttgagaagtttggcatgtctccttccaagggtgttctgttctatggccctcctggctgtggtaaaaccttgttggccaaggcaattgcaaatgagtgccaggctaacttcatcagtattaaggggcctgagctgcttaccatgtggtttggtgagagtgaggctaatgtgcgtgagatttttgacaaggctagggggtcagcaccatgtgtgctcttctttgacgagcttgactcgattgccacccagagaggaggcagcagcggggatgctggaggtgctgctgatagagtgctgaaccagctgctgactgagatggatggcatgaatgctaagaaaaccgtcttcatcattggtgctaccaacaggccagacatcatagaccctgccctgcttaggccagggcgtcttgatcagcttatctacatccctcttcctgatgtcgagtcgaggcaccagatcttcaaagcttgcctcaggaagtctcctttggccaaggatattgatctgagtgctctggccaagtacacccaagggttcagcggtgctgatatcacggaaatttgccagcgtgcttgcaagtatgccatcagggagaacatcgaaaaggacatcgagagggagaggcggaggaaggacaaccctgaagccatggaggaggacgaggtggatgaggtcgctgagatcagggctgcccatttcgaggagtcgatgaagtatgcgcgccggagcgtgagcgatgccgacatccgcaagtaccaggcctttgcccagactctgcagcagtctcgtggattcggcagcgagttccggtttgctgatcaaccggctgcgggcgctgcctctgccgctgcggctgacccttttgcatccgctgccgcagcagccgacgatgatgatttatatagctaaatcctttcgctgtgcgatttcgtttcgctagtagatgttgtgctcgtacgcagtccgaaataaggaaagtttgcttgtggagtggaactttaatattttgaggaaagggagtaccaggtgcttagtgtctgtaatatactaaaacataaatatatatagctaagcgtcggcca

SEQ ID NO: 5623 - DNA, 1351 bp, Pseudoroegneria spicata
gttggtgctgatctcgctgctctttgtactgaggctgctctccagtgcatccgcgagaagatggatattatagatcttgaggatgagaccatagatgctgagatactgaattctatggccgtgacaaacgaccatttcaagactgcactaacgacaagcaacccatctgctctccgtgaaactgttgttgaagttcccaatgtctcttgggaagatattggtggtctggagaatgtcaagcgggagttgcaggagactgtccaataccctgtggaacatccagagaaattcgagaagtttggcatgtctccttccaaaggtgttctgttctatggccctcctggctgtggtaaaaccttgttggcgaaagcaattgcaaacgagtgccaggctaacttcatcagtatcaagggacctgagctgcttaccatgtggtttggtgagagtgaggctaatgtgcgtgagatttttgacaaggctaggggatcagcgccatgtgtgctcttctttgatgagcttgactcgattgctacccagagaggaagcagtgttggtgatgccggaggtgcagcggatagagtgctgaaccagctgctgactgagatggacggcatgaacgccaagaaaactgtcttcatcattggtgctaccaacaggccagacatcatagaccctgcgctgcttaggccagggcgtcttgatcagcttatctacatccctcttcctgatgtcgagtcaaggcaccagatcttcaaagcttgcctcaggaagtctcctttggccaaggatattgatttgagcgctctagccaagtacacccaagggttcagcggtgctgatatcaccgaaatttgccagcgtgcttgcaagtacgccatccgggagaacatcgagaaggacattgagagggagaggcggaggaaggacaaccctgaagccatggaggaggatgaggtggacgaggtcgctgagatcagggctgctcacttcgaggagtcgatgaagtatgcacgcaggagtgtgagcgatgccgacatccgcaagtaccaggcctttgcccagactctgcagcagtctcgtggattcggcagcgagttccggttccctgatcagcctgccgcaggcggtgcctctgccgctgctgccgatccttttgcatccgctgccgcagcagctgaagatgacgacttatatagctaaatcctcctcgttgtgccattgacttacccgtgatttccttcgtatactgttatgttttgctctggtatgcaagacacggtcaaaactatgtacttaaaattattattgggatgcactgatattcgttacctgccggttatttgcagctgta

SEQ ID NO: 5624 - DNA, 1889 bp, Triticum aestivum
gcaccagacactgagatcttctgtgatggtgagcctgttaagagggaggatgaggagaggcttgatgatgttggctacgatgatgtaggtggagtcaggaagcaaatggcccagatcagagaactggttgaactcccactgcgtcaccctcaacttttcaagtctatcggcgtgaagcctccaaagggcatattgctgtttggaccacctggctctggcaagacccttattgctagagctgttgccaatgaaacaggtgcattcttctttctgatcaatggcccagaaattatgtccaagttagcaggagaaagtgagagcaatctcagaaaggcatttgaagaagctgagaagaatgctccgtccatcatttttattgatgagattgattcaatagccccgaagagagagaagaccaatggagaagttgaaaggcgtattgtttcacagctgttgactcttatggatgggcttaaatcccgtgcacatgttattgtcatgggtgctacaaaccgcccaaacagtattgatcctgccctcagaagatttggtaggtttgaccgggagattgacattggagtccctgatgaagttgggcgccttgaggttctccggattcacaccaaaaacatgaagttggctgaagatgtggaactggaacatatttcaagagatactcatgggtatgttggtgctgatcttgctgctctttgcaccgaggctgctctccaatgcattcgtgagaagatggatattattgatcttgaggacgagacaatagatgctgagatactcaactctatggctgtgacaaatgaccatttcaagaccgccctgacgacaagcaacccgtctgctctccgtgaaactgttgttgaagttcccaatgtttcttgggaagatattggtgggctggagaatgtcaaaagggagttgcaggagactgttcaataccctgtggagcatccggagaaatttgagaagtttggcatgtctccttccaagggtgttttgttctatggccctcctggctgtggtaaaaccttattggccaaggcaattgcaaatgagtgccaggctaacttcatcagtatcaaggggcctgagctgcttaccatgtggtttggtgagagtgaggccaatgtgcgtgagattttcgacaaggctagggggtcagcaccatgtgtgctcttctttgatgagcttgactctattgctacccagagaggaagcagcagtggggatgctggaggtgctgctgatagagtgctgaaccagctgctgactgagatggatggcatgaatgctaagaaaaccgtcttcatcattggtgctaccaacaggccagacatcatagaccctgccctgcttaggccagggcgtcttgatcagcttatctacatccctcttcctgatgtcgagtcgaggcaccagatcttcaaagcttgcctcagaaagtctcctttggccaaggatattgatctgagtgctcttgccaagtacactcaagggttcagcggtgctgatatcactgaaatttgccagcgtgcttgcaagtatgccatcagggagaacatcgagaaggacatcgagagggagaggcggaggaaggacaaccctgaagccatggaggaggacgaggttgatgaggttgctgagatcagggctgcccactttgaggagtcgatgaagtatgctcgccggagcgtgagcgacgctgacatccgcaagtaccaggcctttgctcagactctgcagcagtctcgtggattcggcagcgagttccggttccctgatcagccggctgcgggcgcttcctctgccgctgcggccgacccttttgcttccgctgctgcagcagctgacgatgatgatttatatagctaaat

SEQ ID NO: 5625 - DNA, 1506 bp, Cucurbita pepo
gatgaagttgggcgtctagaagttctacgcattcatactaagaacatgaagcttgctgaagaagttgatttagagaggattgccaaagatacacatggctacgttggtgctgatttggccgctctctgtaccgaggctgctcttcaatgtattagagagaagatggacgtaatagacttggaagacgactctatcgatgctgagatactcaactcaatggcagttacaaatgagcatttccagacagctcttggaaccagcaacccgtcagctcttcgtgaaacagttgttgaagttcctaatgtttcatgggaggacattggaggtcttgagaatgttaaaagggagcttcaagagacggttcaatatcccgtcgaacaccctgagaaatttgagaaattcgggatgtcgccctcaaaaggagttcttttctatggccctcctggatgtggaaagactcttctggcgaaggctattgcaaatgaatgtcaagcaaacttcattagtgtcaagggtccagagttgctcactatgtggtttggagaaagtgaggccaatgttcgtgaaatcttcgacaaggcccgccagtctgctccttgtgtcttgttctttgatgaactcgactcaatcgctacccaaaggggtagtagcgttggggatgctggaggtgctgctgatcgtgtactgaaccaacttctcacagaaatggatggaatgtcagcaaagaagactgttttcatcatcggtgccaccaacagaccagacatcatagatcccgctctgttacgtcctggacgtctcgatcagttaatttatattcctcttcctgacgaagaatctcgccttcaaattttcaaggcttgcttgagaaaatctccaatctccaaagatgtagaactcagagcccttgccaagtacactcaaggcttcagtggtgctgatatcacagagatctgtcagcgtgcctgcaaatatgctatcagagagaacattgagaaggatattgagaaggagaggaggaaaagcgagaacccggaggccatggaggaggatgcagatgacgaagtggccgagatcaaagctgctcactttgaggaatctatgaagtatgcacgaaggagtgtgagcgatgctgacatccgcaaataccaggcatttgcacaaacacttcagcagtctagaggctttggagccgagttcaggttctcggagcagagctcgggaccaactgcatctgacccatttgcaacttcagctggtggggctgatgaagatgacctctacaactagtatgtcatttaggttccaacctcatttatgtttagactcagtagtatgatattacttgtttaaatgcttcctgtggatctgcttttggttggacattcctgaatccaaactgttggatggaaagaaaggagttggggagaaatccttttgttaatccatagttttattatgggctgcacaaaaactgaacagattctatttgaatgtgattatttt

SEQ ID NO: 5626 - DNA, 677 bp, Cucurbita pepo
gaactcagagcccttgccaagtacactcaaggtttcagtggtgctgatatacagaaatctgtcagcgtgcctgcaaatatgctatcagagagaacatcgagaaggacattgaaaaggagaggaggaaaagtgagaaccctgaggccatggaggaggatgccgatgacgaagtcgccgagatcaaggctgctcactttgaggaatccatgaagtatgcccgaaggagtgtcagcgacgcggacatccgcaaataccaggcatttgcacaaacacttcagcagtcaagagggttcggagccgaattcaggttcgagcagagctcgggatcaactgcatctgacccatttgcaacctctgctggtggggctgatgaagatgacctctataactagtacgtcatttaggctccaacccgatttatgcttagacttgatagcatgatataacttggtaaaagcttcatcatgtggatcacttttgattggacagagtcgtgaatccaaaccattggagggaaagaaatcattttgtttatccataattttgttatgggttacacaaaaactgaaagattctatttgattaagattatcatttacatcattcttgatgtaccatctttgtcgagtggctagtcaagccgaacaatttgaaattgagcatgcaagattgaatga

SEQ ID NO: 5627 - DNA, 871 bp, Cucurbita pepo
acggaatgtcagcaaagaagactgtcttcataattggagctaccaacagaccagatattatagatcctgcacttcttcgtccaggacgtctcgatcaattgatttatattcctcttcccgacgaggattctcgtcaccaaattttcaaggcttgtttgaggaagtctccaatatcaaaagatgtagaccttagagccctagctaagtacactcagggctttagtggtgctgatattacagaaatctgccagcgtgcttgcaaatatgctatcagagagaatattgagaaagatattgagagggagaggaggagaagagataatcctgaggccatggaagaagatgtagaagacgaggtggcggagattaaagctgctcatttcgaggagtcgatgaagttcgctcgtagaagtgtgagtgatgctgatatccgtaaataccaggcatttgctcaaacactgcagcagtcaagagggtttggttctgagttcagattctcagaaaacacttctggaactgcagcagccgacccgtttgcagcctcggcgggcggggctgatgacgatgatctttacaactaggtttttcatgtgtcatgtaagtttagaacagaacgtttcttcttcttatactgcaaatctgtgtccgtttcccatataaattatctgtcggggaggaggagcctagagttggagggctgtttggtcccattcgtggcttcagggcactccccttgggtagtgatacgtgcctataatgtagactttgagctggtttacttgctattactgctttataatggttactttattagaactccataagattgctgtttgagcacactactcaatttctttgaaatcttaactcc

SEQ ID NO: 5628 - DNA, 887 bp, Malus domestica
gccaatgtgagggaaatttttgacaaggcccgcggatctgctccatgtgtcctgttctttgatgaacttgattccattgctactcagagaggtagtagcgtaggtgatgctgggggtgctgctgatagggttttgaaccaactcctcacagaaatggatggaatgactgcaaagaaaactgttttcattataggtgccaccaacagacctgatatcatagaccctgcacttttgcgtccaggccgcctagatcagttgatttacattcctctccccgatgaggagtcccgttttcaaatattcaagtcttgcttgaggaagtctccagtttccaaagatgtggacatcatagcccttgctaagtacacccaaggatttagtggtgctgatataacagaaatatgccagcgtgcttgcaaatatgccattagagagaatattgagaaggatattgagaaggagaggaggagaaacgagaatcccgaggcaatggaggaggatgttgaggatgaaattgcagagatcaaggctgctcattttgaggagtcgatgaagtatgctcgcaggagtgttagcgacgctgatatccgcaaataccaagcatttgcgcagacattgcagcagtcgagagggtttggaacagagtttaggtttgcagacaatcctactggcacaactgctgcatccgacccttttgcaactgctgctgctggcgcagatgaagatgacctttacagttaggatggttttcgttaagcagcgtctttttcgtgcttgaattttaactgttgcattttgtattttccgtcgatgatgtggtagaatcgttgaagtgtccatttaatcgttgttgtaaccaaagaagccttggggtttccggccattgg

SEQ ID NO: 5629 - DNA, 812 bp, Avena sativa
cttctttgatgagcttgactcgattgctacccagagagagcagcagcggggatgctggaggtgccgctgatagagtactgaaccagctgctgactgagatggatggcatgaatgccaagaaaaccgtcttcatcattggtgctaccaacaggccagatatcatagaccctgctctgcttaggccagggcgtcttgatcagcttatctacatcccacttcctgatgttgattcaaggcaccagatcttcaaagcatgcctcaggaagtcccccttggccaaggatattgatcttagtgctctggccaagtacacccaagggttcagcggtgctgatatcacggaaatttgccagcgtgcttgtaaatatgccatcagggagaacatcgaaaaggacatcgagagggagagacggaagaaggacaaccctgaagccatggaggaggacgaggtggacgaggtggctgagatcagggctgctcacttcgaggagtcgatgaagtatgcacgccggagtgtgagcgatgctgacatccgcaagtaccaggccttcgcccagacactgcagcagtctcgcggatttggcagcgagttccgtttcgctgatcagccggctgctggcgctgctcctgcagctgatccttttgcatcggctgccgcagcagccgacgatgatgatctatatagttaaatcccttttgcggtgcgatttgcttcgtagacgctgtgctctggtgatgccgtacacgggaagaccatgtacttattgtacttaagttaatgttcggatgcacagttaatcattctgccggct

SEQ ID NO: 5630 - DNA, 1610 bp, Juglans hindsii x Juglans regia
  misc_feature (457)..(457): n is a, c, g, or t
gggggttgaaatctcgcccacatgttatgatcattaggggctacaaagattcccaatagcattgaccctgctttgagaaggtttggaagatttgacagggaaatatatattggtgtcccggatgaagttggacgtcttgaggttctccgtatccatacaaagaacatgaagcttgctgaagatgttgatttagaaagaattgctaaggatacccatggttatgttggtgctgatctagcagctctatgtactgaggccgcacttcaatgcattagagaaaagatggatgtgatcgacttggaagatgagacaatcgatgcggagatacttaattcaatggccgttacaaatgagcacttccaaacagctcttggtacaagcaatccatctgctctccgtgaaactgttgttgaagtgcccaatgtcagttgggaggatattggaggtctcgagaatntaagagggaacttcaagagactgttcaatacccagtggagcatcctgagaaatttgagaagtttggaatgtcaccatctaagggagttcttttctatggccctcctggatgtgggaaaacactgctggccaaagctattgctaatgaatgccaggcaaactttatcagtgtcaagggtcctgagttgcttacgatgtggtttggagagagtgaagccaatgtacgggaaatatttgacaaggcccgccaatctgctccttgtgttctattctttgatgaacttgactcaattgctactcagagaggtagcagcgtaggagatgctgggggtgctgctgatagggttttgaaccaactcttgacagaaatggatggcatgtctgcaaagaaaactgtattcatcattggggccaccaacagacctgatattatagatcctgcactcctgcgacctggtcgtctcgatcagttgatctacatccctctccccgatgaggagtcccgcttccagatatttaagtcttgcttgaggaaatctccagtttccaaagatgttgatctcagagctcttgccaagtatactcaaggctttagcggtgctgacattacagagatatgccagcgtgcatgcaaatatgccataagagagaacattgagaaagatattgagagggaaaggaggggaaaagagaatcctgaggcaatggaggaggatattgaggatgaagtggcagagatcaaggcagcccattttgaggaatcaatgaagtatgctcgaaggagtgtgagtgatgctgacattcgtaaataccaggcatttgctcaaacattgcagcaatcaagagggtttggaagtgagtttaggtttgccgataacccatctactggggctgctgcatctgaccctttcgcaacttctgctgctggtgcagacgatgatgacctttacagttagacttgccatggtgtcttatttattatatttgacattcctaccttacgttttcatttgtaatccagtacacgatgtggtttaagatattattgaattgcccttatccaaggaggaggccttagagtttagccatctgatgactactgcaaatttcaagaaacggttcattgatttgatagtttccaacttttactagct

SEQ ID NO: 5631 - DNA, 1292 bp, Citrus sinensis
  misc_feature (78)..(78): n is a, c, g, or t
  misc_feature (96)..(96): n is a, c, g, or t
  misc_feature (104)..(104): n is a, c, g, or t
  misc_feature (128)..(128): n is a, c, g, or t
  misc_feature (144)..(144): n is a, c, g, or t
  misc_feature (151)..(151): n is a, c, g, or t
  misc_feature (161)..(161): n is a, c, g, or t
  misc_feature (194)..(194): n is a, c, g, or t
  misc_feature (228)..(228): n is a, c, g, or t
  misc_feature (263)..(263): n is a, c, g, or t
  misc_feature (267)..(267): n is a, c, g, or t
  misc_feature (273)..(273): n is a, c, g, or t
  misc_feature (277)..(277): n is a, c, g, or t
  misc_feature (282)..(282): n is a, c, g, or t
  misc_feature (338)..(339): n is a, c, g, or t
  misc_feature (344)..(344): n is a, c, g, or t
  misc_feature (410)..(410): n is a, c, g, or t
  misc_feature (451)..(451): n is a, c, g, or t
  misc_feature (453)..(453): n is a, c, g, or t
  misc_feature (677)..(677): n is a, c, g, or t
  misc_feature (716)..(716): n is a, c, g, or t
agaatcacttccgtactccacttgggacaagcaacccctctgctctgcgtgaaactgttgtggaagttcccaatgtcngctgggaggacattggangccttganaatgttaagcgggagcttcaaganactgttcaatatccantggagcntccagagaantttgagaaatttggcatgtcaccttcgaaaggngtccttttctatggtccccctggatgtgggaaanctttactggccaaggcaattgcaaatgaatgccangcanacttcntcantgtcnaaggccctgagctgctcacaatgtggtttggtgagagtgaagccaatgttcgaganntattngacaaggcacgacaatctgccccatgtgttcttttctttgatgagctggactctattgcaactcanagaggaagcagtgtgggggatgcaggcggtgccgctgatcngnttttgaatcaacttctaactgaaatggatggcatgtcggctaaaaaaactgttttcattataggggcgacaaacagacctgacattattgaccctgcccttttgcggccaggtcgacttgaccagttaatttatattcctctcccagatgaggattcacgccaccagatctttaaagcctgtttgagaaagtcaccaatctcaaaagatgttgatctgagagcnttggccaagtatactcaaggcttcagtggggctgacatnacagagatttgccaacgagcttgcaagtatgccattagggaaaatatagaaaaggatatcgagagggagaggagaagaagggacaatcctgaggcaatggatgaggatgctgctgaggacgaagtggcagagattaaggctgctcatttcgaggagtccatgaagtttgctcgaaggagtgtcagtgatgctgatatccgcaaatatcaggcatttgctcagacgctgcagcagtcccgcggtattggatctgaatttaggtttgcagaggcaggaactggggctacgactggtgctgatccgttttcaacctctgctggtggggctgatgacgatgatctgtatagttagattttactttccttaaattaagagaccattctgtctttagcttttaccacatcaaactcagttctgactttgagctgggggtaggtttccgggccaatgttattgcttttcaaaatgttttaaagatattgttgttatttatcattaataacttgcaatgaaaattcagaagttcatcgggattttatgtttgaaaacctcgtgccgaattcggcacgaggcctc

SEQ ID NO: 5632 - DNA, 740 bp, Eucalyptus grandis
  misc_feature (209)..(209): n is a, c, g, or t
  misc_feature (397)..(397): n is a, c, g, or t
cggcgacatcaaatatttaaggcatgcttgaggaaatccccagtctccaaagatgttgatctgagagctcttgctaagtatacgcaaggatttagtggtgctgatatcacagaaatatgccagcgttcatgcaaatatgccatcagagaaaacattgagaaagatatcgagagagaaaggaggagaagtgagaatccagaagcaatggnggaggacgtcgaggatgaagtggcggaaatcaaagctgctcatttcgaggaatcgatgaagtatgctcgcaggagtgtgagtgatgctgatattaggaagtatcaagctttcgctcagacactccagcagtcgagagggtttggaagcgaatttcgatttgcagacgccggtgctggtgctggtgctngcactgcgggatcagatccattcgcagcttctgctggcggtgctgatgacgatgacctctatagttaaaaagatagtctgttcacgtttccctttgcatatcaaacctttctcccttcctgtttcactgtatactgttggaattgtctcgtgggaaggctttggcttcatggtgtccgacgtactcccgatcattatgaggtccccaaacttcccgtgtttctgacattctgaggtagtggccttccatttaaaattcttactttgtctcaatttatttgcgctgcattaagcatgagcagtggaattcagtcccggaaatggattgctcttgctgtccaaag

SEQ ID NO: 5633 - DNA, 1778 bp, Allium cepa
  misc_feature (297)..(297): n is a, c, g, or t
  misc_feature (307)..(307): n is a, c, g, or t
  misc_feature (313)..(313): n is a, c, g, or t
  misc_feature (315)..(315): n is a, c, g, or t
  misc_feature (330)..(330): n is a, c, g, or t
  misc_feature (333)..(333): n is a, c, g, or t
  misc_feature (351)..(351): n is a, c, g, or t
  misc_feature (393)..(393): n is a, c, g, or t
  misc_feature (498)..(498): n is a, c, g, or t
  misc_feature (501)..(501): n is a, c, g, or t
  misc_feature (507)..(507): n is a, c, g, or t
  misc_feature (516)..(516): n is a, c, g, or t
  misc_feature (522)..(522): n is a, c, g, or t
  misc_feature (534)..(534): n is a, c, g, or t
  misc_feature (550)..(550): n is a, c, g, or t
  misc_feature (552)..(552): n is a, c, g, or t
  misc_feature (555)..(555): n is a, c, g, or t
  misc_feature (558)..(558): n is a, c, g, or t
  misc_feature (567)..(567): n is a, c, g, or t
agaaattatgtctaagctagcgggggagagtgaaagtaacttgaggaaggcttttgaggaagcagagaagaatgcaccatctataatcttcatagacgagatagattctatagcacctaagagagagaagacaatggagaagtagagagacgcatcgtttctcagctcttgacattaatggatggtctgaaatcccgagctcatgttattgttatgggagcaactaataggcctaacagcattgaccctgctcttagaagatttggaaggtttgacagggaaattgatattggagtncctgatgaanttggangncttgaagtgcttcgnatncataccaaaaacatgaanctatctgaagatgttgatttggagagaattgctaaagatacncatggttatgtgggtgctgatttagctgcgctttgcactgaagctgcactccagtgcatcagggagaagatggatgttattgatctggaagatgattctattgangcngaaatnctcaactcnatggcngtcactgatgancactttaagactgctntnggnacnagcaatccntctgcactccgtgaaactgtggttgaagtgcctaatgttagctgggaagatatcggcgggcttgaaaatgtcaagagagaactgcaagagactgttcaatatccagtggagcatcctgagaagtttgagaaatttggaatgtctccttcaaaaggtgtattgttctatggtcctcctggttgtggaaagactttattggccaaagcaattgccaatgagtgtcaagcaaattttattagcataaagggacctgaattgcttacaatgtggtttggtgagagtgaagcaaatgtccgtgagatctttgataaggctcgtgggtctgcaccatgtgttcttttcttcgatgaactcgactccattgcaactcagagaggaagcagtgttggggatgcaggaggtgctggagatagagttctgaatcagcttcttacagaaatggatggaatgtccgcaaagaaaacagtcttcatcattggtgccacaaacaggcctgacatcattgacccagcattgctaaggcctggtcgtctcgaccagcttatttacatccccttacccgatgaggcttcacgtctgcaaatattcaaggcctgcctcagaaaatctcccattgcaaaggaggttgatttggtggctctagccaagtacactcaaggcttcagtggtgctgatatcactgaaatttgccagcgcgcttgcaagtatgcaatcagagaaaacatcgagaaggacttagaaagggagaaaagaagagaggcgaatccagaagcaatggaggaagacgaagaggatgaagtagcagaaataaaagccgttcactttgaagaatcaatgaaatatgcacgtaggagtgtgagcgatgcagacatccgcaaataccaagcatttgctcagacattgcaacagtcgagagggtttggaagtgaatttcgcttctctgagaggtcagaacccactgctgctgccactgctgcttcagatccattcagcacttctgctgcagctgctgcagatgatgatgatttatacagttgaaagttgtgatttgtatgcttgaaacttaatgtttatttatggatttaaatatatcacggatctatttcagacggtgggataagtacttaattattgtcgttccattacagtgaatactggttaattttagttcctgcttttggcaagattatatataagataatggctgtttt

SEQ ID NO: 5634 - DNA, 967 bp, Tragopogon dubius
tcggggtcttgaaaacgttaaacgcgagcttcaagagacggttcaatatccggttgagcatccggagaagtttgagaagtttgggatgtcgccatcgaagggggttttgttttatggaccaccagggtgtgggaagacgcttcttgcgaaggctatcgcgaatgaatgtcaggcaaattttataagtattaagggtcctgaattgcttactatgtggtttggtgagagcgaggcgaatgtgcgggaaatttttgataaggcgcgtgggtctgctccttgtgtcttgttttttgatgagcttgactccattgctacccagagaggaagtagtcaaggagatgctggaggtgcagcagatagagttctgaatcaacttcttaccgaaatggacgggatgtcagccaaaaagacagttttcataattggtgcaacaaacagacccgatatcatcgatcccgcacttttgaggcccggtcgactcgatcagttaatatacatcccactccctgatgaggaatcccgctatcagatcttcaaatcagctttaaggaagtctcctgttgccaaagatgtggacctcaaagcacttgctaaatacacccaaggcttcagtggcgctgacatcaccgaaatctgtcagcgtgcctgcaaatatgccattcgtgagaacatcgagaaggatattgagagggagaagagaagaagcgagaacccagaagccatggaagaagacgtggacgatgaggtggcggagatcaaggcggcgcattttgaagaatcaatgaagtttgcccgtagaagtgttagtgatgctgacataaggaagtaccaagcctttgctcagacactccaacagtcgagagggtttgggtctgaattcaggttttccgagacaagtgccgccacaaccgcagccacctccgacccttttgccgcccctgctggtgctgctgatgaagatgatctt

SEQ ID NO: 5635 - DNA, 2023 bp, Triticum aestivum
gcaccagacactgagatcttctgcgatggtgaacctgttaagagggaggacgaggagaggcttgacgatgttggctacgatgatgttggtggagtcaggaagcaaatggcccagatcagagaactggttgaactcccactgcgtcaccctcaacttttcaagtctatcggtgttaagcctccaaagggcatattgctgtttggaccacctggctccggcaagacccttattgccagggctgttgccaatgagacgggtgcattcttctttctgatcaatggcccagaaattatgtccaagttagcaggagaaagtgagagcaatctcaggaaggcatttgaagaagcagagaagaatgcaccatcaatcatcttcattgatgagattgattcaatagccccaaagagagagaagaccaatggagaagttgaaaggcgtattgtgtctcagctgttgacccttatggatgggcttaagtcccgtgcgcatgttattgttatgggtgctacaaaccgcccaaacagtattgatcctgctctcagaagatttggtaggtttgatcgtgagattgacattggagtccctgatgaagttggccgtcttgaagttctcaggatccacaccaaaaacatgaagttagctgaagatgttgaactggaacacatttcacgagacacccatgggtatgttggtgctgatcttgctgctctttgtactgaggctgctcttcagtgcattcgtgagaagatggatattatagatcttgaggatgagaccatagatgctgagatactgaattctatggctgtgacaaacgaccatttcaagaccgcactaacgacaagcaacccatctgctctccgtgaaactgttgttgaagttcccaatgtctcttgggaagatatcggtggtctggagaatgtcaagcgggaattgcaggagactgtccaataccctgtggagcatccagagaaattcgagaagtttggcatgtctccttccaaaggtgttctgttctatggtcctcctggctgtggtaaaaccttgttggccaaggcaattgcaaatgagtgccaggctaacttcatcagtatcaagggacctgagctgctgaccatgtggtttggtgagagcgaggctaatgtgcgtgagatctttgacaaggctagagggtcagcaccatgtgtcctcttctttgatgagcttgactctattgccacccagagaggaagcagcgtcggcgatgctggaggtgcagctgatagagtgctaaaccagctattgactgagatggatggcatgaacgccaagaaaactgtcttcatcattggtgctaccaacaggccagacatcatcgaccctgccctgcttaggccagggcgtcttgatcagcttatctacatccctcttcctgatgtcgagtcgaggcaccagatcttcaaagcttgcctcaggaagtctcctctggccaaggatattgatctgagtgctctggccaagtacacccaagggttcagcggtgctgatatcacagaaatttgccagcgtgcttgcaaatacgccatcagggagaacatcgagaaggacatcgagagggagaggcggaggaaggacaaccctgaagctatggaggaggatgaggtggatgaggtcgctgagatcagggctgctcactttgaggagtcgatgaagtatgcacgcaggagtgtgagcgatgcagacatccgcaagtaccaggcctttgcccagactctgcaacagtcccgtggattcggcagcgagttccggttccctgatcagccggccgcgggcgccgcctcttctgctgccgccgacccttttgcatccgctgccgcagcagctgaagatgacgacttatatagctaaattctcgttgttgtgccatcgacttacccgtgatttccttcgtatactgttatgttttgctctggtatgcaagacacggtcaaactatgtacttaaaattattattgggatgcactgatattcgttaaaaaaaaaa

SEQ ID NO: 5636 - DNA, 2025 bp, Triticum aestivum
gcaccagacactgagatcttctgcgatggtgagcctgttaagagggaggatgaggagaggcttgacgatgttggctacgatgatgttggtggagtcaggaagcaaatggcccagatcagagaactggttgaactcccactgcgtcaccctcaactttttaagtctatcggtgtgaagcctccaaagggcatattgctgtttggaccacctggctctggcaaaacccttattgcgagggctgttgccaatgagacgggtgcattcttctttctgatcaatggcccagaaattatgtccaagttagcaggagaaagtgagagcaatctcaggaaggcatttgaagaagcagagaagaatgcaccatcaatcatcttcattgatgagattgattcaatagccccaaagagagagaagaccaatggagaagttgaaaggcgtattgtgtctcagctgttgacccttatggatgggcttaagtcccgtgcgcatgttattgttatgggtgctacaaaccgcccaaacagtattgatcctgctctcagaagatttggtaggtttgatcgtgagattgacattggagtccctgatgaagttggccgccttgaagttctcaggattcacaccaaaaacatgaagttagctgaagatgttgagctggaacacatttcacgagacacccatgggtatgttggtgctgatcttgctgctctttgtactgaggctgctcttcagtgcattcgcgagaagatggatattatagatcttgaggatgagaccatagatgctgagatactgaattctatggctgtgacaaacgaccatttcaagactgcactaacgacaagcaacccatctgctctccgtgaaactgttgttgaagttcccaatgtctcttgggaagatattggtggtctggagaatgtcaagcgggagttgcaggagactgtccaataccctgtggagcatccagagaaattcgagaagtttggcatgtctccttccaaaggtgttcttttctatggccctcctggctgtggtaaaaccttgttggccaaggcaattgcaaatgagtgccaggcgaacttcatcagtatcaagggacctgagctgcttaccatgtggtttggtgagagtgaggctaatgtgcgtgagatctttgacaaggctagagggtcagcaccatgtgtcctcttctttgatgagcttgactctattgccacccagagaggaagcagtgttggggatgctggaggtgcagctgatagagtgctaaaccagctattgactgagatggatggcatgaacgccaagaaaactgtcttcatcattggtgctaccaacaggccagacatcatagaccctgccttgctgaggccagggcgtcttgatcagcttatctacatccctcttcctgatgtcgagtcgaggcaccagatcttcaaggcttgcctcaggaagtctcctttggccaaggatattgatctgagtgctctggccaagtacacccaagggttcagcggtgctgatatcacagaaatttgccagcgtgcttgcaaatacgccatcagggagaacatcgagaaggacatcgagagggagaggcggaggaaggacaaccctgaagctatggaggaggatgaggtggatgaggtcgctgagatcagggctgctcactttgaggagtcgatgaagtatgcacgcaggagtgtgagcgatgcagacatccgcaagtaccaggcctttgcccagactctgcaacagtcccgtggattcggcagcgagttccggttccctgatcagccggccgcgggcgccgcctctgctgctgccgcggacccttttgcatccgctgccgcagcagctgaagatgacgacttatatagctaaattctcgttgttgtgccatcgacttacccgtgatttccttcgtatactgttatgttttgctctggtatgcaagacacggtcaaactatgtacttaaaaaattattattgggatgcactgatattcgttaaaaaaaaaa

SEQ ID NO: 5637 - DNA, 1753 bp, Fagopyrum esculentum
tgacgaaattgattccattgctcctaagagagagaagacaaaatggtgaggttgagaggagaattgtctcccagctattgacactaatggatgggcttaagtcccgagctcatgtcattgttatgggtgccaccaatcgccccaacagcatcgaccctgctttgagaaggtttggaaggtttgacagggagatagatattggtgttccggatgaagttggaagacttgagattcttcgtattcacacgaagaacatgaagcttgctgaagatgttgatttggaaaagatctgcaaggagacacatgggtacgttggtgctgatttggctgctttgtgcactgaagctgcactgcagtgcatcagagagaagatggatgtcattgatctagaagatgacaccattgatgcagagatttgaactccatggcagtttctaatgaacacttctcgactgctttgggacaaagcaatccttctgctttgcgtgaaactgttgttgaagtgccaaagtttcatggaatgacatcggtggtcttgagaacgtcaagagagagcttcaagagaactgtacaatatcccgtggaacatcctgagaagttttgaaaagttcggaatgtctccctcgaagggtgttttgttttacggccctcctaggatgtggtaaaactctgcttgccaaggccatcgccaatgaatgtcaagcaaatttcatcagtatcaagggacctgaattgctcaccatgtggtttggagagagtgaagccaatgtcagagagattttgacaaggctcgtggatctgctccttgtgttttattctttgacgagcttgactcaattgccacacagagaggcagtagtcaaggtgatgcaggtggtgcagccgatagggttcttaatcaacttttgactgaaatggatggcatgtctgccaagaaaaccgtctttattattggtgccaccaacagacctgatattattgatcctgctctcctccgtcctggtcgtcttgaccagctaatctacatccctctccccgacgaggagtcccgtctacaaatcttcaaggccaacctaaggaagtctcctattgcaaaggatgtagatctcagagctcttgccaagtacacccagggcttcagtggtgctgatattaccgaaatctgtcagcgtgcttgcaaatatgctatcagagaaaacattgagaaggacattgagaaggagaagagaagaagtgaaaacccagaggcaatggaagaggacatggaggatgaagtgtctgaaatcagagctgcacatttcgaagagtcaatgaaatacgctcgtaggagtgtgagcgacgctgacattcgtaagtaccaggcttttgctcagacattgcagcaatcccgagggttcggtagtgagttccgattctctgaagctagcggagctgctggtggtgcagcagggtctcaaccttttgcagcctctgcaggtggagctgatgaagatgacctctacaattaattatgcttatggttagtctatgtgcacttgatttggttcacctggtcaagatatcgaaccattttctagcacttattctgttttcatttttaagaaacagttttcaatacttgccagaattatttttatggtttttacttgcccactgcacacaatgttccttcaattatgtcttatgtaacattgttggaggactaggacaaaggaaatctaaactgtatttgcttcctaatttatttctgttg

SEQ ID NO: 5638 - DNA, 676 bp, Platanus occidentalis
tgcactgctgaggcctggccgtcttgaccagttgatatacattcctctgccagatgagagctcccgccatcaaaatttacaaggcctgcctgaaaaaatcacctgttcgaaggacgtggatatccgggttcttgccaagcatactcaaggctttagtggagctgatattacagagatatgccaacgtgcttgcaagtatgccattagagagaacattgagaaagatatcgaaagggagaggaggagaaaggaaaatcccgaggcaatggaggaggatattgaagatgaagtggcagaaatcaaaccagctcactttgaggagtcaatgaagtatgcacgcaggagcgtgagtgacgccgatattcgcaagtaccaggcatttgcacagacattgcagcagtcgagggggttcgggagtgaattcaggttttcagaggctggagctgggactactgggtcggacccatttgcagcttcggctggtggagctgacgaagatgacctttacagttagtcatataatctggttatcctgaagttatcgttatttgttttggatattgtctttaaactttactattgtgatattttaaaggacttggagtcggggactcttgatcctattgacgattttcaagtacatgtagatcgaaaatcaagtaagatagtctttccg

SEQ ID NO: 5639 - DNA, 1074 bp, Musa acuminata
agaagttcgaaaaatttggcatgtcgccttcaaagggagtcctattctatgggcctcctggttgtgggaagactttgttggctaaggcaattgcaaatgagtgccaagcaaactttatcagtgtcaagggtccagaacttctcaccatgtggtttggtgagagtgaagcaaatgttcgagaaatctttgacaaggctcgtcagtctgcaccttgtgtcctcttttttgatgagctggattccatcgcaactcagagagggagtcatgttggagatgcagggggcgctgctgacagggttcttaatcagcttttgaccgagatggatggcatgactgccaagaaaactgtatttatcattggagcaactaataggcccgatatcatagatccagcactgctcaggcctggccgtctcgatcagttaatttatattcctctgcctgatgaagattctcgtttccagatttttaaagcttgcctgaggaagtcccctattgcaaaagacgtcgacctgagggctcttgctaagttcactcagggcttcagtggtgcagatatcacagaaatctgccagcgtgcttgtaaatatgcaatcagagagaatatcgaaaaggatatagaaagggagaggaggaggagtgagaatcctgaagctatggaggaggatgacgctgatgaagttgcagaaataaaagctgttcatttcgaggagtcgatgaagtttgccaggaggagtgtcagtgatgcagacatcaggaaataccaggcgttcgcacaaaccttgcaacaatccaggggtttcgggaccgagttccggtttgctgaacgagctgcaacgacaggatttgatccattcgccacccctgctgctggagctgatgacgatgatgatctatacagctagtgcatggaatgtgcattcaaatgctgtgatgctttttctgtggcaatttagtctactgctgcagttggtcgtttagtagttttgcatgaagctgtatgagatgtaagatggtcgatggacaggttatacttatctatgttaatatagttagctagaagaattatatagt

SEQ ID NO: 5640 - DNA, 732 bp, Mesembryanthemum crystallinum
ccggttggatttttttgatgagcttgattctattgccactcagaggggtggcagtagtggagatgctggtggtgctgctgacagagttttgaaccaacttctgactgaaatggatggcatgtctgccaagaaaacagtttttataattggagctacaaacaggcctgatattattgatgcagccctccttcgaccgggtcgtcttgaccaattgatttacatccctctgccagatgaggattctcgccatcaaattttcaaggctgccttgaggaagtctcctattgctaaagatgttgatcttagggtccttgccaagtacactcagggctttagtggtgcagatatcacagaaatatgccagcgcgcgtgcaagtacgctattcgagagaacattgagaaggacattgagaaggagaaaaggagagcggaaaatcccgaggcaatggaagaggatattgatgaagtggctgagataacagctgcacattttgaagagtcaatgaagtatgctcgtaggagtgtcagcgatgctgatattcgcaaatatcagtcatttgctcaaaccttgcagcagtccagagggtttggctccgagttccgttttgccaacagcacctcagggaccactaccggatctgatgcatttgctggccctggcgctggagctgatgaagacgatctctacaattgatgttctcgctactaataactttaaactatgaactatgt

SEQ ID NO: 5641 - DNA, 1814 bp, Cucumis melo
ggtgcatttttcttctgtatcaatggaccagagatcatgtcaaagttggctggtgaaagtgaaagcaacctcagaaaagcttttgaggaagcggagaaaaatgcaccgtccataatttttatcgatgaaattgattcaattgctcccaagcgtgagaagaccaatggggaagttgagcgaaggattgtctcacaactactgaccctcatggatggactgaagtctcgtgctcatgtcattgtgattggggctacaaatcgacccaacagcattgatccagctctgagaagatttggaagatttgatagggaaatagacattggtgttcctgatgaagttgggcgtctggaagttctacgaattcataccaaaaacatgaaactcgctgaagaagttgatttggagaggattgctaaagatacgcatgggtatgttggtgctgatctggcagctctctgtactgaggctgctcttcaatgtatcagagagaagatggatgtaattgatttggaagatgactctatagatgctgagatactcaattcaatggcagttacaaatgagcatttccagacagctcttggaaccagcaacccgtcagctcttcgtgaaacagttgttgaagtaccaaatgtttcatgggaggatattggaggtcttgagaatgtgaagagagagctccaagagacggttcaatatccagttgaacatcctgagaagtttgagaaatttgggatgtcgccctcaaaaggagttcttttctatggccctcctggatgtggaaagactcttctggcaaaggctattgcaaatgaatgtcaagcaaactttattagcgtcaagggcccagagttgctcacgatgtggtttggagagagtgaggccaatgttcgtgaaatctttgacaaggcccggcagtctgctccttgtgtcttgttctttgacgaacttgactcaattgctacacaaagaggtagtagcgttggggatgctggaggtgctgctgatcgtgtactgaaccaacttcttacggaaatggatggaatgtctgcaaagaaaactgttttcatcattggtgccaccaacagaccagacattatagatcctgctcttttacgacctggacgtctggatcagttgatttatattcctcttcctgatcaagaatctcgacttcagattttcaaggcttgcttgaggaaatctccaatctcaaaagatgtggaactcagagcccttgccaagtacactcaaggcttcagtggtgctgatattacagaaatttgtcagcgtgcctgcaaatatgcaattagagaaaacattgagaaggacattgagaaggagagaaggaaaagcgagaaccccgaagcaatggaggaggatgctgatgatgaagtggccgagatcagggccgctcactttgaggaatctatgaagtatgcccgaaggagtgtcagtgatgctgacatccgcaaataccaggcatttgcgcaaacacttcagcagtcaagagggtttggagccgagttcaggttcgagcagaactcagcaccagctgcatccgacccgtttgcaacttctgctggtggggctgatgaagatgatctctataactagtatggcatttagattccaaccccatttatgctttagacttggtagtatgatataacttcatatggatcgcttttttattggacagaatccagtttttatttgaatgtgattatcatttacaatcattcttgacacacaaaaggagtttcttttcacctaagctgcttataataataatataacatctttgttgggtt

SEQ ID NO: 5642 - DNA, 1172 bp, Solanum tuberosum
cttttctatggtcccccaggatgtgggaaaacctacttggcaaagcaattgcaaatgaatgtcaagccaattttatcagtgtcaaaggacctgaactgctcaccatgtggtttggagagagtgaggcgaatgttcgtgaaattttcgataaagcgagacaatctgcaccttgcgtcctcttctttgatgagcttgactctattgctactcagaggggaagcagcagtggagatgctggaggagcagctgatcgtgttttgaaccaacttctgactgaaatggatggcatgaatgcaaagaagactgtttttataattggggccacaaacaggcctgatataattgaccctgcacttcttcgacctggccgtcttgaccagttaatttatattcctctgccagatgaagattcacgccatcagattttcaaggcatgtctcagaaaatcccccttatcaaaggatattgatctgagagctctcgccaaacatactcagggatttagtggggctgatatcactgagatttgtcaacgagcctgcaaatatgccataagggagaacatagagaaagatatagaaagggagaagagaagacaggagaatcccgattcgatggatgaggatgttgatgaagtaccagagatcaagcctgctcattttgaggagtctatgaagtatgcacgccgaagtgtcagtgatgctgatatacgcaaataccaggcatttgctcagacattacagcagtctagaggttttggaacagaatttcggtttgcagaggctagtagcggcgggactgctgcagctgacccatttgcaacttctaatgctgcagccgatgatgatgacctatatagctgaagttctagtttttccttgttattttactgcaagtctcctacttcccgggttaaactcgaatatcggaacctagtacttgattctggatctcgggttttgactttttagaacgttaagataatttaaagttacagtttacacttacttatatcctggcgaatatttttttgaatttgatgcgcaggtttaaatagcctagttgtaacttgcatggtttcttgttcttccttgtgtgtacatttagtgggttcaaaaatcgaggcatttcatgttaacatgcatgaattgcaggcatttgagcggccgctc

SEQ ID NO: 5643 - DNA, 573 bp, Salvia sclarea
ctactagaccttggctgtcactcaatgtggacctcagagtccttgcaaaatacactcaaggtttcagtggtgctgacattactgaaatatgccaacgtgcttgcaaatacgctatcagagagaacattgaaaaagatattgagaaggagaggagaagaagtgacaatcctgaagctatggaggaagacgtggacgacgaagtagctgagatcagggcggctcactttgaggaatcaatgaagtatgctcggaggagtgtgagtgatgccgacattcgcaagtatcagtcatttgctcagacgctgcagcaatcaagaggatttggttctgaattccggtttgctgacaacactagtggtggcactactgcagccgatccttttgcagctcccgctgctgcagccgatgacgatgacctttatagttaggggcgtctctctctgcagagcatcgcatggttctcctctacattctagttatatgccagtttcccctaaaacggggatcttttgattcatggaattcacctgtattttatttaacttgtgataaatttatagataaatttattac

SEQ ID NO: 5644 - DNA, 1138 bp, Phalaenopsis aphrodite
aaaggggtaggttgttctacggtccgtcctggctgtggtaagactctgcttgctaaggccattgccaatgaatgccaagccaactttatcagtgtgaagggtccgtgagctgctcaccatgtggttcggtgagagcgaggcgaatgttcgcgagatttttgataaggctcgacagtctgcaccttgtgttctgttctttgatgagcttgactcaattgctactcagagagggagcagtgttggcgatgccggaggtgctgctgatagagtcctcaatcaacttctcacagagatggatggaatgtctgcgagaaaactgtcttcattatcggcgctacaaacaggcctgacatcattgaccctgcattgctccggccaggccgcctggaccagttgatttacattcctctaccagatgaggcttccagatatcagatatttaaagcttgtctcaggaaatcccccatctcaaaagaggttgatttgggggctctggctaagtacacccaaggcttcagcggcgcagatattacagaaatttgtcagcgcgcctgcaagtatgcaatccgagaaaatattgagaaggacattgagaaggagaggcgccgtaacgaaaacccagaagccatggaggaagacgaaggagatgaagttgcagaaatcaaagctggccactttgaggagtccatgaaatacgctcggcggagcgtgagtgatgccgacatccgcaagtaccaggcattcgccaaaacctgcagcagtcgagaggtttcggcagcgagttccggttttcagatcgcccaacggcgacggccggtgcggctggaggagctgatccattcgctacctctgccgctgctgatgaggatgacttgtatagttaaacttcatggcttcttaattgtgttgtagtgcttgaaaatgatagacatggtgtcaagtttcatttaatttcctaacattgtttcatgcgtctagttgttttgttttctacctaagatggttgttgtcttcttcctaaattgtttagggggagctaaaaggatttattaatagctttttaatgagtttagaagattttatcatgttaagcttgcttaagtggaagcattaaagtagtaccaaggtaaacgaaaaa

SEQ ID NO: 5645 - DNA, 1503 bp, Pteridium aquilinum
ttcacacaagaacatgaagctttctgatgatgttgatctggagaggattgccaaagatacgcatggatttgtgggagcagatttagcagcattgtgcacagaagctgccttgcaatgcattcgtgagaaaatggatgttattgatctcgaagatgagactattgatgcagaggttctaaattccatggctgtgaccaatgaacacttccagacagctcttggcatcagcaatccatcagccttgcgagaaactgtggttgaggtacccaatgtttcttgggaggatattggtggacttgataacattaaaagagagctgcaagagaccgtgcaatatccagttgagcatccagagaagtttgagaagtttggcatgtctccatcaaagggtgttttgttctatggacctcctggttgtgggaaaactttgcttgctaaagccattgcaaatgaatgccaagcaaactttattagtattaaaggtcccgagttacttaccatgtggtttggtgagagtgaggccaacgtacgtgatgtgtttgacaaggctcgacaatctgctccatgtgtgctattttttgacgaactcgactccattgcaacccagcgtggaagcagtgtaggagatgctggtggagctgcagacagggtcttgaatcagcttcttacagagatggatgggatgactgcgaagaagacagtttttattattggagctaccaataggcctgatattattgatccagctttacttcgccctgggcgtttggatcaactcatttacattcctctgccggatgagggatcacgcttgaagatatttcaagcttgcctcaggaagtctccagttgcgaaagatgttgatttgagtgctttggctcgatatacgcaagggttcagtggggctgatataacggagatttgccaacgtgcttgcaaatatgcaatcagagagaatattgaaaaggatattgagcgtgagaagagaagaagtgaaaatcccgaggccatggaagaggatgaagttgatgagattgccgagatcaaagcagcccattttgaggagtccatgaaatttgcacgcaggagtgttagcgatgctgatattcgcaagtaccaggcctttgcacagactctgcagcagtcgcgaggtttcggatcagagttccgctttccagaccgacctgctgctgctggtggcaatgctgctggtactgatgcctttgcgccagcagctgctgctgacgatgatgatttatacaactagacaaaaggcttttcctcgagggcgagtaaagtccactctaactagtctaaggctggattcctaaatcatgtatggattcgtccatgtgatttttcttcagagcagggtcgctaaaagttgagtctaatcatggttgtgggcttaaatttctccccctgtatcaaagttaatacttgtaactgcactttatttttgttttatgacaatttcagaaaggcggcatttttgtgctgtga

SEQ ID NO: 5646 - DNA, 1248 bp, Trifolium pratense
  misc_feature (919)..(919): n is a, c, g, or t
  misc_feature (1048)..(1048): n is a, c, g, or t
  misc_feature (1198)..(1198): n is a, c, g, or t
gtggtcttgaaaatgttaagagggaactccaagagactgttcaatatccagtggaacaccctgaaaagtttgagaagtttggaatgtctccttcaaagggagttcttttctatggtcctcctggctgtggtaaaacacttctggcaaaagctattgccaatgaatgccaggcaaacttcatcagtatcaaaggtcctgagctactcactatgtggtttggagaaagtgaggcaaatgtcagggaaatttttgacaaggctcgtggttctgcgccatgtgtcctgttctttgatgaactcgactccattgccactcagagaggtagtagtgtaggagatgctgggggtgctgctgacagggttttgaaccagctgctaacagaaatggatgggatgtcggcaaagaaaacagttttcatcattggcgccactaatcgaccggacattatagacccagctcttctgcgtccaggccgtctagaccagttgatttatatccccctcccagatgaagattcccgtcatcagatatttaaagcttgcttgagaaaatcccccatcgcaaaagatgttgatattagagctcttgcaaagtatacccaaggatttagcggtgctgatattactgagatttgccagcgtgcatgcaaatatgccataagagagaacattgagaaggacattgaaaaagagagaaagagaagcgagaaccctgaggccatggaagaggatgttgaagatgaagtagctgaaattaaggcagctcactttgaggaatcgatgaaatatgcaaggaggagtgtgagtgatgccgacattcgcaagtatcaagcatttgcccaaacattgcagcagtccagagggtttggaactgagtttaggtttgcagattctggaaccagtggtgctgccgctacagntgcatctgacccatttacatctgctggcggagctgatgacgacgatctctacagttaaacttgtatcagtggtgtcttatttatgacttgtgcttatgaagtccctaagacttcctttggataattatntcagtgcttcttaaaagataattatgtcagtgcttaaaagcatttgtttataggtgacggttaaggtgggcaagtcctctaattttttcatgatgggaaatgtgtttttacctctatagcatgtttaaaccggtttttacaaattggatnttttcccctaacaattagatatcaaagtatgtggccaaaattttgtcatt

SEQ ID NO: 5647 - DNA, 2056 bp, Coffea canephora
tcctgtcaggaagggtgacctcttccttgtaaggggaggaatgagaagcgtagaattcaaagtgattgaaactgaccccgctgagtattgtgtggttgcacctgatactgaaatcttttgtgagggagaaccagtgcgaagggaggatgaagatcggttggatgaggttggttatgatgatgttggaggagttcgtaaacagatggctcagattcgtgaactggtagagttgcctttgaggcacccacagctctttaaatcaattggtgtgaagcccccaaaaggaattctgctttatggtcctccgggatctggaaagaccttgatagcccgagctgtggctaatgaaactggtgctttcttcttctgcattaatggacctgagatcatgtcaaagctggcgggagaaagtgaaagcaatctcaggaaagcatttgaggaagccgagaagaatgccccatcaattatttttattgatgaaattgattctattgctcctaagcgtgagaagacgcatggagaagttgagagaagaattgtctctcagctcttgacgcttatggatgggcttaagtccagagcccacgttattgtcataggtgctactaaccgtcccaatagcattgatcctgccctgagaaggtttgggagatttgacagggaaatagacatcggtgttccagatgaagttgggcggcttgaggttcttcgcattcacacaaagaatatgaagcttgctgaagatgttgatttggaaagaattcccaaggacacccatggttatgttggtgctgatttagcagctttgtgtactgaggctgcactccaatgcatcagggagaaaatggatgtgattgacctggaagatgattctattgatgcggagatactccactccatggccgtcaccaatgagcacttccagactgcacttgggacaagcaacccttctgctctccgagaaactgtggttgaagttccaaatgtcagctgggatgatattggaggccttgagaatgttaaacgagagcttcaagagactgttcaatacccagtggagcatcctgagaagtttgagaaatttggaatgtccccctcaaagggagttcttttctacggcccaccaggttgtggcaaaactttgctagcaaaggctattgcaaacgagtgtcaagctaactttattagcgttaagggtcctgaattacttaccatgtggtttggagagagtgaggccaatgtcagagaaatttttgacaaggctcgccagtctgctccttgtgtactcttctttgatgaattggattcaattgctactcagagaggaagtagtgtaggagatgctggaggtgctgctgatagggttttgaatcagctgctaactgaaatggatggaatgaatgcaaagaaaactgttttcattattggtgccaccaacagacctgatataattgaccctgcacttttgaggcctggacgactcgatcagttgatttatatccctcttccagatgaagattctcgccatcagatattcaaggcgtgcctcagaaaatctcctgtttctaaagacgtagacttgagagctctagccaagtatacccaaggttttagtggagctgatattacagagatttgtcaacgtgcctgtaaatatgctatcagagagaatattgaaaaagatattgagagggagaggaggaggagagataatcctgaggcaatggaggaggacgtggatgatgaagttgctgaaatcaaggctgctcactttgaggaatccatgaagtttgctcgtaggagtgtcagtgatgcagacatacgtaaatatcaggcatttgctcaaaccttgcagcagtctagagggtttggtaccgaattccgattctctgagaccagtgcaggtgttacaggcgctgacccttttgcagcatcggctggtggggctgatgaagatgacctttatagttaggttgtcctagttaatttattctatgttgaatgtgatggtacttttgtacgttattgaatctcccctgtaaaatggcttaaaaaa

SEQ ID NO: 5648 - DNA, 790 bp, Carica papaya
gggcccagaactgctcacaatgtggtttggtgagagtgaagccaatgttcgagaaatatttgacaaggctcgtcaatctgcaccttgtgtccttttcttcgatgagcttgactccattgccacccagaggggaagcagcgttggagatgctggtggtgctgctgaccgtgttctgaaccaactccttactgaaatggatggcatgtcagcaaagaagactgtctttattattggagctaccaatagacctgacataattgatcctgcacttttgcggcctggtcgtcttgaccagttgatttatattcctcttccagatgaagaatcccgtcttcaaatcttcaaagcttgcttgagaaaatcacctgtctccaaagatgttgatttgagagcacttgctaagtatactcaaggcttcagtggtgcagatattacagagatatgccagcgagcatgcaagtatgccattagggagaacatagaaaaggatatagagaaggaaaaacggaggagcgaagatcctgaagcaatggatgaggatactgatgaggaagttgcagaaattagtgctgctcactttgaagagtcgatgaagtatgctcgcaggagtgtcagtgacgccgacataaggaagtaccaagcatttgctcagaccttgcagcagtctaggggttttggcacggaatttaggttttctgagacaggagcaggaaccactggatctgatccattctcaacttccgccgggggtgctgaagacgaagatttgtattaatagccaattatatgg

SEQ ID NO: 5649 - DNA, 1362 bp, Arachis hypogaea
tgcattagagagaagatggatgtcattgacttggaagatgaaactattgatgctgaaatactgaattctatggcagttacaaatgagcatttccagaccgctcttggaacgagcaacccatctgctttgcgtgaaactgttgttgaagtgcctaatgttagttgggaggacattggaggccttgagaatgtcaagcgtgagctgcaagagactgttcagtatcctgtggagcacccagaaaagtttgagaagtttggcatgtcaccatctaaaggagtcctcttctatggtcctccaggatgtggaaaaactttgttagccaaagcaattgctaatgaatgtcaagctaacttcatcagtgtgaaaggcccagaattacttacaatgtggtttggtgaaagtgaagccaatgttagagaaatttttgacaaggctagacagtcggctccgtgtgtcctcttcttcgatgagctcgactccattgccactcagagaggaagcagtgtggggatgctggtggtgctgctgacagagttttgaatcaacttctgactgaaatggatggcatgtcagccaaaaagaccgtgttcataattggggcaactaacagaccagacatcattgacccagcacttcttcggccaggccgtctggatcaattgatctatattcctcttcccgatgaggattcccgtcaccagatcttcaaggcctgcttgaggaagtcacctgtgtccaaagatgttgatttgagagcactggccagatatactcaaggattcagtggtgctgatattactgagatatgccagcgagcatgcaaatatgctattagagaaaacatcgaaaaggacatagaacgagagaggaggaaaagcgagaaccctgaggccatggacgaagatgtcgtcgacgacgaagttgcagagatcaaggctgctcattttgaagagtcaatgaagtttgcccgcaggagtgtcagcgacgcggatattcgcaaataccaggcatttgctcagaccttacagcagtcgaggggattcggaagtgagtttaggtttccagaaactgctgagaggactactggatctgatccctttgcaactgctgctggcgcagccgatgaagatgatctgtatagttagtcggttttataagctctgtattagtgtctctagactttccctttagtaacatcggagcctcctgtttattttgcttttaatatacttaaaatacacataaacataaattcagagctgatatgttactatgtttatattatggatggaatttttaagtttttagataataattgtgaatgtcatgcattcttgcatggtctcacaccggattctcaac

SEQ ID NO: 5650 - DNA, 744 bp, Linum usitatissimum
ccgtctagaccagctgatctacatcccacttcccgatgaggattctcgccaccagatcttcaaggccgccttgaggaaatccccacttgctaaagaggttgacttgagggcactcgcaaagtacactcaaggcttcagtggtgctgacatcaccgagatttgccagcgcgcctgcaagtacgccattcgtgagaacatcgagaaggacattgagaaggagaggaagaaggaagctaacccagaagcaatggaagaggacgaggaagacgaggttgcggagatcaaggctgcacatttcgaggaatccatgaagtacgctcgtcgcagtgtgagtgatgctgacatccgcaagtatcaggcttttgcccagactctgcagcagtccagaggcttcggttcagagttcaggttctcggaaaccggccccgccgcgacggcaggtgctgaccctttctcgactccggccggtggtgccgacgaagacgatttgtataattagtgtttgtacgtgacagatcgagcgagctatgaagtcaaactgtgtacctgagcttttttatctgtagttatttatgtcggatatcggatagtactggatttgaattgaagtttgttatctgtttcttgtcgccattgttgtgtttctggaattctatgaagccttgcattgttattgatgttttgaaccaaagctgctgcaccaagacatcagattctgttagtatatctttttgtttacctact

SEQ ID NO: 5651 - DNA, 2225 bp, Lippia dulcis
ggaaatctctttgatgcttacctgaagccatatttcctagaggcataccgtcctataaggaaaggtgacctgtttcttgttcgtggaggaatgcgaagtgttgagttcaaggttattgagactgatcctgctgagtactgtgtagttgcccctgatactgaaatcttctgtgagggagagcctattaaaagggaggatgaggatcgtttggatgaagttggttatgatgatgttggtggggtccgtaaacagatggctcagattcgggaattagttgagctgccattgaggcacccacagcttttcaaatcaattggtgttaagcctccgaaaggaattctgctttatggacctcctggatctggaaagaccttaattgccagagctgtggctaatgagactggagctttcttcttctgtattaatggaccggagatcatgtcaaaattggccggagaaagtgaaagcaatctcaggaaggcgtttgaagaggctgaaaagaatgcaccgtccatcatatttatagatgagatcgactcaattgctcccaagagagaaaaaaccaatggagaggttgagaggagaattgtttcccaactcttgacgttgatggatggactgaaagcccgtgcccatgtcattgtgattggtgctacaaaccgtcccaacagcattgatcctgccctgagaaggtttggtagattcgacagggaaatagacattggtgttcctgatgaggttggtcggcttgaggttcttcgtatccatacaaagaacatgaagctttctgatgaggttgatctggaaagaattgccaaagacacacatggatatgttggtgctgacttagctgctctgtgcactgaggctgccctgcaatgcatcagggagaagatggatgtgattgacttggaagatgataccatcgacgcagagatactaaactctatggctgttaccaacgagcatttccagactgctcttggaacaagcaacccctctgcccttcgtgaaactgttgttgaagtgcccaacgttagctgggaagatattgggggtcttgagaatgtcaaacgtgaactccaagagacggttcaatatccggtggagcatccagagaagttcgaaaagtttggcatgtcaccttccaagggagttctgttctacggtcctcctggatgtggaaagactttgcttgccaaggctattgccaatgaatgtcaggcaaactttatcagtgttaagggccctgaattgcttactatgtggtttggagaaagtgaagccaatgttagagaaattttcgacaaggctcgtcaatctgctccatgcgtcctattctttgatgaattggactccattgcaacccagagaggaggcagttcaggagatgctggtggtgctgctgaccgtgtattgaatcaacttctgacagaaatggacggcatgaacgccaagaaaactgttttcatcatcggtgccaccaataggcctgacattatcgattctgcgcttctccgtcctggtcgtctcgatcaattgatttacattcctcttcccgatgaggactcacgccatcagatctttaaggcctgcttgagaaaatcacctcttgccaaggaagttgaccttagagcacttgctaaatacactcaaggctttagtggtgccgacattacagaaatttgtcagcgtgcatgcaaatacgcaatccgagaaaacattgaaaaggatattgaaagggagaggaggagaagcgagaaccctgaggctatggaggaagatgttgaagatgaggtagctgagattaaggctgctcacttcgaagaatcaatgaagtatgctaggaggagtgtgagcgacgctgatattcgcaagtatcaggcatttgctcagacattgcagcaatcgagaggttttggttctgaattccgttttactgagaacagtagcgccaccactactgctgctggaactgaccctttcgccgctaccaccggtgccgctgacgacgatgacctctatagttaggtttcttgcctttgattggcacccatttatatcttttaatttatatatcatgttgttgcagtttgagaggaaggaagaaaccattgatgggattcatatgtattttgagtttatcttaagcttattgctctctggaaaagattatggcaacatatttataacattgtttcctttcttctctgatcaaaaaagaa

SEQ ID NO: 5652 - DNA, 822 bp, Elaeis guineensis
gtgatgagcttgattcgattgcaactcagaggggaagcagtgttggtgatgcaggtggtgctgctgacagggttcttaaccagcttcttacagagatggatggcatgagtgccaagaaaactgtattcattattggagcaactaacaggcctgacattatagatccagcattgcttaggccgggccgtcttgaccagttaatttatattccacttcctgatgaggcttctcgttaccaaatattcaaagcttgcctgaggaagtcaccggtgtccaaagatgttgacctgggggcccttgctaagtacactcatggattcagtggtgcagatattacagaaatttgccaacgtgcttgcaaatacgccattagagagaacattgagaaggacattgaaagggaaaggaggagaagcgaaaatcctgaagccatggaggaagatgaagctgatgaagtagcggagatcaaacctgctcacttcgaagagtcaatgaaatatgctcgcaggagtgtgagtgatgctgacattcggaaatatcaggcttttgcacagactttgcagcagtcaaggggatttggcagtgagttccgcttctcagaacgctcagaaactggagctggggctgctggatctgatccctttgcatctacagttgctggggccgatgatgatgatttatacaattagtttacgatcatgtgttgtaatactttgttctcgcatgatgatctggatatttttaggtggattttttttttgttaagttaatatctttaagactaagatagccttttggattctattttgatgattcttaatg

SEQ ID NO: 5653 - DNA, 873 bp, Cajanus cajan
ggggcagaaatggatgggatgccagctaagaaaactgtgtttatcattggggccactgatcgaccagatattatagatccagctcttctgcgtccaggtcgtcttgaccagttgatttatatccccctcccagatgaggattcccgtcatcaaatatttaaagcttgtttaagaaaatctccggtctcaaaagatgttgatcttagagctcttgcaaagtatactcagggctttagtggtgctgatatcactgagatttgccaacgtgcctgcaagtatgccattagagagaacattgagaaggacattgagagagaaaggaggagaagagataatcctgaagcaatggaagaggatgatgttgaagacgacgtagcagaaatcaaggcagctcattttgaggaatcaatgaaatatgctcgaaggagtgttagcgatgctgacattcgcaagtaccaggcatttgctcaaacgttacagcagtcaagagggtttggaagtgagttcaggtttgcagattccaactctggtggtggtggcggtactgctactgcatctgacccatttgcctctgctggtggagctgacgatgatgatctttataattaggttaatttgtatgcttgatatttattcgtaaatgccgtgctcttgtttatgtacttctcattttgaggtctgtctaaaaggcttcccttggattataattgacattcttcgcaaacggcatttgttcatatggccagagcctcttccaaagttgacattatttgagttttattgtattacttgaaagcttctgaagctttgatgctcaattctcaagtgtataacacttcatatgaacataattttacacacaaatttatgact

SEQ ID NO: 5654 - DNA, 588 bp, Capsicum annuum
gagctcttgcaaaatacacgcaagggttcagcggcgctgacattacagagatctgccaacgtacatgcaaatatgctattcgggagaacattgagaaagatatcgagagggagagaaggagaagggataatccggaagccatggaggaagacattgacgatgaggtatctgagatcaagccctctcactttgaggaatcgatgaagtacgctaggaggagtgtcagtgatgctgatatccgcaagtaccaggcgtttgctcagacgttacagcagtcccgaggctttggttttgagttccggttcgcggatgctagcacgggtgccaccaccggaactgctgccgatcccttcgcaacttttgctggtgatgcagatgaagatgatctctatagctagattgtcaaaacttattttcatgtcttatgtttactataattatttttgaagaaactttggaagttggtaaaattcagtatttccattcattgcccagagtttgtaatattattttgatctttatgagctttacataaaatattctgtagctacttattattttgttacacattaaagcctagattttatt

SEQ ID NO: 5655 - DNA, 939 bp, Linum usitatissimum
gcagtctgcaccttgtgtccttttctttgacgagctcgactccattgcaactcagagaggaggcagcagtggtgatgccggcggtgcagccgatcgtgtgctcaaccaacttctgaccgaaatggacggaatgtccgcaaagaagaccgtcttcataataggcgccacaaacagacctgacattatcgactcggcgcttctcaggccaggccgtcttgaccagctgatctacatccctctccctgacgaggattctcgccaccagatcttcaaggccgccttgaggaagtcgccccttgccaaggaggtcgacttgagggcactcgccaagtatactcaaggcttcagtggtgctgatatcaccgagatttgccagcgtgcctgcaagtacgctattcgcgagaacattgagaaggacatcgagaaggagaggaagaaggaagccaacccggaagcaatggaagaggacgaagaagacgaggttgcagagatcaaggccgcgcactttgaggagtcgatgaagtacgctcgtcgcagtgtcagcgatgccgacatccgcaagtaccaggcgttcgcccagactctgcagcagtccagagggttcggttcggagttcaggttctcgggaactggctccgctggcggtgcagcggcaacagcagccgaccctttctcgacttcggccggtggagccgacgaagacgatttgtataattagtgtttacgagacgaattgccctatgaaatcaaactgtgtactgagcttttatctgtagttatttaagtttgaatcggatagtactgaatttgaattgaactttgttttcgcactcttgtccgctttgaacttttatcgttaacgatttgcttcctttcgccattgttgtgttgcttctttaatctttctccaccctttggctattgaacatcaaattaatg

SEQ ID NO: 5656 - DNA, 1990 bp, Olea europaea
ctgatcctcctgagtactgtgttgtcgcccctgatactgagattttctgtgagggagagcctgtcagaagggaggatgaggatcggttggatgaggttggctatgatgatgttggtggtgtacgtaaacagatggctcagattcgggagttagtggagctgccactcaggcacccacagctttttaaatcaattggtgtcaagcctcctaaaggaatactgctttatggacctccaggatctgggaagaccttaatcgctcgagctgttgctaatgaaactggtgctttcttcttctgtattaatggacccgaaattatgtctaaattggctggagaaagtgaaagcaatctcagaaaagcattcgaggaagccgagaaaaatgcaccatcaattatatttatcgatgagattgattcaattgctcccaaaagagagaagaccaatggagaggttgagaggaggattgtttcccaactcttaacgctgatggatggactcaaatcccgtgctcatgttattgtaatgggtgccacaaatcgccctaatagcattgaccccgccttgagaaggtttgggagatttgatagggaaattgacattggtgttcctgatgaagttgggcgtcttgaagttcttcgtatacataccaagaacatgaagcttgctgaagatgttgatttggaaagaattgccaaagacacacatggttatgtcggtgctgatttggcagctctgtgcacagaggctgcccttcaatgcattagggagaagatggatgtcattgacttggaagacgacaccattgatgcagagatactcaactccatggcggttacaaatgagcacttccagactgctcttggaactagcaacccctctgctctacgtgaaacagttgttgaagtacccaatgttagttgggaagatatcggaggcctcgagaatattaaacgcgagctacaagagactgttcaatatccagtggagcatcctgagaagtttgagaagtttggcatgtcaccttcaaagggagttcttttctatggtcccccaggatgtggaaagactttgctggccaaggctattgccaatgagtgtcaggcaaacttcatcagtgtcaagggtcccgaattgctcactatgtggtttggagagagtgaggccaatgttagagaaatttttgacaaggctcgccaatctgctccttgtgtcttattctttgatgaattggattccattgctactcagagaggaagcagtgtaggagatgctgggggtgctgctgacagggtattgaatcagcttctaacagaaatggacggaatgaatgcgaagaaaactgtcttcattattggtgccaccaacaggcctgatataatcgaccctgcacttcttcgtcctggacgtcttgatcaattgatttacattcctcttcccgatgaggagtcacgccttcagatttttaaagtcttgcttgagaaaattcccctctttcctaaagatgtagacctgacagcccttgctaagtacactcagggtttcagtggtgctgacattactgaaatatgccaacgtgcagtcaaatatgctatcagagagaacatcgagaaagatattgagagggagaagagaagaagtgagaatcctgaggccatggaggaggatgtcgaagaagaagtggcagagattaaacctgctcattttgaagaatcaatgaagtttgcccggaggagtgtcagtgatgctgacattcgcaagtaccaggcatttgctcagacgttgcagcagtcaagagggttcggcactgaattccgatttgctgagaacaatgctggtgctactgggtccgacccttttgctgctcctgccggtgcagctgatgaagatgacctatatagttaggtcgtttatcaacttactctttccagcctatgttttattaatgtttgcagaaaaggattttattgtattaagctgttttaacgttg

SEQ ID NO: 5657 - DNA, 743 bp, Arachis hypogaea
cctcttcctgatgaggattcccgtcaccagatcttcaaggcctgcttgaggaagtcacctgtgtccaaagatgttgatttgagagcactggccagatatactcaaggattcagtggtgctgatattactgagatatgccagcgagcatgcaaatatgctattagagaaaacatcgaaaaggacatagaacgagagaggaggaaaagtgagaaccctgaggccatggacgaagatgtcgtagatgacgaagttgcagagatcaaggctgctcattttgaagagtcaatgaagtttgcccgcaggagtgtcagcgatgcagatattcgcaaataccaggcatttgctcagaccttacagcagtcgaggggattcggaagtgagtttaggtttccagaaactgctgagaggactactggatctgatccctttgcaactgctggtggcgcagctgatgaagatgatctatatagttagtcggttttataagctctgtattagtgtctctagactttccctttagtaacatcggaacctcctgtttattttacttttaatatacttaaaaatacacaaacataaattcagagatgatatgttacgatgtttatattatggatggaatttttagtttttagataataattgtgaatgtcatgcattcttgcatggtctcacaccggattctcaacaaccatgttgtgtgtttaaaacgttgaaagtataccttgaagtgaattgaattc

SEQ ID NO: 5658 - DNA, 1785 bp, Cirsium arvense
gaaaacagatggctcagattcgtgaattggttgaattgcccttaaggcaccctcagctttttaagtctattggagtgaagcccccaaagggtattttactctatggaccccctggttctggaaagacactcatagccagggccgtggccaatgaaacgggtgcgttcttttttctgcatcaatggaccagaaatcatgtctaaactggctggagagagtgagagcaatctcaggaaggcgtttgaggaggctgaaaagaatgccccttcaatcatttttattgatgagatagattcaattgctcccaagagagagaagaccaatggtgaagtcgagaggaggattgtctctcagctactgacgcttatggacggactaaaatctcgtgcccatgttatcgtaatgggggccacaaaccgcccaaacagtattgatcctgctctgagaaggtttggccggttcgatagggaaatagacattggcgtgcctgatgaagttgggcgtcttgaggttattcgcattcacaccaagaatatgaaactttctgatgatgttgacttggaaagaattgctaaagaaacacatggttatgttggtgctgatcttgctgctctttgcactgaagctgcacttcagtgcattagagagaaaatggatgtcattgacttggaagatgaatctattgatgctgaaatactgaattccatggcagtctcaaatgaacatttccagacagctctcggaacaagcaacccatctgctttgcgtgagactgttgtggaggttcccaatgtcagctgggaggatattggaggtcttgagaacgttaagcgtgagcttcaagagactgttcaatatccggtggagcatcctgagaaatttgagaagtttggcatgtctccctcaaaaggagttctcttctatggtcctcctggatgtgggaagacgcttcttgctaaggctattgcaaacgagtgtcaagccaacttcattagcatcaaaggacctgaattgcttaccatgtggtttggtgagagtgaagccaatgttcgtgaaatttttgacaaggccagggggtctgcaccatgtgtcctcttctttgatgaacttgattccattgcaactcagagaggaagcagttctggggatgccggtggtgctgctgatcgggttctgaatcagctattgactgaaatggatggaatgtctgccaaaaagaccgttttcattatcggagccaccaacagacctgacatcatcgaccctgcactactacgtccagggcgtcttgatcaactaatctacatccctctgccagatgaggactcccggcaccagattttcaaggctgcaatgaggaaatcccctgtttccaaagatgtcgatttgagagctctggccaaatatacccaaggatttagcggggccgatatcacagagatatgccaacgtgcgtgcaagtacgccataagagagaacattgagaaagacatagagaaggaaagaaagagaagtgagaatccggactcgatggatgaggacgaggatgaggtggcggagatcaaggctgctcactttgaggaatccatgaagtatgcgcgtagaagtgtgagtgatgcggatattcgcaagtaccaggcatttgctcagacattgcagcagtcccgaggattcgggtccgaatttcgtttccctgaagctgcatccgggggtgctgccgctgcctctgacccgtttgccgcctctgctggtggagcggatgatgacgacttatacagctagatt

SEQ ID NO: 5659 - DNA, 1735 bp, Humulus lupulus
tttgaggaagcagagaagaatgccccatcaattatttttattgatgagattgattcaatagctccaaagcgagagaagacacatggagaagttgagaggaggattgtttcccagctactgacactcatggatggactgaaatctcgtgcacatgtcattgttatgggtgctacaaatcgtcccaacagtattgacccagcccttagaaggtttggcagatttgatagggaaatagatattggtgttcctgatgaaattggtcgtcttgaggtccttcgtattcatacaaagaacatgaagcttgctgaagatgtggatttggaaagaatttctaaggacacacatggttacgttggtgctgatcttgctgctctgtgtactgaggctgcacttcagtgcattagggagaagatggatgttattgacttagaggatgagtcaatagatgctgagatactgaactcaatggctgttacaaatgagcactttgctactgctcttggaacaagcaatccatctgccctccgtgagacggttgttgaggtgcccaatgttagttgggaggatataggaggtcttgagaatgtcaagagggaacttcaagagactgtacagtaccctgtggagcatcctgagaaattcgagaagtttggtatgtcgccttctaagggagttcttttctatggtcctcctggatgtggaaagacccttcttgccaaagccattgccaatgagtgtcaggccaactttatcagtgtcaagggtcctgagttgcttacaatgtggtttggagagagtgaggctaatgtaagggaaatttttgacaaggccagaggatctgcaccatgtgttctgttctttgatgaacttgactcaattgctactcagagaggtagcagtgtaggagatgctggtggtgctgctgatagagttttgaaccagcttcttactgaaatggatggtatgtctgccaagaagactgttttcattattggggccaccaacagaccagacattatagaccctgctcttctacgtccaggccgtcttgatcagctgatttatattcctcttccagatgaggaatctcgttttcaaatcttcaagtcctgccttaggaagtcaccagtcgccaaagatgttgacctcagtgcccttgccaagtacactcaaggatttagtggtgcagatatcactgaaatctgccagcgtgcctgcaaatatgccatcagagagaacatcgagaaagatattgagagggagaggagaagaaaggataaccctgaggcgatggaagaggatgtggatgatgaagtagcggagatcaaggcagctcactttgaggaatcaatgaagtatgctcggcggagtgtcagtgatgctgatatccgcaaataccaggcatttgctcaaacattgcagcagtcgagagggtttggaaccgaattcaggttcccagagtctggctctgcagcagcaggatctgacccttttgcaaccactgccggtgcggctgatgaagatgacctttacaattaggcttatctttgataggttgtcctatttatttttgcaaatggattgtacttttgtttcttcaccaccgactatgtgctgaagattcattggattgggatctatgttgtgccaggggatagctcctggatgctctctgacttagtttacaaacattttacttctataattacattgattactgcaaaaactcttgagg

SEQ ID NO: 5660 - DNA, 883 bp, Platanus occidentalis
ttctgtaggagatgctggtggtgctgcagatagggttttgtaaccaactcttgacagagatggatgggatgactgcgaagaagacagttttcatcatcggggcaacgaacaggccggacattattgatccagcacttctcaggcctggtcgtcttgaccagttgatttatataccactgccagatgaggcttctcgtcttcaaatcttcaaagcatgcttgcgaaaatcacctgtctctcgggatgtggacctttcagctcttgcacggtacactcatggttttagcggtgcagatattactgaaatctgtcagcgtgcctgcaaatatgcaatcagagaaaatattgagaaggatattgagagggagaagaagaggagtgaaaaccctgaggcaatggaagaagatgatgtagatgaagtgcctgaaattaaggcggcgcactttgaagagtccatgaaatttgctcgccgaagtgtcagcgatgctgatatcaggaaataccagctctttgctcagactctgcagcaatcccgtggatttggatcagagttccggttcccagatcgacctgataatgctacaggcacaggggcttcagatccattctcttctgccgcagctgctggagatgacgatgacctgtatagttaagtgaaaagcaatctccagttacaggtgctgtcatcaacttgtggaaatgatgactgctccagtcctgtttctgttcatagtaccaaagacgttttctagccaagcttgcaaactcaccctagtgcaatttgttttgcgctgagcatttagtaacttaaaaggcttaaaatttcatacgactttgttgaaatgaaagtgtttagctaattatgtttgagtgtggatttgaa

SEQ ID NO: 5661 - DNA, 969 bp, Sarracenia psittacina
gggagtgctaccacgagaggaaacgaaggaccgtgggggaggtaggcgtggcggtgctgctgacagggttgtaatcagctcttactgaatggatggaatgtctgcaagaaaactgttttcattattggcgccacaaacagacccgatataattgaccctgcactttgcgacctggccgccttgatcaattaatttatatccctctgcctgacgaggagtctcgccatcagattttcaaatcctgtttgagaaaatctcctgtttcaaaagatgttgacctaatggcccttgctaagtacactcaaggcttcagcggtgctgatattacagaaatatgccaacgtgcatgcaaatatgccataagagagaatattgagaaagacaatgagaaggaaggaggaggagagagaaccccgaggctatggaggaggacatggaagacgaggtggcagagataaaggctgcccattttgaggaatcaatgaagtatgctcgaaggagtgtgagcgatgctgacattcggaagtaccaggcatttgctcaaacactgcagcagtcaagagggtttgggaccgaattccgattttcggagacaacgagtgcgggggccactggatctgacccatttgcagcctctgcaggtggggctgatgaagatgacctgtatagttaggttcatctttgttccgtttgtttgtcttcttttatctgttaaaacatttcttactatttatatatttatgttaaaacatgtccttgttcatggtgtgagctcactatgcaacgatgcccaagtcgcggtttggtcagccctgtctccaccttgaagtttcaaaacagttgttactctgatgataacaatggatgtgttttggaactcccatggaattaagtttcagctaatttgaactcatttttcttagttttcaatgattgcaactcgccgaacttgatgacttggtcttggca

SEQ ID NO: 5662 - DNA, 2264 bp, Centaurea maculosa
  misc_feature (619)..(619): n is a, c, g, or t
  misc_feature (637)..(637): n is a, c, g, or t
  misc_feature (742)..(742): n is a, c, g, or t
  misc_feature (796)..(796): n is a, c, g, or t
  misc_feature (1069)..(1069): n is a, c, g, or t
  misc_feature (1081)..(1081): n is a, c, g, or t
  misc_feature (1084)..(1084): n is a, c, g, or t
  misc_feature (1648)..(1648): n is a, c, g, or t
  misc_feature (1891)..(1891): n is a, c, g, or t
  misc_feature (1966)..(1966): n is a, c, g, or t
  misc_feature (1993)..(1993): n is a, c, g, or t
caggttattcgaacaacctgagggttcggctcggagatgttgtatctgtgcaccagtgcccagatgtgaagtatgggaagcgtattcatgttcttcctctagatgacacgattgaaggtgtcactggggacttgtttgatgcatacctgaaaccctacttcttggaggcatatagacccgtgaggaagggggatcattttcttgttagaggagggatgagaagtgtagagttcaaggtaattgagactgacccaagggagtactgtgttgttgctcccgacactgaaatcttttgtgaaggtgagcccatcaagagagatgatgaagataggttggatgagattggttatgatgatgttggtggtgttagaaaacagatggctcagattcgtgaattggttgaattgcccttaaggcaccctcagctttttaaatctattggagtgaagcccccaaagggtattttactctatggaccccctggttctggaaagacactcatagccagggccgtggccaatgaaacgggtgcgttctttttctgcatcatggaccagaaatcatgtctaaactggctggagagagtgagagcaatctcaggaaggcgtttgaggaggcngaaaagaatgccccttcnatcatttttattgatgagatagattcaattgctcccaagagagagaagaccaatggtgaagttgagaggaggattgtctctcagctactgacgcttatggacggnttaaaatctcgtgcccatgttatcgtaatgggggccacaaaccgcccaaacagnattgatcctgctctgagaaggtttggccggttcgatagggaaatagacattggcgtgcctgatgaagttgggcgtcttgaggttattcgcattcacaccaagaatatgaaactttctgatgatgttgacttggaaagaattgctaaagaaacacatggttatgttggtgctgatcttgctgctctttgcactgaagctgcacttcaatgcattagagagaaaatggatgtcattgacttggaagatgaatctattgatgctgaaatactgaantccatggcagtntcnaatgaacatttccagacagctctcggaacaagcaacccatctgctttgcgtgagactgttgtggaggttcccaatgtcagctgggaggatattggaggtcttgagaacgttaagcgtgagcttcaagagactgttcaatatcctgtggagcatccggagaaatttgagaagtttggcatgtctccctcaaaaggagttctcttctatggtcctcctggatgtgggaagacacttcttgctaaggctattgcaaatgagtgtcaagccaacttcattagcatcaaaggacctgaattgcttaccatgtggtttggtgagagtgaagccaatgttcgtgaaatttttgacaaggccagggggtctgcaccatgtgttctcttctttgatgaacttgattccattgcaactcagagaggaagcagttctggggatgccggtggtgctgctgatcgggttctgaatcagctattgactgaaatggatggaatgtctgccaaaaagaccgttttcattatcggagccaccaacagacctgacatcatcgaccctgcactactacgtccngggcgtcttgatcaactaatctacatccctctgccagatgaggactcccgacaccagattttcaaggctgcaatgaggaaatcccctgtttccaaagatgtcgatttgagagctctggccaaatatacccaaggatttagcggggccgatatcacagagatatgccagcgtgcgtgcaagtacgccataagagagaacattgagaaagacatagagaaggaaagaaagagaagtgagaatccngactcgatggatgaggacgaggatgaggtggcggagatcaaggctgctcactttgaggaatccatgaagtatgcncgtagaagtgtgagtgatgcggatatncgcaagtaccaggcgttcgctcagacattgcagcagtctcgagggttcgggtccgaattccgtttcccggaagctgcatccgggggtgctgccgctgcctctgacccgtttgccgcctctgctggtggagcggacgacgacgacttatacagctagattcttgtattaagccatgagactcgtgatcgtgtcgagaaatgatgtgcgattatatcgtatttcagtcgtctgtctttcactgctctcttttaacgtcgtatttttgtttgac

SEQ ID NO: 5663 - DNA, 1718 bp, Cichorium intybus
tttctttttctgcattaatggaccagaaatcatgtcaaaattggctggagaaagtgagagtaatcttagaaaggcatttgaagaggctgaaaagaacgccccttcgattattttcattgatgaaatcgactctattgcccctaaaagagaaaagactaacggtgaagttgaaaggaggattgtttcacaattgttgacacttatggatggattaaaatcgcgtgctcatgttattgtaatgggggccacaaatcgcccaaatagcattgaccctgctttgagaagatttgggagatttgatagggaaattgacattggtgtccctgatgaagttgggcgccttgaagttatccgtatccacaccaagaacatgaaactttctgatgatgttgatttggagaagatagctaaagaaacacatgggtatgttggtgctgacctggcggctctttgtactgaagctgcacttcaatgcattagagaaaaaatggatgttattgatttggaagatgattctattgatgctgagattcttaattccatggcagtttcaaatgaacatttccagactgctcttggaacaagcaacccatctgctttacgtgagactgttgtggaagttcccaatgttagctgggaggatattggaggtcttgagaatgttaagcgtgagcttcaagagacggtccaatatcccgtggaacacccggaaaaattcgagaaattcgggatgtcaccatcaaaaggagttctcttctacggcccacctggatgtggaaagacgcttttagccaaagccattgctaacgaatgccaagccaacttcattagtatcaaaggacccgaattactcacaatgtggttcggtgaaagtgaagccaatgtccgtgaaattttcgacaaagccagaggatccgcgccatgtgtcctcttcttcgatgaactcgattccatcgcaactcagaggggaagcagttccggggacgcgggtggtgcagctgaccgtgtactcaaccaacttctaaccgaaatggacggaatgtcggccaaaaagacggttttcataatcggggcaacaaacagaccggacattatcgaccccgcgttactccgtccagggcgtctcgatcaactaatctacattccgctaccggatgaggattcccgccaccagattttcaaggcggcaatgcggaaatccccggtttctaaagacgttgacttacgtgcactggccaaatacacacaaggcttcagtggcgctgacatcaccgaaatttgccagcgcgcttgcaagtatgcaatccgtgagaacatcgagaaagatatagagaaggaaaggaagaggagtgagaatccggattcgatggatgaagatgaagatgaggtggcggagattaaggcggcgcattttgaggagtcgatgaagtatgcgaggagaagtgtgagtgatgcggatattagaaagtatcaagcgtttgctcagacgttgcagcagtcgagagggtttgggtccgagtttcggttcccggaagcggctggggcggcggcttctggtggtgcttctgatccgtttgcagcggctgctggtggtggtgatgatgatgacttatacagttaggattttataaagtaggtgtgacactcacgttttatttcggttgttggttcgctgttctgttttggaccttttgttatggatggttgtcgaaacttgt

SEQ ID NO: 5664 - DNA, 1309 bp, Cynara scolymus
tgaattcatggcagtctcaaatgaacatttccagactgctcttggaacaagcaacccatctgctttgcgtgagactgttgtggaggttcctaatgtcagctgggaggatattggaggtcttgagaatgtcaagcgtgagcttcaagagactgttcaatatcctgtggagcatccggagaaatttgagaaatttggcatgtctccctcaaaaggagttcttttctatggtcctcctggatgtgggaagacacttctagctaaggctattcaatgagtgtcaagccaacttcattagcatcaaaggacctgaattgcttacaatgtggtttggtgagagtgaagccaatgttcgtgaaatttttgacaaggccaggggatctgcgccatgtgtcctcttctttgatgaacttgattccattgcaactcagaggggaagcagttctggggatgcaggtggtgctgctgatcgggttctgaatcaattattgactgaaatggacggaatgtctgccaaaaagaccgttttcattattggagccaccaatagacctgacatcattgaccctgcattactacgtccagggcgtcttgatcaactaatctatatccctctgccagatgaggactcccggcaccagattttcaaggctgcaatgaggaaatcccctgtttccaaagatgttgatttgagagctctggccaaatatacacaaggatttagtggagctgatatcacagagatatgccagcgtgcctgcaagtacgcaataagagagaacattgagaaagacatagagaaggaaagaaagagaagcgagaatcccgactgtatggatgaggacgaggatgaggtggcggagatcaaggctgctcactttgaggaatccatgaagtatgcccgtagaagtgtgagtgacgccgatattcgcaaataccaagcatttgctcagacattgcagcagtctcgtggatttgggtctgaattccgtttcccagaagctgcatccgggggtgctgccgctgcttcccgacccgtttgccgcctctgctggtggagcagacgatgacgacttatacagctagatttttcataaatcttgttacaagtcaagagaccgatgatcatgtcaagaatgtgcgattatatcgtatttcagttgtttattcagtgctctcttttaaaatattttgttgacacttatgttgtcgaaacttgtgctacacttcacaattgaaacttgggggttcggcatggttcatcactacttttccctttttcaagttatattatatcatcagtactttctct

SEQ ID NO: 5665 - DNA, 842 bp, Solanum melongena
tcggagatgctggaggagcagctgatcgtgttctgaaccaacttctgactgaaatggatggcatgaatgcaaagaagaccgtttttataattggggccacaaacaggcctgatataattgaccctgcacttctgcgacctggccgtcttgaccagttaatttatattcctttgccggatgaagattcacgctatcagattttcaaggcatgtctcagaaaatctcccttatcaaaggatattgatttgagggctcttgctaaacatactcagggatttagtggggccgatatcactgagatttgtcaacgagcttgcaaatatgccatcagggagaacatagagaaagatatagaaagggaaaagagaagacaggagaatcccgattcaatggacgaggatgttgatgaagtaccagagatcaagcccgctcattttgaggagtctatgaagtatgcacgccgaagtgtcagtgatgctgatatacgcaaataccaggcatttgctcagacattacagcagtctagaggttttggaacagagtttcggtttgcagaggctagtggtggtgggactgctgcagctgacccattcacaacttctactgctgcagccgatgacgatgatctatatagctgaagttcttgattttctgttattttgtttcaagtctcctgcttctcgggttaaacttgaatatccggaactacttcttgattctggatcttggggctagttcgtttaacttctggtagcccaatacaatttacccttaatatctggagttgcttactgtttatgacactttttagaaccttaagataatttaatgttacaatttac

SEQ ID NO: 5666 - DNA, 892 bp, Ipomoea nil
atcagcgccatgtgttctcttctttgatgagcttgactcgattgccactcagaggggaagcagcgtcggggatgctggtggtgcagctgatcgggttcttaaccaacttctaactgaaatggatggcatgactgcaaaaaagactgttttcataattggggctacaaacagacctgacataattgaccctgcactccttcgtcctggcagacttgatcaattaatttatatccctctccctgatgaggattcacgccaccagattttcaaggcttgccttagaaaatctcctctttcaaaagatattgatctgcgagctcttgcaaaatacactcatggatttagtggagctgatattacagaaatctgccagcgagcctgcaaatatgccattagggagaacattgagaaagatatagagagggagaagaggagaagtgagaatcctgattccatggatgaggatgttgaggatgaaatatcggagattaagcctgcacattttgaggagtccatgaagtatgctcgtcgcagcgttagtgatgctgatatacgcaagtaccaggcatttgctcagacgttgcagcagtctcgaggctttggaaccgagttccgctttgctgagtcaggatccggcggtgcttccggagctgacccgtttgcgacatccactgctggagccgatgaagatgacttgtatagttaagacatgttagaatgtcctcctacccttgttatttttttgcaatgacacttctgcttcattcattgctcccatgactactgattaactgttctttattgggcttcggatattgacacttcgacagggttgtgtctggtcaacttcgtttctactgttctcaatattttcagtttaagacctgataat

SEQ ID NO: 5667 - DNA, 1759 bp, Pennisetum glaucum
gagattgattccatagcacctaagagggagaagacccatggagaagttgagaggcgtattgtttcacagcttttgactctcatggatggcctcaagtctcgtgcacatgttattgttatgggtgccacaaaccgtccaaacagtattgatcctgctcttagaaggtttggtaggtttgaccgtgagattgatattggtgttcctgatgaagttgggcgtcttgaggttctccggattcataccaaaaacatgaagctctctgaagatgttgagttggagcacattgcaaaggatactcatggttatgttggtgctgatcttgctgccctttgcactgaggcagctcttcagtgcattcgtgagaagatggatattatagatcttgaggatgagaccatagatgctgagatactcaactctatggctgtctcaaatgatcatttcaagactgcacttgggacaagcaacccgtctgctctgcgtgaaaccgttgttgaagttccaaatgtctcttgggaggatattggtggcctggagaatgtcaagagggagctccaagagactgttcaatatccagtggagcatccagagaaattcgagaagtttggcatgtctccctcaaagggtgttctgttttacggccctcctggctgtggaaagactttgttggccaaggcgattgctaatgaatgccaggctaacttcatcagtgtgaagggacctgagctgcttaccatgtggtttggtgagagtgaggccaatgtccgtgagatatttgacaaggctaggcagtctgctccttgtgtcctcttcttcgacgagcttgactccattgctactcagagaggaagcagtgttggtgatgctggaggtgctgctgatagagtgttgaaccagctgctgactgagatggacggcatgaatgccaagaagactgttttcattatcggtgccaccaacagaccagacatcattgaccctgctttgctgaggccagggcgtctggatcagcttatctacattcctctgcctgatgaccagtccaggctccagatcttcaaagcctgcctcaggaagtctcccgtggctaaggatgttgatttgaacgcccttgccaaatacacccagggattcagcggtgcagatatcactgagatctgccagcgggcgtgcaagtatgccatcagggagaacatcgagaaggatatcgagatggagaggcgtaggagggacaaccctgaggcaatggaggaagacgaggtggatgaaattgctgagatcagggctgttcacttcgaggagtcgatgaagtatgcgcgccggagcgtgagcgacgccgacatccgcaagtaccaagccttcgcccagaccctccagcagtctcgcggattcggcagcgagttccggttcccccaccaacctgcggcagcagcggccgaccccttcgcagcccctgcggctgcagctgacgatgatgacctatacagttagattagcagttctgctgtggcttaacttatatatatctgcttatatggtatgctgaacttatcgtgtggagaggatgtacttgcttttaagttaatgtatttggctagattacctaaatcgtgagattacctaaatcgtgtcatctacttgaatgcttgcctggtgcagagctgcgtctgttttattttgagatgaattacacctttgtggaggaggacggaggcctagaggagctcctcggctagactgctagagttttcggggaggg

SEQ ID NO: 5668 - DNA, 858 bp, Fagopyrum esculentum
tcaactgttgactgagatggatggaatgtcagcaaagaagaccgttttcatcattggtgcaactaataggcctgatattattgatcctgcccttctacgtcctggtcgtctagatcagctgatttatattcctctccctgatgaggagtcccgcttccaaatctttaaggccaacctgaggaagtcccctattgccaaggatgttgacatcagagctcttgccaagtatactcagggattcagtggtgctgatatcactgagatatgtcaacgggcctgcaagtatgctataagggaaaacattgagaaggacatagagaaggagcggaagaagagggataaccccgatttgatggaggaggacgatgatgacgaagtggcagagataaaggcggcacattttgaggagtcgatgaaatacgcccgaaggagtgtaagtgacgctgacatccgcaagtaccaggcatttgctcagactctacagcagtcgagaggatttggcagtgaattccgctttgcggatgcaagtggtggggctgctgccagcggaggtgtatcccagccattcagctctgctgcaggggcagccgatgaagatgacctctacaactgaaaacacttgcccacgatggcaattactttgttttattcccaagttaacaatacagttgtatgtagtttgcatcaagtactggggcttcgtgggaagggaatgcgtttggttgggtgacttgtggagaagcgtgtgttttgcttttggtactgtgtatgacacatgactacgcatggatgcaagttggtatggactgtgaaaatgtctctcgaagcctttttcttattctaaataagtttctttaa

SEQ ID NO: 5669 - DNA, 1055 bp, Olea europaea
ccaagagactgttcaatatccagtggagcatcctgagaagtttgagaagtttggcatgtcaccttcaaagggagtcttttctacggccccccgggatgtggaaaaactttgctagctaaggcaatagccaatgagtgtcaggccaacttcatcagtgtcaagggtcctgaattgctcactatgtggtttggagagagtgaggccaatgttcgagaaatttttgacaaggctcgccaatctgccccgtgtgtcctattctttgatgaattggactcgattgctactcagagaggaagcagtgtaggagatgctgggggtgctgctgacagggtattgaatcaacttttaacggaaatggatggaatgaacgcaaagaaaacagtgttcattattggtgccaccaataggcctgatataattgatcctgcacttcttcgtcctggacggcttgatcaattgatttatattcctctccctgatgaggagtcacgccttcagatttttaaggcttgcttgagaaaatctccactttccaaagatgtagacctgacagccctggctaaatacactcaaggtttcagtggtgctgacattacagaaatatgccaacgtgcagtcaaatatgccataagagagaacatcgaaaaagatattgagagggagaagagaagaagtgagaatcccgaggccatggaggaggatgttgaagatgaagtagctgagattacacctttcatttgaggaatcaatgaagtatgcacggaggagtgtcagtgatgctgacattcgcaagtacctggcatttgcccagacgttgcagcagtcaagagggttcgggactgaatttcgatttgctgaaacgagtgctggtgctactgggtctgacccttttgctgctgctgccggtgcagctgatgaagatgacctatatagttaggttgttcatgtacttcttcgagctatgatgctcgtttcatactttatggtatatgttatgtatcacttacagaagcattatcagattcagctagaaatttattacttctctaaaatta

SEQ ID NO: 5670 - DNA, 651 bp, Capsicum annuum
aatcacctctttctaaggatatcgatctaagagctctagctaagtttacaccgggctttagtggagctgacattacagaaatctgtcaacgtgcttgcaaatacgctatcagagaaaacattgagaaagatattgagagggagagaaggagaagtgagaaccctgaagcaatggaggaagacattgaagacgaggtacctgagatcacgccttctcatttcgaggaatcaatgaagtacgctaggaggagtgtcagtgacgctgatatccgcaagtaccaggcttttgctcagacattgcaacagtctagaggttttggttctgaattccgattctcggaaaccagcacagcagggaccactggcactgctgctgctgacccctttgcaacttcaactggtgcagcagatgatgatgacctgtatagttaggttgtccaagtttttattttcatattttgcatacattgtgcaactctgtgaaatgggctcctatttattcagctgatgaaaaacttttgagtagcaaattggaatctctcctttgatatgctctaaagtataatttatgtttggatctttttgttctcaccttgtaatttatttatatttggatccttccatatttgtcgtttataattcagttttttta

SEQ ID NO: 5671 - DNA, 719 bp, Solanum tuberosum
ttgaccagttaatttatatcccactgccagatgaagactcacgccatcagattttcaaggcatgtcttagaaaatctcccctatcaaaagatattgatttgagagctcttgccaagtatactcagggatttagtggagctgatatcactgagatctgtcaacgggcatgcaaatatgccataagagagaacattgagaaagatatagaaaaggaaaagaggcgagcagagaatcctgattctatggatgaggatgctgatgatgagatatcagagattaagcctgctcattttgaggagtccatgaagtatgcacgacgaagtgtgagtgatgccgatattcgtaaataccaggcatttgctcagaccttacagcaatctcgaggttttggaactgaatttcggttttctgagaccagtggtggggctgctgcatctgaccccttcacaacttctaatgctggagctgatgatgatgacttgtatagctaaagttatggactatcctgttattttgctgcgacatttttcttttccgttgttgctatagagtttcctaaacaaaaatgtctttgaactattactttgattctggaagctgttggtttattttgcgcactctttaatgttgttatcttgaggtgttttgtgacattttaaagaaacctcaatagcttcgctaatacagtggaccttggttatttattctcttcttcacct

SEQ ID NO: 5672 - DNA, 832 bp, Fagopyrum esculentum
acccagggcttcagtggtgctgatattaccgaaatctgtcagcgtgcttgcaaatacgctatcagagaaaacatcgagaaggacattgagaaggagaagaggagaagcgaaaacccagaggctatggaagaggatgtggaggatgaagtgtctgagatcagagctgcacatttcgaagagtcgatgaaatatgctcgtaggagtgtcagcgacgctgacattcgtaagtaccaggcttttgctcagacattgcagcaatcccgagggttcggtagcgagttccgattctctgaagctagcggagctgctgctggtgcaacagggtcccaaccttttgcagcctctgcaggtggagctgacgaagatgacctctacaattaattatgctgatgggtagtctattgtgcacttgatttggttcacatggtccagatattgaaccattttctatcacttattctgtttttatttttaggaaacagttttcaatacttgccagaattgtttttatgggttttacttgcccactgcacacaatgttcttcaactatgtcttatgtaccattgttggaggactaggacaaaaggaaacctaatctgtttatttctgttgccctttttccttaatttgctcaactttcgctttgcgcttcccattctactatcattctactgtcattctagctgtacattgttctacaagagacaaaatcaaacacatcttgtgtagaatatggtcatgataaggagtaggatatcagtatttacgtaaatttaggaaggttcaagacataaggagttggatatcagtatttcgaagtcattatgttac

SEQ ID NO: 5673 - DNA, 1184 bp, Ambrosia trifida
atgctgagatactgaattccatggctgtcaccaatgaacatttctctactgctcttggaactagcaatccatctgctctgcgtgaaactgttgttgaggttcccaatgttagctgggatgatattggagggctcgagaatgttaagcgtgagcttcaagagacggttcaatatccagtggagcatccagagaaatttgagaaatttggtatgtcaccgtcaaaaggagttcttttctacggtccacctggatgtggcaaaacacttctggcaaaagctattgcaaatgaatgtcaagctaatttcattagtatcaaaggacccgaattgctaacgatgtggttcggtgaaagtgaagccaatgttcgtgaaatttttgataaggccagaggatctgctccatgtgtccttttctttgatgaactcgactccattgcaactcagagaggaagcagttctggagatgcaggtggtgctgctgaccgtgttctgaatcaactgttgactgaaatggatggaatgtctgccaaaaagacggtttcataattggagccactaacagacccgatattattgatccggcattacttcgacctggacgtcttgatcaacttatttacattccactaccagatgaagagtcacgttactcgatcttcaaggctgcaatgaggaaatcccctgtttctaaagatgttgatttgagagcccttgccaagtatactcaaggatttagtggggcggatattactgagatatgtcaacgggcctgcaagtatgcaattagagagaacatcgagaaagatatagagagggaaagaaagaggagcgagaatcccgactcaatggatgaggatgatgacgatgatgtggctgagataaaggcggctcactttgaggaatccatgaagtatgcacgcagaagtgtgagcgatgctgacattagaagtaccaggcgtttgcgcagacattgcagcagtcgagaggatttggatccgaatttcggttctcggaagcaacatctggtggcgctgatccatttgctgcttctgctggtggagctaatgatgatgatctatacaactaactagcttttctagattattatttcttaaaactcatgtttaagaagaaaaagacttgttggattattaatttgtgcattttcatgactttccttcatat

SEQ ID NO: 5674 - DNA, 1690 bp, Cirsium arvense
attttgctttatggacctcctggttcaggaaagacgctgatagccagggccgttgctaatgaaacaggagctttctttttctgcatcaatggaccagaaattatgtcaaagttggctggagagagtgaaagcaatcttaggaaggcatttgaggaggctgagaagaatgccccatcaattattttcattgatgagatagattcaatagctcctaagagagagaaaaccaatggtgaagttgaaaggaggattgtatcacagctcttgacacttatggacggattgaaatcacgtgcccatgttattgtaatgggggctacaaatcgcccaaacagcattgatcctgctctcagaaggtttggtaggttcgatagggaaattgacattggtgtgccagatgaagttggacgtcttgaggttcttcgtatccacacaaagaacatgaagctttctgatgatgttgatttggaaaggatagctaaagaaacacatggttatgttggtgctgatcttgctgctctttgcactgaagctgcgcttcaatgcattagagaaaaaatggatgttattgacttggaagatgaatctattgatgctgagatactaaactccatggcagtctcaaatgaacatttccagacggctcttgggacaagcaatccatctgctttgcgtgagacggttgttgaggttccgaattgtagctgggatgatattggaggccttgagaatgttaagcgtgagcttcaagagactgttcaatatcccgtggagcatccagagaaatttgagaaatttggtatgtcaccatctaaaggagttcttttctatggtcctcctggatgtgggaagacacttctggccaaggctatcgcaaacgaatgtcaagctaacttcattagtatcaaaggacctgaattactaacaatgtggtttggggaaagtgaagccaatgttcgtgaaatttttgacaaagccagaggatctgcaccctgtgttttattctttgatgaactcgactccattgcaactcagaggggaagtagttctggagatgcaggtggagctgctgatcgagtgctgaatcaactactaactgagatggatggaatgtctgctaaaaaaactgttttcataattggagctaccaatagacctgacattatagaccccgcattactacgtccaggacggctggaccaacttatttatatcccgttaccagatgaggactcacgacaccagatttttaaggctgcaatgaggaaatcccctgtttctaaggatgttgatttgagagctcttgccaaatatacacaagggtttagtggagccgatattacagagatatgccaacgggcctgcaagtatgcaataagagagaatattgagaaagacatagagagggaaagaaagagaagtgagaatcccgactcaatggacgaggatgaggatgaagtggcggaaatcaaggctgctcattttgaggaatcgatgaaatatgctcgtagaagtgtgagtgatgcagacattcgcaaatatcaggcatttgctcagacgttgcaacagtctcgagggtttggatcggaattccgtttctcggaagcaacgtctggagggggtgctgctgcatctgacccatttgctgcttctgctggaggagctgatgatgacgacttatacagttagc

SEQ ID NO: 5675 - DNA, 1674 bp, Euonymus alatus
tgtcattgttatgggggctacaaatcgtcccaacagcatcgacccagctctgagaaggtttggaagatttgacagggaaattgatattggtgtaccagatgaagttgggcgccttgaggttcttcgtattcatacaaagaacatgaagcttgctgaggatgttgacttggaaagaatttcgaaggatacccatggttatgtgggggctgatctggcggctctttgtaccgaggctgcactccaatgcatcagggagaagatggatgtgattgacttggaagatgaaacaattgatgctgagatactgaactccatggcagtaagcaatgaacacttccagactgctcttggaacaagcaatccttccgccttgcgtggaacagtggttgaggtgcccaacgtcagttgggaggacattggtggtcttgagaatgttaaaagggagcttcaagagaccgttcaatatcctgtggagcatcctgagaaatttgagaagtttggaatgtctccctctaagggagttctgttctatggtcctcctggatgcggtaaaactctcctggcaaaagctattgcaaatgaatgtcaggcaaacttcattagtgtcaagggtcctgaattgcttaccatgtggttcggagagagtgaggcaaatgtacgagaaatttttgacaaggctcgccagtctgccccttgcgtcctattttttgatgaactcgattctattgctactcagagagggagcagttcaggagatgctgggggtgctgctgatagggttttgaaccagcttctgactgagatggatggcatgtctgcaaagaaaactgttttcatcatcggtgcaaccaatagaccagacattatagatcctgcacttcttcgtcctggtcgtcttgatcagttgatctatatccctctacctgatgaggaatctcgtcttcaaatcttcaaatcttgcttgaggaagtccccagtatctaaagatgttgatctcagagcgctagccaagtacactagtggattcagtggtgctgatatcaccgagatatgccagcgtgcttgtaaatatgctattagagagaacatcgagaaggatattgagagggagaggaggaggagcgataacccagaggccatggaggaggatgtagaggatgaagtttcagaaatcaaggcagcacattttgaggaatcaatgaagtatgctcgtaggagtgtgagcgatgctgatattcgtaaataccaggcatttgctcagacattgcagcagtccagaggatttggaactgaattcaggtttgctgactcaagcactggtggagctgcagcatctgaccctttcgctgcctctgctggcggtgctgatgaagacgacctttatagttagtaattatcttttcttttcgtatttgcatatgctgtttaggcctatacatttatgtggtacttgcttattctgcatatggtgttgtaaaatgccagccttggtcaaattattgattccaaaaaatacctcgtcgttgactagctgaagagtattggctgccttgccttctaatttaaaagaacacaatttgctatttgtaccagagtggttgactttcactcaatttcttaagttgaatttaatcaatgttggaccttggttgtcttggttgaggttttgattcc

SEQ ID NO: 5676 - DNA, 1679 bp, Flaveria ramosissima
acactgatagccagagccgttgcaatgaacaggagcttcttttctgcatcaatggtccagaaattatagtcaaaattaggcaggagaaagtgaaagcaatactcaggaaagcattcgaggaggccgagagaacgccccatctattattttcattgatgagatagattcaattgctccaaagagagagaagactaacggtgaagttgaaaggaggattgtatcacagcttttgacacttatggatggattaaaatcacgggctcatgttattgtaattggggccacaaaccgccctaacagcattgatcctgctctcagaagatttggtaggttcgatagggaaatcgacattggtgtcccagatgaagttgggcgtcttgaggttcttcgtatccacacaaagaacatgaaactttctgaggatgttgatttggaaaagatatctaaagaaacacatggttatgttggtgcggatcttgctgctctttgcactgaagctgcacttcaatgcattagagaaaagatggatgttattgatttggaagatgaatctattgatgctgagatactgaattccatggctgtcacaaatgaacatttcgctactgctcttggaactagcaatccatctgctctgcgtgaaactgttgttgaggttcctaatgttagctgggatgatattggaggccttgagaatgtcaagcgtgagcttcaagagacggttcaatatccagtggagcatccagagaaattcgagaaatttggtatgtcaccatcaaaaggagttcttttctacggtccacccggatgtgggaaaacacttctagcaaaggctattgcaaatgaatgtcaagcgaatttcattagcatcaaaggacctgaattactaacaatgtggttcggtgagagtgaagccaatgtgcgtgaaattttcgacaaagccagaggatctgctccatgtgtccttttctttgatgaacttgactcaattgcaactcagagaggaagcagttctggagatgcaggtggtgctgcagaccgtgttctgaaccaactcttgactgaaatggacggaatgtctgctaagaagacagtcttcataatcggagccactaacaggcccgatattattgacccagcattacttcggcccgggcgtctcgatcaacttatctacattccattaccagatgaagaatcgcgctactcgatattcaaggctgcaatgaggaaatcccctgtctctaaagatgttgatctgagagctcttgctaagtacactcaaggattcagtggggctgatattactgagatatgtcaacgggcctgcaagtatgcaattagagagaacatcgagaaagatatagagagggaaagaaagaggagtgagaatcccgactccatggatgaggatgaggatgatgtggctgagataaaggcggctcactttgaggaatcgatgaagtatgcacgcagaagtgtgagcgatgctgacatcaggaagtaccaggcgtttgctcagacactgcagcagtcgagaggatttggatctgaatttcgattcccagaagcaacatctggtggtgcggctgacccgtttgctgcttctgctggtggagctaatgatgatgacttatacagttaggttttgtaaagtattcctgaaaactcatgtctta

SEQ ID NO: 5677 - DNA, 1291 bp, Flaveria ramosissima
gacattggtgtccagatgaagttggtgtcttgaggtttctcgtatccacacaaagaacatgaaactttctgaggatgttgatttggaaaagatatctaaagaaacacatggttatgttggtgctgatcttgctgctctttgcactgaagctgcacttcaatgcattagagaaaagatggatgttattgatttggaagatgaatctattgacgctgagatactgaattccatggctgtcacaaatgaacatttcgctactgctcttggaactagcaatccatctgctctgcgtgaaactgttgttgaggttcccaatgttagctgggatgatattggaggccttgagaatgttaagcgtgagcttcaagagacggttcaatatccagtggagcatccagagaaattcgagaaatttggtatgtcaccatcaaaaggagttcttttctacggtccacctggatgtgggaaaacacttcttgcaaaagctattgcaaatgaatgtcaagcaaatttcatcagcatcaaaggacctgaattactgactatgtggttcggtgagagtgaagccaacgttcgtgaaatttttgacaaagccagaggatctgctccatgtgtccttttctttgatgagcttgactccattgcaactcagagaggaagcagttctggagatgcaggtggtgctgctgaccgtgttctgaaccaactcttgactgaaatggacggaatgtctgctaaaaagacagtttttataatcggagccactaacagacccgacattattgacccggcattacttcgacccgggcgtctcgatcaacttatctacattccattaccagatgaagaatcgcgctactcgatattcaaggctgcaatgaggaaatcccctgtctctaaagatgttgatctgagagctcttgctaagtacactcaaggattcagtggggctgatattactgagatatgtcaacgggcctgcaagtatgcaattagagagaacatcgagaaagatatagagagggaacgaaagaggagtgagaatcccgactccatggatgaggatgaggatgacgtggctgagataaaggcggctcactttgaggaatcgatgaagtatgcacgcagaagtgtgagcgatgctgacatcaggaagtaccaggcgtttgctcagacactgcagcagtcgagaggatttggatctgaatttcgattcccagaagcaacatctggtggtgcggctgacccgtttgctgcttctgcaggtggagctaatgatgatgacttatac

SEQ ID NO: 5678 - DNA, 805 bp, Linum usitatissimum
accagcttctaaccgaaatggatggtatgtccgcaaagaagaccgtcttcatcatcggggcaacaaacagacccgacatcatcgattctgcactcctgaggcccggccgtcttgaccagctcatctacatccctctcccagacgaggattctcgctaccagatcttcaaggctgccttgaggaagtccccacttgctaaagaggtcgacttgagggcacttgccaagtacactcaaggattcagtggtgctgatatcaccgagatctgccagcgtgcctgcaagtacgccattcgggagaacatcgagaaggacattgaaaaggagaggaagagggatgcgaacccggaagctatggaggaggacgaggaggagattgcggagatcaaggctgcacactttgaggagtcgatgaagtacgcccgccgcagtgtgagcgatgctgatatccgcaagtaccaggcttttgcccagactctgcagcagtccaggggtttcggttctgagtttaggttctcggagaccgctgccacaggtggagcaacggcagctgctgaccctttctcaacttcagcaggtggagccgatgaagatgacttgtatagttagatttttaccaaaagtatccgaactccgtatttattttgcatcattcgagttaaaatctgctggcactggattagaatggaacttgttttcgatccaatctggccgatatcggacctgactgaatggtccttttgtttgatgtgttgtaacaatgttatgcactgtttctctttaatagcaagtgttcaatttgtgtc

SEQ ID NO: 5679 - DNA, 1319 bp, Castanea mollissima
ttgacttagaggatgaaactattgatgctgaggtgttaaattcgatggctgtgactaatgaacacttccaatctgcattggggacttcaaatccgtcagcgctacgtgaaacagttgtggaggttcctaatgtttcctgggaagatgtgggaggtttggacaacgttaaaagagagcttcaggagactgtccaatacccagtggagcatcctgagaagtttgagaaatttggcatgtcaccttctaaaggtgttctcttttatgggcctcctggctgtggtaaaacactacttgcaaaagcaattgccaatgaatgccaggcaaatttcattagtgtcaagggacctgagttgttgacaatgtggtttggagaaagtgaggcaaatgtgcgtgagatatttgacaaggctaggcagtcagctccatgtgtccttttctttgatgaactagactctattgcaactcagcgtggtggctctgttggtgatgctggtggtgctgcagacagagtactaaaccaacttctgacagaaatggatggtatgacagccaagaaaacagtgttcattattggggcaacaaacagaccagacattattgattcagctttgctcaggcctggacgtctggaccagttgatttatatcccacttccagatgaggcttcccgtcatcagatatttaaagcatgtttgcggaaatcgcccatctctaaggaggttgaccttgcagctcttgcgcggtatactcaagggtttagcggtgcagatatcactgaaatttgtcagcgtgcctgcaaatatgctattagagaaaatattgagaaggatattgagagggagagaaggaagagagagaaccctgaagctatggaggaggatgacattgatgaggtccctgagataaaggcagcacactttgaagagtcgatgaaatatgctcgccgaagtgtcagtgatgcagacatcaggaaataccagctctttgctcagactttacaacaatcacgtggttttggatctgagttccggtttccagatcgaactgagagtgctgcagcaggagcttcagaccaattttcctctgccactgctgctggagatgatgatgatctgtacaactaaagttgaatccaatacctgttttaagtgctgcagctaatatgttacatccactgccatgaatttcatattttattctgcttaggaacaattgtagcctttagcttttaagtttctatctcactattacttattttttttgctatgggaaaatttcttttcatttatatggtttgctttgtttgtgggttggatctt

SEQ ID NO: 5680 - DNA, 615 bp, Actinidia deliciosa
  misc_feature (465)..(465): n is a, c, g, or t
aaatctcctatttccaaagatgtcgacctaagagcccttgcgaaatatactcaaggcttcagcggtgcagatattacagaaatatgtcaacgtgcttgcaaatatgccattagggagaacattgagaaagatattgaaagggagaggaggaggagtgagaaccctgaggctatggaggaggatgttgaagatgaggtggcagagatcaaggctgcccatttcgaggaatcaatgaagtatgcccgaaggagtgtgagcgatgccgatattcgcaagtaccaggcgttcgctcagacattgcagcagtcgagagggtttgggagcgaattccgattctcagagaccagtgccggggccaccactggatctgacccttttgcagcttctgccggtggggctgatgaagatgacctctatagttaggttctctctctgttgtgtgtttcgtcttttatgtcatgtttnaaacatttcttactctttaaaagtatttatgtagtttctgcgtcttgttattttgaattctgctgcgtatcaaggccttagttgggttttgattagcccacctccagtttaaagttctcatattgtttctattaatctgacgagtacagt

SEQ ID NO: 5681 - DNA, 1630 bp, Lolium multiflorum
ggcacgagggtcccgtgcacatgttattgttatgggcgctacaaaccgcccaaacagtatcgatcctgccctcagaagatttggtagatttgatcgggagattgacattggtgtccctgatgaagttgggcgcctggaagttctccggattcacaccaaaaacatgaagttggctgaagatgttgaactggaacacatttcaagagacacccatgggtatgttggtgctgatctcgctgctctttgcactgaggctgctctccaatgcattcgtgagaaaatggatattatagatctcgatgatgagaccattgatgctgagattctgaactcaatggctgtgacaaacgaccatttcaagactgcattaacaacaagcaacccatctgctctccgtgaaactgttgttgaagttcccaatgtctcttgggaagatattggtggtctggagaatgtcaagagggagttgcaggagactgtccaataccctgtggagcatccagaaaaattcgagaagtttggcatgtctccttccaaaggtgttttgttctacggccctcctggctgtggtaaaaccctgttggcaaaggcaattgctaatgagtgccaggctaacttcatcagtatcaagggacctgagctgcttaccatgtggtttggagagagtgaggctaatgtgcgcgagatcttcgacaaggctaggggttcagcgccatgtgtcctcttctttgatgagcttgactcaattgctacccagagaggaagcagtgttggggatgctggaggtgctgctgatagagtgctcaaccagctcctgactgagatggatggcatgaacgccaagaaaactgtgttcatcatcggtgctaccaacaggcctgacatcattgaccctgcgttgcttaggccagggcgtcttgatcagcttatctacatccctctccctgatgttgagtccaggctccagatcttcaaggcttgcctcaggaagtcccctgtggccaaggatgttgatctggatgctctcgccaagtacacccaagggttcagtggtgctgatatcactgaaatttgccagcgttcttgcaaatatgccatcagggagaacattgaaaaggacatcgaaagggagaggcggaagaaggacaaccctgaagccatggaggaagacgagactgatgagattgctgagatcagggctgctcactttgaggagtcgatgaagtatgcgcgccgtagtgtgagtgatgctgacatccggaagtaccaggcctttgcccagactctgcagcaatctcgtggattcggcagcgagttccggttccctgatgctcctgcctcaggtgcagccgctgctgcagatccttttgcgtcatcagccgctgcagctgaggatgatgatttatatagctagatcctgttgctgtaccattaacttaccgacgatttcctttccttcatacactgttatgtcatgctctgtatggaagacacgggcagacaatgtacttatttaagttgatattgggatgcactgataatctgctggttattttttctgtcgtcttgaatttatttctactcttattgaaaaccaagatatctatccgggaggaaatattcatatgat

SEQ ID NO: 5682 - DNA, 2037 bp, Quercus alba
cccacagctcttcaaatcaattggtgtgaaacccccaaaaggaatcttgctttatgggccacctgggtctggaaaaactctgattgcaagagctgtagctaatgagacaggtgcattcttctttttgattaatggacctgaaataatgtcaaagctagctggtgagtctgaaagcaacttgagaaaggcatttgaggaagccgaaaagaatgccccgtctattatatttattgatgagatagattcaattgccccaaagagggaaaagacgaatggtgaagtggagaggcgtattgtctcccaactcctgacattaatggatggcctcaagtcccgagcacatgtgattgtcatgggagctaccaataggcctaatagtattgatcctgcactgaggagatttgggagatttgatcgtgaaattgacattggtgtaccagatgaggttggaagattggaagttcttagaatccacacaaagaatatgaaacttgcagatgatgttgatcttgaaagagtttcaaaagatacccatggttatgttggcgcagatcttgctgctctttgcacagaggctgctcttcagtgtattcgggagaaaatggatgtcattgacttagaggatgaaactattgatgccgaggtgttaaattcgatggctgtgactaatgaacacttccaatctgcattggggacttcaaatccgtcagcgctacgtgaaacagttgtggaggttcctaatgtttcctgggaagatgtgggaggtttggacaacgttaaaagagagcttcaggagactgtccaatacccagtggagcatcctgagaagtttgagaaatttggcatgtcaccttctaaaggtgttctcttttatgggcctcctggctgtggtaaaacactacttgcaaaggcaattgccaatgaatgccaggcaaatttcattagtgtcaaaggacctgagttgctgacaatgtggtttggagaaagtgaggcaaatgtgcgtgagatatttgacaaggctaggcagtcagctccatgtgtccttttctttgacgaactagactctattgcaactcagcgtggtggctctgttggtgatgctggtggtgctgcagacagagtactaaaccaacttctgacagaaatggatggtatgacagccaagaaaacagtgttcattattggggcaacaaacagaccagacattattgattcagctttgctcaggcctggacgtctggaccagttgatttatatcccacttccagatgaggcttctcgtcatcagatatttaaagcatgtttgcggaaatcgcccatctctaaggaagttgaccttgcagctcttgcacggtatactcaaggatttagcggtgcagatatcactgaaatttgtcagcgtgcctgcaaatatgctattagagaaaatattgagaaggatattgagagggagagaaggaagagagagaaccctgaagctatggaggaggatgacattgacgaggttcctgagataaaggcagcacactttgaagagtcgatgaaatatgcccgccgaagtgtcagtgatgcagacatcaggaaataccagctctttgctcagactttacaacaatcacgtggttttggatctgagttccggtttccagatcgaactgagagtgctgcagcaggagcttcagacccattttcctctgccactgctgctggagatgatgatgatctgtacagctaaagttgaaaccaaacctgttttaagtgctgcagctgatatgttacatccactgccatgaatttcatgttttattctgcttcggaacaattgtagcctttagcttttaagtttctatttcactgttagtaattttttttgctatgaaaaaacttcttttaacttatatggtttgctttgtttgtgggctggatctttcaaccatgtgaaaatagggcaagacttctttccagtatttcagtaaactggatgagatatgtctatgagaccaacacatggccattgtgagatatgtgttgtctgtt

SEQ ID NO: 5683 - DNA, 1205 bp, Carthamus tinctorius
  misc_feature (664)..(664): n is a, c, g, or t
aatgaacactttcagacagcctctggcaccagcaatccttctgccctgcgtgaaactgttgtggaggttcccaatgtcagctgggaagacattggtggccttgagaatgttaaaagagagctgcaagagactgttcaatatcctgttgaacaccctgagaaatttgagaagtttggcatgtcgccttccaaaggagtcctcttctatggtccacctgggtgtggtaaaactcttcttgccagggctattgcaaatgaatgccaagccaacttcatcagcattaagggtcctgaattgcttactatgtggtttggggagagtgaggctaatgttcgtgaaattttcgacaaggctcgtggatctgctccttgtgtcctctttttcgatgaactggattccattgctacgcagagaggaagcagtcaggggatgctggaggtgcagctgatagagttctgaaccaacttttgactgaaatggatggaatgtccgccaagaagaccgtcttcattattggtgcaaccaacaggcctgatatcatcgatccagctcttttgaggcctggccgtcttgatcagttgatatacatccctcttccagatgaggagtcccgttaccagattttcaaatctgctttaagaaaacgcctgtttctaagacgtgnacctacgagctcttgccaagtacacccagggcttcagtggtgctgatatcacggaaatctgccggcgtgcctgcaagtacgccatccgtgagaacatagagaaagatatcgagagggaaaggagaagaagtgagaatccagaagcaatggaggaggatgtggaagatgaggtgcccgaaatcagagctgctcactttgaagagtcgatgaagtttgcgcgaaggagtgttagtgatgctgatatccgcaagtatcaggcttttgcccaaacgctgcagcagtctagaggaattgggtcggagttcagattctcggaggcaagtgggcggagtgctgctaccgacccttttgccgccccggctggtgcagctgacgaagatgacctttataactaagtcgccaaataattgtctagtcatctcatctatctggtcaaatagattttgttagttgtgtaatcttatactatgttttaactttgctttatgatggtaacagttttgtggaagttggtaaaaatactatggctggttgacaaaaa

SEQ ID NO: 5684 - DNA, 810 bp, Salvia sclarea
ggtgctgctgatcgtgtgttgaatcaactcctcacagaaatggacggaatgaatgcgaagaagactgtcttcatcatcggtgccaccaacaggcccgacatcattgaccctgccctcctccgtcctggccgtctcgatcaactcatctacattcctcttcccgatgaggaatcgcgccatcaaatcttcaagtcgtgcttgaggaagtcgcctgtctccaaagacgtcgacctacaagccctcgctaagtacactcaggggttcagtggcgccgacatcactgagatatgccagcgcgcggtcaagtatgccatcagagaaaacatcgaaaaagatatcgagagggagaggcggagaggcgagaaccccgaggcgatggaagaagatgtcgaggacgaggtaccggagatcaagcctgcgcacttcgaagaatcgatgaagtttgctcgcaggagtgtgagcgacgccgacatccgcaagtaccaagcattcgcgcagaccctgcagcagtcgaggggattcggcgcagaattccggttcgccgagaacagcgccggcggcgcctctgcagcggcggccgacccttttgcagcaggatcagctgcagccgatgatgatgatctctacagttgaagactgctgataggctgaaatgctttctttaattgcttttgttagttaatttctaagttaaaagacttgatactacagtttgtcttcacaccattcctatatgcaaaatttgggtaacattttactttgtgtaaaataacgaaatattgttttactttgacatgatatgtttgatga

SEQ ID NO: 5685 - DNA, 919 bp, Cynodon dactylon
ccgggggtgctgcagatagagtgttgaaccagcttctgactgagatggatggcatgaatgcaaagaagactgttttcattatcggtgccactaacaggccggatatcattgaccctgccttgcttaggccagggcgactcgatcagcttatctacattcctctgcctgatgatcaatctaggctccagatcttcaaagcctgtctcaggaagtctcctgttgctaaggatgttgacttgaacgctcttgctaagtacacccagggtttcagcggtgcagacatcacagaaatctgccagcgtgcgtgctagtatgccatcagggagaacatcgaaaaggacattgagagggagaggcgtagaaaggacaaccctgaggccatggaggaagatgaggtggacgaaattgctgagatcaaggctacacacttcgaggagtcgatgaagtttgcgcgccgaagtgtgagcgatgccgacatccgcaagtaccaggccttcgcccagacgctgcaacagtctcgtgggttcggcagcgagttcaggttccctggccagccagcgacgatgggggctggctccggcgctgcggctgacccctttgcatccgcggctgccgctgacgaggatgacttgtataattaaagtagcgctgctgtagctaaacttgaccagttaatattatgttactccctccgtttttaaattgttgacgtcgttgactttttttttgttacgtttgaccattcgtcttattcaaatttttttaaaaaattatcaaatattttatcataatttatttattaccaaagaaaattgaaacataacttataattttacatatttaaaaaaatatttggaataagttgagcggtcaaatataacgaaaaagttaatggcgtcaacaacttaagaacagaggg

SEQ ID NO: 5686 - DNA, 1833 bp, Trigonella foenum-graecum
gaaattgattctattgcacccaagcgggagaagacaaacggtgaagttgaaagaaggattgtttcacaacttttgactcttatggatggattaaaatctcgtgctcatgttattgtcatgggtgccactaatcgtccgaatagcattgacccagcattgagaaggtttggtagatttgatagggaaatcgatattggtgttccagatgaaatcgggcgacttgaagtccttcgcatacataccaaaaacatgaagctctctgatgatgttgatttggagagaatctcaaaagatactcatgggtatgttggtgctgaccttgctgctctttgcactgaagctgctttgcagtgcattagggaaaagatggacctcattgacttagaggatgagactattgatgctgaaatactaaattccatggcagttacaaatgagcatttccatactgcacttggaacaagcaacccatcagctctacgcgaaactgttgttgaggtgcctaatgtcagctgggaggacattggaggccttgagaatgtcaagcgtgaactgcaagagactgttcaatatcccgttgagcacccagaaaagtttgagaagtttgggatgtcaccatcaaaaggagttcttttctatggtcctccgggatgtggaaaaactttgttagccaaagcaattgctaatgaatgtcaagctaacttcatcagtataaaaggaccagaattgcttacaatgtggtttggtgaaagtgaagccaatgttagggaaatttttgacaaggctagacaatcagctccatgtgtcctcttttttgatgagcttgactccattgccactcagagagggagcagtgttggtgatgctggtggtgctgctgacagagttctcaatcaacttctgacagaaatggatggcatgtctgccaaaaagactgtgttcattatcggggcaactaacagacctgacatcattgatcccgcacttctccggccaggccgtctagatcagttgatctatattcctcttcctgacgagggttcccgtcattcgatcttcaagtcctgcttgaggaagtcaccgatcgcaaaagatgttgatttgggagcattggctaggtatactcaaggttttagtggtgccgacattacagaaatatgccagcgagcatgcaaatatgctataagagaaaacatagagaaggacatagagcaagagaggaagaggaaggaaaaccctgaggccatggatgaagacatggttgacgaagaagttgcggagatcaaggcggctcattttgaggagtcaatgaagtatgcgcgtaggagtgttagtgatgctgatatacgcaaataccaggcatttgctcagaccttacaacaatcaagggggttcggaagtgaatttaggtttgcagataccgcaaataggactaccggatctgacccttttgcaactactactgccggtggtgcggctgaggaagatgatctgtatagttaggtttacttcaatgatgtgtcggtagactttcctttcaaagggaaaaacatgaagcctatcgtatgttttgcttttcacgcacttaagttaaattactatagattgttactggtttaacgtataatttagatatggtatgtttatattatggatggttttcttgttattatagaaaatagttgagcatgtcttgcatttttaacgatcgcatacttcaacgttctgtttatgtgcttgtcatagacagcaataccttatgttcagtcaaaaaatatccgatgtactgtggttttattcgattcgagggtattaatctttgcaattctgtgc

SEQ ID NO: 5687 - DNA, 696 bp, Gerbera hybrid cultivar
cgatcaactaatttacatccctctaccagatgaggactcccgtcaccagatcttcaaggctgcaatgaggaaatcccctgtttccaaagatgtcgatttgagagctcttgccaagtacactcaaggcttcagtggggctgatattacagaaatatgtcaacgggcctgcaaatatgcaataagagagaacatcgagaaggacatagagagggaaagaaagagaagcgagaacccggactccatggacgaggacgaggatgaagtggcagagataaaggccgctcactttgaggaatccatgaagtatgctcgcagaagtgtgagcgatgctgatattcgcaaatatcaagcatttgctcagactttgcagcagtctcggggctttggatcagaattccgtttctcggaagcaacatccggtgctgctgcatccgacccgtttgctgcaactgccggtggagctgacgatgacgacttatacagttaggcttgttctataaattatatcccaaactcatgtttttatgaaacacacttatggacatttcagttggtaaaacttttttgattctggattaggcatttgatatctcgattcaaatacatgtttacgtatggttatactttgtttctattgttggaaaatagtgcatattttgctttaagattaataatgtcaaacaaaaaaaaaaaaaa

SEQ ID NO: 5688 - DNA, 863 bp, Lactuca sativa
gccatgttcgtgaaattttcgatagggctcgtggatctgcaccgtgtgtcctcttcttcgatgaactcgactcaattgcaactcagagggggagcagttctggagatgctgggggtgctgctgaccgagttctgaatcagctactgaccgaaatggacggaatgtctgcaaagaaaaccgttttcataatcggggcaaccaaccgacccgacatcatcgacccggccctactacgtccgggtcgtctggatcagttaatttatattccattaccagatgaagactcgcgtcaccaaatcttcaaggctgcaatgagaaaatcacctgtttcaaaagacgttgatctgcgagctcttgctaaatacactcaaggcttcagtggggccgacattacagagatatgtcaacgcgcgtgcaagtacgccatccgagagaacatcgagaaagatatagagagggagaggaagaggagcgagaatcccgactccatggatgaagatgaggatgagttggcggagattaaggcagctcattttgaggaatcgatgaagtatgcacgaagaagtgtgagtgatgcggatattagaaagtatcaggcatttgctcagacgttgcagcagtcgagaggatttgggtccgagtttaggttttctgaggcaacatctggcggtggtgcggcggatccgtttggtgcgtctgctggcggggctgcagcagaggatgatgatttatatagttaggttttatttattatgggttatttatggatattttattttatttttcaatttgtgcatttccctgatttacatctgcattgtcagatttgaacatataagtttatgtatgtatgggtaactttt

SEQ ID NO: 5689 - DNA, 1783 bp, Chelidonium majus
gtgaagtggagaggcgtatagtctcccagctactgactttgatggatggtcttaaatccagagcacatgtgattgtgatgggagctaccaataggcctaatagcattgacccagctctgaggagatttggaaggtttgatcgagaaattgatattggtgtgccagatgaggttggaaggttggaagttctccgcatccatacaaagaatatgaagcttgcagaagatgttgatcttgaaaaagtttcaaaagatacccatggatatgttggtgccgatcttgctgctctttgcactgaagctgctctgcaatgtatcagggaaaagatggatgtaattgatttagaagacgagactattgatgctgaaattctcaattccatggctgttacgaatgagcacttcataactgcgttgggaacgtcgaatccgtctgcattacgtgaaacagttgttgaagtgcctaatgtctcttgggaggatattggtggattggaaaatattaagagagagctccaggagactgtccaatacccagtggagcatcctgagaagtttgagaaatttggcatgtctccatctaaaggtgtcctcttctatggccctcctggatgtggtaaaacacttctggccaaagcaattgcaaatgagtgccaggctaatttcataagtatcaaaggacctgaactgctgacaatgtggtttggagagagtgaggcaaatgtgcgagagatatttgacaaagcacgggggtcagctccatgtgtacttttctttgatgagcttgactccattgcaactcagcgtgggagttcgtcaggagatgctggtggtgctgcagatagggttttgaaccaattgttgacagaaatggatgggatgactgcaaagaaaactgttttcataatcggtgccacaaacaggccagacattattgatccagctttgctcaggcctggtcgactggaccagttgatttacattcctctgcctgatgaggcttctcgacttcaaattttcaaagcatgcttgcgaaaatctcctgttgctagggatgttgatatttcagctctagcacggtacactcaaggtttcagtggtgctgatatcactgaaatctgtcagcgtgcatgcaaatatgcaatcagagaaaatattgagaaggatatcgagaaggagaggaagaagagtgaaaatcccgaagcaatggaagaagatgatgtagatgaagtcccggagattaaggcagcacattttgaagaatccatgaagtttgctcgtcgtagtgtcagtgatgctgacattcggaagtaccagctctttgctcagactctgcaacaatctcgtgggtttggatctgaattccgattctctgatcgcactgagaacacctcaggcactactggtgtgtcggatcccttcactgctcccaccgatgccggtgatgatgacctgtacagctaaattctcagttatccaatgctaatgttattccttttaacaaaggaggatgttagtccttttagtggttattagtcagaagtatgtttcatctttcttgatgttgaagttatggagagctctcaaattttgcagtatgttctgcaattgactttaagttgttttatgactaaactaaaatattactaaagttacttgtatagtagtggatgtaatgaacatgtcttatttaagtttatgagatgatctttctgccttctgtcttcttttctggtaaatgcttgttcaatccctcttctataaattattaatgaacataattt

SEQ ID NO: 5690 - DNA, 920 bp, Ocimum basilicum
aggacctgaattgcttacaatgtggttcggagagagtgaagccaatgttcgtgaaatatttgacaaggctagaggttctgctccatgtgtgctcttctttgacgagcttgactctattgctactcagagaggaagtagtgttggggatgctggtggtgccgctgacagagttcttaatcagcttctcactgagatggatggcatgaatgctaagaagactgttttcataattggggctactaacagacctgacattattgatccagcacttctacggccgggccggctcgatcaattaatttacatacccctgccagatgaagaatcgcgccatcaaatcttcaaagcatgtcttcgaaaatcaccactgtcgaaagatgttgatctccgtgctcttgctaaatatactcaaggatttagcggagcagatatcacagaaatatgtcagagggcttgcaaatatgccataagagagaatattgagaaagacatagaaagggagaggagaagcagcgaaaaccctgactctatggacgaggacgttgatgatgaagtatcggaaatcaagcctgcacacttcgaggagtccatgaaatttgctcggagaagtgtgagtgatgctgacatccggaaataccaggcatttgctcagaccctgcagcagtctcgcggatttgggactgagttccgtttttctgagcaaacacccggtgcatctgcagctgacccctttgcatcagctgctggtggagctgacgacgacgatctgtatagttagatgctgtttacccttctccagctctagaaactcgatttattctgatgcacacaaggaagaaaacgcctcttgcatctcttatgtactccagatgcccgttcgactatggatttcgcgtcgaaatgctttctgatttactgtt

SEQ ID NO: 5691 - DNA, 693 bp, Cicer arietinum
ggatgttgacctcagagctcttgccaagtacactcaaggtttcagtggtgctgatattactgagatttgccagcgttcatgcaagtatgctattagagagaacattgagaaggatattgagagagaaaggaggagaagcgaaaatcccgaggctatggaagaggataatgaagatgatgatgtagctgaaatcaaagcagcccattttgaagaatcaatgaagtatgcaagaaggagtgttagtgatgctgacattcgcaagtaccaagcgtttgcccaaacattacagcagtcaagagggttcggatccgagttcaggtttgcagatgccagcactggtggtactgctactgcagcagctgacccttttgcaagtgctggtggagctgatgaagatgacctttacagttaggtcaacatttgctgttttgtattcaggaacgacaatgctacctaatttatgtaccttttcatttgttttatgaagtcaagcttccatttgattactattttaattgctccctaaaaggtattggtacatcattaggtgcgagcttttatgaaggtttgaaacaattatttggccagcttctgggaccatggtctcaggctctcggctttttgggtcactacaattgtatttttgagcctacacatttttaatagcaatgattttaaataacttacgaatga

SEQ ID NO: 5692 - DNA, 851 bp, Zingiber officinale
ttaatcagctactgacagagatggatggcatgaatgccaagaaaactgtattcattatcggggcaaccaacagaccagatatcatagatcctgctctgcttaggcctggccggttggaccagttgatttatattcctttaccagatgaggcctctcggtaccaaatttttaaagcttgcctaagaaaatctccagtggcaaaagatgttgagctgagggctcttgcgaagtacactcagggatttagtggtgcggacatcacagaaatttgtcagcgggcatgcaagtatgccattagagaaaacattgaaaaggacattgaaagagaaaagaggaagagtgaaaatcctgaagccatggaggaagacgatgaggctgatgacatagcagagatcaaagccgttcattttgaagagtcaatgaagtttgcccgcaggagtgtcagcgacgctgacattcgcaagtaccaagcatttgctcaaactttgcagcagtcacggggtcttggcagtgagttccgttttgccgatcgttctgaagctacacctggagcagacccttttgcaaccccaactgtcgatgctgatgatgatgatttatatagttagttaactgatttagaagaatggataaaatgttattgtgataccatgttgaatttccacctttagttttcgtcgtgttgactccatactacgaatttaagggcacaggatgtgctcataggcattggtatcactatatgactatatccaagtaaaaacctttcacttgtgatttattgtttcagtttagtttgtgcatcgcataggaagtgttcttgctgcaaaataaaagataaatacagttcg

SEQ ID NO: 5693 - DNA, 559 bp, Tropaeolum majus
gcgaaatacactcaaggcttcagtggtgctgatatcactgaaatatgccaacgatcatgcaaatatgccatcagagagaacatcgagaaggatattgagaaggagaggaggagaagtgagaatcctgaggctatggaggaagatacagaagatgaagtgcctgaaatcaaggcaggacattttgaggaatcaatgaagtatgctcgaaagagtgtgagtgacgcagatatccgcaagtatcaagcatttgctcagacgttacaacagtctagaggttttgggtcggaatttaggtttgcagatgctggaactggtggtggtggtgctgctgctggagctgatccgtttgcagcttcggctggtggggctgatgaagatgacctttacaattaagtttttactcgtcgttattgcttctaagttaaaagtttttttattttttaatatttgaagtttttaagacttttttactcgaatacttcttagactcgctattcttttgcttaaggaaactgcagaagactatgtttcgatttttatttttatcgagaaactcgtc

SEQ ID NO: 5694 - DNA, 2273 bp, Capsicum annuum
gggatctgtttgatgcattcttgaaaccttactttttggaagcatatcgtcctttgaggaaaggggacaatttccttgttagaggagggatgagaagtgtggaattcaaagtcattgagactgacccaggggagtattgcgttgttgctccggacactgaaattttttgtgagggggagcctgttaagagggaggatgaggagagactggactatgttggctatgatgatgttggtggtgtgagaaaacagatggctcagattcgtgaactggtggagttaccattgaggcatcctcaacttttcaaatccatcggtgtgaaaccaccaaaggggattttactttatggacctcctggttcagggaagacgctgatagccagagcggtggcaaacgaaactggtgcatttttcttttgcattaatggaccagaaattatgtccaaattggctggagagagtgaaagcaatctcaggaaggcgtttgaagaggctgagaaaaatgctccatctattatatttattgatgagattgattcaattgctcccaagcgagagaagacacatggtgaagttgagagaaggattgtttcacagctcctgactctgatggacggactgaaatctcgtgctcatgtcatagttatgggagctaccaatcgtcctaacagcattgatcctgctctcagaaggtttggtaggtttgatagggaaattgacattggtgttcctgatgaagttggacgtcttgaagttcttcgtattcataccaagaatatgaagcttgcagaagaagttgatctggaaagaatatcaaaagatacgcatggttatgttgctgcggatcttgctgctctttgcactgaagctgcacttcagtgcattagagagaaaatggatgtcattgatctggaagatgattccattgatgctgaaatattgaattcgatggctgtcacaaatgagcacttccaaactgctctaggaacaagcaatccatctgcattgcgtgaaacagttgttgaagtgcctaatgtctcgtgggaagacattggaggccttgaaaatgtcaaaagagagcttcaagagactgttcaataccctgtggagcatccagagaagttcgagaaatttggcatgtcaccttcaaagggtgttctcttctatggtcctccaggatgtgggaaaactcttcttgccaaggcaattgcaaatgagtgtcaggccaatttcattagtgttaaaggacctgagctgctcaccatgtggtttggagagagtgaagccaatgttcgtgaaatctttgacaaggctagacaatctgcaccctgtgtcctcttctttgatgagctcgactctattgctactcagaggggaagcagtgttggagatgctggtggagcagctgatcgggttctgaaccaacttctgactgaaatggatggcatgaatgcgaagaaaactgtatttattattggggccacaaacaggcctgatataattgaccccgcacttctgcgacctggtcgacttgaccagttaatctatatcccactgccagatgaagactctcgccatcagatcttcaaggcatgtcttagaaagtctcccctatcaaaagatattgatttaagagctcttgccagacatactcagggatttagtggagctgatatcactgagatttgtcaacgggcctgcaaatatgccataagggagaacattgaaaaagatatagaaaaggaaaagagacgagcagagaatcccgattctatggatgaggatgctgatgatgagatagcagagattaagcctgctcattttgaggagtccatgaagtatgcacgtagaagtgttagtgatgccgatatacgtaaataccaggcatttgctcagaccttgcagcaatctcgtggttttggaactgaatttcggttttctgagaccagtggtggggctgctgctacaactgaccccttcgctacttctaatactggagctgatgatgatgacttgtatagctaaagttgtggtctgtccagttattttgctgcggcatctttcttttccgttgttgcaatagagttgcctaaacaatttacttctacgaaaatgtctggaagaattctttgtttcttgaaactgtcgggctcttgttcaacttctggtttattttgcccgctctttaatgtcgttatcttgagatgttctgtgacatttttaaagaacctctttgctaatattgtggaccttggatattctctctcctcgtgc

SEQ ID NO: 5695 - DNA, 968 bp, Brassica oleracea
  misc_feature (946)..(946): n is a, c, g, or t
cagggtcgtaacatatatgacggctgttgtcagttggatatccagttctcaaaccttgaggagctgcaagtaaattacaacaacgatcgatctagggattatacaaatccaaacctgccatcagagcaaaaaggccgtttacctcaccctggctacggtgatgcaggagtggcatatcctcagatggcaaacacatctgcgattgcagctgcctttggctgtggcttgcctccgggtataactggcacaaacgataggtgtacaatccttgtctctaatcttaatactgatagtgttgatgaggataagctgttcaatctgttttctctttacgggaacattgtgaggataaagcttcttcgtaacaaacctgaccatgcccttgtccaaatgggagatggtttccaggctgagcttgcagtacatttccttaagggagcaatgctgtttggtaagcggctagaggtaaactactcgaagcatccaaatattacaccaggaacagactcgcatgactatgtaaactcgaacctgaaccgcttcaaccgcaatgctgcaaaaaactaccgctattgctgctcccctaccaagatgattcacttgtccactcttccgcaagacgtgacagaggaagaagtggtgaaccatgtccaagaacacggggcgatactgaacacaaaagtgtttgagatgaacgggaaaaagcaagctctggtgcagtttgagaacgaggaggaagctgcggaagcactggtttgcaagcacgcgacctctctaggcggatcaattatcagaatctccttctctcagctacagacaatttaaagtcgacaaaggcctctctctcttttctctctctcacctctaataacatttgggtatggtgaggatgatgaatgtgtgtttctttaactcaaatatctctgctacttgtttggacttttcngcactctttttaaacttggtcc

SEQ ID NO: 5696 - DNA, 1071 bp, Tripterygium wilfordii
gattgtcacctttcagaagtcggctgggtttcaagctcttatccagtatcaagtatgccagagtgctgtttcagctagaacttctctccagggacgcaatatttacgatggttgctgtcagctggacattcaattctctaaccttgacgagttacaagtaaactacaataatgaccgatcaagggatttcacaaaccccaatttgccatctgaacagaaaggcagatcctctcatcctggttacagcgacgcaggagctgcgttttctcagatggtgaatgctgctgcaatagcagctgcttttggaggaggtttgccccctggaataactgggaccaatgacaggtgtactgttctggtatccaatctcaattctgatagaattgatgaggacaaactctttaatctgttctctctgtatggaaacattgtgaggataaaacttcttcgaaacaaaccagatcatgcccttgttcagctgggcgatggcttccaggctgaattagccgtacactttctgaagggagccatgctgtttgggaagcatttggaggtcaatttctcaaaacatccaaacataactcaaggtgctgacacccatgagtacatgaactcaaatctcaaccgtttcaaccgcaatgctgcaaaaaactacaggtattgctgctctccaacaagaatgatccacctttcaaccctgcctcaggatatcactgaagaggagattgtgagccacttggaagaacatggaaccattgccaacacaaagctctttgagatgaatggaaagaagcaagcacttgttcagtttgaaactgaggagcaagccactgaggcgcttgtttgtaaacatgctacctcacttggtgggtcaataatccggatttctttctctcaattacaggaaataagagagaactcataggagaaaggtaacaagattatggaactgagggacggtattagggttaagaattcataattgtcatggatgtttatttggacccaccctttgtcacctgtaatcatggttgattgttttcaactctaatttatgttgtttgatagtct

SEQ ID NO: 5697 - DNA, 1094 bp, Flaveria ramosissima
gaagacgttaattagggcgaagtcgcaccccaacaggagtcgctctctctgccgcgtccaagtttcggctgacttaatctttatcttcatcttcaggatatgacagagccttctaaagtcatccacgttcggaatgttggtcatgagatttcggagcctgatctgctacagctattccagccttttggggtcattaacaaactagtgatgcttcgtgcaaaaaaccaggctctcctacaaatgcaagatgttccttctgctgtcactgcaatgcaattttatgccaatgtgcagccaagcataaggggaagaaatgtttatgttcagttttcatctcatcaagagctaactaccatggagcaaaatactcaaggaagagtagatgagcccaatcgtattcttttggtcactattcatcatatgctgtaccctataacagtggaagtcctgcatcaagttttctctcctcatggatatgtggagaagatcgtcacctttcaaaaatcagctggttttcaagcactaattcaatttcagttacgccaaagtgccgtggctgcaagaaattctcttcaggggagaaatatatatgatggttgctgccaactagatattcagttctcaaatcttgaagagttgcaagtcaactacaataatgagcggtctagggatttcactaacccatcactaccatcagaacagaagggcagatcctcccaacctggatatggagacgcaggagttggatatccacagatgaacaacgctgctgcaattgcagctgcatttggaggtggattgccccctggaattagcgggaccaatgacagatgcactgttcttgcatctaatctaaatcctgataggatcgatgaggacaagctgttcaacttgttttctttatatgggaacattgtgagaatcaagcttcttcgtaacaaaccagatcatgctcttgttcagatgggtgatgggtttcaggctgagttggcagtacactttttgaagggagctacactatttgggaagcggctggaggttaatttttcaaagcatcctaatattacaatgggtgctgaaacgcacgagtattt

SEQ ID NO: 5698 - DNA, 1257 bp, Tabernaemontana elegans
tgatgcttcgggacaaaaaccaaggctctccttcaaatgcaagatattccttcagctgtaaatgctctgcaattctacacaaatgttcaaccaagtataaggggtaggaatgtctacattcagttttcatcacatcaggagctaacgactatggatcagagtactcaagggcgggcagatgagcctaatcgaattctgttagttacaatacatcacatgctataccccattactgtggaagtgctgcatcaagtgttttctcctcatggatttgtagagaagatcgtcacgtttcagaagtcggctggcttccaagctttaattcagtatcagttgcagcaaagtgctgtttctgcaagaaattctcttcagggccgtaacatatacgatggttgctgtcagctagacattcagttctcaaacctcgatgagttacaagttaactacaataatgagcggtctagggatttcacaaacccatctctgccatctgaacagaagggtagatcgtcccatcctggctatggagatatgggagttggatatcctcagatggcaaatgcagctgctattgctgctgcctttggaggtggtttgcctcctgggattagtggcacaaatgatagatgcactgttctcgtttctaatttaaattctgatagaatcgatgaggacaagctgtttaacctgttctccatctatggtaacattgtaaggatcaaacttcttcgtaataagccagaccatgcattggttcagatgggggatggcttccaggctgaattggctgtccactttttgaagggagctaagctttttggtaagcgtttggaggtgaacttttcaaaacatccgaacatcaccaccggtgcagatacccatgaatattcaaactcaaacctcaaccggttcaaccgtaatgcagccaaaaactatcggtattgttgctcgccaaccaagatgattcacatatccactcttccgcaggacgtaaccgaggaggaaattatagcgcatttggaggagcacggaaccattgtcaactctaagttatttgaaatgaatggaaagaaacaggctctcgtgctttttgagaatgaggagcaagcaactgaagcccttgtatgtaagcatgcaacgtccctgggtggttcaaccattcggatttctttttctcagttgcagaccatctgaggagcatctgctggaattgggacaccgctagaattgtaatgttctaatgactggttttaaatt

SEQ ID NO: 5699 - DNA, 641 bp, Parthenium argentatum
aaatacccaaggacgagtagacgaggagcccaatcgcattcttttggtcaccattcaccatatgctgtaccccataactgtggaagtcctgcatcaagttttttctcctcatggatatgtggagaaaatcgtcacctttcaaaagtcagctggttttcaagcactaattcagtttcagttacgccaaagtgctgtggctgcaagaaattctcttcaggggagaaatatttatgatggttgctgccaactagatattcagttctcaaatcttgaagagttgcaagtcaactacaataatgagcggtccagggatttcacaaacccatcactaccttcagaacagaagggcagaccttcccaacctggatatggagatgcgggagttggatatccacagatgaacaacgcggctgcgattgctgctgcatttggaggcggattgcctcccggaatcagcgggaccaacgacagatgcactgttcttgcatctaatctaaatcctgataggatagacgaggacaagctgttcaacttgttttctttatatgggaacattgttagaatcaagcttcttcgcaacaaaccagatcatgcccttgttcagatgggtgatgggtttcaagctgagttggcagtacact

SEQ ID NO: 5700 - DNA, 1150 bp, Ambrosia trifida
tactcatttaaaaaagaaagaaaaacatagaagtggaagatgtgttaattagggcgaagtcgcagactccctttgccgcttccaagttccttccttccttccttccttgggctgggctgacttgtttttattcattcatccatcaacagataagataggatatgacagaaccatccaaagtgattcacgtccggaatgttggtcatgagatttctgagcctgatctgcttcagctattccagccttttggagtcattaacaaactagtcatgcttcgtgctaaaaaccaggctctcctacaactgcaagatgttccttctgctgtcagtgcaatgcaattttatgccaatgtgcagccaagcataaggggaagaaatgtttatgttcagttttcatctcatcaagagctaactactatggagcaaagtacccaaggacgagtagacgaggagcccaatcgcattcttttggtcaccattcaccatatgctgtaccctataactgtggaagtcctgcatcaagttttttctcctcatggatatgtcgagaaaatcgtcacctttcaaaagtcagctggatttcaggcactaattcagtttcagttacggcaaagtgctgtggctgcaagaaattctctgcaggggagaaatatttatgatggttgctgccaactagatattcagttctcaaatcttgaagagttgcaagtcaactacaataatgagcggtccagggacttcacaaatccatcactaccttcagaacagaagggcagaccctcccaacctggatatggagatgcgggagctggatatccacagatgaacaacgcggctgcgattgctgctgcatttggaggcggattgcctcccggaatcagcgggaccaacgacagatgcactcttcttgcatctaatttaaatcctgataggatagacgaggacaagctgttcaacttgttttctttgtatgggaacattgtgagaatcaagcttcttcgcaacaaaccagatcatgctcttgttcagatgggtgatgggtttcaggctgagttggcagtacactttttgaagggagctactctgtttgggaagcggttggaggttaatttctcaaagcatccgaatattacaatgggtgctgaaaccca

SEQ ID NO: 5701 - DNA, 1248 bp, Cynara scolymus
cggggagactcgtaacccacaccgattccctttcagacactctctttgccgcttcaagcttcggctgacttcattcctatctcccttcatcatcttcagggatatttaaaatgacagagccttctaaagtcattcacgttcggaatgttggtcatgaaatttctgagcctgatctgcttcagctattccagccttttggagtcatcaacaaactagtgatgcttcgtgctaaaaaccaggctctgcttcaaatgcaagatgttccctcagctgtcaacgcaatgcaattctatgccaatgttcagccaagcataaggggtagaaatgtttatgttcagttctcgtctcatcaagagctaactactatggagcaaaatactcaaggacgaggagacgagcctaatcgtatactcttggttacgattcatcacatgctataccctataaccgtggaagttctacatcaagtattctcccctcatggatatgtggagaaggtcgtcacatttcaaaagtcagctggttttcaagcacttattcaatttcaatcgcgtcaaagtgctgtttctgccagaaatgcccttcaggggcgtaatatatatgatggttgctgtcaactagatattcagttctcaaatcttgaagagttgcaagtgaattacaataatgagcggtctagggatttcacaaacccatcgctgccttcagaacagaaagggagacctctcacacctggatacggagatgcaggagttggatttcctcagatgaacaatgctgctgcaattgcggctgcatttggaggagggttgcctcctggaattagtgggacgaatgacagatgcactcttcttgcatctaatctaaatcctgacaggatagatgaggataaactcttcaacttgttctctctgtatgggaacatcgtcagaatcaagcttcttcgcaataaaccagatcatgccctagttcagatgggtgacggctttcaggctgagttggctgtacactttttgaagggagctaccctatttgagaagcggttggaggttaatttttcaaagcatccaaatatcacaatgggggctgaaacacacgagtatttgaactcgaatctgaaccgttttaaccgcaacgctgctaaaaatacccgctattgtgctcaccacccagatgatccacttgtcgacctgccacagacgtgacagagaagagatgtatcgcactggagacatgcagcatgtgaca

SEQ ID NO: 5702 - DNA, 1318 bp, Cichorium intybus
atgcaattctatgccaatgtacaaccaagcataaggggaagaaatgtttatgttcagttttcatcacaccaagagctaaccaccatggagcaaaatactcaaggacgtggagacgaggagcctaaccgtatactcctggttacaattcatcacatgctttaccccatcaccgttgaagtcctgcatcaagttttctctcctcatggttatgtggagaaaattgtcacttttcaaaagtcagctggttttcaagcacttattcagtttcaatcgcgccagagtgctgtgtctgccagaaattcccttcaggggcggaatatttatgacggttgctgtcaactagatattcagttctcaaatcttgaagagttgcaagtgaactacaataatgagcggtctagggattttacaaacccgtcactgccttcagaacaaaagggaaggccttcttctcaacctggatatggagatgcaggagttggatttccacagatgaataatgctgctgcaattgctgctgcatttggaggagggttacctcctggaattagtgggaccaatgacagatgcactgttcttgcatctaatttaaatcctgacaggatagatgaagacaaactcttcaacttgttttctttatacggaaacatcgtccgaatcaagcttcttcgcaacaaacccgatcacgcccttgttcaaatgggcgacggttttcaagccgaattagctgtccactttttaaagggcgcgacactatttggaaagcgcttagaggtcaatttctcaaaacatcccaacatcacaatgggcgcggaaacacacgaatatttaaactcaaatctcaaccgatttaaccgcaatgctgcgaaaaactaccgttactgttgctcaccaaccaaaatgatccacctgtccaccctaccacaggacattacagaagaggaaattgtgtcccaccttgaagaacatgggagtattgtgaactcgaagctttttgaaatgaatgctaaaaaacaggcgcttgtcatgtttgaaaatgaagaacaggcgactgaagcgcttgtgtgtaagcacgcaagcagccttggggattccatgattcggatctcgttttctcagttgcagaccatttgaagggtagtttggtcttttcacagtcgtggaatcggatggatttggtgatgtgattttatgacattattcaaaactgtttgttttagtgtgtattcttgtttctactactactctactgctgctgctactctctttgtggtttttagatggttgtattatttatttctgttttttttttcttttt

SEQ ID NO: 5703 - DNA, 977 bp, Heritiera littoralis
tatttatgatggttgctgtcagctggatatacagtattcaaaccttgatgaattacaagtccattacaataatgatcgatcaagagacttcaccaacccaaatcttccaacagaacagaagggcagatcaacacagcatcctgggtatggtgatgtaggagttggatttccgcagatggctaatgcagctgcaattgcagcagcttttggaggaggtttgcctccaggaataagtgggacaaatgataggtgtacactgcttgtttccaatctaaattctgatagaatagatgaggataagctgttcaacctattctcactttatggaaacattgtgagaattaaacttctacgcaataaaccagatcatgctctcgttcagatgggtgatggcttccaggctgaactggcagtacattttctcaagggggccgtgctgtttggaaagcgactggaggtcaacttttcaaaacatccaaatataacgcagggagctgacacccatgaatatgtgaactcaaatctaaaccgctttaatcgcaatgctgcaaagaactatcgctactgctgctccccaacaaaaatgattcatctttccactctacctcaggacgtcaatgaagaagaaattgtgaatcacttggcagaacatggcaccattgttaataccaagctgtttgaaatgaatggaaagaagcaagcccttgttatgttcgaaagtgaggagcaagctactgaagcccttgtttccaagcatgcaagctcccttggtgggtcaataatccggatttcattctctcagttgcagacaatcagagagaacgcccagtaatagtttaatggtaaggaactgcaatggtactggcattaaggattcattattgtccagtatacttatatggggttgtaggtcgttgtttatctctcttttcaattatcgctagtctaattgcttgtatggtgctagaactggatac

SEQ ID NO: 5704 - DNA, 1555 bp, Amsonia hubrichtii
gtctacattcagttttcatcacatcaagaactaacaactatggatcagaatacccaagggcggggagatgagcctaatcgaattctgttagttacaatacatcacatgctataccccattactgtggaagtgctgcatcaagtgttttctcctcatggatttgtggagaagatcgtcacgtttcagaagtcggctggcttccaagctttaattcagtatcagttgcagcaaagtgctgtttctgcgagaaattctcttcagggccgtaacatatacgatggttgctgtcagctagacattcagttctcaaaccttgatgagttacaagtaaattacaataatgagcggtctagggattttacgaacccatctctgccatcagaacagaagggtagatcatctcattctggatatggagaaatgggagttggatatcctcagatggccaatgcagctgctattgctgccgcctttggaggtggtttgcctcctgggataagcgggacaaatgatagatgcaccgttcttgtttctaatttgaatcctgatagaattgatgaggacaagctgtttaacctgttctccatctatggtaacattgtaaggatcaaacttcttcgtaataaaccagaccatgcattggttcagatgggtgatggcttccaggctgaattggctgttcactttttgaagggagctaagcttttcgggaagcgtttggaggtgaacttctcaaaacatccgaacatcaccacaggcgctgatacacacgaatattcaaactcgaacctcaaccgtttcaaccgtaatgcagccaaaaactatcgatactgttgctcaccaacaaagatgattcatatatccacccttcctcaggatgtaactgaggaggaaattatagcccatttggaggagcatgggaccattgttaactctaagctatttgaaatgaatggaaagaaacaggctcttgtgctttttgagaatgaggagcaagcaactgaagcccttgtatgcaagcatgcaacatcccttggtggttcaaccattcgcatttctttttctcagttgcagaccatctgaggagtgtctgctggaattcaaacgatgggagcatatttaatgttctagtaactggttttaaatctcacctgtaactgtagtttcctgtttacttgtgtactatcactttctgattggctcatgcttgtaccatttattctgatcttcttctattaacataggtgggaaattgggaatttaccaagttttgtagaactagggttagccacgtgttaagagagagagaactagtcttcattgtaaatagcctgaaggtggatcagggccttatgttctgtcttcataccatgtacaatatgttctatcaggctcttgattgtttgccttctttctcaagttgccccacttttcttgttctttttccacctctgcccactctcttcactttagatgcctctctctctctctctctcctcccccctcatgtgcgttgtttcgcatagataactccctcccacctcctgcgagacag

SEQ ID NO: 5705 - DNA, 1695 bp, Senecio madagascariensis
gtaaattgaaacgcgtatattttagggttttagcctaaattgaggagatctgtcatcatcgccgttgacaacatcgctgatttataaagagcagagaatatgacagaggctgctgcttcgaaagtgattcatgttcgtaatgttggtcatgagatttcagagcctgatctccttcagcttttccagccttttggagtcgtcaacaaactcgtcatgcttcgtgccaaaaccaggctctccttcaaatgcaagatgttccttctgctatcagtgctatgcaattttatgccaatcttcagcctaccataaggggtcggaatgtttacgttcagttctcctctcatcaagagcttactactatggaccaaaatacccaaggacgaccagacgaggagcctaatcgtattctgttggtcaccattcatcacatgctctaccctattaccgtcgaagtcctccatcaagtcttctctcctcatggatacgtcgaaaagatcgtcacctttcaaaagtcagctggtcagcttcttcatcttttttctcctttcctaacattttatttacaatgcacacaatttctttctttcatcccatctaggttttcaagcacttatacagtttcaatcccgccagagtgccgtggctgcaagaaattcccttcaggggcgtaatatatatgatggttgctgtcaacttgatattcagttctcaaatcttgaagagttgcaagtgaattacaataatgagcggtctagggatttcacaaacccgtcgctaccttcagagcagaaaggcagaccctctcaacctggatacggaggagatgcagcaggagtcggatttccacagatgaataatgcggctgcaattgcggctgcttttggaggaggcttgccgcctggaataagcgggacaaatgaccgatgcactattcttgcatctaatcttaatcctgatagaatagacgaggataagctgtttaacctgttttctctatacgggaacattgtcagaatcaagcttcttcgcaacaaaccagatcatgctcttgttcaaatgggtgatggctttcaggctgagttggccgtacactttttaaagggagctacactatttggaaagcggttggaagttaatttttcaaagcatcctaacattacaatgggtgctgaaacacatgagtatttgaactcaaatttaaaccgttttaaccgcaatgctgctaaaaactaccgctattgttgctcaccaaccaaaatgatccacctgtcatccctaccacaagatgcgacagaagaggagattgtatcacatcttgaagaacacgggaacattgtgaattcaaaggtgtttgaaatgaacggtaaaaagcaggccctcgtgctgtttgaaaacgaggaacaagccacagaaactatcgtgtgcaagcatgcaaccacacttgatgattccatgattcgtatctccttttctcagttgcaaaccatctagtcaccccttcatctttagggatttcacaattccggtcttgtcttcttatttatgaacttttatctctgttttattttgttttagtgtgtattcttactctctttggatttttagatgtttttactagtttgttccttttgttgctgtattagttatttttgttttgctgttggaacctataaatttctggtttcttttgtgccg

SEQ ID NO: 5706 - DNA, 525 bp, Cleome gynandra
gtcagctggtttccaagctcttgtgcagtatcagttacaacagtgtgctgtctctgctagaacatctctgcagggtcggaatatatatgatgggtgttgccagctggatattcaattctcaaacctcgaggagcttcaagtcaattataacaacgagcgttctagggattatacgaatccaaatctatcttctgagcagaaaggccgctcatcacatcagccagcctatggtgacgtgggagttgcatatcctcagatgtcaaatgcagctgcaattgcatctgtctttggaggaagccttcctccaggtgtaacaggcacaaacgataggtgtacagtccttgtttccaatctcaatcccgaaagaattgacgaggataagctttttaatcttttctccctctacgggaacataataaggattaaacttctgcgtaacaaacccgaccatgcacttgttcaaatgggtgatggtttccaagctgaacttgcggtgcacttcctgaagggagcttggctgtttgg

SEQ ID NO: 5707 - DNA, 1115 bp, Brassica juncea
atgaactcgcagaacgtggctttgttcctggaatgtcaaaggaagagcaagacaatctagctaaaagcgagacgttagcgatcagaatatcaaacattgcaaacatggttctcttcgccgctaaagtctatgcctccgtcacaagcggctctttagcgatcgttgcttccacgttggactctcttctcgatctcctctccggcttcatcctctggttcaccgccttctcgatgcagacaccaaacccttatcagtatcccatcgggaagaagaggatgcaaccacttggaatcttggtctttgcatcagtgatggccacacttggtttgcagatcatcctggagtctcttcgcacgatggtgtccagtcacaaagagttcagcttaacaaaagagcaagagagttgggtggttgggatcatgctctctgttacattagtcaaactcctcctcgttctttactgcagatcgttcagtaacgagattgtcaaagcctatgctcaagaccacttcttcgacgtcatcacaaacatcattggactcattgcagtaatcctagctaattacatcgataactggatggatccagttggtgctatcattcttgcattgtacacaataaggacatggtcaatgacggttctagagaacgtgaactctctcgtcgggaaatcagcaacaccagagtatctgcagaagcttacttacctgtgttggaaccaccatagagagattaggcacatcgatacggtgagggcgtacacgttcggatcgcattactttgtggaggttgatatagttcttcccgctgatatgcctctgcaagtggctcatgatattggagaagcgctgcaagagaagctggagcagctgcaggagattgaaagggcttttgtgcatcttgattatgagtacactcacaaacctgagcacgctagatcccactgttagctttacggtgaagaacctctctacgtcacaaaattcttagagatttataagaatcatcaatcatatttgtttagaagacaagtgtacctttgtaactatgtctagttttgttgttctactagtaaaaactataagtttctaaataaaaaaaaagttcatttcata

SEQ ID NO: 5708 - DNA, 1098 bp, Brassica juncea
acgagcttgcggaacgtggctttgtccctggaatgtcaaaggaagagcaagacaatctagctaaaagcgagacgttagccatcagaatatcaaacatcgcgaacatggttctttttgctgctaaagtctacgcttccgtcacaagcggctctctagcaatcgttgcttccacgttggactctcttctcgatctcctttctggattcatcctctggttcaccgccttttcgatgcagaccccgaacccttatcagtaccccatcgggaagaaacggatgcagccgctgggaatcctagtctttgcctcggtgatggccacgcttgggttgcagatcatcttggagtctcttcggacgatggtgtccagtcaaaaggagttcagcttgacaaaagagcaagagagctgggtggttgggatcatgctctccgtcacattagtcaaactccttctcgttctttactgcagatcgttcagcaacgagattgttaaagcctatgctcaagaccacttcttcgacgtcatcacaaacatcatcggactcattgcagtgatcctcgccaattacttcgataactggatggatccagttggagccatcattcttgcattgtacacaatacggacatggtcaatgacggttctggagaacgtgaactcactcgtcgggaaatcagcaacgccggagtatcttcagaagctgacttacctgtgttggaaccaccatagagagatcaggcatattgacacggtgagggcgtacacgtttgggtctcattactttgtggaggttgatattgttcttccagctgatatgcctctgcaagtggctcatgatattggagaagcgctgcaagagaagctggagcagttgcaggagattgaaagggcttttgtgcatcttgattatgagtacactcacaaaccggagcacgctagttcccactgttagcttgcggtgaaggtgtctctacgtctacaaaattcttacagatttaagaatcttcaatcgtattgtttagtagacaagtgtacctttgtaactatctagttttgttgttctactagtaaaactataattctaagtctaaataaaaaaa

SEQ ID NO: 5709 - DNA, 1520 bp, Ipomoea nil
ggctctcccctccctccctctctctctctctcgctcgctcgcagtagtccgcagagccgggccagcactccgccgcgattcgcgaaggcttctggaggagtagggtttcgtccgtactgctgcgacgcagcaatccgaaaatggtggagacggttagcctcgacgtcgatcgcggtggctccgaggagcacctcctgctggcggcggaggctagcaagactgactgctcctggaggttgaacttcgacgggttcgagttgtcggcggagcacaaggagaagcctcctcgcggcctccatgactgccttggggttttaagagaagaagatattgtggcagagtattatcaacaacaggtagaaatgcttgagggatttaatgaaatggatgccttagcagatcgtggttttgtgccaggaatgtcaaaggaagaaagggaaaagttggccaaaagtgagacagctgccataaggatatcaaatgttgcaaacatggttctctttgctgctaaggtttatgcatctatacagagtgggtcactggccatcattgcatccacattagactctctgcttgatcttctctctggttttattttgtggtttacggctttctccatgcagacaccaaatccatatcaatatccaattggaaagaaacgtatgcagcctttgggaatccttgtttttgcttctgtgatggcgaccttaggactgcagataattttggaatctgtgcgcactcttatatctgaggaggcagatttcaacctcaccaatgaacaggagcgatgggttgttggcataatgatttttgtcactctggtgaaactggttttggtgttttattgtcgatccttcaccaatgaaattgtcaaggcatatgcccaggatcacttctttgatgttgtcactaacatcataggccttgttgctgcattacttgcaaactacataactggctggattgatcctgttggagctattattctggctttgtacacaatccgaacatggtcaatgacagtgctggagaacgtgaactctctcgttggcaaatcagccacaccagagtttctacagaagctgacatacctgtgttggaatcaccacaagtccataaggcacatagacaccgtcagggcttacaccttcggctctcactactttgtcgaagttgacatagtcttgcctgcagacatgcccttgcaagaggctcatgacatcggagaatccttgcaggagaaactggaactgctgcaagagatcgagcgcgcctttgttcacttggattatgagtacagccacaaaccagaacatgcacaggcacatcagtagatactgtaagtaacttttatgtgactttctactctccccctcatgtcttttttccggtggtttttaactgtaattgatggggattgtattttcactgggtaggctccaatttgtcatttctttgacagcctacaaacactttaattatgcttgattcttatttttgccaattggtttctatat

SEQ ID NO: 5710 - DNA, 1634 bp, Nicotiana benthamiana
  misc_feature (1456)..(1456): n is a, c, g, or t
aagttccactttccttattcaaaccaccatatagagatctacaactacccaccacaaagaactccaaattacataaaggtccctcgagtttcaccaaatttacgcactttaccactctctgcggctccttcaagtaggtgccgccagttttttcacctagtgttttcagctgttttttccctgttttccggtgaccggaaaatgttagaagtagttcctctcggcggcgatcacggcggcggcggcgaagaggagcttttattgctggagacaaacaatgccgaccggtcatggagattaaacttcgacgagttgcggttatcgtctgaatccaaagagaagcctccacgtggcctccatgattgccttggagttttaagtcaagaagacaacattgctgaatactaccagcaacaggtagaaatgctcgagggtttcaatgaaatggacgccttgaccgatcgtggttttgtacctgggatgtcaaaggaagagagggagaaaacggctaaaaatgaaacatttgccattaggatatcaaatgttgcaaacatggttctctttgccgctaaagtatatgcatcggtcaagagtggttcattggccatcatagcatccacattggattcactgctggatcttctctctggtttcatattatggtttacagctttctccatgcagacacctaacccatatcaatatccaattggaaagaaacgtatgcagccgttgggaatcctggtttttgcatctgtcatggcgactttgggactacagataattctggagtctatgcgtacactgatatctgatgagtctgatttcaacctcaccaaggagcaggagagatgggttgttgggattatggtctttgtgactttggtgaaactagttttaatgttgtattgccggtcttttaccaatgagattgtgaaagcatatgcccaggatcatttctttgatgttatcacaaacatcattggtctcattgcagcattgcttgctaattacattaccgactggatagaccccgttggagctatgattcttgcattgtataccattcgaacttggtcaatgactgtactggagaatgtgaactctctagttgggaagtcagctgcaccagaatatctgcaaaagctgacttacctctgctggaaccatcacaaggccataaggcatatagataccgtgagggcttatacatttggttctcactactttgttgaagttgatatcgtcctgcctgcggacatgcccttgcaagaggcacatgatattggcgagtcattgcaggagaagcttgaactattgcctgagattgagcgggccttcgttcatcttgactatgaatacagccacaaacctgaacatgcacaggcataccaataggcagtaatgtaacatcttccctaaccactgtacctaatacctctgcataaatgaactntgatatgctgtgcgagatcggctgatctggtgattgctctttaaaagaaaatctggaaaagaaaaggctgctatgatctggatgttccctggaacaagtaatgtgaactaattattttgttaatttaccttgactattcatatatataacatgatttctcagtttgcttgctccgggt

SEQ ID NO: 5711 - DNA, 1006 bp, Nicotiana tabacum
  misc_feature (103)..(103): n is a, c, g, or t
  misc_feature (439)..(439): n is a, c, g, or t
  misc_feature (443)..(443): n is a, c, g, or t
atccacattggattcgctgcttgatcttctctctggtttcatattatggtttacagctttctccatgcagacaccaaacccatatcaatatcctattggaaanaaacgtatgcagccgttgggaatccttgtttttgcttctgtcatggcgactttgggactgcagataattctggagtctatgcgtacactaatatctgatgagtctgatttcaaccttaccaaggagcaggagagatgggttgttgggattatggtctttgtgactttggtgaaactagttttaatgttgtattgccggtcttttaccaatgagattgtgaaagcatatgcccaggatcatttctttgatgttatcacaaacataattggtctcattgcagcattgcttgctaactacatcaccgactggatagatcccgttggagctatgattctngcantgtataccattcgaacttggtcaatgactgtattggagaatgtgaactctctcgtcggcaagtctgctgcaccagaatacttacagaagctgacttacctctgctggaaccatcacaaggccataaggcatatagataccgtgagggcttatacatttggttcgcactactttgttgaagttgatatcgtcctgcctgcggacatgcctttgcaagaggcacatgatattggtgagtcgttgcaggagaagcttgaactattgcctgagattgagcgtgccttcgttcatcttgactatgaatacagccataaacctgaacatgctcaggcataccaatagtcaaaaggattttgtgacatcttctctagccaatgtacctaatacctctgcatagtgaactctgatatgctgttcgagatcggctaatctggtgattgctctttaaaagaaaatctgggaaagaaaaggctgctatgatctggatgttccctagaacaagtaatatgaattattattttgttaaattttaccttgcctattcatatatataacatgatttct

SEQ ID NO: 5712 - DNA, 1393 bp, Ambrosia trifida
ctatactgggtcggtgtctttttagggtttgcaatggtggagacgatgggtgacggtggagatggtggagaaggggagttttttgttgacggagatgagtacacgtggcggcggcggtggtggcggtgctgacgtgtcatggcggttgaactttgatgggtttcagtttacgtctgagcataaggagaagccgccacgtggcctacatgactgccttggtgttttagccaggaagataatgtggcagaatattaccagcagcaggtagagacgttggaggggtttactgagatggatgagttagcagagcgtggttttgtgcctcggttgtcggcggaagagaaagcaagtttggcaagaaaggagacacttgctattagaatatcgaatgttgcaaacatggttctttttgctgcaaaagtttatgcgtctgttaggagtggttctttggccataattgcgtcgacattagattcacttcttgatctgttatcagggtttatcttgtggtttacagcattctccatgcagactccgaacccctatcagtatccaattggaaaaagacgaatgcagcctttgggaattcttgtgtttgcatctgttatggcaactcttgggctgcagattattttggagtctgttcgcacattggcatctgatgaaaaggatttcaatttaaccaaagagcaagaacaatgggttgttgggattatgctttccgtgacatttgtgaaactcgccctgtgtatatattgccgatcatttacaaatgagattgtaaaagcttatgctcaagatcacttttttgatgtcgtcactaatctgattgggctaattgctgtgctacttgctaattatatcagtgattggatggatcccgtcggagctattattctagcgctttacactatccgcacatggtcactaacagtcttggagaatgtaaactctttggttggaaaatcagcagcaccagaatatctacagaaactgacatacctctgctggaaccaccacaaggctataaggcacatagataccgtacgagcatacactttcggatctcactactttgttgaggttgatatcgttctaccatcagacatgccattgcaaacagctcatgatattggtgagtcattgcaagagaaactagagcttttgcctgaaatcgagcgtgcttttgttcatcttgattatgagtactctcacaaacctgagcatgcacaaacacatcattaaacgaaacagaaaatttgtgattctttgacctccatgtcgggtcaaccgcctgtaactaagttctcattcacatgatgcagaatactgattattgtacttgctaagttccttcaatttatgtgagtattttagtggctgtgtagctagt

SEQ ID NO: 5713 - DNA, 1503 bp, Ambrosia trifida
tcaaaaaaacttgaacttgaatttgtgggtctttagggttttggatcttctgaactgggtctgtgtctttttagggttttgcaatggtggagacgatgagtgacggtggagatggtggagaaggggagttttttgttgacggagatgagtacacgtggcggcggcggtggtggcggtggcggtggtgacgtgtcatggcggttgaactttgatgggtttcagtttacgtctgagcataaggagaagccgccacgtggcctacacgactgccttggtgttttagtccaggaagataatgtggcagagtattaccagcagcaggtagagacgttggaggggtttactgagatggatgagttagcagagcgtggtttgtgcctcggttgtcggcggaagagaaagcaagtttggcaagaaaggagacacttgctattagaatatcgaatgttgcaaacatggttctttttgctgcaaaagtttatgcgtctgttaggagtggttcgttggccataattgcgtcgactttagattcgcttcttgatctgttatcagggtttatcttgtggtttacagcattctccatgcagaccccgaacccatatcagtatccaattggaaaaagacgaatgcagcctttgggaattcttgtttttgcatctgttatggcaactcttgggctgcagattattttggagtctgttcgcacattggcatctgatgaaaaggatttcaatttgaccaaagagcaagaacaatgggttgttggcattatgctttccgtgacatttgtgaaactcgccctgtgtatatattgccgatcatttacaaatgagattgtaaaagcttatgctcaagatcacttttttgatgtcgtcactaatctgattgggctaattgctgtgctacttgctaattatatcagtgattggatggatcctgtcggagctattattctggcgctttacactatccgcacatggtcactaacagtcttggagaacgttaactctttggttggaaaatcagcagcaccagaatatctacagaaactgacatacctctgctggaaccaccacaaggctataaggcacattgataccgtacgagcatacactttcggatctcactactttgtagaggtagatatcgttctaccatccgacatgcctttgcaaacagctcatgatattggcgagtcattgcaagagaaactcgagcttttacctgaaatcgagcgtgcttttgttcatcttgattatgagtactctcacaaacctgagcatgcacaaacacatcatcattaaaaaaaacaaaaatttgtgattctttgacctccatgttgggtcaaccgcctgtaactaagctctcactcgcatgatgcagaatactgattattgtacttgctaagttcctccatttatgtgagattttagtggctgtgtagctagttatatgatatttaactatctgtgcaattcatgtgtatgtgttggatttaaatta

SEQ ID NO: 5714 - DNA, 1268 bp, Ambrosia trifida
ggagaagccgccacgtggccttcatgactgccttggggtttagttcaggaagataatgtggcagagtattaccagcagcaggtagagacgttggaggggtttacggagatggatgagttagcagagcgtggttttgtgcctcggttgtctgcggaagagaaagcaagtttggcaagaaaggagacgcttgctattagaatatcgaatgttgcaaacatggttctttttgctgcaaaagtttatgcgtctgttaggagtggttcgttggccataattgcgtcgacttttagattcgcttcttgatctgttatcagggtttatcttgtggtttactgcattctcgatgcagactccgaacccctatcagtatccaattggaaaaagacgtatgcagccgttgggaattctcgtgtttgcatctgttatggcaactcttgggctgcagattattttggagtctgttcgcacattggcatctaatgaaaaggatttcaatttaaccaaagagcaagaacaatgggttgttggcattatgctttccgtgacatttgtgaaactcgccttgtgtatatattgccgatcatttacaaatgagattgtaaaagcttatgctcaagatcacttttttgatgtcgtcactaatctgattgggctaattgctgtgctacttgctaattatatcagtgattggatggatcccgtcggagctattattctggcgctttacactatccgcacatggtcactaacagtcttggagaatgtaaactctttggttggaaaatcagcagcaccagaatatctacagaaactgacatacctctgctggaaccaccacaaggctataaggcacattgataccgtacgagcatacactttcggatctcactactttgtagaggtagatatcgttctaccatcagacatgcctttgcaaacagctcatgatattggtgagtcattgcaagagaaactcgagcttttacctgaaatcgagcgtgcttttgttcatcttgattatgagtactctcacaaacctgagcatgcacaaacacatcatcattaaacaaacaaaaatttgtgattctttgacctccatgttgggtcaaccgcctgtaactaagttctcactcacatgatgcagaatactgattattgtacttgctaagtgcctccatttatgtgagattttagtggctctgtggctagttagttatatgatatttaactatctatgcaatgcatgtgaatgtgttggatttaaatta

SEQ ID NO: 5715 - DNA, 680 bp, Linum usitatissimum
cttcttgctaattacgtcgacgattggatggaccccgtcggagccataattctggcgttgtacacgattcgtacgtggtcaatgacggtgctcgagaatgtgcactcgctcgttggcaaatcggcaactccagactatctccagaaactgacttacctctcgtggaaccatcacaaagccatcagacatatcgacacagtccgagcttacacgttcggttcgcactactttgtggaggttgacatcgtgttgcctgcagatatgccactgcaggaggctcacgatattggggagtccctgcaggagaagctggaactgctccccgagatagagagagctttcgttcatctcgattacgagtacagccacaaaccggaacacgctcaatcgtaagcagcatcagagagagtgagcaaagagctctgcaagtcccagatgcaaatcttaatggaatgtagtacgtattgctagtcaaacctctggaattatccagattgggtttgagtaaattggaaccggttgagcagtaagagaagatcgaccatgagggagaacgtgtagaaggttattgggttggttagcgtcatagattcatgcaatgtagccaatattcagagtatcctcaaactgaattcattagttttatcacattgaatctgatccattagcaccattgttcg

SEQ ID NO: 5716 - DNA, 727 bp, Linum usitatissimum
gtcacttcttcgatgtggtgaccaacttcatcggccttttcgccgcgcttcttgctaattacgtcgacgattggatggaccctgtcggagccataattctggcgttgtacacaattcgtacgtggtcaatgacggtgctggaaaacgtgcactcgctcgttggcaaatcggcaaccccagactatctccaaaagctgacctacctctcgtggaaccatcacaaagccatcagacacattgacacggtcagggcttacacgttcggttcgcactactttgtggaggttgacatcgtgttgcctgcagatatgccactgcaggaggctcacgatattggggagtcccttcaggagaagctggagctgctcccggagatagagagagctttcgttcatctcgattacgagtacagccacaaaccggaacacgctcaatcgtaagcagcatcagagagagtgagcaaagagctctgcaagtcccagatgcaaatcataatggaatgtagtacgtattgcaagtcgaacctttggaattatccagattgggtttgagtaaattgtatccggttgaacagttagagaagatcgaccacaagggagaacacgtagaaggttattcggttggttagcgtagtagcttcatgcaatgtaggcaatattcatagtattatccaattgaatccattagtattatcacgttgaatctgatccattagcaccattgttcg

SEQ ID NO: 5717 - DNA, 1071 bp, Helianthus annuus
gagaaagcaagtttggcaagaaaggaaacacttgctattagaatatcaaatgttgcaaacatggttctttttgttgcaaaagtttatgcgtccgttaggagtggttcattggccattattgcgtcgactttagattcacttcttgatctgttatcaggatttatcttgtggtttacagcatgctccatgcagactccaaatccctatcaatatccaattggaaaaagacgaatgcagcctttgggaattcttgtatttgcatctgtcatggcaactcttgggctgcagattattttggagtccgttcgcacattggcatctgatgaaaaggatttcagtttgaccaaagagcaagaacaatgggttgttggcattatgctttccgtgacatttgtgaaactggccctgtgtatatattgccgatcatttacaaacgagatcgtaaaagcttatgctcaagatcacttttttgatgttgtcactaatctgattgggctaattgctgtactacttgctaattatatcagtgattggatggatcccgttggagctattatcctggcactttacactatccgcacatggtcactaacggtgttggagaacgtaaactctttagttggaaaatcagcagcaccagaatatctacagaagttgacatacctctgttggaatcaccacaaggctatacggcacattgataccgtacgagcatacactttcggatctcactactttgttgaggtagacatcgttctaccatcagacatgcctctgcaaacagctcatgatattggtgagtcattgcaagagaaactcgagcttttgcctgaaatcgagcgtgcctttgttcatcttgattatgagtactctcacaaacctgagcatgcacaaacacatcactaaaaataacaatatatttgtgattctttgacctccatggttgggtcaaccacctgtaactaagttctcacacacatgatgcagaattgattattgtatttgctaagttcctccgtttttatgcgagattttagtgtttgtgtaacagttatatgatatttaactacc

SEQ ID NO: 5718 - DNA, 1475 bp, Tragopogon dubius
agcggagtacaagcatattcaaaaatcgaaacccttgttttacttcaacgtccggtttgtttagggctttcgtgctgtaatggtggaaccaatgagtggtgatggagatcacggtggctctgaagaggaatttctgttaacagacgtaaacctcggcggcggcggcggaggtggttgtgacgtgtcatggcggttgaactttgacgggtttgagttttcgccggaacatacagagaagcctcctcgaggactccatgactgccttggggttttaggttcagaagacaatgtagcagagtattaccaacagcaagtagagacactggagggttttactgaaatggatgccttagcagagcgtggttttgtgcctcgtttatcagaggaagagaaagcatgtttagcaagaagggaaacacttgcaattagaatatcaaatattgcaaacatggttctttttgtggcaaaagtttatgcatcgattagaagtggttcattagccataatcgcatcaacattggactcgcttcttgatctgttatcagggtttatcctttggtttacagcattctctatgcaaacaccaaatccatatcaatacccaattggaaaaagacgaatgcagcccttgggtattcttgtctttgcatctgtgatggcaactcttggactgcagataatcttggagtctgtacgcacattggcatctgatgaaaaggattttagtttgagcacagagcaagaaggatgggttgttgggattatgttatctgtgacattggtgaaattggtcctatgtatatattgccggtcatttacgaatgagattgtgaaagcgtatgctcaagatcacttttttgatgttgtcaccaatctgattgggctgatcgcggtgctacttgctaattatattagcgattggatggatcctgttggagctataattctggcgctttacacaattcggacgtggtcactgacggtattggagaatgtaaattcgctagtgggaaaatcagctacaccggagtatctacaaaagctaacatacctatgttggaaccaccacaagtctataagacacattgataccgtacgcgcatacactttcggatcgcactactttgttgaggtagacattgttctaccatccgacatgccattgcaaatagctcatgatatcggtgagtccttgcaagaaaaacttgagcttttgcccgagattgaacgcgcttttgtacatcttgattacgagtactcccacaaacccgaacacgcacacacacatcatcattaaacaaaagaaaaaaaaacatcagaatacttttgttggctcattcttttggacatgttgtagcatgtttggtaggttttatccatttatatgagattattagtgtgtaaactgatttctttacaatgaatgtaacctactgatttcattaccatgtaccaaatgttaaccaagtattaac

SEQ ID NO: 5719 - DNA, 1561 bp, Arnica chamissonis
agcatattcaaaaatcgaaacccttgttttacttgaactcgaatttgtgtgttctagggttttaggtttataatggtggaaccgatgagtggtgatggagatcacggcggctctgaagatgaatttctgttaacggagatgaatatcggcggaggtggtggaagtactggtggttgtgacgtgtcatggcggttgaacttcgacgggtttcagttgtcgtcggagcataaagagaaacctcctcgaggtctccatgactgccttggggttttagtcccagaagacaatgtagcagactattaccagcagcaggtagagacgctagagggttttactcagatggatgcattagcagagcgtggttttgtgcctcgattgtcggcggaagagaaagcaagtttggcaagaaaggagacacttgctattagaatatcaaatgttgcaaatatggttctttttgttgcaaaagtttatgcatccgttaggagtggttcacttgccataatcgcgtcgacgttagattcacttcttgatctgttatcaggatttatcttgtggtttacagcattctccatgcagacaccaaacccgtatcagtatccaattggaaaaagacgaatgcagcctttgggaattcttgtgtttgcatctgtcatggcaactcttgggctgcagattattttggagtctgttcgcacattggcatctgatgaaaaggatttcagtttgaccaaagagcaagaacagtgggtcgttggcattatgctttctgtgacatttgtgaaactcgccctgtgtatttattgccgatcatttacaaatgagattgtaaaagcttatgctcaagatcacttttttgatgtcgtcactaacctgattgggctgatagctgtactgcttgctaattatattagtgactggatggatcctgttggagctattattctggcgctttacactattcgcacatggtcactaacggtgttagagaatgtgaactccttagttggaaaatcggcagccccagaatatctacagaaactgacgtacctctgttggaaccaccacaaggctataaagcacattgataccgtgcgagcctacacttttggatctcactactttgttgaggtagacatcgttctaccatcagacatgcctctgcaaacagctcatgatatcggtgagtcattgcaagagaaacttgagcttttgcctgaaatcgagcgtgcttttgttcatcttgattatgagtactctcacaaacccgagcatgcacaaacacatcattaagcaaagcaaaaacaaattatgattatttgacctccatggtcgggtcaacctcctgtaactaagttctcacaaacatgatgcagaatactgattattgtatttgctaagttcctccatttatgtgagattttagtggttgtggagctaactaaatgatattttttgactatctgtataatgaatgtgaatgtatgtggatcatgagatctgaattctgatttagggtcatctcattttctggaaaaggctgttaaaggaatgtgacttt

SEQ ID NO: 5720 - DNA, 1450 bp, Flaveria ramosissima
ggtccgcacgctcttaccgtgtatcctgtcagtaacctcatgcctaccacctgttttcggatcttctcgttattcaacaatcacaaaacccttctttcatccaactcccaagacatacttacgttctacacccctatgtaccctgattccgtttaggcaacaaagtgttttataatggtggaaacgatgagcggtggtggagatcacggtggctctgaggaggaatttctgttaacggagataaatatcggtggcggcggcggtggcggtggacgaggtggaggtccaggtggctgtgacgtgtcatggcggttgaacttcgacggcttccagttgtcgtcggaacatatagagaaacctcctcggggtctccatgactgccttggggttttagtcacagaagacaatgtagcagaatattaccagcagcaggtagagactctggagggttttactcagatggataccttagcagagcgtggttttctgcctcgattgtcggcggaagagaaagcatgcttggcaagaaaggagactcttgctattagagtatcaaatgttgcaaacatggttctttttgttgcgaaagtttatgcgtctgttaggagtggttcgttggccataattgcatcaacattagattcacttcttgatctgctgtcaggatttatcttgtggtttacagcattctccatgcagactccaaatccttatcaatatccaattggaaaaggacgaatgcagcctttgggaatacttgtgtttgcatctgtcatggcaacacttgggctgcagattattttggagtctgttcgcacattggtatccgatgagaaggatttcagtttaaccaaagagcaagaacaatgggttgtttgcattatgctttctgtgacgtgcgtgaaattcgccctgtgtatatattgccgatcatttacaaatgagattgttaaagcttatgctcaagatcacctttttgatgttgttactaatctgattgggctaatagctgtactactggctaattatattagttactggatggatcctgttggagctattattttggctctttacactatccgcacatggtcgctaacggtgttggagaatgtaaactctttagttgggaaatcagcagccccagaatatctgcaaaaactgacatacctctgttggaaccaccacaaggctataaggcacattgataccgtacgagcatacacttttggatctcactactttgttgaagtagacattgttctaccatcagatatgcctctacaaacagcacatgatatcggcgagtcattgcaagagaaactcgagctgctgcctgaaattgaacgtgcttttgtcaccttgattatgagtactcacacaaacctgagcacgcacaaacacatcattaagacaaacaacaatttgtgattctttgacctctatggtt

SEQ ID NO: 5721 - DNA, 926 bp, Trigonella foenum-graecum
aacccatatcagtaccctattggaaagaagcggatgcaaccattgggaattctggtttttgcctctgtcatggcgacactggggctgcaaataattttggagtctgcccgcacactaatctacactgataataccttcagcttgactagggaacaagagcgctgggttgtgggtattatgctttctgtgactttggtgaaattcatgctgatgatttattgccgctcttttaccaatgagattgttaaggcttatgcgcaagatcacttttttgacgtgatcactaatgtgattggcctcattgctgcacttttggccaattattttgatgattggatggatcctgttggtgccatcattctggctttgtacacgattcgcacatggtcaatgacagtgttggaaaatgtgaattccctagtcggaagatcagctgctccagagtatcttcagaaactaacatacctctgctggaaccaccacaaggctgtaaggcacattgacactgttcgagcttacacatttgggtctcactactttgttgaggttgatatcgtcctaccagcagacatgcctttgcaagaggctcatgatatcggagagtcattgcaagagaagctcgaacttttgcctgagatcgagcgtgcttttgttcatcttgattatgagttcagtcacaaacctgagcatgctcaagcacactcttagcagcaatatggagagcaatgctgacttgcgaatttcagatgtaaatgtcaactattttagttagatctgaatctgtaagtactgagaaattgttgagagctgaatctgtattctctccactctatttctcgtatttattatgtatataagatatttgtaccctacctaatgtctcagtatcatgcttatattttttaggaaagtatcatgcttatata

SEQ ID NO: 5722 - DNA, 649 bp, Malus domestica
ctcggttgctgtgctcccttgctcattattttgatgattggatggacccccgttggagccatcattctggccttgtacaccattcgcacatggtcgttgactgtgctggaaaatgtgaactcgctagttggaagatcagctgctcccgaatatctacaaaaattgacgtacctttgctggaaccatcacaaggcaatacgccatatcgatacagtccgggcttacacctttggctcgcactacttcgtcgaggttgacattgtcctgccggctgacatgcccttacaagaggctcatgacataggggaaacgctgcaggagaagcttgagctcctgcctgaaatcgagcgcgcctttgttcatctagattacgagttcagccacaagccggagcacgcacagtcgcactcataaaagtgaggataattctatttgttgttgtgttcaactttgtacgctagaatcgatcccaaatcgaaggcagtaataaactgaaaatgtgtagatgtttggtaggcgtcaagaacaagttgggattctggtaacactgggaaaacagcatttgtatggccgggtcgcatgcaccttttagtgagacccagcaatttcaagttactgtatatcactactccttgagaaaaaaaaaaaa

SEQ ID NO: 5723 - DNA, 825 bp, Eucalyptus grandis
  misc_feature (305)..(305): n is a, c, g, or t
  misc_feature (334)..(334): n is a, c, g, or t
  misc_feature (514)..(514): n is a, c, g, or t
  misc_feature (550)..(553): n is a, c, g, or t
  misc_feature (557)..(559): n is a, c, g, or t
  misc_feature (612)..(612): n is a, c, g, or t
cggcctgggtctaacaaaagagctagaacaatggcttgtgggtatcatgctctcagtgactctggtcaaattcctcctagtcctttattgccggacattcacaaatgagattgtcaaagcatttgcccaggatcacttttttgatgtcataaccaatgtcattggtctcattgctgcactcttggctaattatgtcgtcacttggatggatcctgtcggagctattatccttgcgctctataccatccggacatggtcaatgacagtcttggaaaacgtaaactccctcgtggggaaatctgcanctccagaatacctgcagaaactcacgtanctctgttggaatcatcacaaggcagtaagacacatcgacactgtcagggcctacacctttggatcccactactttgtcgaggtggacatcgtcctgccggctgacatgcctctgcaactggctcacgacattggcgaatccttgcaggagaagctcgagctcctgccagaaatcgagcgngcctttgttcatctcgactatgagtattctcacaannnngagnnngctcaagcgcatagttaatggtaatgcttctattatgtttccaagtccctctnctcaggcaaccgtgtattattcaattgttacggaaaatggaaagtgacatgtggctgcagcttttgttgcttttaaatgtaaaattgcttcacatcgagcctactattgtatttcccaaatgactgaatctgcgttttaccttagaaggggcgatgtatacggaaaaggtatgaagctctttagatatatattgctacatattttggacccag

SEQ ID NO: 5724 - DNA, 2059 bp, Arachis hypogaea
ggggtgactctcttagtttcagctactactcactccttcagctcatttctttttcatgcctttcaattcccctctcacagtctcacgtttcgaaactatttcaattgtgtctgcatctttattacaagcaaagaagaaagaagaaagtatatcatagcatcaacaccaaccacaaccacaaccacaacgttctctaaaatgcatcaatgcaatcacaaccgttgattcttcttctttcaaaatcttgatctactttttcagtcaacaacgacgacggcgagaacgttataaacgacggcgttttaggggtttctggtgaacggagacaatggtggagacgttggaggtgcaaagcgacgagcagagatcgctgctgtcgccggactcgaacaatggcgaccgttcatggcggttgaacttcgaagggtttcagatgtcgtcgccgcacgcggacaagcaagtgaaaccctcgcgtggaatccatgactgctacggtgttctagggcaagaagataacattgctgagtactatcagcaacaggttgaagtgctagagggctttaatgaaatggatgccttggcagaacgtggttttattcctgggatgtcaaaggaggagcaggaaaagctagcaagaagcgagacgtttgccatcagactatcaaatgtagcaaacatggttctctttattgctaaagtctatgcatcaatcagaagtggttccttggccatcattgcatccactttggactcgcttcttgatctcctgtctggattcatactctggtttactgcattttccatgcaaacaccgaacccgtatcagtaccctataggaaaaaagcgaatgcaacctttggggattcttgtttttgcctctgttatggcaacactaggattgcaaattattttggagtcaatgcggacactaatatcagatgaaaatgcattcagcttgaccagagaacaagagcagtggattgttggtattatgctttcagtgacgttggtcaaattcctcctaatgatctattgccgctcctttactaatgagattgtcaaagcctatgcccaagatcacttttttgatgtgatcacgaatgtcattggtctcattgctgcacttttggcaaattatgtagatgattggatggatcctgttggtgctatcattctggctttgtacactatccgcacatggtcgttgacagtgctggaaaacgtgaattccctggttggaagatcagctgcaccagagtatcttcagaaactaacatacctctgctggaaccaccacaaggccgtgcggcacattgacactgtgcgtgcttacacttttgggtctcactactttgttgaggttgatattgtcctgccttctgatatgcccttgcaagaggctcatgacattggggaatcattgcaagaaaagcttgagcttttgcctgagattgaacgtgcctttgttcatcttgattatgagtacagtcacaaacctgagcatgcccaatcccattgatagcagcaattaggaaatgcaatgccttgccatcaattgtaaatgtgaaccatttcacttggattccactctaaagttgctaatcttccacataaccctgtcatgcatcataagttcttaaatctcaacttggtaatatatgccccaagtgtatgtcatgataggaaaatcatgcagagatccttgaacatcccagagtactatagtagcagaaatagattccttgcttctacctctattcaggtacagtatcacccatgtattgtatctcaatatagggtgctggttaaaatgtgcaaatctaatgttttccttggaccagtttcatgattaaactataggatgtgtttttttctagttcatgtttttgccttccaattttccgtgatttctatgtctggtaattttgttgaaaaacaatacatgtgagggctttaacatcaaagatcaatctggtaagttgccaaattaaagatgaatttcacgtgtaatatcaagtgattcgaatatttagataacataccagcaaaggttatgcat

SEQ ID NO: 5725 - DNA, 1403 bp, Solanum tuberosum
tttcacgagaaaaatgttggaattagtgcctcccgacggcgatcacggcggagaatgcggcggcgaagagcagctgttgttgatggaggcgaacaatgtcgacaggtcatggaggttgaacttcgatgaactacggttatcgtctgagaataaagagaaacctcatcctcatggattacatgattgtctcggtgtattgagtcaagaagacaacattgccgtttactaccagcaacaggtggaaatgctcgtgggcttcaatgaaatggatgccttggctgatcgtggttttgtacctgggatgtcaaaggaagagagggaaaaattggccagaagtgaaacaactgccattaggatatcaaatattgcaaacatggttctctttgccgctaaagtatatgcatctgtcaagagtggttcattggccatcatagcatccacattggattcactgcttgatcttctctctggtttcattttatggtttacagcgttctccatgcagacaccaaacccgtatcaatatcctatcggaaagaaacgcatgcagcctttgggaatccttgtatttgcttctgtcatggcgactttgggactgcagataattctggagtctatgcgtacactaatatccgatgagtctgatttcagccttaccaaggagcaagagagatgggttattgggattatggtttttgtgactttggtgaaactagttttggtgttgtattgccggtctttcaccaatgagattgtgaaagcatatgcccaggatcatttcttcgatgttgtcacaaacatcattggactagtcgcggcattgcttgctaactacttcagtggctggatagaccctgttggagctatgattctcgcgctgtataccattcgaacatggtcaatgaccgtgttagagaacgtgaactctcttatcggtaaggcagctgcaccagaatatctacagaagctgacttacctctgctggaaccatcacaaagccataaaacatatagatacagtgagagcctatacatttggttctcactactttgtcgaagttgatatcgtcctacctgcagacatgcccttacaagaggcacatgatatcggcgagtcattgcaggagaagctcgaattattgccagagatcgaacgtgcctttgttcatctcgactatgaatacagccacaaacctgaacatgcacaggcatacctataatcaaacggatattggtaacatcttctcttaacactgtacttaatattatataccacaggtgaactttgtaatgctattcgaaatcggtcaatctggtgattgctcttaaaagaaaagctactattatctggtagaacagggattatgaattatatttttgttaatttatcctgcttattcatat

SEQ ID NO: 5726 - DNA, 1449 bp, Solanum phureja
gtttttcttttttcattttcacgagaaaaatgttggaattagtgcctcccgacggcgatcacggcggagaatgcggcggcgaagagcagctgttgttgatggaggcgaacaatgtcgacaggtcatggaggttgaacttcgatgaactacggttatcgtctgagaataaagagaaacctcatcctcatggattacatgattgtctcggtgtattgagtcaagaagacaacattgccgtttactaccagcaacaagtggaaatgctcgtgggcttcaatgaaatggatgccttggctgatcgtggttttgtacctgggatgtcaaaggaagagagggaaaaattggccagaagtgaaacaactgccattaggatatcaaatattgcgaacatggttctctttgccgctaaagtatatgcatctgtcaagagtggttcattggccatcatagcatccacattggattcactgcttgatcttctctctggtttcattttatggtttacagctttctccatgcagacaccaaacccgtatcaatatcctatcggaaagaaacgcatgcagcctttgggaatccttgtatttgcttctgtcatggcgactttgggactgcagataattctggagtctatgcgtacactaatatccgatgagtctgatttcagccttaccaaggagcaagagagatgggttattgggattatggtttttgtgactttggtgaaactagttttggtgttgtattgccggtctttcaccaatgagattgtgaaagcatatgcccaggatcatttcttcgatgttgtcacaaacatcattggactagtcgcggcattgcttgctaactacttcagtggctggatagaccctgttggagctatgattctcgcgctgtataccattcgaacatggtcaatgaccgtgttagagaatgtgaactctcttatcggtaaggcagctgcaccagaatatctacagaagctgacttacctctgctggaaccatcacaaagccataaagcatatagatacagtgagagcctacacatttggttctcactactttgttgaagttgatatcgtcctacctgcagacatgcccttacaagaggcacatgatatcggcgagtcattgcaggagaagctcgaattattgccagagattgaacgtgcctttgttcatctcgactatgaatacagccacaaacctgaacatgcacaggcatacctataatcaaacggatattggtaacatcttctcttaacactgtacttaatattatataccacaagtgaactttgtaatgctattcgaaatcggtcaatctggtgattgctcttaaaagaaaagctactattatctggtagaacagggattatgaattatatttttgttaatttatcctgcttattcatataatatatctgccatgattcctcagtttgct

SEQ ID NO: 5727 - DNA, 1345 bp, Tragopogon dubius
cttgtgtggtggagtacatgcagatacaaatatcgaagctttcgtttcttccttttcagtttccgatctgttataccggagacaatggtggagtcggtgactggagaaggagatcacgctggtgaagaggagttattgctcttaggcggcggcggcggtggtggtggttgtgatggctcgtggaggttgaacttcgatggatttcagttttcttccgagcataaggagaaacctcctcgacgactccacgactgtctaggagtatcaggtccagaagacaatgtggcagaatactaccagcagcaggtggagatgctggaggggttaccgaaatggatgccttagcagggcgtggttttgtacctcgaatgtctgcagaagagaaggaaagtttggcgagaagggagacacttgccattagaatatctaatgttgcaaacatggttctttttactgcaaaagtttatgcgtccgttagaagtggttcattggccataatagcctccacattagattcacttcttgatcttttatctggattcatcctctggtttacagctttctcaatgcagattccaaacccttatctatacccaatcggaaagagacgaatgcagcctttgggcatacttgtctttgcttcagtcatggcaactcttgggctgcagataattttggagtctgttcgcacattagtatatagtgataatgagtttaggttgaccaaggagcaagaagaatgggtggttggcattatgctctcagtaactttggtcaaacttatgttgtgtatatattgtcgttcgttcaccaatgagattgtcaaagcctatgcccaagatcatttctttgatgttgtcacaaatctcattggcttgatagctgtactacttgctaattatattagtgactggatggatcccgttggagccataatattggcattgtacacaatccgaacatggtctctaacagtgttggaaaacgtgaattccctagtggggaaatcagcagcaccagaatacctacaaaaacttacttacctgtgttggaatcaccacaaggcgattaagcatatcgacacagtaagggcttatacatttggatctcattattttgtggaggtggacattgtcctaccctccgatatgcctttacaaacagctcatgatatcggggaagccttacaagaaaagctcgaattattgccggagattgaacgggcttttgttcatcttgactacgagtactctcacaaacctgaacatgcacgcacacatctctaaacatacatacttgtatgtatttttagatattatatgaaacataatagtaactacagttg

SEQ ID NO: 5728 - DNA, 1534 bp, Cirsium arvense
ttctttcctaccactaacactaatcatctatcctactattctttttatttttatttttttatatatcattttactccataactggccttcaaaatatctccaatttacgtttctcctttcttatggttgtggtggtggagtacatgtagatttcaaaatttcaaaacggttcgttttcatcttcttcttcttccgaagcttctcgatctgtttgttatacaacaatggtggagccgctgagtgtggaaggagatcacggcggtgaagaggaggagctgttgcttctgaaggatgtcaaaatcaccggcggcggccattgcgatggctcctggaggttgaactttgatggatttcagttttcttctgatcataataacaaggagaagccttctcgacgactccatgactgtctaggtgtatcaggcccagaagacattgtggcagagtattaccagcagcaggtagagatgctggagggatttactcagatggacgccttagcagaacgtggctttctacctcgtatgtctgcggaagagaaggaaagtttggcacgaagggagacacttgccattagaatatcgaatgttgcaaacatgtttctttttgctgcaaaagtttatgcgtccgttaggagcggttcattggccataatagcttccacgttagattcacttcttgatcttctatctggatttatcctttggtttacagctttctccatgcagattccaaacccttatcaatatccaatcggaaagagacgaatgcaacctttgggaatacttgtctttgcctcagtcatggccactcttggactgcagatcattttggagtctatacgcacgttagcatctaatgagaacgcgtttaacttgaccaaggaacaagagatgtgggttgttggcattatgctttctgtgacgatggtgaaacttgtgctgtgtatatattgtcgttctttcaccaatgagattgtcaaagcttatgctcaagatcacttttttgatgtcgtgaccaatctcattggcctaatagctgtactgcttgctaattatatcagcgactggatggatcctgttggagctataattctggctctctacaccatccgaacatggtctctaacggtgctggagaatgtgaactcccttgtggggaaatcagcagcacccgaattcctccaaaaactcacgtacctgtgttggaaccaccacaaggcgatcaggcacatcgacactgtaagagcatatacatttgggtctcattactttgtggaggtggatattgtcctaccctctacaatgcctttacaaatagctcatgatatcggggaatccctgcaagaaaaactcgaactgttgcctgaaatcgagcgagcttttgttcatcttgactatgagtattctcacaaacctgaacatgcacatgcacatctctaagaatccatgttcgtttctttcatgtagctttcttctttcctagttcctactgttgttggttgttttaggttatgataatatatatatatgtg

SEQ ID NO: 5729 - DNA, 761 bp, Cirsium arvense
gaccagagagcaggagcaatgggtcattggcatcatgctttctgtgacattggtgaaactcgtcctgtgtatatattgccgttcgtttaccaatgagatcgtcaaagcctatgctcaggatcacttttttgatgtggtcaccaatctgattggcctaatagccgtactgctggctaattatatcagcgattggatggatccaggttttgcatttgttggaacagctggcgctttacactatccggacatggtcaatgacagtgttggagaacgtaaactcgctagttggaaaatcagctgcaccagaatatctacagaagctgacgtacctatgttggaaccaccacaagtctataaggcacattgacaccgtgcgtgcctacacgtttggatctcactactttgtagaggtggacatcgtgctaccatcagagatgcctctgcagatagctcatgatatcgggggagtcgttgcaagagaagctggagctgttgcctgagatagaacgggcttttgttcatctggactacgagttctctcacaaacccgagcatgcacagacacatcattaagtcattctttgaaccaaaacaacctgtaagttctctatctctctctctcatacaagtatacgatcgtctgattgattcttttgatattatttgctaagctcctttatttatgtgtggagctgatatatatagtgtataatgatgctattgacttcttttatgataatgaatgtgaaagtagatcatca

SEQ ID NO: 5730 - DNA, 1250 bp, Cucurbita pepo
ttcccaatattttgggtttccacgttttgctgggtagttcatggtccttgaagttgcaagtttgttcgtgcatacgttttttttgcctttgtaaagcatgtctcctgaagattatgtagctgagtactaccagcagcaggtagaaatgcttgagggctttaatgaaatggatgcgttggctgatcgtggttatgttcctggaatgtcaaaggaagaacgtgaaaagttagctaagagtgaaacatttgcaatcagactatcaaatgttgccaatttggttctgtttgcagctaaagtatatgcatccatcagaagtggttcccttgctataattgcttccacactggattcacttcttgatcttttatctggtttcatcctatggtttactgcattttccatgcaaacaccaaacccgtatcagtatcctattggcaagaaacgtatgcagcctttgggcattcttgtttttgcctctgtcatggcaactcttggattacagataatattggagtcaattcggactctcttattaggcgattctgtgttcaacttaaccaaggagcaagagcgatgggttatgggcattatgctctcagttactctggtgaaactactcttaatgctttattgccgggcttttaccaacgagataatcaaagcatatgctcaagatcatttctttgatgtagtcaccaatgcaatcggccttgtggctgctcttcttgctaattatatagctggctggatcgaccctcttggagctattattctggctttgtacactatacgaacatggtcgatgacggtattggaaaacgtgaactcccttgtcggaagatctgctgcccccgagtacctacagaagctcacttacctatgttggaaccaccacaaggccatcaaacacattgacacagttcgagcatatacatttggatcacactactttgtcgaagtcgatatcgtcctgcccggagacatgccattggaagaggctcacgacataggtgaatcactccaagaaaagctcgagttgctaccagaaattgagagggcatttgttcatcttgattacgagtacaagcataaaccagagcacgcacaggcacacttttagaacaaggcacaaacatggtgatttcttcaactctacaatcccgcatgttcatttatgttgtagtaaaactgcaataacatcgttttctgtcttgtaaatttgttcctgattctatccatgatctcacaaa

SEQ ID NO: 5731 - DNA, 1405 bp, Flaveria ramosissima
agcggtggtggagatcacggtggctctgaggaggaatttctgttaacggagttaaatatcggcggcggcggcggcggtggacgacgtggaggtcctggtggttgtgacgtgtcatggcggttgaacttcgacggcttccagttgtcgtcggaacatatagagaaacctcctcggggtctccatgactgccttggggttttagtcacagaagacaatgtagcagaatattaccagcagcaggtagagaccctggagggttttactcagatggatacattagcagagcgtggttttctgcctcgattgtcggcggaagagaaagcatgcttggcaagaaaggagacacttgccattagagtatcaaatgttgcaaacatggttctttttgttgcgaaagtttatgcgtctgttaggagtggttcattggccataattgcatcaacattagattcacttcttgatctgttatcaggatttatcttgtggtttacagcattctccatgcagactccaaatccttatcaatatccaattggaaaaggacgaatgcagcctttgggaattcttgtgtttgcatctgtcatggcaactcttgggctgcagattattttggagtctgttcgcacattggcatctgatgagaaggatttcaatctaaccaaagagcaagaacaatgggttgttggcattatgctttctgtgacatgtgtgaaattcgtcctgtgtatatattgccgatcatttacaaatgagattgtaaaagcttatgctcaagatcaccttttgatgttgttactaatctgattgggctaatagctgtactactggctaattatattagttactggatggatcctgttggagctattattttggcgctttacactatccgcacatggtcactaacagtgttggagaatgtaaactccttagttggaaaatcagcagccccagaatatctgcaaaaactgacatacctctgttggaaccaccacaaggctataaagcacattgataccgtacgagcatacacgtttggatctcactattttgttgaagtagacatagttctaccatcagatatgcctctacaaacagcacatgatatcggtgagtcattgcaagagaaactcgagctgcttcctgaaattgaacgtgcttttgttcaccttgattatgagtactcacacaaacccgagcatacacaaacacatcattaagcaaaaaagaagtttatgattctttgaatttcatgattgggtggggtcaactgcatctaagttctcattaacatgatgcagactactgaatactgtattttcgaagttctgtgcctccatttatgtgagattttagtgtttgtggagcttattaaattttatttgactctgtattaagaatgtgg

SEQ ID NO: 5732 - DNA, 1502 bp, Fraxinus spp
agacttaagagtgaattattcaatatttctcaagtgcaagtgtaaagtgacgggaaatggtggaacctgtaaataccgacggctccgacgagcaactttgttgccggagacaagaaacggtgaccattcatggcggttgaacttcgatggatttcatttatctactgagcacaagaaaaacctcctcgtgggctccatgactatcttggggttttgggtccagaagataatgttgcagagtattatcagcaacaggtagagatgctggaggggttcaatgaaatggatgtactagcagagcgaggttctgtaccaagagtgtcaaaggaagacagggaaaagctggctagaagtgaagcaattgccatcaggatgtcaaatgttgcaaatatgtttctttttgcagctaaagtttatgcatccatcaggagtggttcgttggccattgttgcgtccacattagactcgcttcttgatctactgtctggttttatcctgtggtttactgctttttccatgcagacgccaaatccttatcaatatcctattggaaagaaacgtatgcagcctctgggaatccttgtttttgcttctgtcatggcaactttaggactgcagattatactggaatccctacgcacattagtttctgatgatgacgaattcaatttgacaaaggagcaagagcaatgggtcattggcattatgctatcagtgactctggtgaaactatttttgtttgcttattgccgcacgttttgcaaatgagattgtcaaggcatatgcccaggatcacttttttgatgttatcaccaacatcattggcctcgctgctgtagtcatggctaactatttcagtgactggatggaccctgttggagctattattctggcattgtacactatccggacatggtcattaactgtgctggagaacgtgaactctcttattggaagatcagctgcaccagaatatctacagaaactcacttacctatgctggaatcaccacaaatccataaggcacatcggacacgtgtaagggcatacacctttgggtctcactatttcgtcgaggtggatattgtgttgccagctgacatgcccctgcaagaagctcatgacatcggagaatccttgcaagagaagctcgaacttttgccggagattgagcgtgcttttgttcatctcgattacgagtactctcataaacctgaacatgcacaagctcatctttagcatgaaggtgttgtagtctacactgctaccatcaattattattgccacctataagttttagtagtgctgttcaactacgttgtctggacctttatagaatggccaaattaaaatatgaatggtgctcgttgaccacaaggttcttgattttaaagacgaatatacgtcttttttgacaaagagaacaatattgtgatgacgggaaagtggcgtatgctaatgtaagtaaactttgctatatgctgacagcatacattcatttt

SEQ ID NO: 5733 - DNA, 731 bp, Valeriana officinalis
aaaaagttcagtttgagccgagatcaggagcgttgggttgttggtattatgctctctgttacagtcgtgaaactcctactctgtttatattgccgatcatttaagaatgagattgtgaaagcttatgcccaagatcaatttttcgatgtcatcacaatatcatcggcttatgctgtactccttgctaactattttaacaattggatggaccctgttggtgctatcattctagcattatacacaatcaggacatggtctctaactgtgttggaaaacgtgaattcgctagtgggaagatctgcggcaccagaatacctacaaaaactgacgtatctttgttggaaccaccacaaagccattaggcacatagacactgtccgggcctacacctttgggtcccactactttgtcgaagttgacattgttctccctgccaccatgcccttgcaagaagctcacgacatcggcgaatctttacaggagaaactagaacagttgcccgaaattgaacgagcctttgttcatcttgattacgagttcagccataaacctgaacatgctcagtctcatctttagtttctcttcttctgttaggtttggtttgatagcgctactctcattggttgtatgtttcttgctgtaaaaacagtctgcctgatacaatttgtgacgccaacacgaattcgctggtaaaatcagatggaattattatggacaggaccgtcaactaa

SEQ ID NO: 5734 - DNA, 1174 bp, Castanea mollissima
gtcaaaggaagagaaggacaagttggctagaagtgaaacgtttgctattaggatatcaaatattgcaaacatgtttctctttgcggctaaagtctatgcatctgtccgaagtggttccttagccatcattgcatccacattggactcatttcttgatcttctgtctggcttcatcctgtggtttacagcattctccatgaaaacaccaaatccatatcaatatcctattgggaagagacgtatgcagccattggggatccttgtttttgcctctgtcatggcaacccttggactgcagataatcttggagtcaatacgcacactattatctgatgagaatgatttctcattgaccaaagagcaagaggaatgggttgttggcattatgctctctgtgactttggtaaaactcggtctggttctttattgccgttctttcactaacgagatcgtcaaagcttatgcccaggaccacttttttgatgttatcaccaacgttattggactcattgctgctctccttgctaattatattactgattggatggatcctgttggagctatcattctggctttgtataccatccgtacatggtcaatgacagtgttggaaaatgtgaactccctcgtgggaaaatcagctgcgccagaatatctacagaaactgacatacctctgttggaaccacgacgaggccataaaacatattgatacagttcgggcttacacctttggctctcactactttgtggaagttgacatagtcttgccagcaggcatgcccttgcaagaggctcacgacattggggaatccttgcaggagaagcttgagcacctgcctgagatcgagcgtgcctttgtacatcttgattatgagtactcgcacaaacctgagcatgctcagtcacaccactagaagtaagaagtaaatctaatattaattctgttaaaagttttgtttcttgctcctgtttacacgccacaggttcttgcttctacttcaatgtgaaaatttaactcctattgagtacaatctgaagctgtaagaatcatggagaaaattgattataagtgtacattcagtgaaattgtgtaatactttggaacatttgttagctggggagctaacttgccctgaatgtacacttataatcaattttctccatgattctta

SEQ ID NO: 5735 - DNA, 1409 bp, Solanum melongena
aggtgacggacgggaaaaatgttggaattagtgcctcacgacggagatcacggtgcagaatgcggcggcgaagagcagcttttgttgatggagacaaacaatgtcgaccggtcatggaggttgaactttgatgaactacggttatcgtctgagaacaaagagaagcctcctcctcatggattacatgattgtctcggtgtattgaatcaagaagacaacattgccatgtactatcagcaacaggtggaaatgcttgagggcttcaatgaaatggatgccttggctgatcgtggttttgtacctgggatgtcaaaggaagagagggaaaaattggccagaagtgaaacaaccgccattaggatatcaaatattgcaaacatggttctgtttgccgctaaagtatatgcatctgtcaagagtggttcattggccatcatagcatccacgttggattcactgcttgatcttctctctggtttcattttatggtttacagctttctccatgcagacacccaacccgtatcaatatcctattggaaagaaacgtatgcagcctttgggaatccttgtatttgcttctgtcatggcaactttaggactgcagataattctggagtctatacgtacactaatatctgatgagtctgatttcagccttaccaaggagcaagagagatgggttgttgggattatggtctttgtgactttggtaaaactagttttggtgttgtattgccgttcttttaccaatgagattgtgaaagcatatgcccaggatcatttcttcgatgttatcacaaacatcattggactagtcgcagcattgcttgctaactacttcagtgactggatagaccctgttggagctatgattctcgcattgtataccattcgaacatggtcaatgaccgtgctagagaacgttaactcccttgtcggtaaggcagctgcaccagaatatctccagaagctgacttatccctgctggaaccatcacagagccataaagcatatagacacagtgagagcctatacatttggttctcactactttgtcgaagtggatatcgtccttccagcagacatgcccttgcaagaggcacatgacatcggcgagtcattgcaggagaagctcgaattattgccagaaatagagcgtgccttcgttcatctcgactacgaatacagccacaaacctgaacatgcacaggcatacctataagcaaacggatattggtaacatcttctctactcactgtacctgatataccactacataagtgaccagtctagtgattactcttaaaagaaaagctactattatatggtaaaacagggattataaattatatttttgttaatttaccttgcttattcatataatatatatgtatgctaattcgtgag

SEQ ID NO: 5736 - DNA, 994 bp, Amorphophallus konjac
ctatcaatacccgattgggaaaagacgaatgcagccagtgggaatcttagttttgcctctgttatggcaacgctgggtttgcagataattttggagtctgtgcgctcactgatttcagatgaggacgagttcagcttgactaaggagcaagaactctgggtcattgacatcatgctctctgtgactctcgtgaagcttgctctagttctttattgccggtcattcaccaacgaaatcgtcaaagcttatgctcaggaccacttttttgatgttgtcactaacatcatcggccttgtagctgcacttctcgccaattatgtcaaggattggatagaccctgtcggagctattattctggcactatacaccatccgaacctggtccatgactgtgctggaaaatgtcaactcccttgtcggtcgcacagctgcaccagagtacctacagaagctgacatatctgtgctggaaccaccacaaagccgtaaggcacattgacaccgtccgggcctacacatttggctctcactattttgtggaggtggacattgtcttgccgtccgagatgcccttgagggaagcacatgatattggggaggctttgcaagaaaagctcgagttgttgcctgagattgaacgagccttcgtgcaccttgactatgagttcacccataagcccgagcatgcacaagcacatgacgcctagtatcccccaactaaacgctgcttctcctcatatgccctgttggaatgagtgagatgctgatgcagtgtactgttaagctctagtattggtattaggttatgaaaaacgaagtctctttgtcttttatgctttttaccagaaggtagaggttatgattggctgagatcttagccttcagcttgctgttctttgttgccttctgctgtcacgtcgccccgctacaccgactgaaccaagatccgtcgggaccggatctccttgcctgaacttagcccttgtactattatta

SEQ ID NO: 5737 - DNA, 1357 bp, Cirsium arvense
ttttctaagcttttaggtctgtaatggtggaaccaatgagtggtgatgcagatcacggtggcgccgaggaggaatctctgttaacggatgtaaatatcggtggcggaggtactggtggttgcgacggctcatggcggctcaacttcgacgggtttcagttgtcgtcggaacataaagagaaacctcctagaagtctccatgactgccttggggtattagtcccagaagacaatgtagcagagtattaccagcagcaggtagagatgctggagggctttactgagatggataccttagcacagcgtggttttgtacctcgtttgtcagaggaagagaaagcaactttggcaagaagggagacacttgccattagaatttcaaatgttgcaaacatggttctttttattgcaaaagtttatgcatcagttcggagtggttcattggccataattgcatccacacttgactcacttcttgatctattatctggatttatcctatggttcacagcattctcaatgcagactcagaacccctatcaatatccaattggaaagagacgaatgcagcctttgggaattcttgtcttcgcatctgtcatggcaactcttggactgcagataattttggagtctgtgcgcacgttggcatctgctgaaaaggatttcaacttgaccaaagagcaagagcaatgggttgttggcatcatgctttctgtgacattggtgaaacttgtcctgtgtatatattgccgatcgtttaccaacgagattgtgaaagcctatgctcaggatcacttttttgatgtcgttaccaatctgattggcctaatagctgtactgcttgctaattatattagcgattggatggatcccgttggagctataattctggcactttacactatccggacatggtcactgacggtgttggagaacgtaaactcgctagttgggaaatcagccgcaccagaatatctacagaagctgacatacctgtgttggaaccaccacaagtctataaggcacattgacaccgtgcgggcctacacatttggatctcactactttgtagaggtagatatcgttctaccatcagagatgcctctgcagatagcccacgatattggggagtcgttgcaagagaagctggagctgttgcctgagattgaacgggcttttgttcatttggattacgagttctctcacaagcctgaacatgcacagacccatcattaagtcgttctttcaaccaaaccaaaccaaaccaaccgtaagttctccctccctctctctctctctagtctctcacataccttgtctgaatgattctgattttattattatttgctaagctc

SEQ ID NO: 5738 - DNA, 1831 bp, Silene vulgaris
ttagacttgaatcacgacgacaacgacgccgcggaccaacacttactctccgcctcctcctccgtcgacgacaacgttgttctcactaccggtgaccgctcctggcagttaaactttgatggttatcagagatcacctgaccacaatgacaatattcccactactactaaattccatacttgccttggcctttctggtcaagaagatgatgtggcagagtattaccaacagcaagtagagatgttggagggtttcagtgaaatggacgccttggcagagcgtgggtttgttcccggaattacaaaggaagaacaagaaaagttggctaaaagtgagacattcgccatcaggatatcaaatgtagccaacatggttctcttcgttgcgaaagtctatgcatcgatccaaagtggttcgttagcaatcattgcatctactctggattcacttcttgatcttctgtcaggatttattctgtggttcactgcattttctatgtcaacaccaaatccatatcaatatccgattggaaagaaacgtatgcagcctctggggatccttgtttttgcttctgttatggctacactaggcctgcagattatcttggagtcagtgcggcaattattgtctgatgagagcgacttcagcttgaatggtgtacaagaaagttggctaataggcatcatgctgtcagtaactttggttaaacttctattggtcctttactgccgctctttcacaaatgagatagtcaaagcttatgcccaagaccacttctttgatgttattacaaacatcattggcctcattgctgctctcctggccaattatgttagtgactggatggatcccattggagctattattcttgctgtgtacacgatacgcacgtggtcaatgacagtgttggaaaatgtaaattcactagtaggaaaatcagctacgccagactttctacagaaactaacatacctatgttggaaccaccacaaggccataaagcacattgacacagtccgagcatacacttttgggtctcactattttgtggaggttgacattgtcctcccttcaacgatgcctttgcaagaggcccatgacattggtgaatctttgcaagagaagcttgaactgctgcctgacatcgagcgtgcttttgttcatctcgactatgaatacactcacaagccagagcatgctcaagcccatttgtaaatgtttgtggttatgacatcatgatgtggaatctatttttaaattagtatgagtttcagaacaagaggtgaaggatgaaggttttcccgcaagctgatagggaagatagtctatgtagtcttgggagcgaaaaatacacggtaacgaagctgctggtgttatcaagcctacatgggcttacggctgtaaatgttggctaggttgtacttccccgacctccgccaacagtctacgtattccattttcaacttatgttttttttcctcttaatttggcatgtttggtgtggtggtaaactggtaatgaagatcagcctccattgcccacttgcatgttcttacctaaaaatcaaactgaaaccaaatgtaaattattggttcgttgagaggagtatcttgtgagtgctggttacaacttgcaagtgatcttcttgttcaatggtggtagttctgatttctgaactctacccatcaaggttagttatgttttaagcttttactactgttaactgttacttctgcaaggatctctgcggtgaaggttatttattacggactactccctccattcaactccacaaggccactttctttttctacgtttgccaacgcgcgtg

SEQ ID NO: 5739 - DNA, 2181 bp, Aristolochia fimbriata
ccgaagactacccaaattttagttcttcacgcatagcaaaaatcgctgggagtttgtatttttcgtaagggtcctcatttttcttttcattttgttagaaacagcaccagtggggcagtgaatgttacaaaggagacgggcgtatcggaatctcgggtcgttttctgctcctctcggaagctttgcttggtatatacgtcttttcgagctgctgaagcggggactggtgagtggtgatactccagacggcttttgttctgcttcgaatttggtccctctgggttccggctctcggctagtggggaaaatgatgaatccggagcgggcagctgccggggattccgaagattccgaacttctcttgccggagtccggcaacggggagcgatcgtggaggttgaacttcgatgggttccagcggacggagcataaggagaagcctcgcgggcttcacgactgtcttggtgttttaggtgcagaagatgttgtggctgagtactaccaacagcagggggaaatgttggaaggattcactgagatggatacattagctgaccgtggttttcttcctggaatgtcaaaagaagagctggaaagaactgctaagagtgagagaatggccattaggatatcaaatattgcaaatatggtcctttttgctgcaaaagtatatgcatcgtatagaagtggatccctggctatcattgcatccacactggattcacttcttgatctgttatcaggttttatcctatggtttacagccttctccatgcagacgccaaacccctaccagtaccctattgggaaaaaacgcatgcagccactggggatccttgtttttgcttctgttatggcaaccctgggtctacaaataattttggagtcagttcgcacacttttttctgatgataatgaatttgaattgagtaaggagcaagaaaaatgggtgattgacattatgctgtcagtaacccttgtaaaacttgcgctggttgtttattgccgctcttttaccaatgagattgtcaaagcttatgctcaagaccacttctttgatgtggttaccaaccttattggacttattgctgctctgcttgcgaagtacataaaggactggattgatcctgttggtgcgatcattctggctctgtacaccataagaacatggtcagcaacagtactggagaacgtaaactctctggttggccgagctgcaacgccagagtatcttcaaaagctcacatacctctgctggaaccatcacaaggccattaggcacattgatactgttcgagcttatacatttggttcccactactttgtagaggttgacattgtcttgccttcagagatgccactgagagaggcccatgacatcggggaggccttacaggagaagctcgagcaactgcctgagatagagcgtgcctttgttcaccttgactacgaatatacacacaagccagaacatgcacaagcacacttgtagatgcaaataaaataccaactacagtcactaatgaaggctctcggtggtttgcctcttaaatatgagcaccttgaagttccagccacggcacttgttttccttgcatattttgtaccaaatataatgatgctatgggcacctacgaatgaattgagcgcagtgcaaggttcgaagatacacctgcgtagcaagagtgctggagtagcagccgtgtggctaaggactgggtatcagccgtgtggctaaggactgggtatcagccgtgtggctaaggactgggtatcagccgtgtggctaaggactgggtatcagccgtgtggctaaggcctgggtatcagccgtgtggctaaggactgggtatcagccgtgtggctaaggactgggtatcagccgtgtaattagtagtaaaggattgatagttggccgaagggttgagttccgttcttaagacatgtcgcctttggcatggcattccgtggtaaagtttttattgatgtctcgttcgatgcacaatagacttcggccagctatcacgtaactagaatcccggatttgtagtaaatgtttatttggccatgaagcaggattataaaaaatctgatgcaaagtggacgttcatttatttggttttaccagactagtaagggtttcattggcttctttcattcttaaagtcggatgcgttgtta

SEQ ID NO: 5740 - DNA, 1781 bp, Vitis vinifera
ccccttcctcttcttctggttcgagaggttgagcctacttcgtccacaacaacgtgaacatatccccagaatgcccctttgcttccattaaattttcaagctataccatacgcccctagtcgccgcaaaatggtggaaccagtgatactcgacggcgatctcgacgggtccgaggaactcctcctccggccaacgcccaaaaatggcgaccgctcgtggcggctgaacttcgacggttttcagttgtcggagcacaaggagaaaaagccgcctcgtagcctccatgactgtcttggagttttggctcctggtccagaagatgatgtggctgagtattatcagcagcaggtagaaatgctggagggctttaatgaaatggatgccttggcagagcatggatatattcctcgaatgacagaggaggaaagggaaaagttggctcgaagtgagacaactgccattagaatatcaaatattgcaaacatgattctttttgctgctaaggtttatgcatccgtcatgagtggttcgttggccatcattgcctctacactggactcacttcttgatcttctttctggcttcattctgtggtttactgcattttccatgcaaacaccgaacccatatcagtaccccattggaaagaaacgtatgcagccattgggaatccttgtttttgcttctgttatggcaactctgggactgcagataatcttggagtcagtacgcacactatcatctgacgaagctgaatttgatttgaccagagagcaagagcaatgggtaattggcattatgctctcagtgacattgacaaaactcattcttgctgtctattgccgcgctttcactaacgagattgtcaaagcatacgcccaggatcacttttttgatgttataaccaacattattggcctcattgctgtactccttgccaattatatcagcgattggatggacccagttggagctatcattctggccttgtacaccatccgcacatggacattaactgtgttagaaaatgtaaactccctggttggaagaacagctgcaccagaatatctgcagaaactcacatacctctgctggaaccaccacaaggccataaggcacattgacacagtccgagcctacacgtttgggtcacactacttcgttgaggttgacattgtcctgcctgcaaacatgccactgcaagaggctcatgacattggggaatccttgcaggtgaagctcgagctcctacctgagatcgagcgtgcctttgtccatcttgattatgagtacagtcacaagcccgagcatgcacaaacatcctcgtagctgggaagtctccctgtttcattcctgtcatttttctcacgttcccaccctaaaattcttctgaacggccagcagaattaatgggcgtggggacatatgattagcaagggtcatatgcgaatgcgtctgtatgtatcgaatatatgcagaagatacattccacttggtgctgaccaacagattagtacgttaatggagttgtgtgctttactttgtgaaacaacgtttattggttacacaaggggaggggggaaatcagtcgggttcagccattttgtgagctagagaagtttagatgggctgactcttagtgccgggtgggtgggtaggtaagcaggcgtcttgtagttgtggccagggtaggtacgaggagttggtgataagcatgagcgtcttggaatttccactggggcgatcatgggcgttttattttttctgaaaatagtcattct

SEQ ID NO: 5741 - DNA, 1508 bp, Vitis vinifera
gtccacaacaacgtgaacatatccccagaatgcccctttgcttccattaaattttcaagctataccatacgcccctagtcgccgcaaaatggtggaaccagtgatactcgacggcgatctcgacgggtccgaggaactcctcctccggccaacgcccaaaaatggcgaccgctcgtggcggctgaacttcgacggttttcagttgtcggagcacaaggagaaaaagccgcctcgtagcctccatgactgtcttggagttttggctcctggtccagaagatgatgtggctgagtattatcagcagcaggtagaaatgctggagggctttaatgaaatggacgccttggcagatcatggatatattcctcgaatgacagaggaggaaagggaaaagttggctcgaagtgagacaactgccattagaatatcaaatattgcaaacatgattctttttgctgctaaggtttatgcatccgtcacgagtggttcgttggccatcattgcctctacactggactcacttcttgatcttctttctggcttcattctgtggtttactgcattttccatgcaaacaccaaacccatatcagtaccccattggaaagaaacgtatgcagccattgggaatccttgtttttgcttctgttatggcaactctgggactgcagataatcttggagtcagtacgaacactatcatctgacgaagctgaatttgatttgaccagagagcaagagcaatgggtagttggcattatgctctcagtgacattgacaaaactcattcttgctgtctattgccgctctttcactaacgagattgtcaaagcatacgcccaggatcacttttttgatgttataaccaacattattggcctcattgctgtactccttgccaattatatcagcgattggatggacccagttggagctatcattctggccttgtacaccatccgcacatggacattaactgtgttagaaaatgtaaactccctggttggaagaacagctgcaccagaatatctgcagaaactcacatacctctgctggaaccaccacaaggccataaggcacattgacacagtccgagcctacacgtttgggtcacactacttcgttgaggttgacattgtcctgcctgcaaacatgccactgcaagaggctcatgacattggggaatccttgcaggtgaagctcgagctcctacctgagatcgagcgtgcctttgtccatcttgattatgagtacagtcacaagcccgagcatgcacaaacatcctcgtagctgggaagcctccctgtttcattcctgtcatttttctcacgttcccaccctaaaattcttctgaacggccagcagaattaatgggcgtggggacatatgattagcaagggtcatatgcgaatgcgtctgtatgtattgaatatatgcagaagatacattccacttggtgctgaccaacagattagtacgttaatggagttgtgtgctttactttgtgaaa

SEQ ID NO: 5742 - DNA, 1226 bp, Cirsium arvense
actgccttggtgtgttagttccagaagacaatgtagcagagtattaccagcagcaggtagagatgctggagggctttactgagatggatgccttggcacagcgtggttttgtacctcgtttgtcggaggaagaaaaagcaactttggcaagaagggagacacttgccattagaatttcaaatgttgcaaacatggttctttttgtcgcaaaagtttatgcctcagttcggagtggttcattggctataattgcgtccacattagactcacttcttgatctgttatctggatttatcctatggttcacagcattctcaatgaagactaaaaacccctatctatatccaattggaaagagacgaatgcagcctttgggaattcttgtcttcgcatctgtcatggcaactcttggactgcagataattttggagtctgtgcgcacattggcatctgatgaaaaggatttcaacttgaccagagagcaagagcaatgggtcattggcatcatgctttctgtaacattggtgaaactcgtcctgtgtatatattgccgctcgttcaccaatgagatcgtcaaagcctatgctcaggatcacttttttgatgtcgtcaccaatctgattggtctaatagccgtactgctggctaattatatcagcgattggatggatcctgttggagccataattctggcgctttacactatccggacatggtcaatgacagtgttggagaatgtaaactcgctagttggaaaatcagccgcaccagagtatctacagaagctgacatacctgtgttggaaccaccataagtctataaggcacattgacactgtgcgggcctacacgtttggatctcactactttgtagaggtggacatcgtgctaccatcagagatgcctctgcagatagcccatgatatcggggagtcgttgcaagagaagctggagctgttgcctgagatagaacgggtcttttgttcatctggactacgagttctcgcaacaaacccgagcatgcacagacacatcattaagtcattctttgaaccaaaaccacctgtaagttctctatctctctctcatacaagtatacgatcgtctgattgatttcttttgatattatttgctaagctcctttatttatgtgtggagctgatatatatagtgtataatgatgctattgacttcttttatgataatgaatgtgaaagtagatcatca

SEQ ID NO: 5743 - DNA, 1465 bp, Eucalyptus grandis
ggccgtttcgttattgggtgttttgtttttctgttgataaagttgccgcacttggaatttcccccccggggtcaacttcatagttctgtgtcatatggttgatgggttttgtttaaggagaaggaaaatggtttgtgccttgggtaaaatctgggttcttcctgcggctgaggcttgatttgctataggtcctgaagataatgtggctgagtactatcaacagcaggtagaaatgcttgagggatttaatgaaatggatacactagcggagcgaggtttcgttcctggaatgtcaaaggaagagcgtgagaagttggctaacagcgaaacatttgccattagaatatcaaatgtcgcaaacatgtttctctttgctgctaaagtttatgcatctattcaaagtggctcattagccataattgcatccacactggattctcttctcgatcttttgtctggatttatcttgtggttcactgcattctccatgcaaacgcctaacccatatcattatcctataggaaagagacgtatgcaaccattgggtattcttgtttttgcatctgttatggcaacattgggtttgcagataattctggagtcagtgcgccagcttctgtctgatgaagctgaattccatttaacaaaagagcaagagaaatgggttgtgggcattatgctgtcagtgaccctggttaaactgttactggttgtctattgccgatctttcactaatgagattgtcaaagcttatgcccaggatcactttttcgatgtcatcactaacatcattggcttgattgctgcactgcttgctaattattttgatgactggatggaccctgttggggctatcattctggccttgtataccatccggacgtggtccatgacggtgttggaaaatgtgaactccctcgtggggagagctgctgccccagagtttctgcagaagctcacttatctctgttggaaccatcacaaggcgataaaaaaaatcgacaccgtccgggcttacacttttgggtcgcactactttgttgaggtcgacatcgttctgccctccaacatgcccttgcaagaggctcacgacatcggggaatccttgcaggaaaagctggagctcctttccgagatcgagcgtgcatttgtccatctcgactacgagtactcccacaagccagagcatgcgcaagctcactcgtagcagcatccgccatgtccgtgtattaactttttacttttggccctgaataactgcctcctctcctgaaacgcgattttgctgtcgggagaaaaacaatgaggactaatgtcataggatgatgtattactgatatgatgctggggcgtacctctacattcgagccgtgatggtgacaaattaggtctaattctgcactcgaatttaccggtattgtttcccaagaggaacgaaagacccttctcaaagctagggttctgg

SEQ ID NO: 5744 - DNA, 593 bp, Sarracenia psittacina
accctgttggagctatcattctcgccttgtacactattcgcacgtggtcattaaccgtgttggacaacgttaactcccttgcgggcaaatccgccgccccggaatatttgcagaagctgacatacctctgctggaaccaccacaaggccattaagcatatcgacactgtccgggcctacacgtttgggtcgcactacttcgtcgaggtcgacattgtcctgccggcagacatgcctttgcgagaggcccacgacattggagaggctttgcaggaaaagctcgagctcctccccgagattgagcgtgcttttgttcatctcgattacgagtactctcataaacccgagcatgcacagacacattctttaacactaagactacaatgaagtcttcccctgtaagttttttgatgcaaaaggaagcttaaggtcttcttggcttatgttagaatattaaaagttaatagtaacatattgtgggcacgccacttcagcagccagtaatcacttttgaaaaaggaaattggaggggacatataccaaactagtcgtgattatataatttattaaattcctaaatcattttacaataga

SEQ ID NO: 5745 - DNA, 1438 bp, Amaranthus tuberculatus
gggtgaactttgatggctatcaattgtctactgagtataaggagaaaccgtctcgtaaactccatgactgtcttggagttttagggtcagaagatgatgtagctgagtattatcagcagcaagtagagatgttggagggtttcagtgaaatggatgcccttgctgagcgtgggtttgttcctgggatgtcaaaggaagaacgagagaagttagctaatagtgaaacatttgccatcaggatatcaaatatatgcaatatggttctttttattgcgaaggtttatgcatcggttcgaagtggttctttggcaattatcgcatccacgttggattcacttcttgatcttctatcgggatttatactgtggttcactgcattttctatgtcaactcctaacccatatcaatacccaattggaaagaagcgtatgcaacccctggggattcttgtttttgcttctgtcatggctacactagggctgcagattattttggagtcaagtcggcagcttctatcagacgagagtgattttagcttgaatagtgaccaagaaagatggcttgtgggcatcatgttgtcagttactttggttaagcttctactagtcatgtactgccgctctttcaccaatgagatagtcaaagcttatgcccaggaccacttctttgatgttattaccaacattattggccttattgctgctctcttggctaattatgtcagtgactggatggacccagttggagctatcattcttgctttgtacacaatacgtacatggtccatgacagtgttggaaaatgtaaactccttagtcggaaaatctgctaccccggacttcctgcagaaactaacatatctctgttggaaccaccacaaatccatcaggcacattgacacggtccgagcatacacttttggatcacactattttgttgaggttgacatagtattgccggcaaacatgcccttgcaagaagcacatgacattggcgaaacattgcaggagaaaattgaacaattgcctgacatcgaacgagcttttgttcatcttgactacgaatatactcacaaacctgagcatgcacaagcccatctatagatgtttgtggctgaatatattattgtctgccggagtttatgttatgtaaaaatgtgggattggtaaggcaattgaaatctaagcaagccatggataatagtagtaatttgcagtgggtttttgggcatattattaaggaatataaaacccatggtatgtatagatgatgctttaattccaagatgatctgaagcaaagagtgttagtttggtttgagttacttaatactcctaatctatatgattaagttatttgtcctgtaactctttgagtattcctaactattatattaaactcctttccggttagtgatatcttggttgttagttcaccta

SEQ ID NO: 5746 - DNA, 1541 bp, Artemisia annua
tactccgacggggctgtttaaaccaacaaccaccaccaaccaaccacccaccatatttcaaaacacctcaaaaccctaaccctagcctttcactatctcaacaaacaatggtggaaccgttgaacattgagagcagcaactaccacagtgaagaagaggaaaagtttctattgacggaagtcaatatcggcggcggcggtggcggctgtgacggatcatggcggctgaactttgacggttatcaggtctcttcggaacataaggagaaggcgccacgtggcttgcatgattgtttaggagtgttagttccagaagacaatgtagcagagtattatcagcagcaggtagagatgcttgaaggctttactgagatggatgcattagcagagcgtggttttgtgcctcgattgtctaaggaagaaaaagagagtttgcaaagaagggagacacttgccattagaatatcaaatgtggcaaacatggttcttttcgtggcaaaagtttatgcgtccataaggagtggttcattggccataattgcgtccactttagattcacttcttgatttgctttcaggatttatcctttggtttacagcattctccatgcagacaaagaacccctaccagtatccaatcggaaagagacgaatgcagcctctgggaattcttgtctttgcatctgtcatggcaactcttgggctgcagataatattggagtctgttcgcacgcttgcgtctactgaaaaggattttaacttgaccaaaaatcaagagcaatgggttgttggtatcatgctttctgtgacattagtgaaacttgttctgtgtatatattgccgctcatttaccaatgagattgtcaaagcctatgcccaggaccacttttttgacgttgtcaccaatctgattgggctaatagctgtactacttgctaattatattagcgactggatggatcctgttggagctataattctggcgctttacactattcgcacatggtcactaacagtgttggagaacgtaaactccctagttgggaaatcagcagcaccagaatatctacaaaagctcacctacctttgttggaaccaccacaagtcaataaagcacatcgatacggtaagagcttacacatttggttctcattactttgttgaggtagacatcgtcctaccatcagacatgcatctgcaaatagctcatgatattggggagtccttgcaagagaagctcgagcaattgcctgagatagaacgtgcttttgttcatcttgattatgagtactctcacaaacccgagcatgcacagactcaccattaacaaattcagtcattatttgagcaactccatggtcaaccattgaccacctgtaagttcttgcacatcacttgttgtcgcctgtttcttttggcgtgtaaatcactaatggcgatttatgtatctgatgagccctgtctatgtgagatcagtggttgtggagctattgaagtgtataatgttattttacaatgaatattaagtaggtcatgagtttct

SEQ ID NO: 5747 - DNA, 2960 bp, Pseudotsuga menziesii
gagctttaaagaatgaattattcagctaaacatttactagacaaaaggatgacaagccaagactaaccaacatttcaagaagaaaagtacttgcttctaactgagtccattttacaaagaccaagttgttaagaagtctctacatacattctttgttgatttctgtatgcaattttccaggatgtgccaacttgtaggcaaaatggggttctacaagccccacaatattgctttaccatcacatcctaagatgataatgttggcaatcggagactaaaagaagatctgaacggcagattatgaagttcccattataaaatatgacacttgcatacagagttaggagtagcttttcccatgctcaggtctgtgactgtattcatagtctaaatgcacaaaagcccgttctatctcaggaagagattccagtttttcctgaagtgcttcaccaatatcatgagccttttgtaaaggcatatcactgggtaacacaatgtctacctcaacaaaataatgagaaccaaatgtgtaagctctcactgtatcaatatgccgtatggctttgtgatgattccaacagagatatgtcaacttctgcaaataatcaggtgaagctgttttcccaaccaacgaattcacattttccaaaactgtgctcgaccatgttctgattgtgtagagagccagcacaattgctccagcaggatctatccaccagtatagagtacttgcaagaatagcagcaattagaccaattacattggtgattacatcaaagaagtgatcttgtgcaaatgccttgacaatctcattagtaaaacttcgacaatacattacaaggaacaacttcacaagagtcactgaaaccatgattccaaccacccaatgccatttgtccccttctaaagataaaccatacccattggacataagctgtcgaatagactctagcaaaatctgtaatcccaatgtagccatgactgaagcaaaaaccagaattcccaatggctgcatgcgtttcttcccgattggataaaggtaaggatttggtgactccatcttaaatgcagtgaaccaaagaataaagcctgataaaagatccagaagcgagtctagagttgaagcaattatggctaacgagccactctttattgatgcatatactttcgcaatgaaaaggacaacgtttgctatgttagataatcgaattgcaattgtctcacttcttgcaaccttgtcgcgatcttccttggataagccaggtaaatatccacgctcggcaacagtatccatttctgtgaatccctcaagcatctcatcctgctgctgataatattcagtcactccatcaccactactaggaccgagcacactgaagcaatcctggaggcagcgttgttgaggcttttcatccctttcaaacctgggaatcctactgaaactcaaacgccatgcattctcttcgctgggctcggccttctcggcgttcgaaagcaggatctcggtagcgtcttctgacatcgcagaggtcagaggttccgccattgttggttggatcttgaagaagagccgcagcgagagcaataacgcaagcagaggagtttgctgaagatctgttgtaacaatggggggtggtggaaggatgaacttgcctgggaataaagatgtaatggagcgagcgcctagtgcaaagcctccctttacattcggagaagtgaagaaagccattccgcctcattgtttcaatagatcactggtcagatcattctcatatctggcatttgatcttgttattgttgcgttgctgctgtattcgacgacttactacttcacaatgtcaggagttctgggatgggttctctggcttgggtactgggcagctcaggggagcgtgctcactggtgtatgggttatagcacatgaatgcggacaccatgcattcagtgattactcttgggtcgatgacactgttgggcttattcttcactcttgccttcttgtgccctatttctcctggaaatacagccatcgaagacatcacagcaacactgggagcctagaacgcgatgaagtttttgttccaaagccaaagactgatatcaaatggacttccaagctttcatctaaccctccaggaaggttgctgacaatagcaattacccttaccctaggatggccattgtatctggcattcaatgtttcaggaaggaagtatccccgttttgccaaccactttgatccatatggcccgatttacaacaaccgagagagattgcagatactggtcagtgacatcgccttgctggcagtggcatatgctctgtacctctgtggctctgcatatggattttcttcgttgataaaggtctatgccatccctctcttgattgtcaatggattccttgtactcatcacctatctgcagcacactcatccctctcttgcccactatgacagctcagagtgggagtggctgaggggtgcactcttaacaatggacagggattttggaatcttgaaccatgtattccaccacataactgacacccatgtagcgcaccatctcgtctccacgatgcctcattaccatgccatggaggccaccaaggctatcaaaccaattctgggtaactattattgttatgacagtacgcctgtttacaaggctgtctggcgggagtttagggaatgtgtgtatgtagaagcagattcccccaaaaaaggtggggtcttctggtataaaaacaaattcacttaataccaccgccaggcagagtagttaggtgcactttctccatcaatgcctctcgttagggaatctgagcatcatgtaggtcatagatgtgtttcagcaacgagtgctgttttctgttttcttttgcaaaaaaatgatgtggacatgaacaaaacctataaaatgggttttcatgtgagaatcattctattgaaatgataatggc

SEQ ID NO: 5748 - DNA, 1404 bp, Cedrus atlantica
cctgacctccgctctgtcagaagatgggaccgagatcctcctctcaagcaccgagaaggccgagcccagcgaggagaatgcatggcgtttgagtttcaataggattccgaggcttcaaagggatgaaaagcctcaggaacctggcctccatgattgcttcagtgtgctcggtcctagtagtggtgatggagtggctgaatactatcagcagcaggaagagatgctcgagggattcacagaaatggatacagttgctgaccgtggatatttgcctggcttatccaaggaagagcgtgacaaggttgcaagaagtgagacaattgcaattcgattatctaacatcgcaaacattgttcttttcattgcgaaagtatatgcatcaataaagagtggctcattagccataattgcttcaactctagactcgcttctggatcttttatcaggctttattctttggttcactgcatttaagatgcagtcaccaaatccttacctttatcccattgggaagaaacgcatgcagccattgggaattctggtatttgcttcagtcatggctacattgggattgcagatcttgatagagtctattagacagcttatgtccaaggaggatggtttatctttagaaggtgacacatggcattgggtggttggaatcatggtttcagttactcttgtgaagttgttccttgtaatctattgtcgaagttttactaatgagattgtgaaggcatttgctcaagatcacttctttgatgtgatcaccaattcaattggtctgattgctgctgtccttgcaagtaagctatactggtggatagatcctgctggagcaattgtgctggctctctacacaatcagaacatggtcaagcacagttttggaaaatgtgaattcgctggttgggagaacagcttcacctgattatttgcagaagttgacatatctctgttggaatcatcacaaagccatacggcatattgatacagtgagagcttacacatttggttctcattattttgttgaggtagacattgtgctacccagtgatatgcctttacaacaggctcatgacattggtgaagcacttcaggaaaaactggaatcccttcctgacatagaacgggcttttgtgcatttagactatgaatatagtcacagacctgagcatgcgaaaagctactcctaactctgtatgaaagtgtcatattttctaataggaacttcataatctgcttttcaggttcttttttagtttcctagtgccaacaatatcattagatttgatggtaacgatatcccctcttgacctacaagtcagcagattttgctctgggagatttgcatgcagaaatcagcaatgaatgtatgttgagactccttaacaacttggtctct

SEQ ID NO: 5749 - DNA, 1180 bp, Fagopyrum esculentum
gacatttgcaattagaatatcaaatgtggctaacatggttcttttgctgctaaagtctatgcctcaatcagaagtggttctcttgcaattattgcatccacgttggattctcttcttgatcttctttctggttttatcctgtggttcactgcattttccatgtcgacacctaatccatatcagtatcccattgggaagaaacgtatgcagccattgggaattcttgtatttgcttccgtgatggctactttagggctgcaaattatattggagtcactgaggcagctagtatctggtgaacacgggttttccctaagtaagaccaagagggatggctggttggaattatgttgtcggtgactgtggtgaaacttctcttggttctttactgccgctccttcactaatgagattgtcaaagcttatgcccaggatcattttttcgatgtaatcaccaatgttattggactcattgctgctctcctggccaattcttttagtgactggatggaccctgttggagctatcattttagcactgtacacaatccgaacctggtccatgactgttctggagaacgtaaactctctagttggaagatcagccactccagatttcttacggaagctgacatacctgagttggaaccaccacaaagccataaggcatatcgacacagtcagggcatacacattcgggtcccactactttgtggaggtagacatagtcttgccagctagcatgccccttcaagaggcacatgacatcggggaatccctgcaggagaagctcgagcagctacctgaaatagagagagcttttgtgcatctcgactatgagtacagtcacaaacccgagcatgctcaagcctatttgtaactgaaaacagggtaagtaaggtttaatcacacagtgaactgtactcatagttgatgctcaagcctatgcccagttaattcgatctctcgaggttgtgcaaaagctttgcctataaggttggtgttgctttggtgattttcttatggtttgtgtatggattgactcgggtgatattatagtttgggcgtcttatgggctgtccctttactactcgaaacgggaaataagtctgctcgagtttgatttgcacagttgtcattgtttaatgtacgagtatacgatgaagggatgacgccaatgac

SEQ ID NO: 5750 - DNA, 1266 bp, Gossypium hirsutum
aggtaactccggtaaaacgctctccttttcttttatttcgtatttataaaaaaatatacaaaataaataaactaaagataacaaaagataaaatgaataacatgaaaatcaccttaaagcttatatcttttgtttttctatcctttctcttccttttttcttcctgttacattttctatctttggccctatatatccgaatacatgccattatcttttcttatttctatcatctatctttgtgtatcgtggtctccctttttctttgatttgtttgcaggttacaaattagcggcggtgacagagggtcggtgcagagagcagttggccgacagtcaggggcaagtggggcgtcggctgaacttaggggctagggtttcttgatttgtttggttattgggctaggttaagtttaggttttgggctagtagtatttgggctaggggatttaattagaattgggcttgattattgggctccgggtatgggttgttggcattatgcttggagtgactctgacaaagcttctcctcatgttctattgccgcacatttacaaacgaaatcgttaaagcttatgctcaggatcacttctttgatgttatcacaaacatcattggccttgttgctgtgctacttgctaagtacatcgacgattggatggaccctgttggagctatcattctggctttgtacacaatacggacatggtcgatgacagtattagagaacgtgaactcattggttggaagatcagcagctccagaatatcttcagaaactgacctatctgtgttggaaccaccataaggccataaagaacatcgatacggtccgagcttacaccttcgggtctcactactttgtcgaagttgatattgtacttccggcaaacatggcattacaagaagctcatgacattggagaatccttgcaagagaaactggagttactgcccgacattgagcgagcgtttgttcatttggattatgaattcagtcacaaacctgaacatgcacaggcacatgctctgtaggtagccattaacctatggtttgtccggttgggctagtaagttagaatgtttctacctacaaattctatggcctatgtatggttggaactcgaggtttagtttagtttagttagttcatgtactgaacctcggcttctaacaagtctagagttcgagtttctgtattttcagtaaaaaagaatcaactgagagtaaaacaagtaaaggtaaatattggtaaatgcagatcttta

SEQ ID NO: 5751 - DNA, 1931 bp, Gnetum gnemon
ggtatagtgcgtaccttttcgtgatcattgtgaaacggatgagcagcgccatccatattgatgtcatattgtgcaccagattacgggtatccgcgattgtgctctcggtcggtttctacggcagcagcagcaaaaacagagattcgatgatatcacaaaagaattctgtgagtgctgctacgtcatttcctgcaacagaaattcaaaagaaatctgtgttggggtaatcgcttttcggagagagagagagtgttgtttacaaaaggcgagagtagcatcagcagccatggcagcagaggctggctcatcggacgttttgctttcaatggaggaggtcgatctgcataacaataacaacggcaacggatggcgactcaacttcaccagagttccacggccggagaagcacgaggacgcctgctttcaaggtccttgttcgcaagtctgttgcctgcgtgtgcttgttccaagcagcaatggagtggctgagtattatcagcaacaggacgagatgcttgaaagctttactgaaatggatgctattgctacccatggcttttcacctggcctgtcaaaggaagagcgtgaaaagattgcaagaagtgagaagatggcaattcgcctgtcaaacctagcaaacattgtgttgtttgtggcaaaagtatatgcttcagtgaagagtggctcattagcaataattgcttcaacccttgattcacttctggaccttttgtctggttttattttatggtttactgcattcaaaatgcaatcaccaaacccttatctttatccaattggaaagaagcgaatgcaacctttgggaatactggtttttgcttcagtcatggctacattgggattacagatacttctggaatctcttaggcgactcatttcaaaggaccatggcttatctttggacggagaaaaagggcgatgggtcattggaatcatggtttctgtcactgttgtgaaattctgtcttgtaatttactgccgaagcttcactaatgagattgtgaaagcatatgctcaagatcatttctttgatgtaattacaaatgccattggactagctgctgccctccttgcaaacagtttcgattggtggatagatcctgctggtgccatagtgttggccttgtacaccataagaacatggtcggtcacagttttggagaatgtcaactccttggtaggtaaaacggcatctccagaatttctgcagaagctgacgtacctttgttggaaccatcacaaatccattcggcatatcgacaccgttagagcttacacatttggatcacattattttgtcgaggttgacattgttctacccagtgacatgccattacaagaggctcatgatattggtgaagctcttcaagaaaagcttgagacccttccagacatagaacgtgccttcgttcacctagatcatgagtacacgcacaaacctgagcatgcaaaaacatacacatagttcttcgtttaaatagaatggtgctgtttaagtttaagatggtgtattgaagattgaaggtacgttttaagggttgacagtgcacaatttccatgaacaattctcattatctacatgggaacgagctgattgatggtggggagctattttgcttttggaatgggcttcatgtcagcatttacctaccaagagttatttagataattacgttttatctgggattaatcctggttgttaacttttttttctgcgagcgatgaaaaaattgctctatattctggtgatacacgaatccataaacagtgatgcattaaagtcttttaacagcaacatgctttgattaacatagattgtggttgctgaagtatacgactgcatccggtatgaagcttgtaaagaaacctagcaatggttgttttggaaagtataacctatcttgctatac

SEQ ID NO: 5752 - DNA, 1473 bp, Oryza sativa
atggctgccgcggcgggggtggctgctggaacgggaagaggtagcggggagggagaggagctgctccccaacgccgtggagggagacggcggctgcggcgggggcggcacgtgcgcgggggaccgcccgtggcggctcaacttcgacggcctccgccgcccggaggcgcaccaggagaagccgccgcgccgcttccatgaccgcctcggagggctagctgaagatattatattgaaaggcggaaagcgtacacatcctgagacctgttttcttaagaaattgttgtacccttttgatgctgtgctcaggaatctggatatttcagttcaaagccctggagatgatgttgcagaatattaccagcaacagtcggaattgttggaaggttttaatgaaatggatacactcacagatcgtggttttcttcctggaatgtccaaggtctacattcttgctctagaagaatgtgaaaaagttgccagaagtgaggcattagccatccggttatctaatatagcaaacatggttctttttgctgcaaaagtttatgcctcaataaggagtggttctctagctataattgcctccactttggattctctacttgacttgttatcaggttttatcttgtggtttactgccttttcaaagaaaacatcaaatccatacaggtacccaattggtaaaagacgcatgcaacctttgggaatacttgtttttgcttctgttatggcaacgcttggccttcaaattatcctagaatctacacgctcattgttttatgatggggatactttccgcttgacaaaagagcaggagaagtgggttgtggatatcatgctttctgttacatcggtgaagctcctactggttgtatattgccgttcattcaccaatgaaattctggcgatctacacaatcagaacatggtcaatgacggtgctagaaaacgtccactccttggttggccaatcggcttcaccagagtaccttcagaagcttacctacctgtgctggaaccatcacaaggctgtcaggcacatcgacacagtgcgagcatatacattcggctcccactactttgttgaggtggatattgttctgccatgtgacatgcccttgcaggaagcgcatgatatcggcgaggctccgcaagagaagctggagagcttgcccgagattgagcgggcttttgtccatctcgactacgagttcacccaccagcctgagcatgctcgatcccatgatacattatagcagtccgaacttcagagaacccaagttgaaattattgaagccatttcagtttcacaaatttgggagtagccaacatgcttcgacacattgcttattttagatgcgttgttttttttttttggtgtggctaggaatcatatctgtgcctgtgggcgtgtaggggatgactggatgggtggcattggcaatgtttgaatcaaatgattgatgagatga

SEQ ID NO: 5753 - DNA, 776 bp, Sequoia sempervirens
tcagttatggctacattgggactgcagatcgtgctagagtctgctcgacaacttgtttcaaaggagcaaggtttatcgttagaaggagatagttggcagtgggttgttggaattatggtttcagtcactcttgtgaagtttgtccttatgatctattgccggacttttacaaatgagattgtaaaggcatatgcacaagatcatttctttgatgtcatcaccaattcaattggtctctttgctgcagttcttgcaagtacattgtactggtggatagatccagctggagcaatagtgctggcactgtacacaatcaggacatggtcgaacacagttctggagaatgtgaattctttggtgggtaaaacagcttcacctgattatttgcagaaattgacatatctctgttggaatcatcacaaagccatacggcatattgatacagtcagagcttacacatttggttctcattactttgttgaagttgacattgtgctacccagtgatatgcccttgcaacaggctcatgacattggagaagcgcttcaagtaaaattggaatctcttcctgacatagaacgggcttttgtgcatttagactatgaatatactcacagacctgagcatgggaatgggcattcctagttgtttatgatgggttgtatactttaactaacattcccagtgttttccaccttttatgtaagccttttattgccaactgatatccctcttccaacatatgtagtcactatcaatgcctagtaatttgtagc

SEQ ID NO: 5754 - DNA, 1813 bp, Picea glauca
ttggtggtagcccagctgtttacatgccaaccctctcacattttcttggacactccaaaagaaaccttatgccagggaccattttattttcatttaatcccacttctgccagcatacccactgcgatcatgcgatcatgtgatcacatccgttggcccttcatgctcacaaacgatgctatcaactacccaacatcattaataatgcgaacgaaactctacacatacattttctgaagctcagggatcactgcttctcctcaatcccccaaaaaatataatggcggaacccctgacctccgctctgtcagaagatgggaccgagatcctgctttcgagcgccgagaaggccgagcccagcgaggagaatgcatggcgtttgagtttcaataggatttcccagtttgaaagggatgaaaggtctcaacaacgcggttttcatgattgcttcagtctgctcggtcctagtagtggtgatggagtggctgaatattatcagcagcaggaagagatgcttgagggattcacagaaatggatacagttgccgagcgtggttattttcctggcttatccaaggaagagcgtgacagggttgcaagaagtgagacaattgcaattcgattatctaacatagcaaacattgtccttttcattgcaaaagtatatgcatcaataaggagtggttcgttagccataattgcttcaactctagactcgcttctggatcttttatcaggctttattctttggttcactgcatttaagatgcagtctccaaatccttacctttatcctattgggaagaaacgcatgcagccattgggaattctggtttttgcttcagtcatggctacattgggattgcagatcttgttagagtgtattcgacagcttgtatacaaggaggatggtttatctttagatggtgacaaatggcattgggtggttggaattatggtttcagttactcttgtgaagttgttccttgtactctattgtcgaagttttactaatgagattgtgaaggcatttgctcaagatcacttctttgatgtgatcaccaattcaattggtctaatcgctgctatccttgcaagtacattatactggtggatagatcctgctggagcaattgtgctggctctctacacaatcagaacatggtcaagcacagttttggaaaacgtgaattcattggttgggaaaacagcttcacctgattatttgcagaagttgacatatctctgttggaatcatcacaaagcaattcggcatattgatacagtgagagcttacacatttggttctcattattttgttgaggtagacattgtgctacccagtgatatgcctttacaaaaggctcatgacattggtgaagcacttcaggaaaaattggaatctcttcctgacatagaacgggcttttgtgcatttagactatgaatatagtcacagacctgagcatgggaaaagctactcctaactctgtatgtaagtgtcatattttataatagaaacttcataatctgattttcaggtcttcttttagtctcccattgctaacattatcatcctaggatatgatagtaaagcaatattacgggacttgtagatctcccatcttgacctacaagttagcagattttgctatgggaaaattgcatacagaaatcaacaatgaatgtatgttgaaacttgggttctgtaaaatggcttcgctaaaagtgagtaattttcttcttgaaacatttgttgtcttgacttgtcatccttttgtctagtaaaagcttagctgaataatttatttctta

SEQ ID NO: 5755 - DNA, 883 bp, Triticum aestivum
acgcttggccttcagatcatcttagaatcaactcgatcactgttgtctgatggtggtgaattcagcttgacgaaggagcaggaaaagtgggttgtggacatcatgctctcagtgacgctggtgaaacttgccctggctttatattgccgcacgttcaccaacgaaatcgtcaaggcttatgcgcaggatcacattttcgatgttatcactaatataattggccttgtggctgcactgctcgcaaattattttgaaggatggatcgacccagttggtgcaattattctagcaatctacaccatcaggacatggtccatgacggtgctggaaaacgtacactcgctcgtcgggcagtcggcttcgccagagtaccttcagaagctgacctacctttgctggaaccaccacaaggccgtgaggcacatcgacacggtgcgtgcctacacgttcggctcgcactacttcgtggaggtggacatcgtgctgccggccggtatgccgctgcaggaggcgcacgacatcggcgaggccctgcaggagaagctggagcgcctgcctgagatcgagcgcgccttcgtgcacctcgactacgagttcacccatcggcccgagcacgctctgtcccatgagaagtagcttcaggatcagccggtggatgcagctctgtacagattaatggcaatagtttcagaaatccgggtgttcgtcaaggcgtcgcagaaaaacctgcgggtgcggcacgcaattgaaatgtgcatactggagtgccggatctggcgatgtcgacgtagattgtgtcttttgtaagttgctgtgctacgtaggtagcatatatattttaatgtcctataccctgatcatggccacatttttattgctggtt

SEQ ID NO: 5756 - DNA, 1048 bp, Amorphophallus konjac
aggaagagcaggaaaagatcgctagaagcgagagaactgcaattcggatatcaaatatagcaaacatgattctctttgcagcaaaagtctatgcttccattaggagtggatctttggcaattatagcatccacattggactcgctacttgatcttttgtctggctttatcctttggtttacggcatgctctatgcaaactccaaatccatatcaatatccaatagggaaaaggcgcatgcaaccactgggaatcctagtatttgcctccgtcatggcaacactgggcctgcagataattttggagtcttttcactcactgatttcaaatgaggatgagttcaacttgactaaagagcaagaacgctgggtggttgacattatgctctcagtgacccttgtgaagcttgctctggttatttactgtcgttcatttaccaatgagattgtcaaagcttatgctcaggaccacctttttgatgtcatcactaatatcatcggccttgtagctgcacttcttgctaattatattggatattggatcgaccctgttggagccatcatacttgcagtatataccatcaggacctggtccaggactgtcctggagaatgtgaactcccttgtcggccgcacggctgcaccggaatatctacagaaattgacgtatttatgctggaaccatcacaaggccatcaggcacattgacactgtccgagcctacacatttggttctcactattttgtggaggtggacgtcgtcttgccgtcggagatgcccctgagggaagcacacgacatcggggaggccttgcaagagaagcttgagttgttgcctgagattgagcgggcctttgttcacctggactatgagttctgccacaagccagagcatgcacaaccacatgattcttagcttttaccgacaggtgcgacggccgtccaccactcattgtttaccacgcgtcctgttgggagtaatataaagatgctaatccaatggttgtttgttatgctcctaacctcattacatgttgagtaaatgtaaat

SEQ ID NO: 5757 - DNA, 1673 bp, Cephalotaxus harringtonia
gcttttggaatggggcgtttctgcaataaattattgccgggcccctttatgtagggacacattgcagatcgttataattatctgataaatcagccatggtggatgctttggaagagggaactgagctgctgcttgatgcaagaaatggtgggagtgacaacccaacaagcgaggagaatgcatggaggctcaaattcaacaaggttccgaggcctcaaagggatgatgatagacctcaaagaagaatccatgattgcttcaatgtagtagtggggccttgtgatggagtggctgaatattatcagcagcaagaggagatgcttgagggttttacggaaatggatgctgtttctgaacgtggttttctgcctggcatttccaaggaagagcgtgagaaggttgcgagaagcgagaggattgcaattcagctgtccaacttagcaaatgttgtcctttttgctgcaaaaatatatgcatcaataaagagtggttcattagccataattgcttcaaccctagactcactcttggatcttctatcgggctttattctttggttcactgcatgtaagatgcagaaaccaaatcctcatctctatcccattgggaaaaagcgcatgcaaccactgggaattctggtttttgcgtctgtcatggctacattgggactgcagatcttgctagagtctgttcgacaacttgtatcaaaggaggagggattatcgttaaaaggaggcagatggcattgggttgttggaatcatggtttcagtcacttttgtgaagttgttccttgtaatctattgccgaactttcacaaacgagattgtaaaggcatatgcccaagatcatttctttgatgtcatcaccaactcaattggtctgtttgctgcaattcttgcaagttctttttattggtggatagatccggttggagcaatcgtgctagcactctacacaatcaggacatggtcaaataccgttttggaaaatgtgaattctttggtggggagaacagcctcacctgattatttgcagaaattgacatatctctgttggaatcatgacaaagccataaggcatattgatacggtcagagcttacacatttggttctcattacttcgtcgaggttgacatcgtgctacccagcgatatgcctttacaacaggctcatgacattggagaagcacttcaagaaaaattggaatctctttccgatatagaacgggcctttgtgcatttagactatgaatattctcacagacctgagcatgggacaagccattcctagtagtttacattgatgtctatattttaactaacattcctagtccttactcctttacttcttgcatggaaatcttttactgccaacatatgctcctcttcgaatgtgatacataatcccaattaaggcttagtaatttgtaggtagctcgtcttgttggagctctgcatgtgcacagattttgtttcgaaagattaacatggcccacatgaatctccaaatgacatgtgccaaggtttcttagcaacttggtgtacgtgtgacatggttaagacacgagctccaaatttcatgttctttactggaaatcttgaatgttgattatcatgaaatatttgttctcctaactttgtgatgctttggtgcagtaaagttttagttgaa

SEQ ID NO: 5758 - DNA, 612 bp, Chelidonium majus
atcatgctctctgtaacattggtgaagctctgcctttgtatttattgtcgttctttcagcaatgagattgtcaaagcttatgcccaggatcattctttgatgttgtcaccaacatcatcgggctaatagctgccctccttgcgaactattttgatgactggatggatcctgttggagctatcattttagcaatgtacaccatccggacatggtcagcaacagtgctcgaaaatgtgaactcacttgtaggcaggacagcagcaccggaatatcttcagaagctgacttacctttgctggaaccaccacaaggctgtaaggcacattgacacggtacgagcttacacatttggatctcactacttcgttgaagttgacattgtcttaccatctgacatgccattgcgagaggcacacgacgtcggagaggccttgcaggagaagctcgaatgcctgcccgagatcgagcgcgcctttgttcatctcgattatgagtttacccacaagcctgagcatgcacaatcacaatcctaaggttccgggtacatatattttttcatttagcaaatgataagaagtggtatttgcttattgaaagggagaaaagaagatt

SEQ ID NO: 5759 - DNA, 639 bp, Hordeum vulgare
cggacgcgtggggcacaggatcacattttcgatgtgatcactaatataattggtcttgtggctgcactactagcaaattattttgaaggatggatcgacccagtcggtgcaattattctagcaatctacaccatcaggacatggtcgatgacggtgctggaaaacgttcactcgcttgtcgggcagtcggcttcgccagagtaccttcagaagctgacctacctatgctggaaccaccacaaggccgtgaggcacatcgacacggtgcgcgcctacacgttcggctcgcactactttgtggaggtggacattgtgctgccggcgggcatgccgctgaaggaggcgcacgacatcggtgaggccctgcaggagaagctggagtgcctgcccgagatcgagcgcgccttcgtccacctcgactatgagttcacacatcggcccgagcacgctctgtcccatgacaagtagcttcaggttcaggcagtgggtgcagctctgtacagattaaaggctgaagctgtttatttttagcgtcaatggtttcagaaatcagctgttcgtcagcctcgcggaaaaacctgcgggtgcagcactcaattgaaagggaaacgttaccttccaaaaaaaaaaaaaaaaaaa

SEQ ID NO: 5760 - DNA, 1544 bp, Brachypodium distachyon
ggttcgggaatggctggtagtggtgccggcggcgcggagggtgaggagctccggctgctctccgtcgttgagtctggccacggcggcggcggcggcggcgcacctgaggcggagaagtcgtggcgcctcaacttcgacggattccgtcccccggaggcgcaccaggagaggccacctcgcgggctccaccatcactgcctcggcgtcctagctcaaagtcctgaggatgttatcgctgaatactatcaacaacaagtggaaatgctagagggtttcaatgaaatggatgcgcttacagatcatggttttcttccaggaatgtccaaggaagagcgtgaaaaggttgcgaggagtgaaacactagccatccgtttgtctaacattgcaaacatggttctttttgcggcaaaagtgtatgcttcagtaaggagtggctcacttgctattatagcttccactttggattctcttcttgacttgttgtcagggtttatcttatggtttaccgccttttcaatgcaaacaccaaatccctacagatacccaattggtaaaaagcgcatgcagccactgggaatacttgtctttgcctcagtaatggcaacacttggccttcagatcatcttagaatcgactcgctcgctggtgtctgatgcaaacgaatttagcttgacaaaggagcaggaaaggtgggttgtagacatcatgctctcagtgacactggtgaaacttgccctggctttatattgccgctcattcaccaatgaaatcgtcaaggcttatgcacaggatcacatttttgatgttataacaaatgtaattggtcttgttgctgcactccttgccaactactttgaaggatggatcgacccagttggtgcaattgttctagcaatctacacaatcaggacatggtcgatgacagtgctagaaaatgttcactccctggtggggcaatctgcttcgccggagtaccttcagaagctaacctacctatgctggaaccaccacaaggctgtgaggcacatcgacaccgtgcgcgcatacacgttcggctcccactacttcgtggaggttgacatcgtgctgccttcaggcatgccactgcaggaggcccatgacataggcgaggccttgcaggagaagctggagcgcctgcctgagatcgagcgcgccttcgtccacctcgactacgagttcacccatcggccggagcacgctctgtcccatgacaaatagctcaggcctgcaggtgcatccagatccgtgtctggtagtatttatgttcagcagcaatagttcaacaaatccagtgttccatcggctgtcgcaggtcagcacacgattgaattgtgcataccgaagtgctggatatggtgatgccaacttagattgtgcagtgtaggttgttgtatgtaaagtatgttgaagaaatctgttttgctatacctaaattgcctgatttatagttagagatttaagatttggaagaaacgatgaaaagaggagaatggaatggtgtccagatactatttaatggctct

SEQ ID NO: 5761 - DNA, 713 bp, Setaria italica
ggctggatcgacccagttggtgcaatcattcttgcaatctacacaatcagaacatggtctatgacagtgctggagaacgtgcactccctggtggggcagtcggcctcgccggagtacctccagaagctgacgtacctgtgctggaaccaccacaaggccgtgcggcacatcgacacggtgcgcgcctacacgttcggctcccactacttcgtggaagtggacatcgtgctgccgtcggacatgccgctccgggaggcgcacgacattggcgaggccctgcaggagaagctggagcggctgccagagatcgagcgcgccttcgtgcacctcgattatgagttcacccaccggcccgagcacgctctgtcccacgagaactagcttgcaagtttagagcagggggaaatacacgggttcgtagccgcaggaagacctggtgctcgtctcatcagccgtcgtaggaaaccattggggtacatgcgatgggaacatgagtgcattctcgagtgcccgcagcggcgatgctctggaccctggtagattgcagtgtgatttctagtacaagaatctcatgccagtgatcagtgatgagggcctcttttataccggtcttcagctcttttcttgtgttatatctggtttcctgaagaccgacaactgagctgtgtatttcttctggagtaatgtatacagccttgatttagtcaatgcct

SEQ ID NO: 5762 - DNA, 2024 bp, Setaria italica
cacccagcgagccgtgagcgaggcgagggaggcccccacttcgtcccccgcctcgcctccctctttaatcaagacggcgcacgccggcacgcggggggcgggccgagcgcttttggcctggccgtcttgcttggcaactacagtaccaaccgactggccaggcggaggcagcccagtctcccgctgcggttccccctcgtgcgccgtcgtgccaaggggagtgtggcacgtacggtttgaagcgcggcgcgccaagctcgccgggctcctagggttggggaatggctggggcggcggcggcggcagatggcgtagagggggaggagctgctcctgctctcggccgtggaggctggcaacggtggcggcggcgcgcacgccgcggcggaggagtcgtggcggctcaacttcgaggggttccgcccgccggaggcacaccagcaggagaggccaccgaccggcgcgctccaccactgcctcggcgtcctagctcaaggtcctgaggatgttgttgccgagtactaccaacaacaagtggagatgcttgagggttttaatgagatggatacgcttacagatcgtggtttccttcctggaatgtccaaggaagaacgcgaaaaggttgctaggagtgagacattagcaatacggctgtctaactttgcaaacatggttctttttgctgcaaaagtgtatgcttcagtacggagtggctcacttgctattattgcttccactttggattctcttctagacttactgtcagggttcatcttgtggtttaccgccttttcaatgcaaactccaaacccctacagataccctatcggtaaaaagcgtatgcagccactgggaatacttgtttttgcttctgttatggcaactcttggccttcagatcattctagaatcagtacggtcattggtgtctgatggagatgaattcagcttaacaagccagcaggaaaagtgggttgtggacatcatgctctcggtgacattggtgaaacttgccctggttatatattgccgctcgttcacaaatgaaatcgtcaaggcatatgcacaggatcactttttcgatgtcattaccaatgtaattggtctagttgctgcactacttgccaattatattgatggctggatcgacccagttggtgcaatcattcttgcaatctacacaatcagaacatggtctatgacagtgctggagaacgtgcactccctggtggggcagtcggcctcgccggagtacctccagaagctgacgtacctgtgctggaaccaccacaaggccgtgcggcacatcgacacggtgcgcgcctacacgttcggctcccactacttcgtggaagtggacatcgtgctgccgtcggacatgccgctccgggaggcgcacgacattggcgaggccctgcaggagaagctggagcggctgccagagatcgagcgcgccttcgtgcacctcgattatgagttcacccaccggcccgagcacgctctgtcccacgagaactagcttgcaagtttagagcagggggaaatacacgggttcgtagccgcaggaagacctggtgctcgtctcatcagccgtcgtaggaaaccattggggtacatgcgatgggaacatgagtgcattctcgagtgcccgcagcggcgatgctctggaccctggtagattgcagtgtgatttctagtacaagaatctcatgccagtgatcagtgatgagggcctcttttataccggtcttcagctcttttcttgtgttatatctggtttcctgaagaccgacaactgagctgtgtatttcttctggagtaatgtatacagccttgatttagtcaatgccttgggtcatccaatcagtgtctgacgagttgcacgtttcgtagtagtgatgatgataccgcgagtgtggactgtggactcgctctgcgctaatgtacgcaatgccgcaagctttgtcaagataccttgcatacagctttgcgactagcccacctgttcatagcaatccgaaatctt

SEQ ID NO: 5763 - DNA, 951 bp, Leymus cinereus x Leymus triticoides
cagatacccaattggtaaaaagcgtatgcagccgctgggaatacttgtctttgcctcagttatggcaacgcttggccttcagatcatcttagaatcaactcgatcactgttgtataatggaggtgaattcagcttgacaacggagcaggaaaagtgggttgtggacatcatgctctcggtgacgctggtgaaacttgccctggctttatattgccgcacgttcaccaatgaaatcgtcaaggcttatgcacaggatcacattttcgatgttatcactaatataattggtcttgtggctgcattactcgcaaattattttgaaggatggatcgacccggttggtgcaattattctagcaatctacaccatcaggacatggtcgatgacggtgctggaaaacgtccactcgctcgtcgggcagtcggcttcgccagaataccttcagaagctaacctacctatgctggaaccaccacaaggccgtgaggcacatcgacacggtgcgcgcgtacacgttcggctcgcactacttcgtggaggtggacatcgtgctgccggcgggcatgccgctgcaggaggcgcacgacatcagcgaggccctgcaggagaagctggagcgcctgcccgagatcgagcgcgccttcgtccacctcgactacgagttcacccatcggcccgagcacgctctgtcccacgagaagtagcttcaggctcagccagtggacgcagctctgtacagattaatggcaatagtttcagaaatccggtgttcgtcaaggcgtcgcagaaaaacctgcgggtgcagcgcgcaattgaaatgtgcatactggagtgccggatttggcgacgtcaacgtagattgtgtcttgtaagttgttgtgctacgtacgtagcatatatatttaaatgtcctataccctgatcatggcctcatttttattgggttcacaca

SEQ ID NO: 5764 - DNA, 1429 bp, Pennisetum glaucum
cggctcaacttcgacgggttccgcccgccggaggcgcaccagcaggagaggccgccggccggcgcgctccaccactgcctcggcgtcttagctcaaggtcctgaggatgttgttgctgagtactaccaacaacaagtggagatgcttgagggttttaatgagatggatacgcttacagatcgtggtttccttcctggaatgtccaaggaagaacgtgaaaaggttgctaggagtgagacattagcaatacggctgtctaacattgcaaacatggttcttttcgctgcaaaagtgtatgcttccgtacggagtggctcacttgctattattgcttcgactttggattctctgctagacttactgtcagggttcatcttgtggtttactgccttttcaatgcaaactccaaacccgtacagatacccaataggtaaaaagcgtatgcagccactgggaatacttgtttttgcttctgttatggcaactcttggcctccagatcattctagaatcaatgcgctcattggcgtctgatggagatgaattcagcttaacaagcgagcaggaaaagtgggttgtggacatcatgatctcggtgacattggtgaaacttgccctggttatatattgccggtcattcacaaatgaaatcgtcaaggcatatgcacaggaccactttttcgatgtcattaccaacgtaattggtctggttgctgcactacttgccaattatattgatggctggattgacccagttggtgcgatcattcttgcaatctacacgatcagaacatggtctatgacggtgctggagaatgtgcactccctggtggggcagtcggcctcgccggagtacctccagaagctgacgtacctgtgctggaaccatcacaaggccgtgcggcacatagacacggtgcgcgcgtacacgttcggctcccactacttcgtggaggtggacatcgtgctgccgtcggacatgccgctccgggaggcacacgacatcggcgaggccctgcaggagaagctggagcggttgccggagatcgagcgcgcctttgtgcacctcgactacgagttcacccaccggcccgagcacgctctgtcccacgagaaatagactgcaattttggagcatgggggcagcaggtgggacaacgggttcgtaaccgcaggaagacctggtgctcttctcatcagccgtcgtaggaaaccattggggtacatgcgatggggacatgagtgcattctcgggtgcctgcagctgcgatgctctaaaccctggtagattacagtgtgacttctagtgcaaacatctcatgctagtgattagtgacgagggcctcttttataccggtcttcagctcttttcctgaggaccgataactgagctgtgtatttctggaagataatatatacagccttgcttt

SEQ ID NO: 5765 - DNA, 1777 bp, Oryza sativa
taatcacgagacccgcactctttttttgcgtcgctcgagcgcccgcgttccccgcttcgccgaaactaccaaccgcctcgccgttctcctctccccgtggcgccgccgcgccgcacggcgggagggcaactgaccgagggagactgcccaccagcgtgccgcgcgccgtcgcctccggctccctggttcgtggaataatggcggcggcggtcgcgggcggtggggaggagggggaggagctgctcctgctctccgccgtcgaggccggttccttcggcggcggtggcgacggtggcggcgcgggcgcagcggcggagaagtcgtggcgcctcaacttcgacggcttccgaccgccggaggtgcagcaggagaggcggccgccccgcgggctccaccaccactgcctcggcgtcctatctcaaggtcctgaggacgtagttgctgaatactaccaacagcaagtggaaatgctagagggctttaatgaaatggatacacttactgatcgtggttttcttccaggaatgtccaaggaagagcgtgagaaggttgctaggagtgagactttagccatccggctatcgaacatagcaaacatggttctttttgctgcgaaagtgtatgcttctgtgagaagtggttcacttgctattattgcttcgactttggattctcttcttgacttgttgtcaggatttatcttgtggtttactgccttctctatgcaaacaccaaatccctacagataccctattggtaaaaagcgtatgcagccactgggaatacttgtctttgcctctgttatggcgacacttggccttcagatcatcctagaatcagtacgctcgttgttgtctgatggggatgagttcagcttgacaaaagagcaagaaaagtgggttgtggacatcatgcttgcagtgacattagtgaaacttgcccttgttttatattgccggacattcacaaatgaaatagtgaaggcttatgcacaggatcatttttttgatgtcatcacaaatatgattggtcttgttgctgcactactagcgacttatatcgaaggttggatcgacccagttggtgcaatcatcctagcaatctacacgatcagaacatggtcgatgacggtgctcgagaacgtccactccctggtcgggcagtcagcctcgccggaataccttcagaagctgacctacctatgctggaaccaccacaaggccgtgaggcacatagacacggtgcgggcgtacacgtttggctcccattacttcgtcgaggtggacatcgtgctgccgtcaagcatgccgctgcaagaggcgcacgacatcggcgaggccctgcaggagaaactggaacgcctgcctgagatcgagcgagcgttcgtgcacctcgactacgagttcacccatcggcccgagcacgctctgtcccatgaaaaatagccagacgcaggttgcaagttcgcaaccactggtattaagtttagcagcagcaattagtttcagaatttctggtgctcgtcaggaaacctgcgggtgtatgagattttaattctgtatactggattggcgggtgtgacagtgccaaagccgtagattgtgatttgtaactacttgttgtagactataggattcttgactgttaaatccgtcatctcgatcatctcgtgtagtacaatttatactcaaagtctagagagacatatgcctggtaattacaggctcacagccactttacattaatatacggtcttctgctccttcggctacgaatc

SEQ ID NO: 5766 - DNA, 1428 bp, Sciadopitys verticillata
atggaggagggtaccgagcttctgctcaatgcagatgttgaggatgcagaagaaccaagcatggaggatgcatggagattgagtttcaacaagattcaaaggcctgaaagggatgagaaacctcagcgaggaattcaagattgcttcaatgttgtacttggtcctggtgatggagtggctgaatattatcagcagcaagaggagatgcttgagggctttacagaaatggatactgtttctgcgcatggatttctgcctgggatgaccaaggaagagcgtgaaaaggttgcaagaagcgagaagatggcaattcaactgtccaacttagcgaacattgtcctttttattgcaaaagtatatgcatcaataaagagcggttcattagccataattgcttcaacgctagactcactcttggatcttctatcaggctttattctttggttcacttcatttaagatgcagaaaccaaatccctatctctatcccatagggaaaaaacgcatgcaaccattgggaattctggtttttgcttcagtcatggctacattgggactgcagatcttgctggagtctgctcgacaacttatatcgaaggaggaaggtttatcgttagaaggtggcaggtggcattgggttgttggaatcatggtttcagtcactcttgtgaagttgttccttgtaatatattgccgaactttcacaaacgagattgtcaaggcctatgcccaagatcatttctttgatgtcatcaccaattcaattggtctatttgctgcagttcttgcaagtactttgtactggtggatagatcctgctggagcaattgtgttggctctctacacaatcaggacatggtcaaacacggttttggaaaatgtaaattctttggttggaaaacagcttcacctgattatttgcagaaattaacatatctctgttggaaccatcacaaagccatacggcatattgatacagtaagagcttacacatttggttctcattactttgttgaggttgacattgtgctacccagcgatatgccgttacaacaggctcatgacattggagaggcacttcaggaaaagctggaatctcttcctgacatagaacgggcctttgtgcatttagactatgaatatactcacagaccagagcatgggaaaagagattcctagttttagaaatgggtgtatatattcagcaatgaaactttcgaatctcttttctattttgcatgttaaaatcttactggcaaaatattgttgctgtagtaagtgatatatattaccaaacatttagtaatttgtaggtctcccttcattccagggcactgcaagttaacagattttattttgaaaaatttacacagttcacacaaatttctgtgaaatacttatgccattgtttggaagcaaggtccaaatc

SEQ ID NO: 5767 - DNA, 1638 bp, Panicum virgatum
cacttcgtcgcccgcctcgccttccccttcgcctccctctttaccgcagattcacacgacgagacggggcacgcggcacgcgggggcggggggctcggctagtgcatttgcttggcaactaccaaccaactggtcaggcagtccagttgcggcacctcgtgcgccgccgcgccaactgacaagggagagtgcgacgtgcggctcgaagcgcggcgcggcgcgccaagctcgccggctcctagggttcgggaatggctgcggcggcgggggcggacggaggagagggggaggagctcctcctgctctcggccgtggaggctggtaacggcggcggcggcgcgcccgccgcggtgggggagtcgtggcggctcaacttcgaggggttccgcccgccggaggggcaccagcaggacaggccgccggccggcgcgctccaccactgcctcggcgtcctagctcaaggtcctgaggatgttgttgctgagtactaccaacaacaagtagagatgctggagggttttaatgagatggatacgcttacagaccgtggtttccttcctgaaatgtccaaggaagagcgtgaaaaggttgctaggagtgagacattagcaatacggctgtctaacattgcaaacatgatcctttttgctgcaaaagtgtatgcttcagtacgcagtggctcacttgctattattgcttcaacattggattctcttctagatttactatcagggtttatcttgtggtttactgccttttcaatgcaaactccaaacccctacagatacccaattggtaaaaagcgcatgcagccactgggaatacttgtttttgcttctgttatggcaactcttggcctccagatcattctagaatcaatgcgctcactggtgtctgatcaagatgaattcagcttaacaagcgagcaggaaaagtgggttgtggacatcatgatctcagtgacattagtgaaacttgccctggtgatatattgccgctcattcaccaatgaaattgtcaaggcatatgcacaggatcacttttttgatgtcatcaccaatgtaattggtctggttgctgcactacttgcaaattatattgagggctggattgatccagttggtgcaataattcttgcaatctacacaatcagaacatggtcgatgacggtgctggagaacgtgcactccttggtgggacagtcggcctcgccggagtaccttcagaagctgacgtacctgtgctggaaccaccacaaggccgtgcggcacatcgacacggtgcgcgcctacacgttcggctcccactacttcgtggaggtggacatcgtgctgccgtcggacatgccgctgcgggaggcgcacgacatcggcgaggccctgcaggagaagctggagcggctgccggagatcgagcgcgccttcgtgcacctcgactacgagttcacccaccggcccgagcacgcgctgtcccacgagaagtagcctgcaagctatgttgcccagatacgcggatacggataccggtacgcgatacggcgatattccgatacgccatttttccaaaaaaaaggaaacggaaatacgctaatatatatataaattaaaaataaataaagattccagggactagaacggg

SEQ ID NO: 5768 - DNA, 1255 bp, Panicum virgatum
tacgcagtggctcacttgctattattgcttcaacattggattctcttctagatttactatcagggtttatcttgtggtttactgccttttcaatgcaaactccaaacccctacagatacccaattggtaaaaagcgcatgcagccactgggaatacttgtttttgcttctgttatggcaactcttggcctccagatcattctggaatcaatgcgctcactggtgtctgataaagatgaattcagcttaactagcgagcaggaaaagtgggttgtggacatcatgctctcggtgacattagtgaaacttgccctggtgatatattgccgctcgttcaccaacgaaattgtcaaggcatatgctcaggatcacttttttgatgtcatcaccaatgtcattggtctggttgctgcactacttgcgaattatattgaaggctggattgatccagttggtgcaataattcttgcaatctacacaatcagaacatggtcgatgacggtgctggagaacgtgcactccctggtggggcagtcggcctcgccagagtacctccagaagctgacgtacctgtgctggaaccaccacaaggccgtgcggcacatcgacacggtgcgcgcctacacgtttggctcccactacttcgtggaggtggacatcgtgctgccgtcagacatgccactgcgggaggcgcacgacatcggcgaggccctgcaggagaagctggagcggctgccagagatcgagcgcgccttcgtgcacctcgactacgagttcacccaccggcccgagcacgcgctgtcccacgagaagtagcctgcaagtgtcgagcgggcgcaagaggtggaaggactcatagggttcattgctgaaaccatttatgagtagccgcaggaagcaaagcaagtttcagagacctggtgctcgtctcgtcagccgtcgttataaaccattggggtacatgcgatgggagctgtgcattctagagtgcctgcagcggcgatgccctggtagactgcagtatcatttttagtagaagatgagggcctcttttgtaccggtcttcagctcttttgctgtgttatctggttgcctgagggccgataactgagctgtgtatttctgattttctggaagatcatgtatacatacagcatcactttagtcaatgcctgggatcatccagtcagtatttctgacaacttgccctgcttgaaaatttcgtagtagtggtgataatgatgatgatgatgatg

SEQ ID NO: 5769 - DNA, 892 bp, Triticum aestivum
aacccatacaggtacccaattggtaaaaggcgcatgcaacctttgggaatacttgtttttgcatctgttatggcaacactcggtcttcaaattattctagaatccacacgctcattgttgtcatctaatggagctgaattccgcttgacaaaagaacaggaaatgtgggttgtgaatattatgctggcagtgacgctggtgaagcttctgctggttatatattgccgctcattcaccaatgaaattgtgaaggcatatgcacaggatcacttttttgatgtcatcaccaacattattgggcttgtggctgcacttcttgctaattattttgaaggctggattgacccagttggtgccatcattctagcgatctacacaatcaggacatggtccatgacggtgctggagaacgtgcactccctggtcggccaatcggcctcaccggagttcctccagaagctcacctacctgtgctggaaccatcacaaggccgtgaggcacatcgacacggtgcgggcgtacacgttcggctctcactacttcgtcgaggtcgacatcgtcctgccgtgcgacatgcccctgcaggaggcgcacgacatcggcgaggccctgcaggagaagctggagagcctgcccgagatcgagcgcgccttcgtccacctcgactacgagttcacccaccagcccgagcacgcccggtcctacgacacatagcatagcctgaagacctgaaccccggcggcggcgctgttcgtggaacttcagagacagagagcctgagctgaagctgttgaagtcggcacagtttcagaaatctgggtgtcaaacctgtccactcgcagattcagttgtgcagtttgatttttgttactgttttgatctgatctcgctg

SEQ ID NO: 5770 - DNA, 588 bp, Euphorbia peplus
cgtacatggtcaatgacagttctggagaatgtgaattcacttgttggaaaatcggctactccagattatctgaaattactcacatacctttgttggaaccatcacaaggccattagacacattgatactgtccgggcatacacctttggctctcactacgttgttgaggttgacattgttttgcctgctagcatgcccttgcaagaggctcatgacattggggaatcgttacaggagaagcttgagcttctgccagagatcgagcgtgcctttgttcatcttgactacgagtacatgcataagcctgagcatgctcaaacacacccgtagtaagattctcagcagatgattattgattattaattgtgattattaattgtgatttatacttacgcacgagtcttgaatttggaactaagtaggaattgttggatatttagattagggggaaaattaagatatggaactcttttttttagtcactaatgagtatagtacgcattctggctgttttgttttgatgatggtgatgatatgtaatgttatatatttgttttaatatgaaggaattgttcccagcctaaacgt

SEQ ID NO: 5771 - DNA, 481 bp, Cleome spinosa
cgatgattggattgatcctgttggagctatcattctcgcgttatacacaatccgaacatggtcaatgacggtgttggaaaacgtgaactcccttgtcgggaaatcggcagcgccagaatatctgcagaaactgacttacctctgttggaaccaccacaaagccatcaggcacattgacacagtcagggcatacactttcggctcccattactttgtggaagtagacattgtcctgcctgcagatatgcccctgcaagtggcacacgacatcggggaatcgctccaagagaagctcgaactgctccccgagatagaacgggcctttgttcacctcgattacgagtatacccacaaacccgagcacgcaaaagctcactgctagccggaaaatatcgagattccctttcgttaatgcctaaggtttatgaagtgtttagattggttcaatgatggagaaggtactgagagtcgggtagcgagt

SEQ ID NO: 5772 - DNA, 488 bp, Thellungiella halophila
tcgccaattacatcgataattggatggatccagttggagctatcattcttgcattgtacacgatacgaacatggtcgatgacggttttggagaatgtgaactctctagttgggaaatcagcgacaccagagtatctgcagaagctaacttacctgtgttggaaccaccataaagccatcaggcacatcgatacagtgagggcttacacttttggatctcattactttgtggaggttgatattgttctccctgctgatatgcctctgcaagtggcacacgacattggagaatcgctgcaagagaagctggagctgcttgaggagatcgaacgggcttttgtgcatcttgattatgagtacactcacaaacctgagcacgctagatcacactgttaagctcttttatttttcctaatcagccaaaaaaggttacagcttttgtttggtttttaatcaactgttcggtttggtattgttagagtttggttc

SEQ ID NO: 5773 - DNA, 1796 bp, Pinus pinaster
ggacaaattcactgggatgtccactgcagtgaacttcccttcaaagcttgaagagggaaacagaacgaatcgcacctaacttggagttttgtgggctggtagcccggctgtttacatgccagacctctcccattttacaggacttttgaagagaaacctactgacagggactattttatttcattgaatcccgtttctaccaatatacccactaccatcatgtggttacatctgtcagttcttcatgcttagacaatgctgtcaactacccaacatctttaataatgtcgatgattctctacacatacgtttcctgaagctcagggatcactgcttctccgcctcaatccccaaaaattacaatggcggaacctctgacgtctgctctgtcagaagatgggaccgagatcctgctttcgaatgctgagaaggccgagacaagcgaggagaatgcatggcgtttgagtttcaataggatttccaggtttgaaagggaggaaaggcctcaacaacgcggccttcatgattgcttcagtgtgctcggtgctagtagcggtgatggggtggctgaatattatcaacagcaggaagagatgcttgagggattcacagaaatggatacagttgctgagcgcggttatcttcctggcttatccaaggaagagcgtgacaaggttgcaagaagtgagacaattgcaattcggttgtctaacatagcaaacattatccttttcactgcgaaagtatatgcatcaataaagagtggctcattagccataattgcttcaactctagactcgcttctggatcttttgtcaggctttattctttggttcactgcatttaagatgcagtcatcaaatccttacctttatcccattgggaagaaacgcatgcagccattgggaattctggtttttgcttcagtcatggctacattgggattgcagatcttgttagaatctattcgacaacttgtatacaaggaggatggtttatctttagatggtgacaaatggcattgggtggttggaattatggtttcagttacttttgtgaagttgttcctcgtattgtattgtcgaagttttactaatgagattgtgaaggcatatgctcaagatcatttctttgatgtgatcaccaacacaattggtctaattgctgctattcttgcaagtagtactcaataccggtggatagatcctgctggagcaattgtgctggctctctacacaatcagaacatggtcaagcacggttttggaaaatgtgaattcgttggttgggaaaacagcttcacctgattatttgcagaagttgacatatctctgttggaatcatcacaaagcaattctgcatattgatacagtgagagcttacacatttggttctcattattttgttgaggtagacattgtgctacccagggatatgcctttacacaaggctcatgacattggtgaagcacttcaggaaaaactggaatctcttcctgacatagaacgggcttttgtgcatttagattatgaatatagtcacagacctgagcatgggaaaagctactcctaactctgtatgtgagtgtcattttataattgaaacttcgtaatctgcttttcaggtcttcttttattcttccactggtatcattctcatcctaggatgtgatggtaaagtgatattgtggtagttgtagatctgccatcttgacctacaagttagcagattttgctccgagaaaattgcatacagaaatcaacactgcatgtatgttaacacttcctaatatcttgg

SEQ ID NO: 5774 - DNA, 1259 bp, Platanus occidentalis
aatccctagttcgttttagcttgtttgttccgacaccgtaaatgaaggatacggtgacttccggctgcgaccccgaggggtcggaggagaggctcctgccggagtccggcaatggcgagaggtcctggaggttgaactttgatgggtttcagttctccgatatcagagagaagccgccgcgggggtttcatgactgtctcggtgttttaggtccagatgatgttgtggctgaatactatcaacagcaggttgaaatgttggaggggttcaatgaaatggataccttagcagagcgtggttttcttcctggaatatcaaaggaagagcaggacaagttggctagaagtgaggcaactgccatcagaatttcgaatatcgcaaacatggttcttttttctgctaaagtttttgcatccattaggagcggatcattggcgatcgtagcgtccacgttggactcacttcttgatcttctatcaggttttatcctgtggtttactgcattctctatgaagactcctaacccttatcaataccctattgggaagaaacgtatgcagccactgggaatccttgtttttgcctctgttatggctacgctgggtctgcagataatcttggagtcagtccgcacacttctgtatgatgaggatgcgttcagcttgaccaaggatcaagagcgatgggtgattggcattatgctctcagtgacactggtgaagctcatcctgactatttactgccgctctttctccaatgagattgtcaaagcttatgcccaggaccacttctttgacgttatcaccaacatcattggtctcattgctgccatcctcgccaattatattaaagggtggctggacccgttcggagctatcattctagcaatatacaccatccgcacttggtcgatgacagtactggaaaacgtgaactccctagtaggcaggtcagctacaccagactacctacggaagctgacgtacctttgttggaaccaccacaagtccattaggcacatcgacaccgtgcgggcttacacctttggatctcatttattcgttgaggttgacatcgttttgccatcagaaatgccactgcgggaggcgcacgacattggggagatgttgcaagaaaagctcgagctcctgcccgagattgagcgtgcgtttgttcatcttgattatgagttcacacacaagcccgagcacgcacaggcacactcttaatccccgggtatgcttctgttgtgttgtgtt

SEQ ID NO: 5775 - DNA, 1250 bp, Hordeum vulgare
gggaggcgaaagccctcccgtctcttcctagcaaccgttgccgcacttctactctactccgctccgatcgcccctctcagccgcgcggcctggagtgcgatttcagagaggtccgtctcgttggctgctcgtgtgcggtgcggccggccggaggaaatggcggcgggaggtggcgtggagcagggcgaggagctcttcctcctccgctccgtcgaggaagggggcggcttgtgcgttggggagcgcccctggcggctcaacttcgacggcttccggcgccaggggccgcagcaggagaggccgccgtcgcgtggcctccaggactgcctcggcgtgctagctcaaggtcctggagatgttgtggctgagtactaccaacaacagttggagatgttggaaggtttcaatgaaatggatacactgacagaccgtggttgccttcctggaatatccaagggaatacttgtttttgcttctgttatggcaacacttggtcttcaaattatcctagaatccacgcgctcattagtatcatctaatggagctgaattccgcttgacaaaagaacaggaaatgtgggttgtgaatattatgttggcagtgacgctggtgaagcttctacttgttatatattgtcgctcattcaccaacgaaattgtgaaggcatatgcacaggatcacttttttgatgtcatcaccaacactattgggcttgttgctgcacttcttgctaactattttgagggctggatcgacccagttggtgcaatcattctagcggtgtacacaatcaggacatggtccatgacggtgctggagaacgtgcactccctggtcggccaatcggcctcgccggagttcctccagaagctcacctacctgtgctggaaccatcacaaggccgtcaggcacatcgacacggtgcgggcctacaccttcggctcccactacttcgtcgaggtagacatcgtcctgccctgcgacatgcccctgcaggaggcgcacgacatcggcgaggccctgcaggagaagctggagcgcctgccggagatcgagcgcgcctttgtccacctcgactacgagttcacccaccagcccgagcacgcccagtcctacgacagatagcatagcctgaagtcctcaaccccgctggcggcggcgttgtaacttgtaagtgggactcgagagcctgagctgaagctgttgaacacggcataatttcagaaatctggatgtcaaaaaaaaaaaaa

SEQ ID NO: 5776 - DNA, 664 bp, Festuca arundinacea
  misc_feature (631)..(631): n is a, c, g, or t
ggcacgaggattgacccagtcggtgcaattattgtaagtggtttcccttccctctctgttgtctttttcatcaaaattgctcttctgttccatctgtagaagttgcatgccagtattgatgacatccctcattcgcctttctccaaaactaacaagcaaatagcatgaaaaacaaacagtacaacttagtgtaactcagttagccatgatgtgtcatttttaaaattaataaattttataacagaaagaaaatcaatttttttccgcatttgcagctagcgatctatacaatcaggacctggtcaatgaccgtgctagaaaatgtccactccctggttgggcaatcggcttcacccgaataccttcagaagctgacatatctatgctggaaccaccacaaggccgttaggcacatcgataccgtgcgcgcctacaccttcggctcccactactttgtggaggtggacatcgtgctgccctcggccatgccgctgcgtgaggcgcacgacatcggcgaggccctgcaggagaagctggagcacctgccagagatcgagcgtgccttcgtccacctcgactacgagttcacccataggcctgagcacgcactgtcccatgacaaatagctcangcgccaggtgaagctgtgtacagatgtgtggct

SEQ ID NO: 5777 - DNA, 2030 bp, Zea mays
caccagcccagccccccctgcaccaagtacaccaggcccacgataagtccgaagccggttcccgacgagtcgcctgtccgggctcataggctcggcgcagccagcgcgtgcgcgccctcgcaagcgacgaataactcccactcccacgctttcctcgcccgcctcgccgccctcttttaatcgcagagaggacgacgcacgcgggggccggggctggggctagacggctagtgcgtttgcccgcttggcaactaccaaaccaactcggccgtcagtctgctcctagtcctcgcgcgccgccgccgcgccgcgggagagcaccacgtacgtacgggtcaaagcgcggttgccccaagctcacagtctgctagggttccagaatggcggcggcggcgaacggcggagacggggaggagctcctcctgctctcggccgtggaggctggccgcggcggcggcgtacccaccgaggtggaggattcgtggcggctcaacttcgaggggttccgcccgccggaggcgcaccaggagaggccgccgaacggtccgcttcaccactgcctcggcgtgctagctcaaggtcctgaggatgttgttgctgaatactatcaacagcaagtggagatgcttgagggttttagtgagatggacacacttacagatcgtggtttccttcctggaatgtccaaggaagaacgagaaaaggttgccaggagtgaaacattagccatacggttgtctaactttgcaaatatggttctctttgctgcaaaagtgtatgcttcagtaaggagtggctcacttgctatcatcgcatcaactttggattctcttctagacttgttgtcaggatttatcttgtggtttactgccttttcaatgcaaacaccaaatccatacagatacccaattgggaaaaagcggatgcagccactgggaatacttgtttttgcttctgttatggcaacccttggccttcagataattctagaatcagtacgttcattggtgtctgatggagatgaattcagcttaacaagtgatcaagaaaagtggcttgtggacatcatgctctccgtgacattggtaaaacttgccctggttatatattgccgctccttcaccaacgaaattgtcaaagcatatgcacaagatcactttttcgatgtcatcacaaatgtaattggcctggttgctgcactacttgccaattacattgagggctggatcgatccgcttggtgcaatcgttctggcgatctacacgatcaggacatggtcgatgacggtgctggagaacgtgcactccctggtggggcagtcggcctcgccggagtacctccagaaactgacttacctgtgctggaaccaccacaaggccgtgcggcacatcgacacagtccgcgcctacacgttcggttcccactacttcgtggaggtggacatcgtgctgccgtcgaacatgcccctgcgggaggctcacgacatcggcgaggccctgcaggagaagctggagcgcctgccagagatcgagcgcgcgtttgtccacctcgactacgaattcacccaccgccccgagcacgccttgtcccacgagaaatagcatgctaggaccgaactgatgcagcaggcggaaggacacggcttcgtaatcgtaactgaaacaattttacttgtagccgcagaaagcttcttctgagacctgatgctcatctcgtcagtcgtcgcagcaaaccagttgggtacatgcgatgagactgaacgtaaaggagtgcttgctctctgcgatggtgtccttgtagcatcatggactacagaatctgattcctcctccaccaccaccacgacgacgacctattttatactggtcttcagctcattagtctaggtttgtttcgttatctttttgcatggagagaccgatgattgaggtatgtatttctgtaagataaattcatatcttgcttcaaaaagtcaaaactttttaaaatttgccagtacgtcgaaaatagttttgatatttatgtctttg

SEQ ID NO: 5778 - DNA, 1851 bp, Avena sativa
cttccgctcctcccgcctcgtggcgccgtgcagcgcaggaaggagacagggagggaccctgccgcagcccaaacagcggcggctgctctttgtcttagggttcgggaatggcggccggtgcaggcggcgcggagggcgaggagctgcggctgctctccgccgccgaggctggcgacaccggcggctcgcctcccgcggcggagaagtcctggcgcctcaacttcgacggcttccgcccgccggaggcgcgccaggagaagccgccccgcgggctccaccaccactgcctcggcgtcctaggtcaaggtcccgaggatgttgtcgctgaatactaccaacagcaagtggaaatgctagagggttttaatgaaatggatgcgctaacagatcgtggttttcttcctggattgtccaaggaagagcgtgaacaggttgctaggagtgaaacattagccatccggctatctaatatcgcgaacatggttctttttgctgcaaaggtgtatgcttcagttaggagtggctcgcttgctattatagcctccactttggattctcttctggatttgttgtcaggatttatcttgtggtttactgccttttctatgcaaacaccaaatccatacagatacccaattggtaaaaagcgtatgcagcccctgggaatacttgtctttgcctctgttatggcaactcttggcctgcaaatcatcttagaatcgacacgctcactgatatccgatggagatgaattcagctgaacaaatgagcaggaaaagtgggttgtggacattatgctctcagtgacgctggtgaaacttgctctggctttatattgccgctcattcaccaatgaaatcgtcaaggcttatgcacaggatcacatgttcgatgttatgacaaatataattggccttgtggctgcattgctcgcaaattactttgaaggatggatcgacccagttggtgcaattattctagcgatctacacgatcagaacatggtcgatgacggtgctagaaaatgtccactcccttgttggacaatcggcttcacctgaataccttcagaagctgacctacctgtgctggaaccaccacaaggccgtgaggcacatcgacactgtgcgcgcctacaccttcggctcccactacttcgtggaggtggacatcgtgctgccatgcgcgatgccgctgcgggaggcgcacgacatcggcgaggccctgcaggagaagctggagcgcctgccggagatcgagcgtgccttcgtccacctcgactacgagttcacccatcggcccgagcacgcactgtcccatgacaaataggtcaggcgcctggtgcagccgcgtacagattggtagctagaactatttatgtttggttttcgacaagttcggaaatacggtgctcttcagtcatcgcagaaacctgcagtgaagcacgcgattgaaatgtgtatgccgaggcgctagttgtaagttatattgctctgctgtagtatatttaaaagttctctaccccgatcacggcctcttttatactggtagtccaagcatggagtacttctctctatctccagggtgccatggatcgtgacgtagcgggctgagcaaactcgtgagtcaccatggatgagcagtgtactatcgaacgcagtagtattaaactgaagcagcacatcttcgatcgtttgaacccagttttctgtcagcatatggactgagaccttattgatcacgtattaggtattacaccacagtaaacagacagaaacatgtgaacgatgtaatgtgggaacataaggttgatgatttgtttctgtactgctgttaaagatctagaggccaa

SEQ ID NO: 5779 - DNA, 1688 bp, Avena sativa
cccgcctcgtggcgccgtgcagcgcaggaaggagacagggagggaccctgccgcagcccaaacagcggcggctgctctttgtcttagggttcgggaatggcggccggtgcaggcggcgcggagggcgaggagctgcggctgctctccgccgccgaggctggcgacaccggcggctcgcctcccgcggcggagaagtcctggcgcctcaacttcgacggcttccgcccgccggaggcgcgccaggagaagccgccccgcgggctccaccaccactgcctcggcgtcctaggtcaaggtcccgaggatgttgtcgctgaatactaccaacagcaagtggaaatgctagagggttttaatgaaatggatgcgctaacagatcgtggttttcttcctggattgtccaaggaagagcgtgaacaggttgctaggagtgaaacattagccatccggctatctaatatcgcgaacatggttctttttgctgcaaaggtgtatgcttcagttaggagtggctcgcttgctattatagcctccactttggattctcttctggatttgttgtcaggatttatcttgtggtttactgccttttctatgcaaacaccaaatccatacagatacccaattggtaaaaagcgtatgcagcccctgggaatacttgtctttgcctctgttatggcaactcttggcctgcaaatcatcttagaatcgacacgctcactgatatccgatggagatgaattcagcttaacaaatgagcaggaaaagtgggttgtggacattatgctctcagtgacgctggtgaaacttgctctggctttatattgccgctcattcaccaatgaaatcgtcaaggcttatgcacaggatcacatgttcgatgttatgacaaatataattggccttgtggctgcgttgctcgcaaattactttgaaggatggatcgacccagttggtgcaattattctagcgatctacacgatcagaacatggtcgatgacggtgctagaaaatgtccactcccttgttggacaatcggcttcacctgaataccttcagaagctgacctacctgtgctggaaccaccacaaggccgtgaggcacatcgacactgtgcgcgcctacaccttcggctcccactacttcgtggaggtggacatcgtgctgccatgcgcgatgccgctgcgggaggcgcacgacatcggcgaggccctgcaggagaagctggagcgcctgccggagatcgagcgtgccttcgtccacctcgactacgagttcacccatcggcccgagcacgcactgtcccatgacaaataggtcaggcgcctggtgcagccgcgtacagattggtagctagaactatttatgtttggttttcgacaagttcggaaatacggtgctcttcagtcatcgcagaaacctgcagtgaagcacgcgattgaaatgtgtatgccgaggcgctagttgtaagttatattgctctgctgtagtatatttaaaagttctctaccccgatcacggccttcttttatactggtagtccaagcatggagtacttctctctatctccagggtgccatggatcgtgacgtagcgggctgagcaaactcgtgagtcaccatggatgagcagtgtactatcgaacgcagtagtattaaactgaagcagcacatcttcgatcgtttgaa

SEQ ID NO: 5780 - DNA, 1984 bp, Pinus taeda
cggcacgaggattgaacaaatcgacaaataaattgcaatcaatagacgcggattccaacctcgaatcgtaaagggacaaattcactagaatgtacactgcagtgaactcccctttaaagcttgaagaggaaacagaacgaaacgcacctaacttggagttttgtgggctggtagctcggccgtttacatgccagacctctcccattttacaggacttttgaagagaaacctactgacagggactattttatttcattgaatcccatttctaccaacatacccactaccatcatgtggttacatctgtcagcccttcatgcttagacaatgctgtcaactacccaacatctttaataatgtcaatgattctctacacatacgttttctgaagctcagggatcactgcttccccgcctcaatccccaaaaattacaatggcggaacctctgacgtctgctctgtcagaagatgggaccgagatcctgctttcgaatgttgagaaggccgagacaagcgaggagaatgcatggcgtttgagtttcaataggatttccaggtttgaaagggaggaaaggcctcaacaacgcggccttcatgattgcttcagtgtgctcggtgctagtagcggtgatggggtggctgaatattatcaacagcaggaagagatgcttgagggattcacagaaatggatacagttgctgagcgcggttatcttcctggcttatccaaggaagagcgtgacagcgttgcaagaagtgagacaattgcaattcggttgtctaacatagcaaacattatccttttcactgcgaaagtatatgcatcaataaagagtggctcattagccataattgcttcaactctagactcgcttctggatcttttgtcaggctttattctttggttcactgcatttaagatgcagtcatcaaatccttacctttatcccattgggaagaaacgcatgcagccattgggaattctggtttttgcttcagtcatggctacattgggattgcagatcatgttagaatctattcgacaacttgtatacaaggagaatggtttttctttagatggtgacaaatggcattgggtggttggaattatggtttcagttacttttgtgaagttgttcctcgtattatattgtcgaagttttactaatgagattgtgaaggcatatgctcaagatcatttctttgatgtgatcaccaacacaattggtctaattgctgctattcttgcaagtactcggcaccggtggatagatcctgctggagcaattgtgctggctctctacacaatcagaacatggtcaagcacagtgttggaaaatgtgaattcgttggttgggaaaacagcttcacctgattatttgcagaagttgacatatctctgttggaatcatcacaaagcaattctgcatattgatacagtgagagcttacacatttggttctcattattttgttgaggtagacattgtgctacccagggatatgcctttacacaaggctcacgacattggtgaagcacttcaggaaaaactggaatctcttcctgacatagaacgggcttttgtgcatttagattatgaatatagtcacagacctgagcatgggaaaagctactcctaactctgtatgtgagtgtcattttataatagaaacttcataatctgcttttcaggtcttcttatagtctcctgctgctaccattctcatcctaggatgtgatggtaaagtgatattgtggtagttgtagatctgccatcttgacctacaagttagcagattttgctccgagaaaattgcatacagaaatcaacactgcatgtatgttgacacttcctaatatcttgggttctatataatggcttagttaaaattgattaattttcttcttgaaacacttgttgtcttggcttgtcatccttttgtctagtacaagcttagctgaatgatctatttcttaaggctcg

SEQ ID NO: 5781 - DNA, 885 bp, Podocarpus macrophillus
gcaaaaagcgcatgcaacccttgggaattctggtttttgcttcagttatggctacattgggactgcagatattgctagagtcttcacgacaacttatatcgaaggagcaaggtttatctttagatggtgacagatggcattgggttgttggaatcatggtctcagtcactcttgtgaagttgttccttgtaatctattgccgaactttcacaaatgagattgtaaaagcatatgcacaagatcatttctttgatgtcataaccaatgcaattggtctatgtgctgcaattcttgcaagcactttgtactggtggatagatcctgcgggagcaattgtgctagcactctacactattaggacatggtcaaacacagttttggaaaatgtgaattctttggttgggagaacagcttcacctgattatttgcagaaattgacctatctctgctggaatcatcacaaagccattaggcatattgatacagtcagagcttacacatttggttctcattactttgttgaggttgatattgtgcttcccagtgatatgcacttacaagaggctcatgacattggagaagcacttcaagaaaaactggaatctcttcctgacatagaaagggcctttgtgcatttagactatgaatattctcacagacctgagcatgggaaacatcactagcagttttacatgtttatattttatagatgattttcaaatggttttatgggaaactctcattgccaacatattattgtcttagtatgtgacatttgctactaatcaatacttgtacatcttcattttgttggggtatttcaagcagatcttgttttgaaaactgtacatagtgtacacaaaatgacgtaaagaacttgtgcca

SEQ ID NO: 5782 - DNA, 1895 bp, Sorghum bicolor
gcgcagccagcgcgcccccgcaagcgacgaactcccacactttcctcgcccgcctcgcctcgcctccctcttttaatcgcagaaggacggcgcacgcgggggccgggggcggctagtgcgtttgcccgctcatcagcgcctgcttggcaactaccaaccaactcggcccgtcacccgtcagtctcctcctgcggctcctcctagttctcgcgcgccgccgtcccgcgggacagcgccacgtacgggccaaagcgcggcgtcccaagctcacagtctgctagggttgcggaatggcttcggcagcggcggaggcgaacggcggggagggggaggagctcctcctgctctcggccgcggaggctggccgcggcggcggcgcgaccgccgaggcggaggagtcgtggcggctcaacttcgaggggttccgcccgccggaggcgcaccaggagaggccgccgaccggtccgctccaccactgcctcggcgttctagctcaaggtcctgaggatgtggttgctgagtactaccaacagcaagtggagatgctggagggttttagtgagatggacacacttacagatcgtggtttccttcctggaatgtccaaggaagaacgagaaaaagttgccaggagtgaaacattagccatacggctgtctaacattgcaaatatggttctctttgctgcaaaagtgtatgcttcagtaaggagtggctcacttgctatcatcgcatctactttggattctcttctagacttgttgtcaggatttatcttgtggtttactgccttttcaatgcaaacaccaaatccctacagatacccaattggaaaaaagcgtatgcagccgctgggaatacttgtttttgcttctgttatggcaacccttggccttcagataattctagaatcaatacgctcattggcgtctgatggagacgaattcagcttaacaagtgatcaagaaaagtggcttgtggacatcatgctttctgtgacattggtaaaacttgccctggttatatattgccgctcattcaccaacgaaattgtcaaagcatatgcacaggatcacttttttgatgtcatcacaaatataattggcctggttgctgcactacttgccaattatattgagggctggatcgacccacttggtgcaattgttctggcaatctacacgatcagaacatggtcgatgacggtgctggagaacgtacactccctggtggggcagtccgcctcgccggagtacctccagaagctgacttacctgtgctggaaccaccacaaggccgtgcggcacatcgacacggtgcgcgcctacacgtttggttcccactacttcgtggaggtggacatcgtgctgccgtcaaacatgccgctgcgggaggctcacgacatcggcgaggccctgcaggagaagctggagcgcctgccagagatcgagcgtgcgtttgtccacctcgactacgagttcacccaccggcccgaacacgccttgtcccacgagaaatagcatgcaagtaccgagctgatgcagcaggtggaaggacacgggttcgtagctgaaactatttttgtgtagccgcagaagagacctgatgctcgtctagtctcgtcagccgtcgcagcaaaccaagtagggtacatgcgatgggactgagcgcaaagtagtgctctctgcgatggtgtccttgtagattacagcatcatgaactacataatctgattctccagtgatggtgatgaggacctattttatactggtcttcagctctttaagtttggggttgttttgtttatctttttgcctgaagaccgatgactgagctctgtattatgctttcataatatatagctctgtctattgaatgtcatatattcttataat

SEQ ID NO: 5783 - DNA, 2032 bp, Sorghum bicolor
caccagcccagacccagacccatacaccaagtacacgtacaccaggcccacgaccagtcagaagccagtttccggcgagtccggcgagtcgcctctccgggctcataggctcggcgcagccagcgcgcccccgcaagcgacgaactcccacactttcctcgcccgcctcgcctcgcctccctcttttaatcgcagaaggacggcgcacgcgggggccgggggcggctagtgcgtttgcccgctcatcagcgcctgcttggcaactaccaaccaactcggcccgtcacccgtcagtctcctcctgcggctcctcctagttctcgcgcgccgccgtcccgcgggacagcgccacgtacgggccaaagcgcggcgtcccaagctcacagtctgctagggttgcggaatggcttcggcagcggcggaggcgaacggcggggagggggaggagctcctcctgctctcggccgcggaggctggccgcggcggcggcgcgaccgccgaggcggaggagtcgtggcggctcaacttcgaggggttccgcccgccggaggcgcaccaggagaggccgccgaccggtccgctccaccactgcctcggcgttctagctcaaggtcctgaggatgtggttgctgagtactaccaacagcaagtggagatgctggagggttttagtgagatggacacacttacagatcgtggtttccttcctggaatgtccaaggaagaacgagaaaaagttgccaggagtgaaacattagccatacggctgtctaacattgcaaatatggttctctttgctgcaaaagtgtatgcttcagtaaggagtggctcacttgctatcatcgcatctactttggattctcttctagacttgttgtcaggatttatcttgtggtttactgccttttcaatgcaaacaccaaatccctacagatacccaattggaaaaaagcgtatgcagccgctgggaatacttgtttttgcttctgttatggcaacccttggccttcagataattctagaatcaatacgctcattggcgtctgatggagacgaattcagcttaacaagtgatcaagaaaagtggcttgtggacatcatgctttctgtgacattggtaaaacttgccctggttatatattgccgctcattcaccaacgaaattgtcaaagcatatgcacaggatcacttttttgatgtcatcacaaatataattggcctggttgctgcactacttgccaattatattgagggctggatcgacccacttggtgcaattgttctggcaatctacacgatcagaacatggtcgatgacggtgctggagaacgtacactccctggtggggcagtccgcctcgccggagtacctccagaagctgacttacctgtgctggaaccaccacaaggccgtgcggcacatcgacacggtgcgcgcctacacgtttggttcccactacttcgtggaggtggacatcgtgctgccgtcaaacatgccgctgcgggaggctcacgacatcggcgaggccctgcaggagaagctggagcgcctgccagagatcgagcgtgcgtttgtccacctcgactacgagttcacccaccggcccgaacacgccttgtcccacgagaaatagcatgcaagtaccgagctgatgcagcaggtggaaggacacgggttcgtagctgaaactatttttgtgtagccgcagaagagacctgatgctcgtctagtctcgtcagccgtcgcagcaaaccaagtagggtacatgcgatgggactgagcgcaaagtagtgctctctgcgatggtgtccttgtagattacagcatcatgaactacataatctgattctccagtgatggtgatgaggacctattttatactggtcttcagctctttaagtttggggttgttttgtttatctttttgcctgaagaccgatgactgagctctgtattatgctttcataatatatagctctgtctattgaatgtcatatattcttataatatatttcgtggcacaatagctctg

SEQ ID NO: 5784 - DNA, 1144 bp, Saccharum officinarum
tttggattctcttctagacttgttgtcaggattgatcttgtggtttactgccttttcaatgcaaacaccaaatccctacagatacccaattggaaaaaagcgtatgcagccgctgggaatacttgtttttgcttctgttatggcaacccttggccttcagataattctagaatcaatacgctcgttggcgtctgatggagatgaattcagcttaacaagtgatcaagaaaagtggcttgtggacatcatgctttccgtgacattggtaaaacttgccctggttatatattgccgctcattcaccaacgaaattgtcaaagcatatgcacaggatcacttttttgatgtcatcacaaatgtaattggcttggttgctgcactacttgccaattatattgagggctggatcgacccacttggtgcaatcattctggcgatctacacgatcagaacatggtctatgacggtgctggagaacgtgcactccctggtggggcagtcggcctcgccagagtacctccagaagctgacttacctgtgctggaaccaccacaaggccgtgcggcacatcgacacagtgcgcgcctacacgtttggttcccactacttcgttgaggtggacatcgtgctgccatcgaacatgccgctgcgggaggctcacgacatcggtgaggccctgcaggagaagctggagcgcctgccagagatcgagcgcgcgttcgtccacctcgactacgagttcacccaccggcccgagcacgccttgtcccacgagaaatagcatgcaagtaccgagctcatgcagcaggtgtaaggacacgggttcgtagctggaactatttatgtgtagccgcagaaagcttcttctgagacctgatgctcgtctcgtcagccgtcgcagcaaaccagttgggtacatgcgacgggactgagcgtaaattagtgctctctgcgatggtgtccttgtagattacgtacgcaatcatgaactacagaatctgattcctccagtgatggtgatgaggacctattttatactggtcttcacctctttagtttggggttattttgttatcttttttgtctgaagaccgatgattgagctccgtatttctataagataatgtgtgctctttctctctcc

SEQ ID NO: 5785 - DNA, 1207 bp, Brassica rapa
  misc_feature (1197)..(1197): n is a, c, g, or t
gaacaaaaaaactcgtatcttataataataatcccttctctgttgtcttcttgtggtgagagaactaggaggcaacaatggcggaatctcctgtgcagatgaacctggtcccgaccgaagctacttctgaaagcttcgcagagtatggtcaagtcatcgaagcttcctcagatggtgatctctttggtcctaacgatgctcagttagatctctccagaggaaccccacgtttttatatcatgcggctcgaaggtcgaaccttgggcttctcaacgatcacgcaccacgcgaacgtgacacagtgtctgggatctataggaggtcacgtttggtatctcggtgtagcgaagccatctcttattgaagatgttgatagagaaagagttggagataatgtagagtcagggtccgatggtcacttgtacgcgcctcctacggttgaagaggtgcgcgtcttcaggttttcaggaccgaagtttgttaaactgaaccgtggtacgtggcatgctgggccgttgttcagtgacagctccatggacttctacaaccttgagctcagcaacacaaatgaggtggatcacacgacacatagtttcaagaagaagaatggggtcatcttccggtttgaggatagcacatcatcatcctaaagtcaaaaatcctatatgatgatcagtgtggttctgttttcatgtctttataagcaaataaaatgagaaacatttttcttgtattcaatgtgccaagtctgtctttgtacaaactataaatctgttcatctattgactcactaaaaaagaacgtgaactcactcgtcgggaaatcagcaacgccggagtatcttcagaagctgacttacctgtgttggaaccaccatagagagatcaggcatattgacacggtgagggcgtacacgtttgggtctcattactttgtggaggttgatattgttcttccagctgatatgcctctgcaagtggctcatgatattggagaagcgctgcaagagaagctggagcagttgcaggagattgaaagggcttttgtgcatcttgattatgagtacactcacaaaccggagcacgctagttcccactgttagcttgcggtgaaggtgtctctacgtctacaaaattcttacagatttaagaatcttcaatcgtattgtttagtagacaagtgtacctttgtaactanctagttttgt

SEQ ID NO: 5786 - DNA, 1636 bp, Phalaenopsis aphrodite
tcgttctgtcttcctttctagggttatttgtgggctcgtctgagaagcaaaggacggagaaaatggcagcttcggagggttctaatggggatattgaagggtcgaagctactcttagctgagtccggcgagcgcgagcgctcatggcggctcaacttcgacgggttccgccgtgcggagcttctggaggagaagccccctcgttctcttcatcactgccttggcaccttagtcaaagaagatgttgtggctgaatactatcagcagcaggttgagatgttggatgggtttggcgaaatggatactttaactgatcgcggtttcttgccccaaatgtcgaaggaagaacgtgaaagtcttgctaggagtgaaaccctagcgatccggatatcgaacgttgcaaacatggttctctttattgctaaagtttatgcgtcagttagaagtggttccttggcaatcatagcatccactctggattctcttcttgatctgttatctggcttcatcctatggtttactgcattctctatgcagacaccaaatccttaccagtatccgatcgggaaaaggcgcatgcagccgttaggaatccttgtgtttgcatctgtgatggcaactctaggtctccaaataattctggaatctgtacgctcacttgtatctgatgaaagtgaatttagcttgaccaaagagcaagagatatgggttgtggacatcatgctatctgtgaccgttgtaaagctttgtcttgttttctattgtcgatcgttcacaaatgagatcgtgaaggcttatgcgcaggaccacttttttgacgttattactaacatgattggcctcgtcgctgctcttcttgccaattacataacggattggatcgaccctgctggagcaatcttattagctatctacaccatcagaacctggttgatgacagttctggaaaacgtgaactccctcgtagggaaaacagcggcaccagagttcctccaaaagctcacgtacctatgctggaaccaccacaaggctataaggcacatcgatacggtgcgggcgtacacctttggttctcgctactttgtcgaggtggacatcgtcttgccatccgatatgcctcttagggaagcacatgatattggagaagcattgcaagagaagctcgagcttctgcccgacgtagaaagagcttttgttcatctcgactatgaatacactcaccgaccggaacattcccaagtgcaggactcataggttcgaaggctgcacggctgtcatcggaaagagggccatggtaatttctttgccctcttattgctattctgcattccagtaatatattttagtagtttgagatgttttctttagtagatgctaagtcactgcatgtactaggacctgtcattgaaatggtttatgccaaataatggaatagtaatggcaggcaacgcccgtaaggatgatgtatctccttcagaaatcaacaagattaagatggaaatttgtaaatgctgatataagaggcagctaaacttttgctccatttgtctcccttctttgatttgtgcttcatgagtattttgaacaagcattaactatttagcttgttttattaaagtatagtatttaattagaac

SEQ ID NO: 5787 - DNA, 1277 bp, Phalaenopsis aphrodite
tcaaagaagatgttgtggctgaatactatcagcagcaggttgagatgttggatgggtttggcgaaatggatactttaactgatcgcggtttcttgccccaaatgtcgaaggaagaacgtgaaagtcttgctaggagtgaaaccctagcgatccggatatcgaacgttgcaaacatggttctctttattgctaaagtttatgcgtcagttagaagtggttccttggcaatcatagcatccactctggactctcttcttgatctgttatctggcttcatcctatggtttactgcattctctatgcagacaccaaatccttaccagtatccgatcgggaaaaggcgcatgcagccgttaggaatccttgtgtttgcatctgtgatggcaactctaggtctccaaataattctggaatctgtacgctcacttgtatctgatgaaagtgaatttagcttgaccaaagagcaagagatatgggttgtggacatcatgctatctgtgaccgttgtaaagctttgtcttgttttctattgtcgatcgttcacaaatgagatcgtgaaggcttatgcgcaggaccacttttttgacgttattactaacatgattggcctcgtcgctgctcttcttgccaattacataacggattggatcgaccctgttggagcaatcttattggccatctacaccatcagaacctggttgatgacagttctggaaaacgtgaactccctcgtagggaaaacagcggcaccagagttcctccaaaagctcacgtacctatgctggaaccaccacaaggctataaggcacatcgatacggtgcgggcgtacacctttggttctcgctactttgtcgaggtggacatcgtcttgccatccgatatgcctctcagggaagcacatgatattggagaagcgttgcaagagaagctcgagcttctgcccgacgtagaaagagctttcgttcatctcgactatgaatacactcaccgaccggaacattcccaagtgcaggactcataggttcgaaggctgcacggctgtcatcggaaagagggccatggtaatttctttgccctcttattgctattcagcattccagtaatatattttagtagtttgagatgttttctttagtagatgctaagtcactgcatgtactaggacctgtcattgaaatggtttatgccaaacaatggaatagtaatggcaggcaacgcccgtaaggatgatgtatctccttcagaaatcaacaagattaagatggaaatttgtaaa

SEQ ID NO: 5788 - DNA, 1776 bp, Pteridium aquilinum
ctttgcttgtcatctgatctatctatccatcatcctatatgacatgcatgtatgtatgtgtgctttaagagatttgcaattccccaacgacttccaaagcagcgcccatggaacttcaccacagtaagctgcatcagcatcaaggtaatgctgcagacgatgaggaaggtgctcaggctttgctagcaggggaccgtcccgccagagagcttccttcctggcgtcttagcttccatggcttccaacgattatcttcttctgcttcagaaggccccccttctcccgtccactcttacacctgcgccctccatgactgtctcaagcgtctcggttctgccaacagagtggacgagtactatcagcaacaggaggagatgttggaaggcttcacagagatggacgtccttaccgatggcatcagggagttcgcttccaaggaagagcgagatcaagttgctaaagctgaaaggctggctatacaaatatcgaacttggcaaatttattgttgtttatctcgaaagtttatgtatcagtgagaaccttgtcactggcgattattgcatccacattggactcattgctagatttgctttcgggtttcatcttgtggtttactgcaatttctatgcagcagcctaatccctatctttatcccattgggaagaaacggatgcagccattgggcattcttgtgtttgcatcggttatggcgacattgggacttcaaattctaattgaatcggctcgccaactcgcttacagggacaaacaactcgcgctagatggtagtgacaaagcttggctcgttggaattatggtttttgtcacattggtgaagctggccctcgtgttttattgccgaagttataagaatgagattgttcgagcctatgctcaagatcatttctttgatgtcatgacaaactcaattggcctgttggcagcaattttggcaaattatttctactggtggatggatccagctggggcaattgtgttggcactgtatacaatcagaacttggtctttgacagtgctggagaatgtgaattctctggttggaaggactgcctcaccggaatacttacaaaagctcacatacctgtgttggaatcatcataaagatatacgccaaattgatactgtgcgggcatacacatttggatctcattattttgctgaggttgatattgtgcttccagctgatatgcccctgcagatggcccatgacattggtgaatctcttcagaacaagttagagtccctcgtagacatagagcgtgcatttgtgcatcttgattatgaggtgtctcatcgacctgaacatgctcagtatgattcttagctcttgctattcttttttccttctggaaactgaaagctgggctttgtagcagggtatatctgtctttagctttatccaactgaaaaggtctgttgtactagcaaggtctcccactagaaaagggggttttttgcagcgaaatccaacacatctctgctatcctaccgagccaagcgtaggacctaccacctacctttagaggctatttgtgcattttagcagcaacagaagattgattaaatggataagaacaatggctgtggctgcgtaatccagatcaaataactttctgatggtaaaacgctggttaactcttaaatgagaaagatgcttgcttatccaacatggacatttgccacttggtatgggatgcagaagggtgtaaattgttatgtgatattgcatcgtaagtggaactcgaaacttgaaa

SEQ ID NO: 5789 - DNA, 1875 bp, Brachypodium distachyon
acgctactccaaacccccctccggcgcgggcttgcttcgccttgatcggagggttcgggagggcggaagaaatggcggcggcggctggagagggagttggtggggagggcgaggagctcctgctccgctccgtcgaagcaggggacggcttgtgcgtgggggatcggccctggcgtctcaacttcgacggattccggcgtcaggaggcgcagcaggagaacccgccgcgcggccgcctccatgactgtctcggcgttttagctcaaggccctggagatgttattgctgaatactaccaacaacaattggaaatgttagaaggtttcaatgaaatggacacactaactgaccgtggttgcctgcctggattgtccaaggaagaacgcgagaaagttgcccggagtgagacattagccatccgattgtctaacatagcaaacatggttctttttgctgcaaaagtttatgcctcaataaggagtggctccctagctattatcgcttcaacgttggattctctgcttgacttgttatcgggatttatcttgtggtttactgccttttcaatgcaaacaccaaacccatacaggtaccctattggtaaaaggcgcatgcaacctttgggaatacttgtttttgcttctgttatggcaacactcggtcttcaaattattctagaatcaacacgctcattgctatctgatggaactgaatttcgcttgacaaaagagcaggagatgtgggttgtggatattatgctctcagtgacactggtgaaacttctgttggttatatattgtcgctcatttacgaatgagattgtgaaggcatatgcacaggatcacttttttgatgttatcaccaatattattgggctcgtggccgcacttcttgctaattatgttgaaggctggattgacccagttggtgctatcattctagccatctatacaatcaggacatggtccatgacggtactagaaaatgtccactccctggttggccaatcagcctcaccggaattccttcagaagctgacctacctatgctggaaccatcacgaggcagtcaggcacatcgacacggtgcgggcatacacgtttggctcccattactttgtcgaggtggatattgttctgccacgcgacatgcccttgcgagacgctcacgacatcggcgaggccctgcaggagaagctggagagcctgcccgagatcgagcgggcctttgtccacctcgactacgagtttacccaccagcccgaacatgctcgatcctacgacacatagcagcctgaaaccccggttgcagatcacagatcacagtttcagaaatctggaagtcgaaccttgttgcctttgtagattgtccgtggcatggcgtgattcggcttgtgcagttttcttatttgcctgctgtgctctagttgctctatagtatatatgaatcaatcataatgtttctgtgtatagtttccttgtcacgactgatcagtcatgaggtcgacatgtacaacaaagcatgctgcctgcgttacaataccattaatgcacaggctgatttagtcctgtagccggaacgggcgggaccagaggcgtgtcgccctcacaaagaatctatattgtacaagtcagccgtggcccatgacaatcgctgagctaccggacatccaattggcgcacgcctcagcgtggtgttgggaggtgtatatacggccgtagacgtccagctcagctcacgtacgccgggcgccggacgaagagaaacatagtagagcatgaaacgactgctgggacaagacaacaaagcagagcactagtatggatccaactctattcttccctgaagggtaggaatatcatttgttgcaaatta

SEQ ID NO: 5790 - DNA, 620 bp, Cryptomeria japonica
  misc_feature (182)..(182): n is a, c, g, or t
gtgctggctctctacacaatcaggacatggtcaaacacagttctggaaaatgtgaattctttggtgggtaaaacagcttcacctgattatttgcagaaattgacatatctctgttggaatcatcacaaagcgatacggcatattgatacagtcagagcttacacatttggttctcattactntgttgaagttgacattgtgctaccaagtgatatgcctttgcaacaggctcatgacattggagaagcgctccaagaaaagttggaatctattcctgacatagaacgggcttttgtgcatttagactatgaatactcacagacctgagcacgggaatgggcaattctagttgtatatgatagtttgtatacttcaactaacattcccaatattttcctcctttcatgtaaacctattattgcaaaccgatatctctctttcaacatgatatgtagtcactgtcaatgcttggtggtgtagtttttgttttgaagtatttgacaaaaatctttgaagaaattgtgctttagtttcttccaatttgttctctgtaaatgtggttaaggcacgggctccaaattatatccttggctggaaaaatattgaatactgattttctc

SEQ ID NO: 5791 - DNA, 667 bp, Cycas rumphii
gtaatatattgccgaactttcacaaatgagattgtgaaggcatatgctaaagatcatttttttgacgtaatcaccaactcaattggcttagttgctgctatccttgcaagtgcactgtactggtggatagatcctgctggagcaattgtgctggctctttatacgatctggacatggtcaaaaacagtgttggagaatgtgaactctttggttgggaaaacagcttcacctgactttttgcagaaactgacatacctctgttggaatcatcacaaagacataaggcatattgatacagtgagagcttacacatttggttctcattactttgttgaagtggacatagtccttcccagtgacatgcctttacaccgggctcatgacattggagaagcgcttcaggaaaaattggagcgtcttgctgagatagaacgtgcatttgtacatttagactatgaatatactcacagacctgaacatgggaaacaggactcatagttctgtaattagctgtcatattttttaatagaaactgctgctggaaagcattgccttttgttacttggtttctcccaagaagagtgatgtcaagcatgtctccagatccatcattccaatatgtatgatgtcaaacaatgctctttgttaatttacagcttttatctta

SEQ ID NO: 5792 - DNA, 1625 bp, Taxus baccata
tcggggttagtactagtaccctttccctttcattacctacactttttgacacatcgtaggtacccaatcttctgaaatattctcttcttcttccagagatagttgtaatagtgtcgtattacctgatcaagcaaccatggtggatccttcgcacgagggagctgagctgctgcttcatggaggaatagtcgagggtggaaacccaacaagtgaggagactgcatggaggctcaaatttgacagggttccgaggcctgaaagggatgagaaacgtccgagacgaatccatgattgctttaatgtagtgctcggtcctggtgatggagtggccgaatattatcagcagcaagaggagatgcttgagggttttacagaaatggatactgtttctgaacgtggttttctgcctggcatgtccaaggaagagcgtgaaaaggttgcaagaagcgagaggattgcaattcgtctgtcaaacttagcaaatgttgtcctttttgctgcaaaaatattcgcgtcaataaagagtggttctttagctataattgcttcaaccctagactcgctcttggatcttctttcgggctttattctttggttcacagcatttaagatgcggaaaccaaatccttatctctatcccattgggaaaaaacgcatgcaaccattgggaattctggtttttgcttcagtcatggctacactgggactgcagatcatacttgagtctgctcgacaacttatatcgaaggaggagggtttatcattagaaggagacaaatggcattgggttgttggaatcatggtttcagttactcttgtgaagttggcccttgtaatctactgccaaactttcacaaacgagattgtaaaggcatttgcccaagatcatttctttgatgttatcaccaacacaattggtctatttgctgcagttcttgcaagtactttttattggtggatagatccatccggagcaattgtgctagcactctacacaatcaggacatggtcaaacacagttttggaaaatgtgaattctttggtggggaaaacagcttcacctgattatttgcagaaattgacatacctctgttggaatcatcacagatccatacggcagatcgatacagtcagagcctacacatttggtggtcattacttcgtcgaggttgacatcgtgctacctagtgacatgcccttacaagaggctcatgacattggagaagaacttcaagagaaattagaatctcttcctgacatagaacgggcatttgtgcatttagactatgaatatactcacagacctgagcatgggaaaaggcatccctagtagtttacattgatatctacggtttaactaacttctctagtcttttccatatcgcatgtaaatctcatattgccaacatatactctttgaatgtgatatataatccctatcaaatacttagaagcatgtagttctcgtcttgttggagaattgcacaggttttgtttcaacagatttacagtccacataaatctccgaataacttgtgccatggtttcttagcacaagctccaaatatcctatccttaactggaaatactgaatgctttttttcataaaatatttgttcttctag

SEQ ID NO: 5793 - DNA, 1567 bp, Zostera marina
ggtttccggtagttggttgttctcctcgttttccgtttacacctatcagtttgtgcacccaagtagattttcccgtttcgcctccagagttttccatgctggaatcatcggttccaagagcatccagtgatgtcaatgtcgaagaagaggagctcaaactccttgccccatcttctttgtcggagaacaccgaggtatcctggcggctgaacttcgacaattttcgtcgctcggaccctgctgaatctgactcccgagaaagcctacacatgtgatgcacgattgtcttggaattctcgtgttagatgcgggaaatgacgttgcagaatattatcagcagcaagtagagatgcttgaaagctttgacgaaatggatgtattggctgatcgtggttatattcctggcatgacaaaaggaggtagacgtagaaagaattgctaaaaaatgagacatttgcaattcaaatatcaaatttggcaaatttttttctatttgtcgcaaaagtctatgcttccatcaacagtggttctttggcaatcatagcatccacattagattccctgcttgatcttttgtcggggtttatcctgtggttcactgcattttctatgcaaactccaaatccttataaatatcccattggaaaaaagcgcatgcaaccactgggtatcttggtttttgcatctgttatggcaacacttggtttgcagataattctagagtctgcacgttctatggcgtctggtgatggcgactttagcttgtcaacggaacaagaaaaatgggtgatatacatcatgggatcagtgacactggttaagcttgcacttatgatgtactgtcgctctttcaccaatgagattgtcaaggcctatgcacaggaccatttctttgatgttgtcaccaatactatcggtcttgtagctgctcttctggccaattatcttatgtactggatcgatccggtcggtgctatcattcttgctttgtacactattcgtacatggtctatgactgtgatggaaaatgtaaattccctggttggtcgttcagcaacgcccgagtttctacagaagttgacatatctttgttggaatcatcacaaggctatcttgcaaatcgatactgtcagagcctacacctttggatcacattattttgttgaggtagatattgtgttaccatcagaaatggtattaagagaagcacatgacataggagaggcattgcaggagaaacttgaaagattaacagagattgaaagagccttcgttcacctggattatgaggtcacgcacaagccagagcatgcacaagcgcatgagaattgaatctattcagtgcgatggttcaatgatcattctggcaacttattattattggtggtctagctaccatattttaagcttgaataggtttacataaactctaatctatatgtttttcagtttcagttttttttccattccactacactaatctgtatattctatggatattctacttgtccggtgtagacatgtaatagttatctttagtttaagtaattaatgtttatttcatcag

SEQ ID NO: 5794 - DNA, 429 bp, Cucurbita pepo
tggagctattattctggccttatacactattcgcacctggtcgatgacggtattggaaaacgtgaactcccttgttggaagatcagctgcccctgagtatctacagaagctcacctacctatgttggaaccatcacaaggccatcaagcatatcgatacagttcgagcatatacatttgggtcacactactttgtcgaggttgataccgttctgccaggagacatgcctctggaagaggcacacgacattggtgaatcattgcaagaaaagctcgagctcctgccggagattgagagggcctttgttcatctcgattacgagtacaagcataaaccagagcatgcgcagacacactcttagaacaaggcaaacacggtactctcttcactctacattccacccgatctatgtggtgagtgtagagatcg

SEQ ID NO: 5795 - DNA, 1356 bp, Distylium racemosum
gtccaggtgatggagtggctgaatattatcagcaacaagacgagatgattgagggttttacagaaatggatgttgtttctaaacatggatttttgcctggaatgtccaaggaagagcatgagaaggttgcaagaagagagaggactgcaattcgtatctctaacttagcaaatattgtccttttcctggcaaaaatatacgcatcgataaagagtggttctttagccataattgcgtcaactctagattcacttttggatcttctatcaggctttattctttggtttacttcatttaagatgcagacaccaaatccttatctctatcccattggcaaaaagcgtatgcaacctttgggaattctggtttttgcctcagttatggctacgttggggctgcagatcttgctagagtctgctcgacaactaatatcaaaggagcaaggtttatcgttagatggtggtaaatggcattgggttgttggaatcatggtttcagtcactcttgtgaagttgttccttgtaatttattgccgaactttcacaaatgagattgtaaaggcgtatgctcaagaccatttctttgatgtcatcaccaatgcaataggtctttgtgctgcagtgcttgcaagtactttgtactggtggatagatcctgctggagcaattgtgctagctgtctacacaatcaggacatggtcaaatacagtcttggaaaatgtgaattctttggttgggagaacagcttcacctgattatctgcagaaactgacatatctctgttggaatcatcacaaatccatacggcatatcgatacagtaagagcttacacatttggcacacattactttgttgaggttgacattgtgttgcccagcgatatgcccttacaagaggctcatgatattggagaagcacttcaggaaaagttggaatctcttcctgacatagaacgggcatttgtgcatttagactatgaatatactcacagacctgagcatgggaaacgatattcgtagttttccagatggatgtctatattttatgatggaaagttgggaatctctttcctttttgtgagtatcttactattagcatattgtcattctaatatgtgctgtataaatcaatcaatggattgtgaattatatatctcctgttttgatggggcattacgagcatgttgttgcaaaaattacaccagtcaacacaaaatttgccaaaaaagaaacttgtgtcatggtttctcagcaactcagtctatgtaaaacagttttataagtgatctccaaatttcatgctcattggctggaatattgaatgataaggttccttttctattcaatattccagcca

SEQ ID NO: 5796 - DNA, 973 bp, Momordica charantia
tggctgagcactaccagcagcaggtagaaatgcttgagggatttaatgaaatggatgccttaactgaccgtggttatgttcctggaatgtcaaaggaagaacgtgaaaagttagcaaagagtgaaacatttgcaatcagaatatcaaatgttgccaatttggttttgtttgtagctaaagtctatgcatcaatcagaagtggctccctagctataattgcatccacgctggattcccttcttgatcttttatctggtttcatcctatggtttactgcattttccatgcaaacaccaaacccgtaccagtatcctattgggaaaaaaacgtaatgcagcctttgggtattcttgtttttgcctctgtcatggcaactcttggattacagataatattggagtcaattcggactctcttatcagatgattctgatttcaagttaaccaaggagcaagagcgatgggttgttggcattatgctttcagttactctggtgaaattgctcttagttgtttattgccgtgctttcaccaacgagatagtcaaagcgtatgcacaagatcatttctttgatgtggtcacaaatgctatcggcctcgttgccgcactcctcgccaattatatagatgattggatggacccccttggagctattattctggctttatacaccatccgcacctggtcgatgacggtattagaaaacgtgaactcccttgttggaagatcagctgcccccgagtatctacagaaactgacctacctatgttggaaccatcacaaggcaatcagacacattgacacagtccgggcatacacatttggatctcactactttgtcgaggttgacatcgtcctgcctggagacatgccactggaagaggcccatgacatcggtgagtcgttgcaggaaaagctggagctcctaccggaaatcgagagggtcctttgttcatctcgattacgagtacaa

SEQ ID NO: 5797 - DNA, 665 bp, Avena sativa
attgggcttgtggccgcacttcttgctaactatttcgaaggctggattgacccagttggtgctatcatcctggcgatctatacaatcaggacatggtctatgacggtgctggagaacgtgcactccctggtcggccagtcggcctcgccggagttcctccagaagctcacctacctgtgctggaaccaccacgaggccgtgaggcacctcgacacggtgcgggcgtacaccttcggctcccactacttcgtggaggtggacatcgtcctgccgtgcgacatgcccctgcaggaggcgcacgacatcggcgaggccctgcaggagaagctggagagcctgcccgagatcgagcgcgccttcgtccacctcgactacgagttcacccaccagcccgagcacgctcggtcctacgacacatagtgtatagatctgtatagcctgaaccccggcactgttcgtggaacttcagagattctgagctgctttgcctgctctgctttgttattagtactacgaccttagtactagagatctcttagtactactgcctgctctgctttgccttcctgcccatttctggtgcattatttttgctgctgtgatcatatctctctcgctcacagaaaagctaacgtctccttgcctcgactgaacagtacgtaaga

SEQ ID NO: 5798 - DNA, 704 bp, Avena sativa
acttcttcgatgttatcaccaacattattgggcttgtggccgcacttcttgctaactatttcgaaggctggattgacccagttggtgctatcatcctggcgatctatacaatcaggacatggtctatgacggtgctggagaacgtgcactccctggtcggccagtcggcctcgccggagttcctccagaagctcacctacctgtgctggaaccaccacgaggccgtgaggcacctcgacacggtgcgggcgtacaccttcggctcccactacttcgtggaggtggacatcgtcctgccgtgcgacatgcccctgcaggaggcgcacgacatcggcgaggccctgcaggagaagctggagagcctgcccgagatcgagcgcgccttcgtccacctcgactacgagttcacccaccagcccgagcacgctcggtcctacgacacatagtgtatagatctgtatagcctgaaccccggcactgttcgtggaacttcagagattctgagctgctttgcctgctctgctttgttattagtactacgaccttagtactagagatctcttagtactactgcctgctctgctttgccttcctgcccatttctggtgcattatttttgctgctgtgatcatatctctctcgctcacagaaaagctaacgtctccttgcctcgactgaacagtacgtaagaaaaaaaaaaaaaa

SEQ ID NO: 5799 - DNA, 358 bp, Olea europaea
gagctattattctgtcattgtacactatccgaacatggtcattaaccgtgctggagaacgtgaactcccttattggaagatcagctgcaccggaatatctacagaaactcacctacctatgctggaatcaccacaaatccataaggcacatcgacactgtaagggcatacacctttggctctcattatttcgtcgaagtggatattgtgttgccagcggacatgcccctgcaagaagctcatgacattggagaatccttgcaagagaagcttgaaattctgcccgagatagagcgtgcttttgttcatctcgattacgagtatactcataagcctagaaacatgcacaagcgcatctg

SEQ ID NO: 5800 - DNA, 1443 bp, Cephalotaxus harringtonia
cagagaagcgagctgctgcttcatgtaaggcatggtgggagtggcgacccaacaagcgaggagaatgcatggaggctcaaatttaacagggtttcaaggcctcgaagggctgatgatatgcctcaaagaggaatccatgattgcttcaatgtagtactcggtcctcgtgatgtagtggctgaatattatcagcagcaagaggagatgctagagtgttttacagaaatggacgctgtttctgggcgtggtttgctgcctggcatgtccatggaagagagtgagaaggttgcaagaagcgagaggattgcaattcgactgtccaacttggcgaatgttgtcctttttgctgtaaaaatatatgcatcaataatgagtggttcattagctataattgcttcaaccctagactcactcttggatcttctatcgggctttattctttggtacactgcatttaagatgcagaaaccaaacccttatctctatcccattgggaaaaagcgcatgcaaccactgggaattctggtttttgcttcagtcatggctacactgggactgctgatcttgttagagtctgttcgacaacttgtatcaaaagaggcagctttatcattaaaaggaggcaaatggcattggcttgttggaatcatggtttcagtcactgttgtgaagttgttccttgtaatctattgccgaactttcacaaacgagattgtaaaggcatatgcccaagatcatttctttgatgtaatcaccaactcaattggtctatttgctgcaattcttgcaagttatttttattggtggatagatccagctggagcaattgtgctagcactctacacaatgaggacatggtcaaatacagttttggaaaatgtgagttctttggtggggaaaacagcttcgcctgattatttgcagaaattgacatatctctgttggaatcatgacaaagccataaggcatattgatacggtaaaagcttacacatttggttctcattactttgtcgaggttgacatcgtgctacccagcgatatgcctttacaacaggctcatgacattggagaaggacttcaagaaaaattggaatctctttccgatatagaacgggcctttgtgcatttagactatgaatgtactcacagacctgagcatgggaaaaggcgttcctagtagtttacattgatgtctatattttaactaacatatgctcctcttcgaatgtgataaataagcctaatcaatgcttagtaatttataggtagctcacttgtcttgttggacctttgcaagtgtgcagattttgttttgaaagatttacacggtccatgtgaatctccgaataacttgtgccatggtttcttagcaacttggactatgtgttacatggttaagacatgagctccaaatttttgtcctttacaagaaatattgaat

SEQ ID NO: 5801 - DNA, 1244 bp, Setaria italica
ggaatggcggcggctggagcgaggggtggcgaagagggcgaggagctgctcctccgtgccgtggatgccggggacgacgtgagcggcggcttgtgcttgggggagaggccctggcggctcaacttcgaccggttccgccgcccggaggcggagcaggagaagccggcgcgcgggctccacgactgcctcggcgtgctagctcaaggctctgctgatgatgttgcagaatactaccaacaacagttggaaatgctggaaggttttaatgaaatggatacactggcagatcgtggtttccttcctggaatgtctaaggaagagcgagagatggttgcccaaaaagagacatgggccatccgattatctaacattgcaaacatggttctttttgcggcaaaagtttatgcctcagtaaggagtgactccctagctattgttgcttccaccttggattctctactcgacttgttatctggttttatattgtggtttactgccttttctatgcaaacaccaaacccatacagatacccaattggtaaaaggcgcatgcaacctctgggaatactagttttcgcttctgtcatggctacgcttggtcttcaaattatcatagaatctacacactcactggtatccgatggcgatgaattccgcttgacaaaagagcaggaaaagtgggttgtcaatattatgctctcagtgacactggtgaagcttctcctggttatatattgccgaacattcaccaatgaaatagtgaaggcctgtgcacaggatcacttttttgatgtcatcaccaatgttattgggcttgtggctgcacttcttgctaattatgttcaaggctggattgacccagttggagctatcattctcgcgatctacacaatcaggatgtggtcgatcacggtgctggacaatgtccactctctggtcggccagtcggcaccaccagcatttctccagaagctcacctacctatgctggaaccaccacaaggccgtgaggcacattgacacggtgcgggcgtacacatttggttcccactacttcgtggaggtggatatcgtccttccctgcgccatgcccctgcgagaggcccatgacatcggcgaggccctgcaggagaagctggagcgcctgcctgagattgagcgggccttcgtccacctcgactatgagttcacccaccagcccgagcatgctcggtcgcatgacacatagctgactgaaatccaaca

SEQ ID NO: 5802 - DNA, 1578 bp, Setaria italica
atcgcggctgctcctctagctctactcctcatcgctcttccttgtcgcggcttgcgggaggcccgtgtcgtcgaccacgagggttcgggagagaggggcaggcgcggagggaatggcggcggctggagcgaggggtggcgaagagggcgaggagctgctcctccgtgccgtggatgccggggacgacgtgagcggcggcttgtgcttgggggagaggccctggcggctcaacttcgaccggttccgccgcccggaggcggagcaggagaagccggcgcgcgggctccacgactgcctcggcgtgctagctcaaggctctgctgatgatgttgcagaatactaccaacaacagttggaaatgctggaaggttttaatgaaatggatacactggcagatcgtggtttccttcctggaatgtctaaggaagagcgagagatggttgcccaaaaagagacatgggccatccgattatctaacattgcaaacatggttctttttgcggcaaaagtttatgcctcagtaaggagtgactccctagctattgttgcttccaccttggattctctactcgacttgttatctggttttatattgtggtttactgccttttctatgcaaacaccaaacccatacagatacccaattggtaaaaggcgcatgcaacctctgggaatactagttttcgcttctgtcatggctacgcttggtcttcaaattatcatagaatctacacactcactggtatccgatggcgatgaattccgcttgacaaaagagcaggaaaagtgggttgtcgatattatgctctcagtgacactggtgaagcttctcctggttatatattgccgaacattcaccaatgaaatagtgaaggcctgtgcacaggatcacttttttgatgtcatcaccaatgttattgggcttgtggctgcacttcttgctaattatgttcaaggctggattgacccagttggagctatcattctcgcgatctacacaatcaggatgtggtcgatcacggtgctggacaatgtccactctctggtcggccagtcggcaccaccagcatttctccagaagctcacctacctatgctggaaccaccacaaggccgtgaggcacattgacacggtgcgggcgtacacatttggttcccactacttcgtggaggtggatatcgtccttccctgcgccatgcccctgcgagaggcccatgacatcggcgaggccctgcaggagaagctggagcgcctgcctgagattgagcgggccttcgtccacctcgactatgagttcacccaccagcccgagcatgctcggtcgcatgacacatagctgactgaaatccaacacggttcagaatgatctgaaactaatgggatcagagaatcctgttttgggtgccaaagcagattgcatgtgagtacgtgacagcaggctgtgattatgttgtgcatattttatttgattgcctgctgaactgtagcaggcagttactactggtgggtaatcttctaaagaatagatagctgttgtatacgctttgtctacgtatatgaatcttgtgccttaagtta

SEQ ID NO: 5803 - DNA, 1968 bp, Pseudotsuga menziesii
gatgctgaccagtaaactagtaaattttattggagcagatctagaacagttatctttactaaatatatatattctcttaagggcagagagatcctgcaatatctgttatctgttattcttctttacatattatctgtcatccaacaatggctgattctctatcatcccctctgtcagatcatggaatccagaaggctgagcccagcgaggagaatgcatggcatcagccatcccctctgttagaccatggagttgagaaggctgagcccagcgaggagaatgcatggcaccagccatcccctctgtcagaacatggaatcaagaaggctgaacctagcgaggaggagaattcatggcgcgtgaatttcaatcagattcagaggcccgaaatgaatgaaaagcctaaacgctgcttgaatgtgcccggtccttgcagtggtgatggagtgactagatattatgagcagcagaaggagatgcttgagggattcacacaaatggattttgtcaataatagtgatgtttcgcttggcatgtctaaggaagattgcgacaagcttgcaagaagtgaagcaactgcaatccgattatctaacattgcaaacattgtgcttttcattgccaaagtatatgcatcaataaagagtggctcgttagccataattgcttcaactctagactcacttctggatcttctgtcaggctttattctttggttcactgcagttaaaatgcagtcaccaaatccttaccgttatcccattgggaagaaacgtatgcaaccactgggaattatggtttttgcttcagtcatggctacgttgggattggcaatcttactagagtctattcgacaacttatatccaaggaacataatttatctttacaaggcagcggatggcattgggtggttggaatcatggtttcagtcactgtcgtgaagttcgtccttgtaatctattgtcgaagttttactaatgagattgtcaaggcatatgctcaagatcacttctttgatgtcatgaccaatgcaattggtctcgttgctgctatccttgcaagtaagctatactggtggatagatccagctggagcaattgtgctggctttctacacaatgagaacatggtcgaagacagttttggaaaatgtgaattcattagttgggaaatcagcttcgcctgattatttgcagaagttgacatacctctgttggaatcatcaccaagccataaggcatattgatacagtgaaagcttacacatttggttctcattattttgttgaggtagacattgtgctgcccagtgatatgcctttacgagaggctcatgacgttggagaagcacttcaggagaaactggaatctcttcctgacatagagcgggcttacgtgcatttagaccatgaatatacccacagacctgagcatgggagaagtcactcctaacttcggacttaggtgtcatactttataacaggaactacataatctactttttcaggtttcataatctaaataaaggtcatgccaatatcaagaaatttgaaccatgtttcttattgactacgtatgccatgccatatgatgtttgtgttgatgttaaagaaaatctcgagagccagattatttatgcagggaacagtccagcatatgttgaccttaaaacttggcatcatagttgcttcttccagataagttctgagataatagatatttacatattctgcatttatgaaagcagatctctctgtgatgcttggggtaacccttaaacctcacaaagcaagctgtaggcacatcattactgatcacaatttccgaaccggtttcaactcttgtgcacagtgcacacgtcttcccttccaatctgaacaccgtaattgaagaagtggcacaatttagatttgcatatttcatagtgatattttatagtggaagtaatatgatgaaaattatatgaggc

SEQ ID NO: 5804 - DNA, 1089 bp, Pseudotsuga menziesii
tatatgcatcgataaggagtggctcattagccataattgcttcaactctagactcacttcttgatcttctatcaggctttattctttggttcactgcagctaagatgcgatctccaaatccttacctttatcccattgggaagaaacgcatgcaacctgtgggaattctggtgttttcttccgtcatggctacattgggattgcagatcttgatagtgtctattcgacaacttgtatccaaggagcatggtttatctttagaaggtggaaaatggcattgggtggctggaatcatgatttcagtcactgccgtgaagtttgtccttctaatctattgtcgaagtttcaataatgagattttgaaggcatatgctcaagatcatttctttgacgtcgtgaccaatgcaattggtctagtcgcagctatccttgcaagcaaattttattggtggatcgatcctgctggagcaattgtgctggctctctacacaatgagaacatggtcgaacacagttttggaaaatgtgaattcgttggttgggaaaacagcttcacctgattatttgcaaaagttgacctatctctgttggaatcatcaccaagccatacggcatattgatacagtgaaagcttacgcatttggttctcattattttgttgaggtagatattgtgctacccagtgatatgcctttacagcaggctcatgacattggagaagcactacaggaaaagctggaatctcttcctgatgtagaacgtgcttttgtgcatttagactatgaatatagtcacagacctgagcatgggaaaggagacacctagattcgtacttaagtgtcatattttgtaataggatcctcataatctgtttcgcaggcttcttttagtctgtcattgccaatatcatcattctaatatgtgacgttaaagcaatattgcgggatttcatagctcttccctctttacagattattacaagtcggcatgtttttcttcggaaaacttgcatatataaattaggaccgggtgtatgccgggactttctaacaacgtggtctttataaaatggcttaattagaagtgcgat

SEQ ID NO: 5805 - DNA, 1321 bp, Abies balsamea
tgcttcactgcgttcggtccttgtagtggtgatggagtggccaaatattatcaacagcaggatgagatgctcgagggattcacagaaatggattatgtcaccgataatggagttttacctgtcatgtctaaggaagattgcgacaagcttgcaagaagtgaaacaaatgcaattcgattatctaacatagcaaacattgtccttttcattgcaaaagtatatgcatcgatacagagtggatcattagccataattgcttcaactctagactcacttctggatcttctgtcaggctttattctttggttcactgcatttaagatgcagtcaccaaatccttaccgttatcccattgggaagaaacgtatgcaaccgctgggaattatggtttttgcttcagtgatggctacgttgggattggcaatcttgctggaatctattcggcaactgatatccaagtcacataatttatctttagaaggcagcggatggcattgggtggttggaatcatggtttcagtcactgtcgtgaagttcatccttgtactatattgtcgaagttttactaatgagattgtgaaggcatatgctcaagatcacctctttgatgtcgtgaccaatgcaattggtctaattgctgctatccttgcaagtaagctatactggtggatagatcctgctggagcaattttgctggctctctacacaatgaggacatggtcgaacacagttttagaaaatgtggtttcattagttgggaaaacagctccgccttattatttgcagaagttgacatacctctgttggaatcatgaccgagccatacgtcacattgatacagtgaaagcttacacatttggttctcattattttgttgaggtggacattgtgttacccagtgatatgcctttacaacaggctcatgacgttggagaagcacttcaggaaaaactggaatctcttcctgacatagagcgggcttacgtgcatttagatcacgaatataagcacaaacctgagcatcgaaagtgtctctcttaactatatatgtcaggttatatttgtattgatgataaagaaaataatcgagaaccagattatttatgcagagaacaatccaacatatgttgaccataaaacctagcgtcatagttgctctttgcagataagttcggagataattgaaagatttatatattctgcatttgttaaagcaaatttctttgtgatgcatgtggtgacccttatcctcacaaagctctgtgagcaggctgcagcacattattactgataacaattttttatcaatttcaaatcctgt

SEQ ID NO: 5806 - DNA, 1248 bp, Sciadopitys verticillata
ggaacctttgggtactgagcttctggtccgtggactagatattgaggctgtagaagaaacaagcacagagaatgcatggagattgaatttcaccaagattcagaggcctgaaaggaatgacagcactcaccgacgaattcaagactgcttcaaaatggtgctcggtcctgctgatggagtggctgagtattatcagcagcaagaggagatgcttgagggttttacagaaatggatgctgtttctgagaacggacctttgcttggaatgtccaaggaagactgtaacaagcttgaaaaaagagagaggactgcaattcgactgtccaacttagcgaacatcgtccttttcattgcaaaagtttatgtgtcaataaagagtggttcattagccatacttgcttcaacattagactcgctcttggatcttctatcaggctttattctttggttcactgcatttaaaatgcggaaaccaaatccctatcgctatcccattgggaaaaagcgcatgcaaccattgggaattctggtttttgcttcagtcatggctacgttgggactggcgatcttgctagagtctcttcgccaacttatatcaaaggagaaaggtttatcgctaggtggcggcaaatggcaatgggttgttggcatcatggtttcagttactgttgtgaagttcttccttgtaatctattgccgaactttcacaaacgagattgtaaaggctttcgcccaagatcatttctttgatgtaatcaccaattcaattggtctaatagctgcagttcttgcaagtaagttctactggtggatggatcctgctggagcaattgtgttggctctctacacaatcaggacatggtcaaaaacagttttggaaaatgtacattctttggttggaaaaacagcttcacctgattatttgcagaaattgacatatctctgttggaatcatcacaaagatatacaacaaattgatacagtaagagcttacacatttggtgctcattactttgttgaggttgacattgtgctacccagcaatataccgttacaacaggctcatgacattggagaggcacttcaggaaaagctggaatctcttcctgacatagaaagggcctttgtgcatttagactacgaatattctcacaggccagagcatgggaaaagacattcctgattttataaatgggtatatattcagcaatggaaactttcaaatctcttttccattctgcatgttaa

SEQ ID NO: 5807 - DNA, 848 bp, Brassica napus
gcattctgtgaaggaagatcttgcaaacatgatagctcctttaatcttcagaccaatcaccagatggcccttctacgcatttctaggcggcgctatgttctgtctattagcaagcagcacctgccacctcctctcctgtcactcagagcgtgtctcttacataatgctaaggcttgactacgctggaatcgcagctctgatctccacttccttctacccacctgtctactactccttcatgtgtgatccattcttctgcaacctctacttaggattcataacaatcttaggcatctccacggtgctcgtctcgctcttaccagtcttccaaagccctgagtttcgcgttgtgagggcctctcttttctttggaatgggattctctggagctgctccgatacttcacaagctgatcatcttttgggaccagcctgaggcgcttcacacaacgggttatgaggttttgatggggttgctttatgggttgggagctttggtttatgcgactaggattcctgagaggtggatgcctggtaagtttgatatagctggacatagccatcagttgtttcatgttttggtggttgctggtgcgtttacacattatagagctgggcttgtttatctcaagtggagagacatcgaaggatgttgaagatttgatgatttgaatctttctttttgtagcttcacgaaaaagttggattgtgtaaagtctatgtgtaagcaaattgttttttttttaattacccttgatcctaaccctaacacatagggccggtcatgtgtaaaacagatgaaacataggcctcgaaccctcaatttttgagaaaattgcataaacttgc

SEQ ID NO: 5808 - DNA, 417 bp, Raphanus sativus
aacctctacttaggattcatcacaatcctgggaatctccacggtcctcgtctcgttcttacccgtcttccagagccctgagtttcgtgtagtgagggcctcttttttctttggaatgggattttccggcgccgcgccgatcctgcataagctgatcatcttttgggaccagcccgaggcgcttcacacgacggggtatgaggttttgatggggttgctttacgggttgggagctttggtttatgcgactaggatccctgagagatggatgcctggtaagtttgatatagctggacatagccatcagttgtttcatgttttggtggttgcctgtgccttcacgcattatagagcagggcttgtgtatctcaagtggagagacattgaaggatgttgaaagtatttgatggaatcttct

SEQ ID NO: 5809 - DNA, 678 bp, Raphanus sativus
  misc_feature (266)..(266): n is a, c, g, or t
  misc_feature (477)..(477): n is a, c, g, or t
  misc_feature (560)..(560): n is a, c, g, or t
  misc_feature (574)..(574): n is a, c, g, or t
gtctactagcaagcagcacgtgccacctcctctcgtgtcactcagagcgagtcgcttacataatgcttaggcttgactacgcaggaatcgcagctctaatcgctacttccttctaccctcctgtctactactccttcatgtgtgatccttttttctgcaacctctacttaggtttcattacaatcttaggacttgccaccgtgcttgtctctttagtaccggtcttccaaacaccggagtttcgtgttgtgagggcctctctattntttggaatgggattttctggagcagctcccatcctacacaagctgatcatcttttgggaccagcctgaagcgcttcacactacatgttatgaggttttgatgggtttgctttacgggctaggagctttggtttatgtgactaggatacctgagagatggatgcctggtaaatttgatatagctggacatagccatcagttgtttcatgttntggtggttgctggtgccttcacacattatagagcagggcttgtgtatctcaaatggagagatattgaaggatgttgaatattnagatggatatttgnatcttatttttttgtagctttgccaaaaagttggattgtgtaaaagtctatgtgtaagcaaatgtttctcttatttatattcacaacgagtactgaacagacga

SEQ ID NO: 5810 - DNA, 548 bp, Thellungiella halophila
ctctacttaggattcataacgatcctaggaatcgccactgttcttgtctcgctcctccccgttttccaaagcccggagtttcgggtcgtgagggcctctctgtttttcgggatgggattctctggcgcggctccgattctgcataagctgatcatcttttgggatcagccagaagcgcttcacacgacaggttacgagattttgatgggtttgctttacgggttaggagctttgatttatgcgactaggattccagagagatggatgcctgggaaattcgatatagctggacatagccatcagttgtttcatgtcctggtggttgctggtgcgtttacacattatagagccgggcttgtgtatcttaagtggagagatattgaaggatgctcatgaagataaaggattaggtttgaatctttgatgtttctgaatctttgtttgtagcttcgtaaaaagaatttggactgtgtaaagtctatgtgtaagcaaatatttcttgttaattcggaattaatattgggtcaaataagagaatcttacaaatc

SEQ ID NO: 5811 - DNA, 440 bp, Brassica napus
tcttctgcaacctctacttaggattcataacaaccttaggaatcgccaccgtgcttgtctctttaataccggttttccaaacaccggaatttcgtgttgtgagggcctctctgttctttggaatgggattctctggcgcggctccgatcctacacaagctgatcatcttttgggaccagcctgaagcgcttcacactacatgttatgaggttttgatgggtttgctttacgggttaggagctttggtttatgtgactaggatccctgagagatggatgcctggtaagtttgatatagctggacatagtcatcagttgtttcatgttctggtggtggccggtgccttcacacactacagagctgggcttgtgtatctcaagtggagagacattgaaggatgttgaatagtaagatggatattgatatttgtatttttttgt

SEQ ID NO: 5812 - DNA, 1745 bp, Gossypium hirsutum
agtcctccgcccgagatttctgtttttatagaaggattcccgtctgggttttcattctcagtccgtgattcttcaatttccttcattttcagttagaaagatgggcagcgtggaacaagtttgtgaagattcaaacctgccaaccgaaacaatggagcagtgtaaagtgaactgttcaaaggaagggaaagggaagaggttgtggaaaaaggttaagtatcagctggttgagtaccactcattgcctggatatttgagggacaatgagtatattttgggccactatagatcagaatggccaatgaaacaggttttgcttagcatcttcacaattcacaacgaaaccttgaacgtttggacgcatttgattgggttcttcattttccttgcccttacgatatacactgcaatgaaggttccgaaggttgttgattttcactctctgcagcacattcctgatgtattgagaaaggctgatttacacaaactgcattcagaattaatgacatgcctgccttccttaccaaatatgcccggtttgcacaaacttcgggaggagttactgttgctctcaggttggcatgtcagggaacttctgtataattgtttacctgagcgtttcttttctggaaatcacaccgatgtttgtgttttgcaaagtgtgaaggaggatgtggcaaacataatagcacccctgatggtgagaccgataacacggtggcctttctttgccttcttgggtggtgcaatgttctgcttgctggctagcagcacatgccaccttctctcttgccactctgagcgcctatcatatatcatgctcaggctagactatgctgggatcgcagctctcatatctacttccttctatcctccggtgtattactccttcatgtgcgatccattcttttgcaacctctatttgggattcataaccatcttgggagtctcaacgatcttagtttccttattgccagtgtttcagaatcccgagtttcgcagcattcgtgcatccctcttctttggcatgggcatgtcaggaatagcacccattcttcacaagctcatcttgttctggcaccagcctgaggcacttctcacaaccgggtatgaggttttgatggggcttttttatggcattggagctttggtctatgcgacaaggataccggaacggtggatgcccgggaagttcgacattgctgggcacagccaccaactttttcacatcttggtcgttgcaggggcatacactcattaccgtgcaggactggtttacctcaaatggcgggatctaaatggatgttaaagtgaaactagagaggagtcgattactgaaagaagtagctaaaatttatgtgcggttgaatttatgatcaacacattgtcagtcaagtgtatattcttcattaaatcagtcttacagctctaagaaccattagctttcagccttagtttatgttctaaacatgcaaatacttgtaataatgtggcagagacgagaacttaatgttttggaggttttaacttctatgcattaatatacacagcttgtatacttataattgggggggggggtggatgctaaatggcggagaatagcctgtaaaatttgacttagaacacagtgtaacttatttttgctttaggttttcttttcttttttcttctttaggaaagaatagccaagattgctggtaaaaattagagcatttttaagttaaagatgttactttaatcgaata

SEQ ID NO: 5813 - DNA, 708 bp, Raphanus sativus
ggatgcaatcactaaacttgggatggtgtgagaagatcagtgatgatggggttatgagtttagcttatggctgtccagatctcaggactctggacttgtgtggttgtgttctcattacagatgagagtgtggtagctttagctgattggtgtgtccacttgaggtcactggggctatactactgcagaaacataacagacagagccatgtactcgctagctcagagcggggtgaagaacaaacaaccggggcaatggaaatcatcagctaagaagagcaaatacgacgaagaagggctgagaagtctcaacatcagccaatgcactgcacttacaccttcagctgttcaagcggtctgcgatacgtttcctgcacttcacacgtgttcggggaggcattcgcttgtgatgagcgggtgtttgaacttgacgtctgtgcactgtgcttgtattcttcaggctcatcgcgcggttgttcctcactctgctcactgaaggagagagtgaatgggttatgtttgtatatagagaagcataatatgtttgaggagattagatgccaaaacttgaaaatgcttttgagttggtttcttttatgttgtcttgaatgatcttttgtatgtgttggttggtgtaatgtccaagaggactgtatgaactcttggttactacctattaccgaaatagagttcctcttatcacaagatac

SEQ ID NO: 5814 - DNA, 1203 bp, Brassica napus
agagaaccaagaaaccgctttcaagaagtattaaaagatggtgagtcaagaagggccagcaacacttgaccgatgctttgaaaagatgaagatggaaggagtcgtgatcaccgagtggaaagatatccctgtggagcttctcatgaagatccttaaccttgttgatgatcggacggtcatcattgcttctggtgtttgcagtggctggagagatgctatttcctttggtctcactcgtctctccctctcttggtgcaagaagaacctgaacagtttggttctgtctcttgctccaaaactcgtcaagcttcagacattagtattgagacaggacaaccctcagcttgaggacaacgcagtggaagcaatagcgaatcactgtcacgagctacaagatcttgacctaagcaaaagcttgaaactcactgaccattctctctattctgtggctcgcggttgcacaaacctcactaagctaaaccttagcggctgcacttccttcagcgacactgctttagcctatttgacaaggttttgcaagaagctcagagttctgaatctttgtggttgtgttgaagctgtttctgacaatgcattgcaggctattggggaaaactgcaatgagatgatggagtcatgagcctagcttatggctgtcctgatctaagaacccttgatctttgcggctgtgttctaattacagatgagagtgtggtggctttggcaaataagtgtgtacacttgaggtcattggggctatactactgcaggaacataacggacagagccatgtactcgctggctcagagtggagtgaaaaacaagcacgagatgtggcggtcggttaagaaaggcaagttcgatgaagaaggactaagaagcctcaacattagccaatgcacttaccttacaccttcagcggttcaagctgtctgtgatacattccctgcgctccacacttgctcaggcaggcattctctggttatgagtggttgtctgaatctaacatcagttcactgtgcctgtatcctccaggctcaccgcacccacaccgcttaccctcacccggctcattaaagcaccagtgtgtaagccagagaggtctctcttccttggtatgtgtacatataagcctaaggttaagaataaagcttatttgtttgagtttatcttcccatctcaagattttacattacagcaacc

SEQ ID NO: 5815 - DNA, 711 bp, Brassica juncea
caaccttagcggctgcacttccttcagcgacactgctttggcctatttgacaaggttttgcgggaagctcaaagttctgaatctttgtggttgtgtggaagctgtatctgacaatgcattgcaggctattggagagaactgcagtcaaatgcagtcactaaacttgggatggtgtgagaagataagcgatgatggggtcatgagtttagcttatggctgccctgatctaagaagccttgatctctgtggctgtgtacttattacagatgagagtgtggtggctttggcgaaccgttgtgtacacttgaggtcattggggctatactactgcagaaacataacggacagggccatgtactccctggctcaaagcggagtgaagaacaagcacgagatgtggagatcggttaagaagggaaaattcgacgaagaaggactaagaagccttaacatcagccaatgcacttacctaacaccttcagcggttcaagcggtttgcgatacgttccctgcgctccacacttgttcaggaaggcattcgcttgtcatgagcggttgtctgaatttgacatcggttcactgtgcttgcacccttcaggctcatcgctctcacactgctttacctcacccggctcattgaactagtgttaaagacaagagggggtctctttcccttgctatgtgtacatacaagcctagaggttaaataaa

SEQ ID NO: 5816 - DNA, 834 bp, Raphanus sativus
gcaaagttctaaatctttgtggctgtgttgaagctgtatctgacaatgcattgcaggctattggagaaaactgcagtcagatgcaatcactaaacttgggatggtgtgagaatgtaagtgatgatggagtcatgagtttatcttatggctgtcctgatctaagaacccttgatctttgtggatgtgttcttattacagatgagagtgtggtggctttggcgaataagtgtgtacacttgaggtcattggggctatactattgcaggaacataactgacagagcaatgtactcactggctcagagtggagtgaagaacaagcacgatatgaggcggtcggttaagaaaggcaagttcgatgaagaaggactaagaagcctcaacattagccaatgtacttaccttacaccttcagctgttcaagctgtctgcgatacattccctgcgctccacacttgttccggcaggcattcgcttgtcatgagtggttgtctgaatttaacatcggttcactgtgcatgtatcctccagacccaccgcacccacacagcttaccctcacccggctcattgaaccagtgtctaaggcataagggtctcttctttggtatttgtacatataagcctaaaattaaaagaaaaaaaaatataagcttgtctgtttgaggtttatcttcacatctcaagattttacaaccttaaaatgattacaaggttctttactttgttttacaatatttgtataactttgatgatccatcactcatcatcagataataacgaataactcaaataataagaggctacatatgacagtagcagtcctctttcagtta

SEQ ID NO: 5817 - DNA, 1125 bp, Raphanus sativus
ggattctcacaagcgtccacgggattcatttgcttacaaagagctaagaagattgaagaacattacagagtcgcaaataattcgaaacccagaaaaagaggcacgaaagaacactttattcagagaatcaagaaaccgcttaatagagtcaagtatataaccgaggctcacttaaccgaggctttgagaagatggaaggcatcatgatcaccgagtggaaagacatccctgtggagcttctcatgaggatccttaaccttgttgatgatcggacgatcatcattgcttctggtgtttgctctggctggagagatgctatctcctttggtctcactcgtctctccctctcttggtgcaagaagaacatgaacggtttggttctgtctctagctccaaaactcgtcaagctgcagactctagtacttgacaaagttttgcaggaagctcaaagttctgaatctttgtggttgtgtggaagctgtatcggataatgcattgcaggctattggagagaactgtagtcaaatgcagtcactaaacttggggtggtgtgagaagataagtgatgatggagtcatgagtttagctgatggctgtcctgatctaagaagccttgatctttgtggctgtgtacttattacagatgagagtgtggtggctttggcgaatcgctgtgtacacttgaggtcattagggctatactactgcagaaacataaccgacagggccgtgtactcgctggctcagagcggagtgaagaacaaacacgagttgtggagatcagttaagaaaggcaaattcgatgaagaaggactaagaagccttaacattagccagtgcacttacctcacaccttcagcggttcaagcggtttgcgatactttccctgcgctccacacttgttcaggcaggcattcacttgttatgagtggttgtctgaacttaacctcggttcattgtgcttgcatcctccaggctcaccgcgcacacacacactctgctttacctcaccctgctcattgaacttgtgtgtaaagacaagagagacctctctctctcactgggcatgtgtaaatacaagcccacccagaggttaaataaataaaagtttgtttgtttgagtta

SEQ ID NO: 5818 - DNA, 798 bp, Brassica napus
gcagtgctgcactaaaccggcatgacgtcccatgccagccgcacctaagcttggatcctatagagcggccgctcgggatctagaactagtggaggtggatttggcctatctctcaacttggtgtttgctcattttttcattgagtggctgattagagtgtgtgcaggctattgggaacaactgcaatcagatgcagtcactaaacttgggatggtgtgagaagatcagtgatgatggggttatgagtttagcttatggctgtccagatctcaggaccctggacttgtgtggttgtgttctcattacagatgagagtgtggtagctttagctgattggtgcgtccacttgagatcactggggctatactactgcagaaacataacggacagagccatgtactcgctagctcaaagcggggtgaagaacaaaccaggggggcaatggaaatcatcggccaagaagagcaaattcgacgaagaagggctgagaagtctcaacataagccaatgcactgcacttacaccttcggctgttcaagcggtttgcgatacgtttcctgctcttcacacgtgttcggggagacattcgcttgtgatgagcgggtgtttgaacttgacgtctgtgcactgtgcttgtatccttcaggctcatcgctcggttcctcactcggctcactgaaagagatggaatgggtaatgtttgtatatagatgcttaataagttgatgaagagattagatgccaaactctaaaattgcttttgagttggtttctttacgttgtcttgaaggatctttt

SEQ ID NO: 5819 - DNA, 704 bp, Cleome spinosa
tacagtcctggaataatgttattaattttcaagagagctactagtcatgttcccctgaagattctctcgatagaagatggcacagttctcaagtccttcaatcatttgcttcaccgaaacaagaaggttgatttcattgaacagttcaatgaaaaacttcttgttaagcaagagaatgagaatctccaaattcttgacgttcgaaatgctgagctgatggaggtcagcaggacggaattcatgacgccatcagcattcatctttttgtatgagaatcagttgttcctaacattcaggaaccgaactgtttctgtgtggaattttcgcggggaactcgttacgtcatttgaggatcatctcctatggcatccagactgtaacacgaacaatatctacataacgagtgatcaggatctcatcatttcgtattgcaaggcagatacggaagatcagtggatagaaggaaacgccgggtcgattaacataagcaatatcttgactgggaaatgcttggcaaaaataacggcgagtagtgggtgtcccaaggaagaagaagagtgcagcagcagtttagggagctcgaagcagagaagaggcgcagttgcagaggctttggaagacataactgcacttttctacgacgaagaacgtaacgagatttacactggaagcagacacggcctcattcatgtctggtccaattg

SEQ ID NO: 5820 - DNA, 1624 bp, Carica papaya
ataacaaactaaactgccttaattatttgtgaagattataattacatcagtatctcagagcattagagtatgttcaattctggaatctccctattccgcatgatatccaaccttaaattttactagaaacagctgcatacccaatccttggagaagaaatgtagaaatgctttagtcagggtgcaaggaaagccatcgctcttccacaagatagaaccatgcaatagtctgcctcacatgcaatccaacaaaatcaggcaagcgaaagacatttgaccttcctttccaatctagaatttatggtgaactttaacacaactaaagaaacatgtgatgcttttcttactgtatagtttaatttttgtttaactaaaactaggattggattagggtatgatgtcaattttccgatacttttaaaatttaggtagaggggagagtgagggagaagacattcactggaaagctctgaacaatgcatgacacttgtaccctttacttttggtgcctaacaagtaactacactaattccatgacagttccctaattatctgctacttacctcaactcctcaacaatcttaccgattttttagtcataacagtccaggtatcatgttattgattttcaaaagagctagtagtcatgttcccttgaagattttatccatagaagatggtacagttctcaaagctttcaaccatctgcttcatcgaaataagaaggttgattttattgaacaattcaacgaaaagcttcttgtcaagcaagaaaatgagaacctccagattctcgatgttcgaaatgcagaattgatggaagttagcagaacagaattcatgactccatcagcatttatttttctgtatgaaaaccagttgttcctaacattcagaaaccggactgttgctgtttggaactttcgtggagagcttgtaacttcctttgaggatcacctgttatggcatccagattgtaatacgaataacatatacataacaagtgatcaggatctaataatttcttactgcaaagctgaatctgaagatcaatggacggaaggaaatgctgggtctataaatatcagcaatattctgactggaaaatgcttagccaaaataaattccgctagtggcactcctaaggtaaatgggtgcagtagcggttcaggcagctctacccagatgaggagcacagttgcagaggcattggaagacataactgcccttttctacgatgaggagcgcaacgagatctacaccggaaacagacatggactgattcatgtatggtctaattagcttgttgaatcagccagatgttagaaagattgtatatttttaggagatctctttgtgttgaaattgtatcttagatgatttttaaactacggtgttgtaatttctagatttttcctttggtgtatagattttctgattgagatgcaatgaagagacagaaagtatggaatggtggctggtcttgcagacttaccttgtatctatactagaattcttttgtctgcttccctttgcagaccattaaaaaacaacatgatgtatcagtgactaattttcttcatcttgtggcattgataaaatgaacactgaaacttattgatttg

SEQ ID NO: 5821 - DNA, 1047 bp, Cucurbita pepo
tatgcttcttgaatgtcagccctgacgaggtcattcgaagttgttttacaataagaacaatgatcacttatcacagttcagtctatgcttctgataacttcagctctttgaaatgcagatctacgaggattgaatatattcgaaggggcaagcctgatgcaggttttgcactttttgagtctgaatcgttgaagtggcctggatttgtcgagtttgatgatgttaatgggaaggttctaacctactctgcacaggatagtatatacaaggtgtttgacctgaaaaactataccatgctttactccatatcagataaacatgttcaagaaatcaagatcagccctgggatcatgctattgattttcaatagagctagtagccacgttcctcttaagattctatcaatagaagatggcacagttctcaaagctttcaaccatctgcttcatcggaacaagaaagtggacttcatagaacaatttaatgaaaaacttcttgtgaagcaagaaaacgagaatcttcaaatacttgatgttcgtaatgctgaattgatggaagttagcagatctgaatttatgacaccatcagcttttatctttctatatgaaaaccaattgtttctgacatttcgaaaccgaactgtggctgtctggaactttcgtggggagcttgtgacttcatttgaggatcaccttttatggcatccagactgcaataccaataacatttacatcaccagtgatcaagatctcattatatcctactgcaaagctgatggggatgatcattggatggaaggaaatgctggttcgatcaatatcagcaacatcttgactggcaaatgtctggcgaagattaatgcaagcaatggaaaccccaaggttgaggactgcagctgcgctgacatttcaaaaaagcaatgcagttcttcacagatgagaaacacagttgcagaggcattggaagatatcactgcacttttctatgacgaagagcgtaacgagatatacacgggtaacaagaacggtctggtacatgtgtggtcta

SEQ ID NO: 5822 - DNA, 2575 bp, Aquilegia formosa
tcttcctctctctctctctctctctccctatactcagaactcagaagacggacctcaactcacgacaaaagtaaaaaaaaacacacaacacccactcactgaattgaatcctctcgatagttccgattgaagaaaagaaagagcaaatctaatctactcaccctattgttttcgttctaatttctaaaccctaaatctatccttcactttataatttctagtttcttctccgattagattagataagatagagggagggggggttaattagggttttgcattgcagattcaatttttagtaaagaaaggagagagagaagagagagggaggctatgattatgatttatgattattatgtcttctggtttggatctagggttttatgatgatgattagcgattataataatactttactctcttcgatattttattattgttaataagttatgttgttgtttatgtgattttcaaagaaattaataaataaatcgtgagagagaaagagtgagaaattgcctatcaattgatggagggtcagggtcagggtcagggtcaacagggtaaaagaatctcagttagccctcgtccatgctcaggtcgacgtatattggcatcctcagcagcagcaggaggaggaacaacaggaggatccaggagtgggaaacgatctcgtgttttggatggaagtggaggtgctggtttcttaaacaatagtgtcagaaagattcaaagaagagagatttgctctaagagagatcgttcttttagtataagcaatgctcaggaacgtttcagaaacatactcttgcaggaagaatatgatactcatgaccctaaagagcactcttctcctatacttccttttttgaagaagaggtccaaaattattgagattgttgctgctcgtgacattgtctttgctcttgctcaatctggtatttgtgcagcttttagtagagagaccaataggaggatatgctttctcaatgtcagtcccgatgaagtcattcgcagcttattttataacaaaaacaatgattcacttatcaccgtctcagtttacgcttcagataacttcagctctttgaaatgcagaaccacaagaattgagtacatacgaagaggtaaacctgatgctggattttctctttttgaaacggaatcgttaaagtggcctggctttgttgaattcgatgatgtaaatgggaaggttctcacttattctgcacaagatagtgtatacaaggtgtttgatttgaagaactacacaatgttgtattctatatcggataagcatgtacaggaaatcaagatcagtccaggcatcatgttattaattttcacaagggctagtagccatgtccctcttaaaatcctatcgatagaggatggtactgttcttaaatccttcaaccaccttcttcaccgaaacaagaaggtagacttcattgaacagttcaacgaaaaacttcttgtgaagcaagagaatgagaatctccaaattcttgatgtcagaaatgctgaactaacagaagtaagcagaacagagttcatgactccgtcagcatttatttttctgtatgagaatcaattatttttgacatttagaaatcggactgtggctgtttggaactttcgcggggagctcgtaacttcatttgaggatcaccttctatggcaccctgattgcaacacaaacaacatatatatcactagtgatcaagatcttataatatcgtactgcaaggctgactcagatgatccattggaaggaaatgctggttcaatcaatgtgagcaatatattgactgggaaatgtcttgcaaagatacgtgctaacagtggtgatcctcagtcttattgtaccagcaccagaaacaccgtctctgaagctttagaggacattactgctctcttttatgacgaagaacgtaatgagatttacactggtaatcggcagggtcttgtgcacgtgtggtctaactgaaaaactataggagtaaaccagagatgagtgttctagatggttataatatatgttggaacgattggccgctacagtgaaaaataaaccaggaccaatctttgaagctttggagacattgctacctccttttttatgatgaggaacacaacacgtgcgttttgaatggggccattatatctgatagccaatgacgattgccctatatggttaattatgctcaactgattggctgggatggtgcaaaccaaaccagaaacactgctttcttttatgttaaaaaatgcaagacggctggtgtaactgaagagctattataccttttagccagagaatgaatgttctagaaggttgacttggactgactggctggtttagcaaaactatgtgctgttgtataatactgattttaggttcactgtattttgttatttgaacactttgcaggatcttgaattgtatttttttgatgcctttttattttgcctggtgtggtggtgccctattcaaaggaaagaagaccagggaacggcttattgttttatgttatccatcaattgtattgtagtgcaacacttctcaaaatct

SEQ ID NO: 5823 - DNA, 7339 bp, Ricinus communis
ataggcctgatatattcaacgggctcctgcaaaggctgttgttttgtaaagccaatgaattggcatcctccaatatggaatccgcaaaccagcttttggaaagattattcgccaatattcagagggtttgtaattttgaataccagttaaaccagcagcagattattcagatgcttattgataccaaaccatgcaagcctatggcttattgcaatttagaatctgagaaatctgcttcttgggtttcctttgatatttacatggagaatataatggacgggaagcaacttcacattagatcatctattgctatacttagagaaacaattaagacactccaagtgcttaaccgtgcaagctggcaggaaactttcttagcactctggctttcagctcttcggcttgtgcaacgagaacgtgaccctgtggaaggtcctattccacatcttgagtctcgtctttgtatccttttgactattgtccccttggcaattgctaatatattggaggatgagaccaaattttgttcctctgcgcttcagggagctggaacatctggacacatggagactagtggtttaggtggtggtaatcatattgatgcttctgtcaatgcaggtggtaacatgaggcacctcatagtagaagcctgcattgcaagaaatctaattgatgcatcagcatatttttggcctggctatgtacctgctgcagcaatctcaatgtcagatttaccaccgcttcaaaaatctccttggttaacatttatggagggatcagcactgaataattctcttgtaaattcacttctcacgactcctgctaccagtttagcagagatagagaagttatatcatattgcattaaatgggtcagcagagcagtcagcagctgcaaaaattctatgcggtgcatcgctaactcgtggatggaatattcaggagcatgtagtgcactatttggtcaagcttctttctcctcctgtaccttctacacacagcggactaaggagtcacttggttgactatgctcctatgctcagtgccattctttttggagcttcatcaattgataatgtccatatactttctttgcatggcgttattcctgaatttgctgcttctttaatgcctatttgcgagacatttgggtcgcttatgcctacgtcaactaatgtatctagtacatgtgatgagccctcattttacatggttttttctgctgcttttctctttcttcttcgtctatggaaattctatagaccctctgttgagcagtggttgacgggaggaggaaccttgggaagtgagattactttggagtatcttttaatgttgcgcaacagacgcattgcctcaaaaaattctgctgctttgggtgaaatcaacagtgttaacagtgattcggtccaaattgaatccatatcagataagcctgtatatgttgacttttatcctaaattacgagcttggtattgtcaaaacaagtcgtgtgtagcttcaacactgtctgggctttctactggaaatcctgttcatcaggttgctaacaaaatcttaaacatgatttactcaaaaatgactagaatcggaacctctccgggaaattcctcaactctatcaagcaacagcttatgcgggtcctcctcaagtagtggtgaagatccttatcagagaccaatgcttcctgcatgggaagtgttggaggctgttcctttcgttcttgaggctatattaacagcttgtgctcatggaaggctttcatctcgggacttgacaacaggtctgagagacctcattgactttcttcctgcatctcttggaggcattatcagttactttgctgcagaagtaactcggggcacatggaaaccagttccaatgaatggaacagattggcctagtcccgcagctgtcctatcatctgtcgaatctgaaatgagagaaattctttctgctgcaggagttgattttccgaccttttcttccaggcatttgcctgtcatgcttccattgccaatggcagctctggtcagcttaactatcacttttaaactcaacaaaggcctcgactaccttcatgttgtagttgggccagcgttggagaattgcgcatcaggttgcccctggcctagcgttccaataattggctctctgtgggcccaaaaggtccgtcgctggcatgactacatagttgtatcatgcgctcgctctgttttcaggcaaaataaagaagctgtctctaagcttttaagaagttgcttctcctcattcctcggatcagttaatgtttcatcgcctttgttgaccaatcaatgcagcatagggggtctattgggaaatactattccgagtgcttgtggatccctggctcctggatttctttaccttcgctcttgtcggacgatacaagatattcaatatgtgaatggtgtgatcataggtcttgtaggagagcatgccagggaatcagctgcgagatgggcaaacacaagctcctcacgcctgaagtctagccaagcatctctgaacctagcagctgcaaaggcaagggaagcagccacactgggtgcaagcctcttatgcatttcaggggggatgaatctcgtccaggaactctacctggagacgatacccacctggttactctcatccaaagccatgaaacatggtgagatgagtgttgtatctcggattgtggaaggatatgcaatggcttacatgttggtcctgtcagggtcattagtatggggggctgggagtaaatctccatcatgggcattgtctagaagggcgcacattgtcggctcccacatggactttttggcaggggtattggagggacacatatcgcttggctgtcatccagccacttggaaagcttatttctcttgtttagttcgcttgctggcaagttttgctccagcctggatacaagaagtgaggctggaaactatgaagaagttggccaatggattgagaggatggcatgaaactgagttggctatctctctgctcgaaagaggtggggttgcagccattggccttgtagccgaactagtaaatgttttggattgagtaattccaagctgagcagaaatcacaacttggtttctgctcctccgcatgttgggagcatgtcaactatggttcccatattatgtgtgcggagcatagacttggcttctgagtggcgaaggaatgggcagaaggtttatggtgtaagcaatttgtgaaactttgccgtatctgattgacacagatgattcagagaattaaaatttgaaccgagtacctgaggttgaagatattgcgatttggccttcgaagaggctatgataaggagttggagctatacaataatgatagctgttccctcttggaagcgaagttggaagaagcctgctcatctctcaactcaaacttcacataaggaaaagagacaaggtaggtgtttgctacagtgataccctaatgctattccaattcaactgtttaccgaatttcagatttttatttgtttcagattagggtttggacttgaggttcaagtaggggtctggctttttagagttaatttatatcagtaaacaatcgtaagctcaagagaaaggaataaagattgtggatggaaggaaggagaatatcggcgaatccaaggccgtgttcgggaagaagagtattagcaaagaaaaggcaacggtcaaatgggttaatgaacactgttaaaaagcttcagcgacgcgagatttcttctaaaccagatcgcgcttttactatgagtaatgctcaggaacgattccgcaatatgcgtttaaaggaggaatatgatacacatgatcccaaaggccattgttcagtagtactgccttttttgatgaagagaaccaaagttattgagattgtggccgctcgtgacattgtctttgctcttgctcattccggtgtttgtgcagcttttagtagagagacaaatcagagaatttgttttctgaatgtgagtcctgatgaagtcattcgaagcttgttctacaataaaaataatgattccctcatcacagtttcagtttatgcttcagataactttagctcgttgaagtgtagatctactaggattgagtacataaaaaggggcaagccagatgctggttttgctctttttgagtccgagtcattgaagtggccggggtttgtagaatttgatgatgttaatgggaaggttttaacctactctgcccaagacagtgtatacaaggtttttgaccttaagaactacacgatgctgtactctatatcggataaacatgtacaagaaatcaagatcagtccaggtatcatgttattgattttcaatagagcaagtagccatgtacctcttaaaattttatcaatagaagatggcacagttctcaaagccttcaaccatttacttcatcggaataagaaggtggacttcattgaacaatttaatgaaaagcttcttgtcaagcaggaaaacgagaatctccagattcttgatgttcgaaatgctgagctaatggaagttagcagaactgagttcatgactccctctgcatttatctttctctatgagaatcagttgttcttaactttcagaaatagaactgttgctgtctggaacttccgtggggagcttgtcacgtcatttgaggatcacctgttatggcaccctgactgtaacacaaataatatatacattacgagtgatcaggatcttattatttcttactgtaaagctgagactgaagagcaatggatggaaggaagcgcggggtctatcaatattagcaacatcttgacaggaaagtgcttggctaaaattaatgctggcaatggtggtccaaagggtggtgaatgcagcagcagcagcagtattggctgctcgaaacagagttgctcttccatgcgaagtacagttgctgaggcactggaagacataactgctcttttctatgatgaagagcgaaatgaaatctatactggtaataggcatgggctggttcatgtatggtctaactgaagttgcaacatgttttatcattttgatatggatgttacaaatctgcacctagaggatattccatcatgtctgcaatgagatctatacccctagttgatgtgggctggttcatgtattggcatattgaagagcagaatgaatcatgttgacctgagtgctatgattccacaatttgacggtctgtcatgcctgcacaagctcgaagctgatgtctgcatagcattccattaaattgcttcagaatgaagattgagttgtaccattagataattgtagttcgttgtgtagcaatctgtagattcttacaattggggtttcttagggtatctgtttgagatgccaaagaagggtttaaatttgtcgaagcctgaagactattcagattatgctatatgtaacattactttgtattctgtctgccaagtaaacaagatgtttgcttgttaactatatctctctgccactagtgaggataatgtgctcaaaatttgtggttggcaaggagatctgacaaaaactaaattcatacttggagaagtacccatatgggctcgagtctgtaaatctttttcgaatatactgtctcatacattcagttaggatgatgattattttgcattttctcatattggtttatcaggttagggttagatgtatattttctttattgttgatatattttctttctagtcatagtaggattagttaatttttcttttcttactttgtttattatccttatcattagaattagttttagcttttatatttttctagcttatgtatgtagaagtcttagggttggtatccaccatctacggatgtgttatgttctaaaccctagaaatcattaagtatcaatttaacttgtttatccttctttaaaatgcagccatgtgctctaatctgatatcaggttaactctgtcagattctttgcacaaagagaagattgatcaagacctttaatattgaagaaaaagattcacttaggtcgatcaggcaaggcaatatcatattttccaatgatcataaggaatcaagtgcaagaacggccttgataaacactgtacggcgcattgctttttctttttcttttcctgcgaaaacctactattagttttacaggaagaaaagttgaagcaggtacatcagataaatcactagaagctgacagttgtgttacaaaccgatatgccaaacattacctatgagcagttggtatatataaaaagctttctgataatctcagttacatgaattaacctagatgatatagaggctttgactcactggaagctgaatattttacaggtgaaaaaaggcaaaacactaactaaattgtctatggcggagagggaggtgcctctctgttggcagagaactattcaagctgtcctgcttttcctttccagggcttcagaatctgaaatgagcagagcaaactttcattgacacacattagtgcaccggcattgttaaactctccgcagtagtttggggctgagaaaatggtaaccaactgcctttctgcgaagaactcgtacccatcctcaactacctacctggtgagcacggcatatgagatcaagatcatgtttcttcaagaattctgctaccttgtcagctccaaaggtataggagacacctctatcattctcaccccaccctctgatgtctctatcaggatcagcccagagaaggtcacaaagaaggccttggtctggcacatctacaggcctttcaatagctctaatctgatccaagctctccatatctggtgagagtccaccatgcatgcataggattttatcatccactactgcagctactggtaaacagttaaagcagtccgtgaaagttttccacagacggacactgaaacggcgtttgcactcatcataaaatccgtatattctgttgatagaagcacattcatgattccctcggaggaggaagaagttgtctggaaacttgatcttgtaggcaaggagaagacatatagtttctatactttgttttcctctgtctacataatctccaagaaataagtagctggaatctggtggaaacccaccatactcgaacagtcgtaaaagatctggatattggccgtgtatataccacagatgttgataggagcttctagttcaagaagtacaggctgagcaagaaagacttgtttagcagtgagacagagatttctgatctcaggttcagtaagctgaatgcgtttgcctctattgttttttccttccaaaagcctctgtataatcccttccaatccttccattccaccc

SEQ ID NO: 5824 - DNA, 1365 bp, Cucumis melo
gagacaaatgaaagaatatgcttcttgaatgtcagtcctgacgaggtcattaggagtttgttttacaataagaacaatgattcacttatcacagtttcagtttatgcttctgataacttcagttctttgaaatgcagatctacaaggattgaatacattcgaaggggcaaacctgatgcaggttttgcactttttgagtctgaatcgttgaagtggcctggatttgttgagtttgatgatgttaatgggaaagttttaacctactctgcacaggatagtatatacaaggtgtttgacctgaaaaactataccatgctttactctatatcagataagcatgttcaagaaatcaagatcagccctggaatcatgttgttgatcttcaatagagctagtagccatgttcctcttaagattctgtcgatagaagatggcacagttctcaaagctttcaaccatctgcttcatcggaacaagaaagttgacttcatagaacaatttaatgaaaaacttcttgtgaagcaagaaaatgaaaatcttcaaatacttgatgttcgcaatgctgaattgatggaagttagcagaactgaatttatgaccccatcagcatttatctttctgtatgaaaaccaattgttcctgacatttagagaccgaactgtggctgtctggaacttccgtggggagcttgtaacttcgtttgaggatcaccttttatggcatccagactgcaataccaacaacatttacatcactagtgatcaggatctcattatatcttactgcaaggctgattctgatgatcattggatggtaggaaatgctggttctatcaacatcagcaacatcttgactggaaaatgtctagccaagattaatgcaagcaacggaaaacccaaggtcaacgacagcagcagcagcagcagcggtgctggcagctcgagaaaggtttgcaactcttcacagatgagaaacacggttgcagaggctttggaagatattaccgcacttttctatgatgaagagcgtaatgagatatacactggcaacaagaatggtctagtacatgtgtggtctaactgaagaccacattttttctttttaaatttgtttttttgttatttttttctcttttctgaagtttgctttgacattgatcaaactgatgatttgatgatgaagatgaaaggcagttcatatgtagagctccaatgccgaaaagttgatggtagaataataggttgtgtcagtttagtggaatagagaaagctttggttgcattgtaacattaaatagattttaatgtgttatgtatactgattgtaaaaatccaccttcgcttttatgagatcagttaacaattta

SEQ ID NO: 5825 - DNA, 1527 bp, Cirsium arvense
gtgtctccctggattcaaaactctttactcatacaaccaaccaactatccatcctctcactcttcaatcattcaccactttacttccttcaaattcagtatcaattggaagataatcttcatctagctagcagaaatcacctattccggcttctaattggcgcaattttgtttgaaaattgagttccccaattgcattccagatgaacgggaatggaagggtttgttagcagcagaaggagaatcacgatggccagcagcggtggcagtagtggtagtggtagtggtagtagtagcagtaggccgccaccacagtgcggtggtcggaggagagtagttgctaccaagaagcgtgataggaccaatttgttatctgtcaacaacagtttcaacaagattcagaggcgtgagatttcttccaaacgccaccgttccttctccgtcaccaattccgtccaccgctttaggaatatccgcttgacggagcaatatgatacccatgatcccaagggacattcatcatttgtattaccattcttgatgaaaagggcgaaggtcattgaaatagtggcagcacgtggtatcgtattcgcccttgcaagttctggtgtttgtgcagcttttagtagagataaaaacaagaggatatgtttcctgaatatctttccagacgaagtcatccgtagcttgttttacaataaaaataacgattcattaattacagtatccgtatatgcttcagacaacttcagttcactcaaatgcagatccacacgaatagaatacatacaaagaggcaaaccagatgctggttttcctctttttgagtccgagtccctcaagtggcctggctttgtggagtttgatgatgtcaatgggaaggtgcttacctactctgcacaagatagcatatacaaggtctttgacctgaagaattatacactgttatactctatagcagacaaaaatgtagaagaaatcaaaatcagccctggcatcatgttattgattttcagtagggctcaaagccatgttcctcttaagatactatcaatagaagatggcacagttctaaaagatttcaatcatctacttcatcggaataagaaggtggattttatagaacaattcaatgaaaagcttcttgttaagcaagaaaatgagaatctccaaattcttgatgtacgcaatgctgaggtgaaagaagttggtagaacagagttcatgactccgtctgcatttatatttctgtatgagaatcagctatttctaacatttagaaaccgaaccgtttccgtttggaactttcgaggggagcttgtgacatcgtttgaggatcatatgctatggcattccgactgcaataccaataatatctatatcactagtgaacaagaccttataatttctttttgcaaggatgattcagatgaccaatggaccgatggaaaagctggttctattaatatcagcaacatatggactgggaaacgcataggtaaaataaacttgagcaatgcaacttcga

SEQ ID NO: 5826 - DNA, 1656 bp, Aristolochia fimbriata
ccgagagacaaatcaaagaatatgtttcttgaatgtgagcccagatgaggttatccgcagcttgttctacaataagaacaatgactctctcatcacagtttctgtttatgcttcggacaacttcagctctctaaaatgcagaaccactaggatagagtacataagaagaggtaaaccagatgcgggctttgctctttttgaatcagagtcattgaagtggcctggttttgtagaatttgatgatgtcaatggaaaggttctcacatattcagcacaggacagcatatacaaagtctttgacctgaaaaattatacaatgctgtactctatatctgataagcacgttcaagaaataaaaatcagtcctggtatcatgttattgatatttaccagagccagtagtcatgtacctctcaagattttatctattgaagatggtactgtactaaaagccttcaaccatatgctccatcgtaataaaaaagtggatttcatcgagcagttcaatgaaaagcttcttgtcaagcaggaaaatgagaatctccagattcttgatgtccgaaatgctgagcttactgaagttagcagaacagaatttatgactccctcggcattcatatttttgtatgaaaatcaattgttcctgacatttcgaaatcgcacagttgcagtgtggaattttcgtggagagcttgtgacatcatttgaggatcacctattgtggcacccggactgtaataccaacaatatatatattaccagtgaccaggaccttataatatcttactgtaaggcagattctgatgattcaggcatggaaggaaatgctgggtccatcaatatcagtaacattttgactggaaaatgccttgcaaagatccggtctggtaacagcattctcaaggatgaggaatgcagatctgcaaaaaggcctaggaatcaaagggtgagaactgctgttgcagaagctctggaggacataactgctcttttctatgatgaggagcggaatgagatctacacaggaaatcgacagggacttgttcatgtatggtcgaattgagtaatcatacagcctatcgagtcattggcgattgccactgtatcatgcatgcttctgttgtaggattttcattctttctttctccctctctctctctctctactccccatcatctcttcatttgtcattcattgcatgtccctcgccgaatggtaaaataagtgacaaattttaccaagttcattctctcttggaagccagtggaaagaaatactaaaagattgagagacaggcaaaaaaacggttgaggttctgtaaagttgctgtgttagtctccttagacccagcaagctgaggattgtcccggggggggagggaggaagaagggaggagaacatgtgttgaggggaaaatgatgtaagacgggctgggatgatggcaggcttgctgttgaaaatgggtttggagtctgaactgcgggcagacctgattgtgtaccatttaggttttaaggtatttgatgtactgacctgaccctgttgacaacattgtaatgatttttcaaagagagtaaatccaaaatccacccacttgcttgtttcttgcccttactctggtgttgggtgttaattcaaccctgaatcctttatctc

SEQ ID NO: 5827 - DNA, 1282 bp, Persea americana
ggatagagctttcagcaccagcaatgcgcaggagaggttccggaatatccggctccaggaggaatttgatacccatgatcctaagggacatgattatttggaacttccatttctgaagaagaggtcgaaaattattgaaatagtggcagcccgtgacattgtctttgctttgacacaatctggtgtttgtgcagcatttagcagagagacaaatcagcggatatgctttttgaatgtgagtccagatgaagtcattcggagcttgttttataataagaacaatgactcactgataacagtgtcagtctatgcttcagacaacttcagctctttaaaatgcagaaccacaaggattgagtatatacgaaggggcaaacctgatgctggttttgctctttttgagtctgagtcattgaagtggcctggttttgtcgagtttgatgatgtaaatgggaaggttcttacattttctgcacaagacagtgtatacaaggtgtttgaccttaaaaactatacgatgctgtattctatatcagataggaatgtccaagaaattaaaatcagtccaggcatcatgctattgatttttggcagagccagcagtcacgttcctcttaaaatcctatcaatagaagatgggactgttctcaaatcttttaaccatctacttcaccgaaataaaaaggttgattttatagagcagttcaatgagaaacttcttgtcaaacaggaaaatgagaatctccagattcttgatgtccgaaatcacgacctgacggaagtaagcagaacagaatttatgactccatcagcctttattttcttatatgagaatcagttgttcttgacatttcggaatcggacggttgccgtttggaacttcagaggggaacttgttacttcatttgaagaccacctgttgtggcaccctgattgcaacaccaacaacatttatatcacaagcgatcaggatcttattatctcttactgcaaggctgattctgatgattcatcattggagggaaatgctgggtcaatcaatatcagcaacatcttgactggaaaatgcctcgcaaagatccgagcaagcaactgtagtcccaaggatgattgctgctgctgctcgaagaagcggacatatgcttccagaatcaggaacactgttgctgaagctctggaggacataactgcccttttctacgatgaagaccgcaatgagatctacaccgggaaccggcaaggtctagtccatgtgtggtctaattgattgtttacccgacgg

SEQ ID NO: 5828 - DNA, 1814 bp, Ricinus communis
gcttctttcctgaaaaaataaaaaatcagctttgggtgtaagtggggatttttgaaaacagatcgaaatcgggccatgaaaattctgagtttgaacaagtaggaattattgacaagtagagggtagactagcattttcagttcctaacgactccagtagttaaaagttacagtgcaataagtatcatctgctgttattcctgcgtcgtggagaccagctgcgagaaaaaagcctgaagctttttgatcttgtttgagcaattgcttatgtgattgggtaaaaaagacagaaagaccgatgggtctgatttagtgtttgaaaaagagggaaacggagatggacggaagtaggaagataagcgtgagcccaagaccatgcagtgggaggagggtattagcaaagaaaagaggaataggaggaattgataataagttcgtcaacagtgttaacaaacttcacagaagggaaatctgctccaagcgtcatcgtgccttcaccgtcaccgacgcccaggatcgtttccgtaatatccgtttgcaggaggaatatgatactcatgatccaaaaggtcattgttccatggtattacctttcttgagaaaaaggtcaaagattattgagattgtagcggcacgtgacattgtctttgctcttgcacaatctggtgtttgtgcagcctttaaccgagagaccaatcaaaggatatgctttctgaatgttactcctgatgaagttatacggagcttgttttacaataaaaacaatgactcgcttattacagtttcagcttatgcttcagataattttagttccttgaaatgcagaagcacaaggatcgaatacatacggaggggtaaaccagatgctggctttgctctttttgaatctgagtcactgaaatggccaggttttgtagagtttgatgatgtaaatgggaaagtactcacttattctgcacaggatagtccagggatcatgttattgatttttaccaaagctagcagccatgttcctctgaagattctttccattgaggacggtactgttctcaaatctttcaaccatcttcttcatcggaataagaaggtggattttattgaacagttcaatgaaaagcttctagttaagcaagaaaatgaaaatctccagattcttgatgtccgcaactttgagctaacagaagttagcagaactgaatttatgacgccatcagcatttatatttttgtatgagaaccagttatttctaacatttagaaatcgaactgtggctgtgtggaacttccgaggagagcttgtaacttcctttgaagatcaccttttgtggcatcctgattgcaacactaataacatatatattacaagcgatcaagatcttattatttcttactgcaaggctgattctgatgatcacttgtctgaaggaattgcgggttccattaatatcagcaatattttgactggaaaatgccttgctaaaataaaagcaagtaatagcttttccagtgaatgcagttgcagtggaaattttagtggatgctgtaacaaatcaaacaagcatatgcataactcaagaattaggagcacagctgcagaagctttggaagatattactgctctcttctatgatgaggagcgcaatgagatctatactggcaatagacacggcctagttcatgtatggtctaattgatgagttgggttttcctttgtttataaagatgaaaatgagatgattgaatgctccatggatgtaagaattacgtgaagttgtatcattagacgctcttgtaccaattcattgttttttttttt

SEQ ID NO: 5829 - DNA, 761 bp, Centaurea maculosa
tcaatgcagatcacacgaatagaatacatacaaagaggcaaaccagatgctggttttccgctttttgagtccgagtccctcaagtggcctggctttgtggagtttgatgatgtcaatgggaaggtgcttacctactctgcacaagatagcatatacaaggtctttgacctgaagaactataccctgttatactccatagcagacaaaaatgtagaagaaatcaagatcagccctggcatcatgttactgattttcagtagggctcagagccatgttcctcttaagatactatcaatcgaagacggcacagttctcaaagatttcaatcatctacttcatcggaataagaaggtggactttatagagcaattcaacgaaaagcttctcgttaagcaagagaatgagaatctccaaattcttgacgtacgcaatgctgaggtgaaagaagttggtagaacagagttcatgactccatctgcatttatttttctgtacgagaatcagctatttttaacgtttagaaaccgaaccgtttccgtttggaactttcgaggagagcttgtgacatcgtttgaggatcatatgctatggcattccgactgcaataccaataacatctatatcactagtgaacaagaccttataatttctttttgcaaggatgattcagacgaccaatggactgatggaaaagctggttctattaatattagcaacatatggaccgggaaacgcataggtaagataaactcgagcaatgc

SEQ ID NO: 5830 - DNA, 955 bp, Citrus sinensis
  misc_feature (653)..(653): n is a, c, g, or t
  misc_feature (678)..(678): n is a, c, g, or t
tccgacccacgcgtccggtgcaagaaatcaaattaggtaatttctccttctctctctcaaacacgcttatgcaccgactgttgcttgttgctaggattactgcaccagtaactaccttcaactcttattttgtgtttctacgtaatgcttctttatgttcatcgtactctcgtttgtttactttacctgtaacagtccgggcatcatgctattaattttcaatagatctagtagtcatgttcctctcaagattctatctatagaagatggcacagttctcaaggtcttttatcatctgctgcatcgaaataagaaggtggacttcattgaacaattcaatgaaaagcttcttgtcaagcaagaaaacgagaatctccagatccttgatgtacgaaatgctgagctgatggaagttagcagaactgaattcatgactccatcagcatttatctttctttatgagaaccagctgttcctaacgttcagaaatcgaactgttgctgtatggaattttcgtggagagcttgtaacttcatttgaggatcacctgttatggcatccagactgtaacacaaataacatttatataacaagtgatcaggatcttattatttcttactgcaaggctgaacctgaggatcaatggatggaangaagtgctggatcaatcaatgtcancagtattttgactgggaaatgcctggctaaaataaatgcgacaaattgcagtccccaagttgatgacgagttaagaagcagcagtactggcaagccaagaaagtgaataaatgctcctatataagaacccggtaggaaagagcttggaaaataaacttctcttttctatgatgaaaacgccatgaaacctacccgggaacagacttggcctggtcacgatggcctattgaaatccaaaattcgaaagattgccccacctgcgttgggggaaaaggga

SEQ ID NO: 5831 - DNA, 638 bp, Vitis vinifera
caagcctgaagaaggttttgctctctttgaatctgaatccttgaagtggcctggctttgtagaatttgatgatgttaatggaaaggtgctaacttactctgcacaagatagcatatacaaagtgtttgacctgaaaaactatgttatgttgtactctatatctgatgaaaatgtgcaagaaataaagataagtcccggcattatgttattgattttcaatagagctacaagtcatgttcctcttaagattttatcaatagaagatggcacagttctcaaagacttcaaccatctacttcatcgaaataagaaagtggacttcatagaacaattcaacgaaaagcttcttgtcaagcaagagaatgagaatcttcagattcttgatgttcggaatactgaactgaaagaagttaacagaactgagttcatgactccctctgcatttatctttctgtatgagaatcagttgtttctaacatttagaaacagaactgttgctgtatggaacttccgaggggagcttgtaacgtcatttgaggatcacctgttatggcatccagactgcaacacaaataacatctatataacgagtgatcaagatcttattatttcttactgcaaggctgattctagtgatc

SEQ ID NO: 5832 - DNA, 752 bp, Liriodendron tulipifera
gaaggggtaagcctgatgccggctttgctctttttgagtctgagtcactgaaatggcctggttttgtggagttcgatgatgtaaatgggaaggtccttacatattctgcacaagatagcatatacaaggtgttcgacttgaaaaattatacaatgttgtactctatatcagacaagcatgttcaagaaattaagatcagtcccggcatcatgctgttgatatttaacagagccagtagtcatgtcccacttaagatcctatcaatagaggatggcaccgttctcaaagacttcaaccatctccttcaccgtaataaaaaggttgacttcatagaacagttcaacgaaaagcttcttgtcaagcaggaaaatgagaatctccaaattcttgatgtccgaaattctgagctgacggaggtaagcagaacggagtttatgactccgtcagcatttatcttcttatatgagaatcagttgttcttaacattccggaatagaacagttgctgtttggaacttccgaggggagcttgtgacttcatttgaagaccacctgttgtggcaccctgattgcaacacaaacaacatttatatcaccagcgatcaggatcttattatctcttactgcaaggctgattctgatgattcgtcacccgaaggaaatgctgggtctatcaatatcagcaatatattggacgggtaagtgcctttgcaagatccgagcaagcagcagcagcagcccccacaaggctga

SEQ ID NO: 5833 - DNA, 1939 bp, Pseudotsuga menziesii
aaatagaatggacgtgaagaagatttctgcgagccctcggccaagttttggacgtcgcgtggtggccggaaagcggcgacgggtggatgagtgccacaactgcgtgaagaagcttcaaagacgcgagatcggttccatcgggaacagggctttcaacagcactaatgcgcaagaaaaattccgaaattttcagctgcaggaagagtttgacacctatgatcctaaagcacactggtttttaaagctgcagttcttaaagaagagatccaaaatcatagaaatagttgcagcacgggatattatatttgctttggcacagtctggtgtttgtgcagcattcagtagagagacaaatagaaaagtgtgcttcttgaatataagtccagatgaagtgatccgcagcctgttttataacaagaacaatgagtcccttattactgtgtcagtttatgcttcagataacttcagctccttgaaatgcagaacaacgccaatcgagtatatcagaaggggcaaacctgatgcaggttttgctttattcgagtcagagtcattgaaatggccaggttttgtagagtttgatgatgtaaatggaaaagtcctcacgtattctgctcaagatggcatctacaaagtttttgatttgaagaattatacaatgttgtactcaatatctgatgaacaagttcaagaaatcaagatcagtccaggtataatgttattaatatttgagagaactgctagtcacgttcctctgaagatcttatccatagaagatgggacggttttaaaatcctttaatcatctgttgcatcgcaacaaaaaagttgatttcattgaacagttcaatgaaaagcttcttgtcaaacaagaaaatgagaacctccaaattcttgatgttcggaatgcacaactgactgaagtgagcaggacagagtttatgacaccgtcagcttttattttcttgtatgagaatcaattatttttaacatttcgcaatcggactgttgctgtttggaatttccgaggagagctcgtgacatcttttgaagaccacttgttatggcatcctgactgtaatacaaataacatttatatcactagtgaccaagatttaataatttcttattgcaaggcccatcctgatggatctgatgaagaagaaaatgtgggctctataaacatgagcaacatcttgactggaaaatgcctcgccaagattcgtgccaatgatccaaacgtacggattagtcctagaaatcggccaaatgcatcaacaatcagaagcactgttcaagaagctcttgaagacattactgctcttttttatgatgaggagagaaatgagatttacactggcaatagacacggtttaatacatgtttggtcaaactgaccggtatgtttgaattttggaaatccagtcaatcgttcaaagtatacttgaatgataatgaagcagttgtcacagctgccaggcatacgaaatgtggcagctgtgatgtcatcactttcactgagttttggagatgtctgttctataattacacaatgtttggctgggtctgtattttagttattttatatcttgtcattttgtaacagctgaatcatttcaatagcatgtatgtatccttagagtgcttattttactccataggatcaaatcaggaaacacaattgtgttggaatatgtaaaactggagagaaaatctatccatataacattgtaacacattaaactgtttttccgcatccctatccgaagtttataatgttatctgagaaattagaatgatgattaccaatcaaacaatgtttttgggtatagcattgtgcgacggagtcctacttataacgtagctgcgttgtaaaataaagctgtaaaaattgtgcaatttcgagatgttaccgaatttgactgaaaagtcggattatt

SEQ ID NO: 5834 - DNA, 2196 bp, Abies balsamea
caggaatcgaaaggggccagccaatctgagcgctcacctcttggatctccctgcctatgttttctcatggacttctgaagacaccatgagaaacccatttgcccgttgtctctatggtctgcaatttaccctttgaatggtggcatccatccatccaaaacctccacgtggtttccgttacagttgctctgatgtgaaaggctatggtgttgttttcttgtgcggcacgggctcggcaagggtctccaaaggtccttgcgattctttctggaatttataacgcggcccggttggttttgaaatgcaatcgtaatccatagagttcgatccgtgcaggttttctgctaagatgtcgcggagcggaggtgtcttttgacgctgtcgtttgctgcgaaggaagaatagttgtcttcggccttcttgaatatggaggggaaaagggttgccgcgaggcctcgaccttgcggtggccggcgcgtcgtggccgcgaaacggcaacgggtggacgcttctgctaactgcgtgcgtaagcttcagaggcgggagattggtaccagcggcaacagggctttcaatatcaccaattcccaggagaagtttcggaattttcagttgcaggaggaattcgacacttatgatcccaaggcacattggtttttgaagttgcagttccttaagacgaggtcaaaaatcatagaaattgttgcagcgcgtgatattgtatttgctttggcccaatctggtgtttgtgcagcatttagcagggaggccaacaagaaaatatgctacctgaatataagtccggatgaagtgatacgtagcctcttttataataagaataatgattctcttatcacagtgtcggtatatgcctcagacaatttcagttcactgaaatgcagaacaacacccattgagtatatccggaggggtcaaccagatgcaggctttgccttattcgagtccgagtcattgaaatggcctggttttgtagagtttgatgatgtgaatggaaaagttctcacctactctgcccaggatggcatctataaggtgttcgacctaaagaactatacattgttgtattcaatatcagatgatcatgttcaagagataaagatcagtccagggataatgttactaatattcgacagggccagtgggcacgttcctttaaaaattttatctatagaggacggcactgttttaaaagcatttaatcacctattgcatcgcaataaaaaggttgactttattgagcagttcaatgagaagcttctagtaaaacaagaaaatgagaacctacaaatacttgatgttcggaatgcgcaattgactgaagtaagcagggcagagttcctgaccccatcggcgtttatttttctttacgagaatcagttattcttgacgttccgcaatcgtacagtcgctgtatggaatttcagaggagagctggttacctcattcgaggaccacttgttatggcatcctgattgcaatacgaataacatttatattactagtgatcaagatttgattatttcttactgcaaggcacttcctctttcttctggcgcagaagaaaatgttggttctataaatataagcaacatattaactggaaagtgcctggctaagattcgtgccaatgatccaaatgttcagataagtcctagaaatcgtccaaatgcgtctactatcagaagtactgtagaagaggcactcgaagacatcactgccttgttctatgatgaagagcggaatgaaatatataccggcaattggcatggcttggttcatgtctggtcaaactgattattaatgcctgtaggttgtgcatatccggtcaatcattcgccgcattttattccgaaatctcaatcactgggtggtaagctgacaacaatgttgctaattgttcaaagtattcggattatgctgcatgatagcagtgatatagaaaggagctcatggcaccagaattctgaatatgacagtttttttcttcacaagtacaaccaacacgggtgtttgattggttactggatgtctgagaaagtgactatatgggtaggcctcaaattgcagaaaattgcaattgatgcagtagatcgtttagtctcctgtaaatctgtattctgaattgtaattgatccgtctaaccatgggtctctaatttaatattttcttgattta

SEQ ID NO: 5835 - DNA, 2170 bp, Chelidonium majus
agcaagaagaacagcagacacagtttggtgcacctttggaaattgagggggaggacatctgcgctagaaagaagaagaggaaaaaggaaaagaacgagtcctccaatccttccctcccacccgcttcccttcaggagagcgagaaaaaaacagctcgatttcgcttctaatttctagggtttggttgaggatctttcagcctaaaaaaaacccttgaaatccttttcctaattcttttggaggatttgtagggtttgttaattcgttttgagtatctgttgatttagggtttatgagaaagatcgcagcttgagattgtgtttttttccaaaaggggacataattgtttgtttatttggtttgggttgtcagatgttttgttagaagaggacactaattagggttttttgagatggacgggaggaggatttccgtcagcccacgcccttgttcaggtcgccgcatttttggcgaggaaaagaccgagagttgatgggtttgttaacagtgtgaagaagcttcagaggcgggagatttgttcgaagagagatcgtgcttttagcatgagtaatgcccaagaacgattcaggaatattgggttgcaggaggaatatgatacccatgatcccaagggacactgtccaatggtactgccttttttgaagaaaagatcgaaaattattgagattgttgcagctcgtgacattgtctttgctcttgcacaatctggtgtttgtgcagcatttagcagagagacaaaccagaggatatgcttcctgaatgtgagtcccgatgaagtcattcggagcttgttctataataagaacaacgattcacttatcacagtttcagtttatgcttcagataatttcagttccttgaaatgcagaacaacaaggattgagtacataaggagaggaaagccagatgcaggttttgcgctttttgaatctgagtctctgaagtggcctggttttgttgagtttgatgatgtaaatgggaaagttctcacctactccgctcaggacagtgtatacaaggtgttcgacctaaaaaattatacgatgctctattctatatcagataaacatgtacaagaaatcaagatcagtccaggcatcatgttgctgatatttacaagagctggtagtcatgtccctcttaagattttatcaatagaggatggcactgttctcaaagccttcaaccatctccttcatcggaataaaaaggtggacttcattgaacagtttaatgagaagttgcttgttaagcaagaagatgagaatctgcagattcttgacgtaagaaacgctgagctaacagaagttagcagaatggagttcatgactccatcagcatttatttcttgtatgagaatcagttgttcttgacgtttcgaaatcgtactgtggctgtttggaacttccgaggagagcttgtaacttcattcgaggatcaccttttatggcaccccgactgcaatacaaacaacatctacattacaagtgatcaggatctcataatttcttactgtaaagcagattccgatgatccgttggaagcaagtgctggttcgatcaatatcagcaatatcttgactggaaaatgccttgccaagatacgtgcaaacaacgacatccctaaggatgagagcagcagtagtggtagtgctgctggtcctagtgggaggataaagaagagagcgtattcagcaaggaccaggaacacagtagcagaagccttggaggacatcactgcgttgttctatgacgaagaacgtaatgagatctacacggggaataggcagggacttgtgcatgtatggtctaactaaaggtataatatacctctttcttctgctcagattgagcaattattgtgagtaggagatggttgagttcttcatcaggctgcgggccattggtgttctcttgtgcaactccgcgttgttcttttgatcctttgtttctggctcttcacagtaggtgttaatgtagatttggtccaagtcgcgtggcttttagatttgtatcagtgatatttaggctggtgtcttttgtgttgcctcttaactacttcacatttctctaggccttgtttgtattcatcttcacttgtacactattctcaaactgattcagttctttaaatgcaagccataagttcc

SEQ ID NO: 5836 - DNA, 999 bp, Linum usitatissimum
aatcatgctgttaattttcaatcgatcaagtagccacgttcctctgaaaattttatcaatcgaagatggtactgctctcaaatcattcaaccatctgcttcatcgaaataagaaggttgacttcattgaacaatttaacgagaaacttcttgtcaagcaagaaaatgagaatctccaaattcttgatgttcgaaatgctgagctgattgaagtcagcaaaactgaattcatgactccatctgcattcatctttttgtacgagaaccagctgttcttaacattcagaaatcggacagttgctgtctggaatttccgcggggagctcgtaacgtcttttgaggatcacctattgtggcaccccgactgcaacaccaataacatatacataacgagtgatcaagatcttattatttcgtactgcaaggttgaatctgaggatcagtggatggaagcaaatgctggatctatcaatgtgagtaatattttgacagggaagtgtttggctaaaataaacgcttcaaatggaagaccaaagattgatgataagagtagcagtagtagtgggtcaactgagcggctaacatcgatgagaagcacggcaggggaagcacttgaagacataactgcccttttttacgacgaagaacgcaacgagatctatactgggaacaggcatggcctggtccacgtatggtctaactaaatagtgtggccttatgttagtttgttttaacagaatgtcatatgtatgcgcacttggtttgtgcagttgtatccaaagtctgtacatgagcggcagaagatcatactaatgttggatgccgacaagtttgttatttacgcaagaatttattagatgcgtttaaggtggtgtagtcggaattcggtagtggcttgtaattcatctctggttcaaggtatttgtttgttttttctgttgaagatgcttgatttgacatgatgtgttttgttgccaactttaatggaatgtctgaagaa

SEQ ID NO: 5837 - DNA, 1282 bp, Fraxinus spp
ggtacttggttgtaaggtttttagttcgacgttggagattgagatggagtggtaggaggaataacggtggaggtcctaggccgtggttgtgggcgacgtgtggtggcgaagaagaggccccgtgggggcgttagatgggtttgtggaacagcgtgaagaagactccaaaggcgagagatttgctctaagcgcgaccgtgctttcagcatgagcaacgctcaggaacgattccgcaacatccttttgcaggaggaatatgatactcatgatcccaagggacattgttccatggtgttgccatttctcaagaagaggtcacaaattattgaaatagttgctgcccatgatattgtctttgctcttgctcaatctggtgtctgtgcagcatttagtcgaggtagatgctttacaaaggaaaatgacaaattacttttgcaatttttttcaccaatattttgcttttaagatttgacattgaaatgggacttttatatttcttggatgcagagactaatcagaggatatgctttttgaatgtcagtcctgatgaagtcattcgtagcttattttacaataaaatatgattcactcatcaccgtttcagtttatgcttcagataattttagttccttgaaatgcagaaccacgaggattgaatacataagaaggggcaaaccagatgctggttttcctctctttgagtcagaatcattgaaatggccaggttttgttgagtttgatgatgtaaatgggaaggttcttacttattctgcacaagatagcatatacaaggtgtttgacttgaaaaattatacgatgctgtactccatctcggataaaaatgttcaagagattaagatcagtccaggaatcatgttactaatatttaccaaggctagcggtcatgttcctctaaagattctttcaattgaggatggaactgttcttaaatctttcaaccatctacttcaccgaaacaagaaggtggatttcattgagcagttcaacgaaaagctactagtcaagcaagagaatgagaacctccagattcttgatgtccgtaattccgagttaacagaagttagcagaacagagttcatgactccatctgcatttatatttttgtacgagaaccagttattcctgacatttagaaaccgaacagtagctgtttggaacttccgtggggagcttgtgacttcgtttgaggatcaccttttatggcatcctgattgcaataccacaacatttacataacgagtgatcaggaccttatcatttc

SEQ ID NO: 5838 - DNA, 811 bp, Castanea mollissima
tgcttgtacttcatgttgaaattgttgtctgttcatatgttttagatatataaggaggggtaaaccagatgctggctttgccctttttgaatctgagtcactgaaatggcctggtttcgtagagtttgacgatgtcaatgggaaggttctcacttattctgcacaggatagcatttacaaagtatttgacctgaaaaactatacaatgctgtactccatatcggataaacatgttcaagagattaagatcagtccagggatcatgttgttgatttttaccaaagcaattagccatgttccccttaagattctttcaatagaagatggaactgttctcaagtctttcaaccatcttcttcaccggaataagaaggtggatttcattgaacagtttaatgaaaagctactagtaaagcaagaaaatgagaatctacagattcttgatgtccgcaattttgagctgacagaagttagcagaactgagttcatgacaccatcagcatttatatttctgtatgagaatcagttattcctgacatttagggaccgaacagtggctgtttggaatttccgtggggagcttgtaacttcatttgaagatcaccttttgtggcatcctgactgcaacacaaataacatatacatcacaagtgatcaggatcttattatctcttactgcaaggctgattctgatgatccactgtctgaaggaaatggatccatcaatatcagcaatattttgactgggaaatgccttgctaagattagagcaagcaacagcttccccatggaaaatgaatgcagttgcagt

SEQ ID NO: 5839 - DNA, 1060 bp, Citrus sinensis
  misc_feature (378)..(378): n is a, c, g, or t
  misc_feature (417)..(417): n is a, c, g, or t
  misc_feature (432)..(432): n is a, c, g, or t
  misc_feature (941)..(941): n is a, c, g, or t
  misc_feature (1021)..(1021): n is a, c, g, or t
  misc_feature (1024)..(1024): n is a, c, g, or t
  misc_feature (1037)..(1037): n is a, c, g, or t
ccacgcgtccggtcactgaagtggcctcgttttgtagagtttgatgatgtaaatggaaaggtactcacctattctgcacaggatagtatatacaaggtgtttgacctgaaaaattatacaatgttgtactccatatcagataaaaatgttcaggagattaaaatcagtcctgggatcatgttattgatttttactaaagctagcggccatgttcctcttaagattctttcaatagaggatggaactgttctcaaatcttttaatcaccttcttcatcggaataagaaggtggattttattgaacagttcaatgagaagcttcttgttaagcaagaaaatgagaatctccagattcttgatgttcggaattttgagctnactgaagttagcagaactgaatttatgaccccatcggcntttatatttctatangagaatcagctattcctgacctttaggaatcgaacagtggctgtttggaactttcgaggcgagcttgtaacgtcgtttgaggatcatctcttgtggcatcctgactgtaacacaaataacatatatataacaagcgatcaagatcttataatctcttactgcaaggctgattccgacgatccattagccgaaggaaatgctgggtcaatcaatatcagcaatatcttgactggaaaatgccttgctaaaataagagcaagcaatggcctccctgcagaaaatgaatgtagttgcagtggtgattatagcagtggcagttgcaacgtgaagaagcatagccatgcctccagaattaggagcacggttgcagaagccttggaagatattactgctttgttctacgatgaagatcgtaatgagatttatactggcaataggcatggcctagttcatgtatggtcaaactgatgattctgatttgttcttgttttgacgaaaagcttatttcnccaatagttcaaatggttgtgctgccgccctgtatcaatttcctgaaactgtaccattgaacactcttctaccaatttgntgntctttttgtttanttgatggcctgttcatcttaaaa

SEQ ID NO: 5840 - DNA, 1424 bp, Tropaeolum majus
gttgatgggttcgtgaacagtgtaaagaagctcctgaggcgggaaattagctccaaacgtgatcgtgctttcaccatgaccgatgcccaggagagattccgcaacattcacttgcaggaggaatatgatactcttgatcctagtgatgagtgtaccgtggtattaccttttcttaggaagagatcaaagataattgagattgtagctgcacatgatattgtgtttgcacttgctcaatcaggagtgtgtgcagcctttagccgagatataaaccaaaggatatgctttctgaatgtcactccggatgaagtcataagaagtttgttttacaacaaaaacaatgattcacttatcacagtttcagtttatgcttcagacaatttcagttctttgaagtgcagaagtacaaggattgaatacatccgaaggggtaaaccagatgctggctttgctctctttgaatccgagtcactaaaatggcccggttttgttgaatttgatgatgtaaatgggaaagttctcacttattctgcacaggacagtatatacaaggtgttcgacctcaaaaattatacaatgttgtactctatatcagataaaaatgttcaagagattaagataagtccagggatcatgttgttgatttttgctaaagctagcagccatgttcctcttaagattttgtcgattgaggatggtacagtcctgaaatcttttaatcaccttcttcaccggaataagaaggtggatttcattgaacagtttaatgaaaagctactggtcaagcaagagaatgagaatctccagattcttgatgtccgtaattttgagcaaacagaagttagcagaactgagtttatgactccatcagcatttatatttttatatgagaaccagctattcctgacgtttagaaatcgaactgtagctgtgtggaactttcgaggggagcttgtaacttcgttcgaggatcacctgttatggcatcccgactgcaacactaataatatatatatcacaagtgatcaggatcttataatatcgtactgcaaggctgattctgatgatcaattatcggaaggaaatgccgggtctataaacatcagcaatatcttgacaggaaaatgcctagctaaagtcaaggcaagcaacagtgctcccgtacaagatgcatgtaaccgagcatccaaaagagtgcgaagctcagttgcggaagcattggaagatatcactgccctcttctacgatgaagagcgaaatgagatttatacaggtaataggcttgggctacttcatgtatggtccaactgataacatcaatttccttatgggttggtcaccatttgctttttttttggggagggaatggttgaatagattgtactgcctcggtttgttgtgagtaaattcttggaactgtacca

SEQ ID NO: 5841 - DNA, 1400 bp, Tropaeolum majus
gttgacgggttcgtaaacagcgtaaaaaactgcagaggagggaaatcagctccaagcgtgatcgtgctttcaccatgacggatgctcaggagagattccgtaacatccgcttgcaggaggagtacgatactcacgaccctagtgatgagtgcaccatgatattaccttttttgagaaaacgatcgaagatcattgagattgtagcggcacgtgatatagtgtttgcgcttgcgcaatcgggtgtttgtgcagcatttagccgagatgccaaccaaaggatatgctttctgaacgtcactcccgatgaagttatacgcagcttattttacaacaaaaacaatgattcacttatcacagtttcagtttatgcctcagacaatttcagctctttgaagtgccgaagtacacggattgaatacattcggaggggtaaaccagatgctggatttgctctttttgaatccgagtcacttaaatggcctggatttgtagagtttgatgatgtaaatggcaaagtgctcacatattctgcccaggacagtatatacaaggtgttcgatttgaaaaattatacaatgttatactccatatcagataaaaatgttcaagagattaagatcagtccagggatcatgctgttgattttcgccaaagctagtagtcatgttcctcttaagattctgtcaattgaggatggcacagtcctcaaatctttcaaccatcttcttcaccgaaataagaaggtagatttcattgaacagttcaatgaaaagctacttgtcaagcaagaaaatgaaaatctccagattcttgatgttcgtaattctgagttaacagaagtcagcagaactgagtttatgacaccatcagcatttatatttttgtatgagaaccagttgttcctgacgtttagaaatcgaactgtagctgtctggaacttcaggggaaagcttgtaacttcctttgaggatcacctattatggcatcctgactgcaatactaacaatatatatatcacaagtgatcaggatcttataatctcatactgcaaggctgattctgatgatccgttatctgaaggaacagctgggtccataaacatcagcaatatcttaaccggaaaatgcttagccaaagttagagcaacgaacaatggcgccacggaagaggaatgtagatgtaatgagcagtgtaggtgcagttcaaagaagcagagccgaacatcgaaaagagtaagaagctcggttgcggaagcattggaagatatcactgcgcttttctacgatgaagaacggaatgagatatacacaggaaataggcttggtttacttcatgtatggtctaactgatgattctattagtaggtcttttttgttttttagttaaattgacatggcatg

SEQ ID NO: 5842 - DNA, 813 bp, Nuphar advena
tacttattctgcacagaacagcatatacaaggtgtttgacctcaaaaactataagctattgtactcgatatcagatgagcatgtccaagaaattaaaatcagcccaggtattatgctactaatttttacaagggccagcggccatgtccctctcaaaatcctatcaatcgaggatggtacagttcttaaatctttcaatcatctcctacatcgaaataagaaggtagacttcattgagcaattcaatgaaaaacttcttgtcaaacaggaaaatgagaaccttcagatacttgatgtgagaaatgcacagctgactgaagtgagcagcacagaattcatgacaccatcagcattcatctttctatatgaaaaccagttgttcttgacattccggaaccggaccgtggctgtttggaatttcagaggagagttggttacttcatttgatgaccaccttttgtggcatccaaactgcaatacaaacaacatttatattactagtgaccaagacctaataatttcttactgcaaggttgatcctgatgattcttcggttgagggaaatgctggttccattaatattagtaacatcttgactggcaaatgtctggcaaagattcgagcatgtgatcctaatgttactattagtcataaagaacaagcgaatgcatccaaaatctggagcactgttgcagaagcattggaggacataacagcattgttttatgatgaagaccggaatgaaatctacactggtaatggacatggtttagtgcatgtatggtcaaactaggatggccaattttcttcagg

SEQ ID NO: 5843 - DNA, 1673 bp, Quercus alba
ggagttaagagagatggaaggcggtaggaggatatcggtgagtcctcggccttgcagtggaaggcgggtagtggacaaagaagcgagcacgcggaagcggtgtggatggtttcgtcaacagcgttaagaagcttcagagacgggaaatcagttccaagcgtgaccgtgctttcagtatgagcgacgcccaggaacgcttccgtaacatccgtttgcaggaggaatatgatacccatgatccaaaaggtcattgttccatgggactgccttttctaagaaagaggtcaaagataattgagattgtagcagcacgtgacattgtgtttgctcttgctcattctggtgtttgtgcagcatttagccgagagactaatcagaggatatgcttcctgaatgtcagtcctgatgaagttatacgaagcctgttttataataaaacaatgactcactcatcacagtttctgtatatgcttcagacaatttcagttctttgaaatgcagaagcacaagaattgaatatataaggaggggtaaaccagatgctggctttgccctttttgaatctgagtcactgaaatggcctggtttcgtagagtttgatgatgtcaatgggaaggtactcacttattctgcacaggatagcatttacaaagtatttgacctgaaaaactatacaatgctgtactccatatcggataaacatgttcaagagattaagatcagtccagggatcatgttgttgatttttaccaaagcaattagccatgttccccttaagattctttcaatagaagatggaactgttctcaagtctttcaaccatcttcttcaccggaataagaaggtggatttcattgaacagtttaatgaaaagctactagtaaagcaagaaaatgagaatctacagattcttgatgtccgcaattttgagctgacagaagttagcagaactgaattcatgacaccatcagcatttatatttctgtatgagaatcagttattcctgacatttagggaccgaacagtggctgtttggaacttccgtggggagcttgtaacttcatttgaggatcaccttttgtggcatcccgactgcaacacgaataacatatacatcacaagtgatcaggatcttattatctcttactgcaaggctgattctgatgatccactgtctgaaggaaatgcaggatccatcaatatcagcaatattttgactgggaaatgccttgctaagattagagcaagcaacagcttccccatggaaaatgaatgcagttgcagtggcaattgttgtggtagcagttgcgctttaaagaagcagagtcctgcctccagaattaggagcacggttgcagaagccttggaagatattactgctctcttttatgatgaagagcggaatgaaatatatactggcaataggcatggtctagttcatgtatggtccaactgatggtttctgtatttgttcctagttatctttagatttattttacctcttttctatcgttgaattgattgttctgctgcgccatgagaatgggaactgtaccatttaatgttatcataccaattctttttttctttgttcattaggctgtgttaggctaggctgtgttaggcaacatgtaaaatattttccgagtgtaaaatattttcaagtgaaaata

SEQ ID NO: 5844 - DNA, 2098 bp, Sequoia sempervirens
tcccggatgtcgtaaacggctccgtggatcttctcttttgattcagagatcacggtgcgacatccagttgcgtgttctatacaatcgcaaggtttcttcgcactgtgacgcggcccgacgattcaaaactttaaccttcttgtggattagggtttaccttttcagaggctatgttggctttcagctgtccgtcacggagtcaggagtgttgtacaaagggttttaggtgtaaatacgaaatttgtagcgtggttagatcgtttttcaatttcaagttgaggaaatagggttttttctggtcttacatggcgacaagtagggattttagatgatggtgtttgtgatttagaggtccgagcagattcatttggacatatggaggcgaaaaagattggggcgagtcctcggccgtgcagtggccggcgggttgtggccggaaaacgccagcgtataggcgacaccaccaactgcgtgcggaaacttcagagacgggagatcggaaccagcggtaatagggctttcaacatctccaatgcgcaagagaagtttcgaaattttcagttgcaggaagaatttgacacttatgatcccaaggcacattggtttttgaaactgcagtttctaaagaagagatccaaaataatagaaattgttgcagcacgtgatattgtatttgctttggcgcaatctggtgtttgcgcagcatttagcagagaggcaacaaaaaataatgcttcttgaacataagtccagatgaagtgattcgcagcctcttttataataagaacaatgattcactcatcacagtttctgtatatgcttcagataacttcagttcacttaaatgcagaacaacacctatcgaatatattcggaggggtcaaccagatgcaggatttgctttgtttgagtctgaatcattgaaatggcccggatttgtggagtttgatgatgtcaatggaaaggtccttacctattctgctcaggatggaatctataaggtgtttgatttaaagaactatacaatgttgtattcaatatcagatgaacatgtccaagagataaagattagtccagggattatgttactgatatttgacagggctagtgggcatgttcctctcaaaatcttgtctatagaggatggtactgttttaaaagcattcaatcacctgttacatcgcaataaaaaagttgatttcattgagcagttcaatgagaagcttcttgtaaagcaagaaaacgagaaccttcaaatacttgatgttcgaaatgcgcaattgactgaagtaagcagaacagagtttatgacaccatcggcattcatttttctttatgagaatcagttattcttgacattccgcaatcgtacagttgctgtatggaattttcgaggagagctggttacatcatttgaagaccatttgttgtggcatccagattgtaacacaaataacatatatattactagtgatcaagatttgattatttcttactgcaaggcgcatcctcattcttcagatgaggaagaaaatgttggttccataaatataagcaacatattaactgggaagtgcctagctaagattcgtgccaatgatccaaatgttcaaattagtccaagaaatcgtccaaatgcatctgcaatcagaagtactgtacatgaagctcttgaagacatcaccgcccttttctatgatgaggagcggaatgaaatatatacaggaaacaggcatggtttggttcatgtatggtcaaattgaggtacccacaaagcgtgcaaactattcacggcaatgcatgcttgattgcttaaggatctgtggttgtaagttgatagtagcaatgctagctgtttgatgtaatccaaattatgctgcatgcttacttttattatatatcggagtccctgaacgtcaagcatagattacatagaatagggcatatagactgtggaagttcggtttttcagaactcataatggtggtgaatgtctgttgaagacgaatgtgtccctgtaaatctgtattttgaagtacaacttgcagtttctaccgtgtaattgttctttaggtaattttacccatgttcaattttt

SEQ ID NO: 5845 - DNA, 1251 bp, Solanum phureja
tacttacggaactcttttccagcatatacaaggtgtttgacctgaagaattacacaatgttatattcaatctcggacaaaaatgttcaagagattaaaataagcccgggaatcatgttgttaatatttaccaaagctagtggccatgtgcctctgaagattctgtccatcgaggacggtactgttcttaaatctttcaaccaccttcttcaccgaaataagaaggttgatttcattgaacagtttaatgaaaagcttcttgtcaagcaagagaatgagaatcttcagattctggatgtacgtaactctgagttgacggaagttagcaggactgagttcatgaccccctcagcgttcatatttctgtatgagaaccagttgttcttgacattcagaaacagaacagttgctgtttggaacttccgtggggagcttgttacttcatttgaggatcaccttttatggcatcctgattgcaatactaacaacatttacataactagtgatcaggacctaattatttcatactgcaaagctgattctgatgatcccttatctgaaggaaatgcgggatctattaatatcagcaatattctgactggtaaatgccttgctaaaataaaagcaaccagcggcaaggccactgatgattgtaatgctagtggcggtgtgcctggtaaaaaaagttacaactcaaataagcgggtccaagattccagaattaggagcactgttgcagaagccctagaagacatcactgcccttttctatgacgaagagcgcaatgagatctatactgggaacaggcttggactggtccatgtatggtctaactgactaattatcctgctcccctgatgtctaagattgttactgatggaggaatgcctcaggtaacattgtatcactagtatagtgttttttagtcttgtacccaaaggaatggtttgagttgtgtcatctctatttactttaaactgtaccgtttgtttgtaatgtggttgcttgggtgattgccctgttagatgaggtattctagatgatttctagtgtactgctagtgcttttgtaacttagggctgtctactgagtcgtagtcagagctagttaaccagtaagtctcatttacttcagccattctaatgctttaaatggttgagagcacagtgttatgtttaagtgacactgcttgttgtttccttaagtgaatgaattttctacttctctttagttattgagtgtttctcccttt

SEQ ID NO: 5846 - DNA, 1268 bp, Picea glauca
  misc_feature (555)..(555): n is a, c, g, or t
  misc_feature (1088)..(1088): n is a, c, g, or t
gatgaacaagttcaagaaatcaagatcagtccaggtataatgttattaatatttgagagaactgctggtcatgttcctctgaagatcttatccatagaagatggtactgttttaaaatcctttaatcatttgttgcatcgcaacaaaaaggtagatttcattgagcagttcaatgaaaagcttcttgtaaaacaagaaaatgagaacctccaaatactagatgttcggaatgcacaattgactgaagtgagcaggacagagtttatgacaccgtcagcttttattttcttgtacgagaatcaattatttttaacattccgcaatcggactgttgctgtttggaatttccgaggagagctggtgacgtcttttgaagaccacttgttatggcatcctgactgcaacacaaataacatctacatcactagcgaccaagatttaataatttcttattgcaaggcccatcctgatggatctgatgaagaggaaaatgtgggctccataaacatgagcaacatcttgactggaaaatgccttgctaagattcgtgccaangatccaaatgtaaggatcagtcctagaaatcggccaaatgcttcgacaatcagaagcactgttcaagaagctcttgaagacattactgctcttttctatgacgaggagagaaatgagatctacactggcaatagacatggtttaatacatgtttggtcaaactgatcagtttgtttgaaatttggaaatccagtcaatcattcaaagcacacttgaatgatgatgaagtagttatgacagctggcaggcataagaaatatggcagctgtgaatgtcttcacttccactaagttttggagatatctgttttataatcacacataatgttggctggttctgtattttagttttttaatttcttgtcattttgtaagagctgaatcgtttcagtagcatgtatgtatccttgagtgtttattttacaccataggatgaaatcagtaaaacacaattgtgttggaatatgtaaaactgtaggagaggaaaactatcatataacattgtaaaacattaaactaattttcagcatctcnatcctgagtttataatgttctgagaaattagaatgatgattaccaagcaaatagtatttcttttcagagtacatcaaacgagcgattcccacctagctgcgatgtaaaataaagctgtaaaaattgtgcaattggcaagatgttgcccaagttaagtataatatcgaccacttttgacta

SEQ ID NO: 5847 - DNA, 1517 bp, Picea glauca
caatttcagttcactgaaatgcaggacaacacccattgagtatatccggaggggtcaaccagatgcaggctttgccttatttgagtctgagtcattgagatggcctggttttgtagagtttgatgatgtgaatggaaaagttctcacctactctgcccaggatggtatctataaggtgttcgacttaaagaactacacattgttgtattcaatatcagatgaacatgttcaagagataaagatcagcccagggataatgttactaatatttgacagggcaagtgggcatgttcctctgaaaattttatctatagaggatggcactgttttaaaagcatttaatcacctgttacatcgcaataaaaaggttgactttattgagcagttcaatgagaaacttcttgtaaaacaagaaaatgagaacctacagatacttgatgttcggaatgcgcaattgactgaagtaagcagggcagagttcctgaccccatcagcgtttatttttctttatgagaaccagttattcttgacgttccgcaatcgtacagttgctgtatggaatttcagaggagagctggttacctcatttgaggaccacttgctatggcatcctgattgcaatacaaataacatttatattactagtgatcaagatttgattatttcctactgcaaggcacttcctctttcttctggcgcagaagaaaatgtgggttctataaatataagcaacatattaactggaaagtgcctggctaagattcgtgccaatgatccaaatgttcagattagtcctagaaatcgtccaaatgcatctacaatcagaagtactgtagaagaagcacttgaagacatcactgccttattctatgatgaagagcggaatgaaatatatactggtaattggcatggcttggttcatgtctggtcaaactgattaatgcctgtaagttgtgcatatccagtcaatcattcactgcattttatgtcgaaatctcgatcactgggtggtaacctgacaacaatgttgctaattgttcagtgtttggattatgctacttgatgccaagaaatatggaagttatgctgcttgataagcaatgatataggaaggagctcatgtcaccagaattctaattatgaaagttttgtttcttcacatgtacaaccaaaaagggtgtttgattggttactggttgtctgataatatgaatctatgggcagtgctgaaattgcagaaaattgcaattgatgcaggagatagtttggtcacctgtaaatctgtattctgatttgtaattgacccgtcttaccatgcaagggtctcaaatttaatattttcttgattttttgtagcagacttgttttctcatgtgtttaaagctgtgcagaacattggatccataaattttattaaaggcaaaagaaaatcacttcaatgctgaagacacatgcaattcaaataccccctttattttacaagggtataaaatgaatatatattatgtataaatgac

SEQ ID NO: 5848 - DNA, 763 bp, Juglans hindsii x Juglans regia
ggggcaggatagtatttacaaagtgtttgacctgaaaaactatacaatgttgtactccatatcggataaacatgttcaagaaattaagatcagtccagggatcatgttgttgatttttaccaaatcaagtagccatgttcccctcaagattctttcaattgaggatggaactgttctaaaatctttcaaccatctccttcaccggaataaaaaggtggatttcattgaacagtttaatgaaaagctactagtcaagcaagaaaatgagaatttacagattcttgatgtccgcaattttgagctgactgaagttagcagaactgaatttatgacaccatcagcatttatatttctgtatgagaaccagttgttcttgacgtttagaaaccgaactgtggctgtctggaacttccgtggggagcttgtgacttcatttgaggatcaccttctgtggcatcctgactgcaacactaataacatatatatcacgagtgatcaggatcttattatctcttactgcaaagctgattctgacgatccactgtctgaaggaaatgctggatcaatcaatatcagtaatattctaaccgggaaatgtcttgctaaagttagagcaagcaacagctttcccgtggaaaatgaatgcagttgcagtgatcattattgtggtagcagttgcgctttgaagaatcagactcatgcctccagaatcaggagcacggttgctgaagccttggaagatattactgctctcttttacgat

SEQ ID NO: 5849 - DNA, 1227 bp, Zostera marina
gtttgatgatgtaaatgggaaggttcttacttattctgcccaagacagcatctacaaggtgtttgatttaagaaattactcgcttctttactcaatatcagacaagaatgttcaagaaatcaagatcagcccaggtatcatgttgttaatatttacgagagcaaccagtcacgttccactcaaaattctttcaatagaagacggaactcttctcaaatcatttaatcatcttttacatcggaacaagaaagttgactttatagaacagttcaatgaaaagctccttgtcaaacaagaaaatgaaaatcttcaaattgtagatgttcggaattcacagttaactgaagtaagcagaacagagtttatgacaccatctgcttttattttcttatacgagaatcagttatttttgacattccggaataggactgtttctgtttggaattttaaaggtgaattagtgacatcttttgaagatcaccttctttggcatcctgattgcaacaccaataacatttatattactagtgatcaagatctcataatttcttactgcaaagctgattctgatgttccatcggtggttgatggggccatcgctggatcaatcaatatcagcaacatattaactggaaaatgcctcgcaaaaatcctagctagcaactcaaaaaggcgaaaaaacaaggcgcacgctgaattccaatgcactgttgtgcaggcattggaggacatcactgcactttattatgacgaagaacgaaatgaaatctacactggtaacatgcaaggtcttgtccatgtatggtccaattaattgacccaacactgcaaaaaacaggtcttccttccaatctcctttcatccatgctgctgctgtcagatggaactcttttagatcacttcattgttgtaagaaatccttctgtcactattgtttttttaatgtaatttcttcttcttgttctacctaaattaccatgttagccgcttagcaaagtcattatttgatgaaattgattgcttttaatattgttaattagaatttgctcctcctaagtcctatctatctctctgcaagaaagattaatacaattttggcagctggatttgaaacgattcttgtaaaatatttaattgttttttaacattagttgttaaggttgaatgttggttttatatatcaaatatacatataaattgaatgtgtagctagttacatttgatttg

SEQ ID NO: 5850 - DNA, 1908 bp, Ambrosia trifida
cccaaaagaaaaagatttggatatacacaaaacacagacaccacagaaaatgacactacttcaaccctaatcccccccccctttccaaattcagtaagtccaaactactccccactaatttcaacttgttatcttcagattcagtgttttcttgattattgtcggtgttgtaaccaccaagacaagagaagagatttggatttggatcttgatttgttttagtgttaaggggatgatggatggaaggaggattacggcgagtccacgcccctgtaacggccgtcgtgtggtggccaagaagcggcgccgtggtggcgctgctgctgctgctgatgctgactctatgaatagtgttaagaagcttcagagaagagagatttgttccaagagagatcgaggctttaggatgtctgatgctcacgacagattcagaaacattcgcttgcaggaggagtatgatactcatgatccgaaggggcattgctctatggtattgccatttcttaaaaaacggtcaaaaatcattgagattgtagctgctcacgatatagtattcgctcttgcgcaatctggagtctgtgctgctttcagccgagacactaaccagagaatatgctttctcaacgttagccctgatgaagttataagaagcttgttttacaataagaacaatgattcactcattacagtatcagtctacgcttcagacagctttagttccttgaaatgcagaacaacaagaatcgaatatatacgacgaggtcaacccgatgccggttttgctctttttgagtcagaatctttgaaatggcccggttttgtggaatttgatgatgtgaacggaaaggtgctgactttttcagcacaagatagcatttacaaggtgtttgatttgaaaaactatacgatgttgtattccatagccgataaaaatgtacaagagatcaaaataagccccggaattatgttgctgatatataataaagctagcagccatgtgcctctcaagattctctctattgaagatggaaccgttttaaaatcctttaatcatctccttcatcgaaacaagaaagtggatttcattgagcagttcaacgaaaagcttcttgtcaagcaagaaaatgaaaatctccaaattctggatgtacgcaattgtgacttaacggaagttagcaggacagaatttatgacaccatctgcattcatctttctctatgagaatcaattattcctgacatttagaaaccgaacagtagcagtctggaattttcgtggagaacttgtgacttcatttgaagatcatttattgtggcatcctgactgcaacacaaacaacatttacatcacaagtgatcaagatcttatcatttcatactgcaaaaccaagtctgatgattcaccaacagaaggaaatgaaggatctataaatatcagcaacatcttgactggaaaatgccttgctaaaataaaggcaaagcgtggtgttcctttggatgaatgcacttgcagtgacgccaacacgagcagaagctgcaagtgcacatcaagaaaacgagttcgagcttctagaatcacgagttctgttacagaagccctggaggacattactgcccttttctatgatgaagagcgtaacgagatttatacaggtaataggctcgggctagttcatgtatggtctaattgaaagtttgttctatatttctaatctcccttgcaagattacttaagtcgggtagaaacaaaacgtgatatagttgtaatttatagatttgttcttcggatagacattatttgctttgttgattttttttactgtaaaatgcaaccagaatgtggatctctttatctattacttgttgaagtgaagtgtaaaaaaatgagtgataattatcttgccaaaaa

SEQ ID NO: 5851 - DNA, 1875 bp, Cannabis sativa
tgattttgttctgtctgaaattatagtttagttagaagtattggtgttagtgtatgcatattgggttgttgtagttttgcaatcaagtgattgaatttgagcgaacatttgtgtaggaagaatatgatacgcatgatccgaagggtcactgttctatggtactgccttttttaaggaagaggtccaagatcattgagattgtagcagctcgtgacattgtgtttgctcttgcccaatctggtgtttgtgcagcttttagtagagagtctaatcagaggatatgctttctcaatgtcagtcctgatgaagttatacgcagcttgttttataataagaacaatgactcacttatcacagtttctgtttatgcttcagacaatttcagttctttaaaatgtagaagcacaaggatcgaatatattcgaaggggcaaaccagatgctggctttgctctttttgaatctgagtcactaaaatggccaggttttgtagagtttgacgatgtaaatgggaaggttctcacgtattctgcacaggatagtatatacaaggtttttgacctcaagaactatacgatgctgtactccatatccgataaaaatgttcaggaaataaagataagtcctgggatcatgctgttgattttaaccaaggctagtggtcatgtgcccctcaagattctttctatagaggatggtacagttttaaaatcatttaatcatctccttcaccggaataagaaggtggattttatcgaacagttcaatgagaagcttcttgtcaagcaagaaaatgagaacctccagattcttgatgttcgtaattttgagttaacagaagttagcagaactgaatttatgacaccgtcagcttttatatttctgtatgagaatcagttgttcttaacgtttagaaatcgacttgtggctgtttggaacttccgtggggagcttgtaacttcatttgaggatcaccttttgtggcaccccgactgtaatactaataacatatacattactagtgatcaagatcttattatatcttactgcaaggctgattctgatgatcccttgtccgaaggaagtgcagggtcgatcaatatcagcaatattctgactgggaaatgccttgctaaaataagagcaagtaacagcaccccattggagagtgaaggttgctgtagtgacaagtgctgtgtcagtggcagcggcggcaactgcaaatcaaagaagcgtacccaagcagccagaactcggagcacagttgctgaagcattggaagatattactgctttattctacgacgaagagcggaatgagatctatacaggcaataggcatggtctagtacacgtgtggtctaactaatggtttctactatcctttcttgtgttcattagatagatttattgatgctgttttaagtggttgaattgattgtgtcgactgttgatgtaagcaagagttgggaataattgtatcattagattgccttgtatcatgtcatataatccgtttaacttaatcccttttgtctcttgtcttgtgccctgtattggaactgaaatgccctattcatagaattgtttttcatagtgaatatgccgtacaaatcttggctctgaaatgaatgctaatttgtatcttaattttgtaggacagacaagaacatgttctatatctatttacggttaagtgaacccaggaatcaggatgattaaatattactggcaaaagcattgagtttgatagtttctctttcttcccttggttacttaatttttacattttaaaatgttgaaagggagtgtgtgtgagtgtgaccactggggcacaacctttagaaaacaatggcttttatctgtcttgtcatatg

SEQ ID NO: 5852 - DNA, 1667 bp, Cirsium arvense
ttacatttttaggtcctcttcttcttttatgcttccatctctctctatatctatctttcccctttctggagagagaaacagaaatttcaaatgtacacttgccacatacaacaacagatttagggcacatataagctcaattagtgtgaagattgaagaaattcaaatctttcttcaccaattcctccattttctgcatataattgctcagtaccaccagcaacctaaaaagccctaataatttatactatatggtcttgagatttagggtttttgaagaatgttgagtttctaactttctattgcgattaagcaatcgactgtgttggttttcgagctcaggaagatcgatagatgcgagtttctagggttttgatttgtgttattgttgtacggtagatgtgaaaagaagaagaggaagaagccatggatggaaggaggatacggcgagtccacggccgtgcagtgggcggagagtggtggcgaagaagcgtccacgtggcggtggtgatggatttgtgaacagcgttaagaagcttcagaggagggagatttgttcgaagagggatcggtcttttagtatgtgtgatgctcaagagaggtttagaaatatccacttacaggaggagtatgatacccatgatccaaagggacactgctctatggttttgccatttcttaagaagaggtcaaaaatcgttgagatcgtcgctgctcgcgacatagtctttgctcttgcacaatctggaatctgtgctgcattcagtcgagagactaaccagaggatatgctttctaaatgtcagtcctgatgaagttataagaagcttgttttacaataaaaacaatgattcgctcattacagtctcggtctatgcttcggacagttttagttctctgaaatgtagaacaactgggattgaatacatacggagaggtaagccagatgccggttttgcccttttcgagtcagagtctttgaaatggcctggttttgtggagtttgatgatgtgaatggtaaagtacttacattctcggcacaagatagcatttacaaggtgtttgatttgaaaaactacatgatgttatactcaatatcagataaaaatgtccaagagatcaaaataagccctggcatcatgttgttgatatttaataaagccagcggtcatgtacctctgaagattctctccatcgaagatggaactgttctgaaaaccttcaaccatctccttcatcgtaataagaaggtggatttcatcgaacagtttaacgaaaagcttcttgtgaaacaagagaacgagaatctccagattcttgatgtacgcaattctgagctaacagaagttagcaggacggaatttatgacgccttccgcattcatatttttatatgaaaaccagctgttcctgacattcagaaaccgaacagttgctgtgtggaacttccgtggagagcttgtgacttcgtttgaagatcatttgttgtggcatccggactgcaacacgaacaacatatatatcacgagtgatcaggatctttatcatctcttattgcaaagctgattctgatgatcctttaaccgaaggaaatgccggctctatcaacattagcaacattctgaccggaaaatgccttgcgaaagtgaaggcaatggacggtacaaa

SEQ ID NO: 5853 - DNA, 1580 bp, Cirsium arvense
agaaccaggagactatacgcaacttctctctggattcaaaactttactaatacaagtatcatctcactcctccatcattcaccgctttcttcgtttcgaatttcgattcacccatttgaaattcacctcaatttcactaccaattgtaagatcaatcgtcatttatctactagtaatcagcttttgcgtcttataattggtggaatttcgtttggaaatcgagttcccaattgcattcaagatgaacgtgaatgcaagggtttggtagtggtggtgccagtagccagaagtagcaggaggaggaggaggaggagaattacgatggccaccagcagcggtagtggtaacagtaggccgctaccacagtgcggcggccggaggagagtagttgctacgaagaagcgtgacttgactaacttgctatctgttaacaacagcgtcaacaagattcagaggcgtgagatttcttccaaacgccaccgttcctttactaacaccaattccatccaccgctttaggaacatccgattgacggagcaatatgatacccatgatcccaaaggacattcatcatttgtattaccattcttgatgaaaagggcaaaggtcattgaaatagtggcagcacgtgggatcgtattcgcccttgcaagttctggtgtttgtgcagcttttagtagagatacaaataagaggatatgtttcttgaatatctttccagatgaagtcatccgtagcttgttttacaataaaaataacgaatcactgattacagtatctgtatatgcttcagacaacttcagttctctcaaatgcagatcaacgcgaatagaatacatacaaagaggcaaaccagatgctggttttcctctttttgagtcagagtccctgaagtggcctggatttgtggagtttgatgatgtcaatgggaaggtgcttacctactctgcacaggatagcatatataaggtctttgacctgaagaattatacgctgttatattctatagcagacaaaaatgtagaagaaatcaagatcagccctggcatcatgttacttattttcagtagggctataagccatgttcctcttaagatactatcaatagaagacggtacagttctaaaggatttcaatcatttacttcatcggaataaaaaggtcgattttatagagcaattcaacgaaaaagcttcttgttaaacaagaaaacgagaatctccaaattgttgacgtacgtaattctgaggtaaaagaagttggtagaacagagttcatgaccccatctgcatttatatttctgtatgagaatcagttatttctaacatttagaaatcgaactgtttctgtttggaacttccgaggagaacttgtgacatcatttgaggatcatgtactatggcattccgactgcaataccaataacatatatataactagtgaacaagatcttataatttctttctgcaaagatgattcagatgatcaatggactgatggaaaagctggttctattaatataagcaacatatggaccgggaaacgcataggtaaaataaactcgagcaatgcaacattga

SEQ ID NO: 5854 - DNA, 1310 bp, Cirsium arvense
atggacggaaggaggataacggcgagtccacgtccgtgcaatggccggagggtggtggcgaagaaacgtccgcgtggtggtgttgatgggtttgtaaatagtgttaaaaagcttcagaggagggagatttgttcaaaaagggatcgttcttttagcatgtgtgatgcccaggagaggtttagaaatatccgcttacaggaggagtatgatacccatgatccaaaggggcactgctctatggttttgccatttcttaagaagaggtcaaaaatcgttgagattgttgctgctcgcgacatagtctttgctcttgcacaatctggaatctgtgctgcattcagtcgagagactaaccagaggatatgctttctaaatgtcagtcctgatgaagttataagaagcttgttttacaacaagaacaatgattcgctaattacagtctcagtctatgcttcagacagttttagttccctgaaatgtcgaacaacagggattgaatacatacggagaggtaagccagatgcaggttttgcccttttcgagtcagaatctttgaaatggcctggttttgtggagtttgatgatgtgaatgggaaagtacttacattctcggcacaagatagcatttacaaggtgtttgatttgaaaaactacatgatgttatactcaatatcagataaaaatgtccaagagatcaaaataagccctggcatcatgttgttgatatttaataaagctagtggccatgtccctctcaagattctctccattgaagatggaactgttctgaaaacattcaaccatctccttcatcgaaataagaaggtggatttcattgaacagtttaatgaaaagcttcttgtcaaaacaagagaacgagaatctccagaattcttgatgttcgtaaattctgagctaacagaagttagcaggacggaattcatgacaccatcggcattcatctttttatacgagaaccagttgttcttaacgttcagaaacagaacagttgctgtgtggaactttcgtggagagcttgtgacttcatttgaagatcatttgttgtggcatccagactgcaacactaacaacatatatatcacaagtgatcaagatcttataatttcttattgcaaagctgattccgatgatcctttaaccgaaggaaatgcgggttctatcaatatcagcaatattctgacaggaaaatgccttgcaaaagtaaaggcaatggagggtacgaaattagatgattgcatttgcagtgggcaaagaagatgcaaatgcaagaagcgggtggggagtaggta

SEQ ID NO: 5855 - DNA, 1738 bp, Flaveria ramosissima
aatgattctcccctttcatcctttcgattcaaatcaaaaccctcatcaaattcaactcactccgattcgaattctcactgaaatcacatcatcatcttcatcatcatcatcgtcataatcataatcatcatcatcatcaagttaccagtagtcagccctagcggttggtggaatttcaatcggaaagttgatcttcgaatacttacagtctgaatgtacggaaatggaaagatttggtggtagcggtggcagaaacggcagaattgcgatggcgagtagcggcgttagtggtagtagccggccgtcaccgcactgcggcggtcggaggagagtggttgccaccaagaagcgtgattgggggaactggctgtcggtcaacaacagtgttaggaagattcataggcgtgagatttcttccaaacgacaccgttccctttcgatcaacaattccgttcaccgctttaggaacatacggttgacggggcaatatgatactcatgatcccaagggacaatcatcatttgtattgccatttttgatgaaaagggcaaaagtcattgaaatagtggcagcacatggtatagtattcgctcttgcaagttctggtgtttgtgcagcttttagtagagatacaaacaagaggatatgcttgttgaatatatttccagatgaagtcatccgtagcttgttttacaataaaaataataactcattaattacggtgtctgtatatgcttcagacaatttcagttcactcaaatgcagatcaacaagaatagaatacatacaaagaggccaaccagatgctggttttcctctgtttgaatcagagtctctgaaatggcctggttttgtggagtttgatgatgtcaatgggaaggtgcttacctactctgcacaagatagcatatacaaggtcttcgacctgaagaattatacactgttatactctataacagacaaagatgttgaagaaattaagatcagtcctgggatcatgttattgattttcacaagagctcagagccatgttcctctgaagatattatcaatagaagatggcacagttttaaaagattttaatcatttacttcatcgcaataagaaggtggattttatagagcaattcaatgaaaagcttcttgttaagcaagaaaatgagaatcttcagattcttgatgtacgaaatgctgaggtgaaagaagttggtagaactgagttcatgactccgtctgcatttatttttctatatgaaaatcagttatttctaacattcagaaaccaaacggtttctgtttggaattttcgaggagagcttttgacatcatttgaggatcatgagttatggcattcggactgcaatacaaataacatttatataacaagtgatcaaggtcttataatttctttctgcaaaggtgattcaaatgatcaacggattagtggcaaagctggttctattaatatcagcaacatatggaccgggaaatgtgtggctaaaataaacgctagcaacgcaactctcagtgaagataaaaagcaaagaatgattgaaaatcatatggttgcagatgcacttgaagagataacagccctttacttcgacgaagaacgcaacgagatttacacgggtaataatcgtggtcttgttcatgtctggtctaattaaagactctagatatcaagtgcgctgattaaatagtttcaagtgtgtgtttgatactaaatatgatttgta

SEQ ID NO: 5856 - DNA, 1690 bp, Flaveria ramosissima
atcatcaagttaccagtagtcagccctagcggtttctactcggtggaatttcaatcggaaagttaatcttcgaatactttacattctgaatgtacggcaatggaaggatttggtagtagcggtggcagaaacggcagaattgcgatggcgagtagcggcgttagtggtagtagccggccgccaccgcactgcggcggccggaggagagtggttgccaccaagaagcgtgattggggcaactggctgtcggtcaacaacagtgttaggaagattcataggcgtgagatttcttccaaacgacaccgttccctttcgatcaacaattccgttcaccgctttaggaacatacggttgacggagcaatatgatactcatgatcccaagggacaatcatcatttgtattgccatttttgatgaaaagggcaaaagtcattgaaatagtggcagcacatggtatagtattcgctcttgcaagttctggtgtttgtgcagcttttagtagagatacaaacaagaggatatgcttcttgaatatatttccagatgaagtcatccgtagcttgttttacaataaaaataataactcgttaattacggtgtctgtatatgcttcagacaatttcagttcactcaaatgcagatcaacaagaatagaatatatacaaagaggccaaccagatgccggttttcctctgtttgaatcggagtctctgaaatggcctggttttgtggagtttgatgatgtcaatgggaaggtgcttacctactctgcacaagatagcatatacaaggtctttgacctgaagaattatacactgttatactctataacagacaaagatgtagaagaaatcaagatcagtcctgggatcatgttattgattttcacaagagctcagagccatgttcctctgaagatattatcaatagaagatggcacagttttaaaagattttaatcatttacttcatcgcaataagaaggtggattttattgagcaatttaatgaaaagcttcttgttaagcaagaaaatgagaatcttcagattcttgatgtacgaaatgctgaggtgaaagaagttggtagaactgagttcatgactccgtctgcatttatttttctatatgaaaatcagttatttctaacattcagaaaccaaactgtttctgtttggaattttcgaggagagcttttgacatcatttgaggatcatgagttatggcattcggactgcaatacaaataacatttatataacaagtgatcaaggtcttataatttctttctgcaaaggtgattcaaatgatcaacggattagtgggaaagctggttctattaatatcagcaacatatggactgggaaatgtgtggctaaaataaacgctagcaacgcaactcttagtgaagataaaaagcaaagaatgattgaaaatcatatggttgccgatgcacttgaagagataacagccctgtacttcgacgaagaacgcaacaagatttacacgggtaataatcgtggtcttgttcatgtctggtctaattaaagactccagagatcaagtgcgctgattaaatagtttcaagtgtgtgtttgatactaaatatgattggttttaggttgtggagtgtatgcagatatggtgcttaaattgcatgaattttcacatgttttttattttgatgtatatt

SEQ ID NO: 5857 - DNA, 1039 bp, Flaveria ramosissima
tagaagtacatcgacgaggtcagcctgatgctggttttgtctctttttgagtccgaatctttgaatggcccggttttgttggaatttgatgatgtgaatggaaaggtgctgactttttcagcacaagatagcattacaaggtctttgatttgaaaaactatacgatgttgtattccatatctgataaaaatgtacaagagatcaaaataagccctggaatcatgttgttgatatataacaaagctagcagccatgtccctctcaagattctctcgattgaagacggaactgttttaaaatcttttaatcatctgcttcatcgaaacaagaaagtggatttcattgagcagttcaacgaaaaacttcttgtgaagcaagaaaatgagaatctccaaattcttgatgtacgcaattcggacttgacggaagttagcaggacagaatttatgacaccgtcagcattcatctttctgtatgagaatcaattattcctaacatttagaaaccgaacagtagccgtctggaattttcgtggggaacttgtgacttcatttgaggatcatttattgtggcatcctgactgcaacacaaacaacatttacatcacaagtgatcaggatcttatcatttcatattgcaaaaccaaatctgatgattcaccaacagaaggaaatgaaggatctataaacatcagcaacattttgaccggaaaatgccttgctaaaataaagggaaagaatgatgttcctttagatgaatgcagctgcagtggcaatggcatcaacatgaaatctagtagcagaagctgcaagtgcacatcaagaaaacgaatccaagcttctagaatcacgagttctgttacagaagccctagaggacataactgcccttttctatgatgaagagcgtaacgagatttatacagggaataggctcgggttagttcatgtatggtctaactgaaagttgtcataaatatctggtttcttgcaagatttcttgggtaggtagaaactaaaccgatatagatgtaatcagta

SEQ ID NO: 5858 - DNA, 1498 bp, Flaveria ramosissima
tgtacggcaatggaaggatttggtagtagcggtggcagaaacggcagaattgcgatggcgagtagcggcgttagtggtagtagccggccgccaccgcactgcggcggccggaggagagtggttgccaccagaagcgtgattggggcaactggctgtcggtcaacaacagtgttaggaagattcataggcgtgagatttcttccaaacgacaccgtccctttcgatcaacaattccgttcaccgctttaggaacatacggttgacggagcaatatgatactcatgatcccaagggacaattatcatttgtattgccatttttgatgaaaagggcaaaagtcattgaaatagtggcagcacatggtatagtattcgctcttgcaagttctggtgtttgtgcagcttttagtagagatacaaacaagaggatatgcttcttgaatatatttccagatgaagtcatccgtagcttgttttacaataaaaataataactcgttaattacggtgtctgtatatgcttcagacaatttcagttcactcaaatgcagatcaacaagaatagaatatatacaaagaggccaaccagatgctggttttcctctgtttgaatcagagtctctgaaatggcctggttttgtggagtttgatgatgtcaatgggaaggtgcttacctactctgcacaagatagcatatacaaggtctttgacctgaagaattatacactgttgtactctattacagacaaagatgtagaagaaatcaagatcagtcctgggatcatgttattgattttcacaagagctcagagccatgttcctctgaagatattatcaatagaagatggcacagttttaaaagattttaatcatttacttcatcgcaataagaaggtggattttatagagcaattcaatgaaaagcttcttgttaagcaagaaaatgagaatcttcagattctggatgtacgaaatgccgaggtgaaagaagttggtagaactgagttcatgactccgtctgcatttatttttctatatgaaaatcagttatttctaacattcagaaaccaaactgtttctgtttggaattttcgaggagagcttttgacatcatttgaggatcatgagttatggcattcggactgcaatacaaataacatttatataacaagtgatcaaggtcttataatttctttctgcaaaggtgatgcaaatgatcaacggattagtgggaaagctggttctattaatatcagcaacatatggaccgggaaatgtgtggctaaaataaacgctagcaacgcaactcttagtgaagataaaaagcaaagaatgattgaaaatcatatggttgcagatgcactagaagagataacagccctttactttgacgaagaacgcaatgagatctacacgggtaataatcgtggtcttgttcatgtctggtctaattaaagactccagagatcaagtgcgctgattaaatagtttcaagtgtgt

SEQ ID NO: 5859 - DNA, 2343 bp, Pinus pinaster
ctcctcgttttggtttcaaccggtatcgaaatgtaccagccaatctgagctcttacgcctcttggatctccatgccgaagtcttctagtggacttctgaacacagcatgagaaacccatttgcccgttttctctgtaatgcgtagtttcccctttgaatggtggtgtctatcaatccaaaccctccacgcggtttccgttacagttgctctgatgtgaggggctatggtcttgttttcgtctgcagaatgggcttggcaagggtctccgaagggttctgctacgccatctagaatctataacacagcccagttggttttcaaatgcaaacggagtccctagggttcgatctgtgcaatatttgctgctgcgatgtcgcggcgcagaggcttcttttgacgctgttgtttgctgcgaagggagaatagttatctttgaccttcttgaatatggaggggaaaaggatcgcagcaagccctcgaccttgcagtggccggcgcatcgtcgctgccaaacgtcaacgggtggacgcttctgctaactgcgtgcgtaagctgcaaaggcgggagatcggcaccagtggcaacagggctttcaacatcactaattcccaggaaaagtttcggaattttcagttgcaggaggaatttgacacttatgatcccaaggcacattggtttttgaagctgcagttcctgaagaagaggtcgaaaatcatagaaattgttgcagcacgtgatattgtatttgctttggctcaatctggtgtttgtgcagcttttagcagggaggccaataagaaaatatgctacctgaatataagcccggatgaagtgatacgcagcctcttttataataagaacaatgattctctaatcacagtgtcagtatatgcctcggataatttcagttcactgaaatgcagaacaacacccattgagtatatccggaggggtcaaccagatgcaggctttgccttattcgagtccgagtcattgaaatggcctggttttgtagagtttgatgatgtgaacggaaaagttctcacctactctgcccaggatggcatctataaggtgttcgacttaaagaactacacattattgtattcaatatcagatgaacatgttcaagagataaagatcagcccggggataatgttactaatattcgacagggccagtgggcatgttccgttaaaaattctatctatagaggatggcactgttttaaaagcatttaatcacctattgcatcgcaataagaaggttgactttattgagcagttcaatgagaaacttctcgtaaaacaagaaaatgagaacctacaaatactggatgttcgcaatacgcaattgactgaagtaagcagggcagagttcttgactccatcggcatttatttttctatatgagaatcagttattcctgacattccgcaatcgtacagtggctgtatggaatttcagaggggagctggttacctcatttgaggaccacttgctatggcatcctgattgcaatacaaataacatttatattactagtgatcaagatttgattatttcttactgcaaggcacttcctctttcttctggagcagaagaaaatgttggttctataaatataagcaacatattaactggaaagtgcctggcgaagattcgtgcgaatgatccaaatgttcagattagtcctagaaatcgcccaaatgcctctacaatcagaagtactgtagaagaagcacttgaagacatcactgccttattctacgatgaagagcggaatgaaatatatactggcaattggcatggcttggttcatgtctggtctaactgattaatgtctgtatgttgtgcatacccagtcaatcattcactggattttatgtcgaaatctcaagcactggggcctgacagtgttgctaattgttcgagtgtttggattatgcttcttgatagcaagaaatatggaaatttaagatgcttgattaacagtgatatagaaaggagctcgtggcaacataattcaaattatgaaagttttgattcttcaaatgtacacgccaagtgtgtttgataggtcagttgtctgataatatgactcagtgggcaggtgctcaaattgcagaaagttgcgattgatacagtagatagtttagtctcctgtaaatctgtattctgaattgtaattgacccttaccatggaagggtctctaatttaatattttctttattttttgtagaagacttgttttctcatgtgtttttaaagctctgcagaacgttggaatcaagatctaaggatcgttaaattttaataaaaggacaaaagcttaatctacg

SEQ ID NO: 5860 - DNA, 840 bp, Olea europaea
catgttactgatatttaacaaagctagtggccacgttcctctaaaaattctgtccattgaggatgggactgtccttaaatccttcagccatctccttcatagaaacaagaaggtggatttcattgaacaattcaacgagaagcttcttgtcaagcaagaaaatgagaaccctacagattcttgatgttcgcaattcagaattaatgaagtgagcagaaccgagttcatgaccccatcagcatttatatttttgtacgagaaccagttattcctgacattcagaaaccgaaccgtggctgtttggaacttccgaggggagcttgtgacttcattcgaggatcaccttttatggcatccagattgcaatacgaacaacatatacataacaagtgatcaggaccttatcatttcgtgttgcaaagctgattctgatgatccactgtcagaaggaaacgctggttcgatcaatatcagcaatatcttgacagggaagtgccttgcaaaaataaaagcaaccaatggttctctcatggatgattgcagcagaagtgcgagttgtgggggcaaaatttgcaactcgaggaagcatgtccaagcttctagaataaggagcactgttacagatgctttggaagacatcactgctctcttctacgatgaagatcgcaacgagatatacactggcaatcggttcggccttgtccatgtatgggctaactgaagttgtttgttgtctcgtttccatatgcacaagtaaataccactgaatttgttcactagttcctccttccatggcatttttatgccttgtatccatcccacttgcatgttatacctttc

SEQ ID NO: 5861 - DNA, 1939 bp, Trigonella foenum-graecum
gagtcagattccgagttcagaaattttgaaacgggatcgacaccaattcattcatttgtggactcttttcgttccatttttcttcgttctctcgtaccttcgttcatgaaactcggtcacacagtaaaagtaccgtttcgtacaaaaccctaattctcgtttttcagatggggaagttgttgttactgtgaagtggtgaagaagaatatggaaggtagtagcgggagaagaatcacggtgagtcctagaccttgttgcggccgaagagtcagagtcgatgccaagaagaagaccggtcgtggtggtcgaacggtcgatggattcgttaacagcgttaagaagcttcagagacgtgaaattagctccaagcgtgatcgtgcttttagtatgaccgatgcgcaagagaggttccgcaatattcgcttgcaggaggaatatgatacgcatgacccaaaaggtccttcgtccgtggtattgccatttctgagaaaaagatcaaagattattgagattgtggcagcacaagacattgtttttgctctcgcacaatctggcgtttgtgcagcatttagccgagaaaccaatcaaagaatatgctttctgaatgtcagtcccgatgaagttataaggagtctattttataacaaaaataatgactcgcttatcacagtttctgtctatgcatcagacagttacagttccctgaaatgcagaagcacaaggattgaatacattaggaggggtaaaccggatgctggctttgctcttttttgaatccgagtctctgaagtggccaggtttcgttgagtttgatgatgtaaatgggaaggtactcacatactctgctcaggatagcatatacaaggtatttgacctgaaaaactatacgatgttgtactccatttctgacaaaaatgtccaggagattaagatcagtccggggatcatgttgttgatttttgctaaagcaagtagccatgtcccacttaaaatcctttcaatagaagatggtactgttttgaaatccttcaatcatctcctttatcggaataagaaagtggattttatcgaacagttcaacgaaaagctacttgtcaaacaagaaaatgaaaaccttcaaattctcgatgtgcggacttttgagctaacagaagttagcagaagtgaatttatgacaccttctgcattcatcttcctatatgagaaccaattattcctgacatttcgaaatcggacagtggctgtgtggaacttccgtggagagcttgtaacttcttttgaggaccacctcttgtggcatcctgactgcaatacaaacaacatatatataaccagtgaccaggatcttatcatatcctactgcaaagctgattctgatgattcattaactgagggaaatgcgggttcgatcaatgtcagcaacattttatctggcaagtgtcttgccaaaataagagcgagcaatagctctccagtggaagacaagtgcagttgctgtgacagttcttcaagtggaagttgtaattcaagaaagcgaaagcatgtctccaaaatgaggagcacagttgccgaagccttggaagatattactgctctcttctatgatgaagatcgcaatgaaatctatacgggaaataggcacggtctagttcacgtctggtctaactgatatattgtgttaactttactgttgccttgtgttttcttattggcttttcttaatgggtaaattgatcatcttgatttgttgtaagaagattggggagctttaaccccatgaagtgtttgtgtatcattcagtttttttttccttgtcatgtacgccatgtgggagtttgttctgtagttggtaacaaatctttatgaagtgctatgctggtaaatcaccagatgttgcttcatttgtaatctataattacattaatggagcggcttggat

SEQ ID NO: 5862 - DNA, 1487 bp, Trigonella foenum-graecum
tctgtttatgcttctgagaatttcagttctttgaaatgcagatctacaaggattgaatacataaggagggccaagccggatgccggttttcctcttttccagtccgagtctttaaaatggcctggatttgtggaatttgatgatgttaatgcaaaggtcctaacatactctgcgcaagatagtatatacaaggtgtttgatcttaaaaactacactatgctgtactcaatttcagataggaatgttcaagagatcaagatcagtcctggcatcatgttattaatatttaatagagcaagtggtcatattccgctgaagattatatccattgaggatggcacagttctcaaagcattcaatcatctacttcatcggaataagaaggtggacttcatagagcaattcaacgaaaaacttctagtcaagcaggaaaatgagaaccttcagattcttgatgttcgaagttctgaactgatggaggtaagcagaactgagttcatgacaccatcagcatttatctttctgtacgaaaatcagttattccttactttcagaaatcgaacagtttctgtttggaactttcgtggcgaacttgttacatcatttgaggatcacctgttatggcatccagagtgtaacacaaacaatatatacataacaagtgatcaggatctgattatctcttactgcaaggcagactctgaagatcaatggatggaagccaatgccggttccatcaatgtgagcaacatcttaacggggaaatgtgtggcaaaaattaatgctgcaaattgcatcgccaaggtggacgattgcagtaatacttgcagctgcaaacgcattgattcatctcaaataaagagctcagttgcagaggctttggaggacataactgctctcttttatgatgaagaccggaacgagatctatactggtaatagacatggttttgttcatgtatggtctaactaatgaagaacaaaaatgacttctgtgtttcttcgctggcttcatggaccaaggaaaagaaccctcatgctttgggtttgtacttttgctgatgtgtagtttctgcagtgaatcaatgtttctactgtctaaactgcctcagcattgtaagcattgtttgccatgagattgttatctagcatcctgcagttgtgtagccagttatagattgaatttgttcaggtaaaacttttatgcatgtgttcctttcactctaaggtcttagagggtttgactttgtagatagatagtttgcgtatattgaagtcacaaccaagtattgtgtcagatgagggacatattcttctattattacttttttcatgctggaattcttaggggactacgtgggatatggtggcaaagggggaaactacatgggtttatattcttcacttactatcattgatataactctcactatgaatgtgttattcatttttggttggttatagagatgttcttgtggtgttggcagt

SEQ ID NO: 5863 - DNA, 1576 bp, Tripterygium wilfordii
gcagaggcgcgagatttcctcgaagagagatcgagctttcactgtcagcaacgctcaggagagattccgcaacatgcgcttgacggttgaatatgacactcatgaccccaaggggcaatgttcagtggtacttccctttttggggaagcgaacgaaagttattgagattgtggctgcccgcgatattatatttgctcttgcgcattctggtgtttgtgcagcttttagtagagagacaaatgagcggatatgttttttgaatgtgagccctgatgaagtcatccggagcttgttttataataagaacaatgattcccttatcacagtctcagtttatgcttctgacaattttagctctttgaagtgcaggtccacaaggattgaatacataagaagaggcaagtcagatgcaggatttgctctttttgagtcagagtccttgaagtggcctggatttgtggaatttgatgatgttaatgggaaggtgctaacttactctgcacaagatagtatatacaaggtgtttgatctagaaaaactacaccatgctctactctatatctgataaaaacgtacaggaaatcaaaatcagtcctgggataatgctgttgattttcaatagagccagtagccatgttcctcttaagattctatcgatagaagatggcacagttctgaaagctttcaaccatctgcttcatcgcaacaagaaggtggacttcattgaacaatttaacgaaaagcttcttgttaagcaggaaaacgaggacctccagattcgtgatgttcgaacctctgagctgatggaagttagcagaaatgagtttatgactccttcagcatttatctttctatatgagaatcagttgtttctaacattcagaaatagaactgttgctgtttggaactttcgtggggagcttgtaacttcatttgaagatcacttattgtggcatccagactgcaacacaaacaacatttatataacaagtgatcaggatcttatcatttcttactgcagggctgaaactgactatcaatggggagaaggaaatgctgggtctatcaatatcagcaatatcttgactgggaaatgcctggctaaaataaatgtgacaaatgcaagtcccacagttgaagagtgcagcagcagtagtacaggcaattctaaaaagcggattatcacggccccaatgagcagcacagtatctgaggctttggaagacataactgctcttttctatgatgaagagcgcaatgagatatacaccggtaacagacatggtctggtgcacgtctggtcaaattgaggagaagatgttttgtcattctgatctttggtacacgcgggaagaacacggtggggtttcgtgcttcgtctaaccgggacagatagaggatggtccgttattctgccctactggctcgagtacaatttaaccttgggagcacagtatcatcattagatgagtttcaaaacctctgtcagattgtatcattagatttgttaaattgttgtgtagtaatagttcctgcatatgtatgctgcccgactaagaaccattgagggcaggta

SEQ ID NO: 5864 - DNA, 1960 bp, Vinca minor
caccgcaccgcaccgcaccgaatgtgctctcgcggagaggaggtagcttttcatagagctattcaaattcacttctccattcttcctatcctctctctagaaccctaatttccaatttggggattcctgagatttttccaatttgaacactctacatacatcgggtaaatcgaagagctccgaaatcctcctgcgagaaattgttcgtacccctgaaatctgtttgatgaaaaattgaaactcatagacccacagacacacacttgatatataagtgtgtgttttatggaattactgtagatttttctttttagggttttgttgtaaaacaataattgtttgtttgtaataaatagatttaggttttttttaattgaaatggacggtagacgaataacggcgagtccccggccttgctctgagaggcgtgtggcggcgaagaagcggcctcgcggtggtatggatggctttgtcaacagcgttaagaagctccaaagacgggagatttcttccaagcgtgatcgagctttcagcatgagtgacgcccaggagcggtttcgcaacatccgattgcaggaggaatatgatactcatgacccaaaggggaaaattaccatggtgctaccatttctccggaagcgatcaaagattattgaaatagttgctgcacgtgatatcgtctttgctcttgtgcaatctggaatctgcgcagcattcagcagagagactaacgagaggatatgctttctgaacacctgtcctgatgaagtcatagaagcttgttttacaataagaacaacgattcactcatcactgtttcagtttatgcttctgataatttcagctcgttgaaatgcagaaccacaagaattgagtatatacgaagaggaaagccagacgcaggtttccccctctttgaatcagagtcgctgaagtggcctggctttgtggagtttgatgacgtaaatggcaaggttcttacttattctgctcaagatagcatatacaaggtatttgacttgaagaattataccatgttgtactccatatctgataaaaatgtgcaagagatcaagatcagcccgggaattatgttgctgatatttaccaaagctagcggccatgttcctctgaagattttatcaatcgaggatgggactgttctcaaatctttcaaccatctccttcatcgtaacaaaaaagtggatttcattgaacagttcaacgagaagcttctcgttaagcaggacaatgagaatcttcagattcttgatgtccgtaattctgagttaacagaagtcagcagaactgagttcatgaccccatcggcattcatatttctgtatgagaaccagctatttttgacattcagaaaccgaacagtggctgtgtggaacttcaggggcgagcttgtgacttcatttgaggaccaccttctatggcattcagactgcaacacaaataacatttacatcacaagtgatcaggacttgattatctcctattgcaaagccgattctgaagatccattagcagaaggaaatgcgggttcgatcaatatcagcaatatactgtcaggaaagtgtctcaccaaaataaaagcaagcaacagtcttcccttggacaattgcacctgcaatgctaactgcggtgggaaaacttgcaacgcaaagaaacgagccaaagctactaatatgagaagcagtgttgctgaagccttggaagacatcactgcacttttttatgacgaagagcgcaatgagatttatactggaaacaggcttggtctggtccatgtgtggtctaactaaggtttgtggcagcatcctgttcttaacccccgcgctcctattatagttcataagggatgaaattcattctgcaactttcctttgtaagtggtatttttcattcccccctagttgtgttgtcatcaggctgtgtagctttccttcctgtt

SEQ ID NO: 5865 - DNA, 4949 bp, Malus domestica
ctaatcctaaaggccttgcaacggtaggagggtggtggcgaagaaacgacctcgtattgggggggttgatgggttcgtcaacagcgttaagaagctacagaggcgcgaaatcagctccaagcgcgaccgtgccttcactatgagcgatgcccaagagaggtttcgcaatatccgcctccaggaggaatatgatacgcatgatcctaagggtcattgtgccatggttctgcctttcctgcgaaagaggtccaaaattattgaaattgtagcagcacgtgacatcgtgtttgccctcgcacaatcaggtgtttgtgcagcatttagccgagaaaccaaccagagaatatgctttctgaatgtcagtcctgatgaagtgataagaagcttgttttataataaaaacaatgactcacttatcaccgtttcggtttatgcctcagacaacttcagttctttgaaatgcagaagcacaaggattgaatacataagaaggggtaaaccagatgctggatttgctctttttgaatccgagtcactgaaatggcctggttttgtagagtttgatgatgtaaatgggaaggttcttacttattctgcacaggatagtatatacaaggtgtttgatctgaaaaactacacaatgttgtactccatatcggataagaatgtccaagagattaagatcagccctgggatcatgctgttgatttttactaaagctagtagccatgttcctcttaagattctgtctatagaggatggtactgtccttaaatcctttaaccatctccttcatcggaataagaaggtggatttcatcgaacagttcaacgaaaagcttcttgtaaagcaagaaaatgagaaccttcaaattcttgatgttcgcaattttgagatgacagaagtaagcagaactcaattcatgacaccatcagccttcatatttctgtatgagaatcagttattcctgacgtttcggaatcgaaccgtggctgtttggaactttagaggagaacttgtgacttcgtttgaggatcatcttttgtggcatcccgactgcaataccaataacatatacattacgagtgaccaggatcttatcatttcttactgcaaggccgattctgacgatccattatctgaaggaaatgctggatccataaatatcagcaatatcttgaccggaaaatgccttgctaagataagagcaaccaacaacgctgaaaaagaatgcacttgtagtggtgagtcttgtggtagcagttgcaattcgaagaagcgggccctttcatcccgaattaggagtacagttgcagaagccttggaagacattaccgctctcttctacgacgaagagcgcaacgagatttacacgggcaataggctcggtctagttcacgtatggttgctctgcttcggttcagttgtaagcgcattgagaatggatgcgaaaattgatgccaatgcatccttggactacgctgaatttcagatttttccatcccagaacaggtatgaggcgcttgtttccagtgatggagaagtagaaaagttagcaggcgggacgctagagccactgttgccacatttaccagaagtaaatgaattgcatcggaagggaacgaatgccagcctgacacttcgacttcctaaaagcctgcatggtgcagcctggttcacgaagtcgactttcaccagattcctgcaaattactggttcaccagaaataatgcataccattactgctaccgaagaagaaatatctcaactggaagaagccagaaagtttcatgtttctttatatggccagcctgacgctataggaatttgtgctgtcaggaacgaacttttgcgggctttggacttgaggctcacagcactaaaaagggaattaactaccgctattgaaaaggcttctcattcctcgttcaactctaaagagatttcaaatttagcaaacttttctcaacattttggaacaacagatttcaggaacactctgttcaagattttagaacagtatcaacaaagcaagagtggtgatcctcaaaatgatgacaagtgcggcaattttggaattgcgaatgttgataagacagatggaagtgctcagatatcaaagcccatgaattttgatacgccagtaaaatatagtgtttcacctgcaaaagctgcccaggttgagcgacagagttcaaccgaaagcagggagtcatctgagtcaagtgatgaggagcaaacatctgcagaaagaagtcggagtctcatgagaagtgccacacctagaaggtcagcatctccaatgcggaggattcaaatagggagaactggatcacgcagagccgctgcattaaccattaaaagcctcaattactttccttctagggaaaagcctttttctgaagagggtgaacctgaacaatcaaataagaaatctgagagtaatgcactcaggatgagtgttcaagatgcaattagtcttttcgaaagcaaacaaagagatcaagctgctgcagatgctcaaaaaaggagctcgttaacaaatatctctacgagcacaaataaagctgtattaagaaggtggaattcaagtttgggggaagcttccacccaatgccaatctgaaattgtctctggagaccgtgttccaatgactcccaatgatataccaaatgatgagatgccaacatcttcagaagaagtgaaaccagagtctgatcttttacccacagatcaaagtactattgaagctcctaaacctgcagttaacgaaggaaattttgagaaaaaattatctagtccaattgataatgaagcagactctaatgtaactccgggagagaaaagtaatcaaaaatcaacagcatcaatggaatggactcgagaaagggaagcagaattgaaccgaatgctgatgaaaatgatggaaagtaagcctattaagcctgtgaagcctgttaagcctgtgaagcctgttaaatctacaaagcctcaagctaccagaaatcaaagccttccttctgaacagagaggtggcttttatgaccactacaaggagaagagagatgaaaaactacgaggtgagaattctagaaagcgagcagagaaagaagcacaattcaaagccatgcaacgaattcttgatgaaaggaaagctgaaatgtcctctacaaaggcgaatgatattgataaaaaaagtgctatgcagaagccccaaaaatcacttggaaaagtatctcaacctgcaaatcctagaaaggaaaatgcaaaaccttctgttacaaagaaggcttcacctagaacatcacccttgcctgctacacgcaagtcatggccatcgacaccaacaccgagagccacaggggcatcgccagctagaactccagttggggtctcttctaccagcactacccctacccgtcaaaaacccaagccaacaccacccagcactaaagtggaaagacccctgcagcgacagaggaatgtgaaggagtctgtgagtactaatgacaggagctcaaagggagtgaatgagaagcagcagcaagcagtgaaaaagagtggtaaaacaacaaaacccaaagtagtgacaacctctggtgattattctgatataattccagcaaagcacagcaaggtgaccaagaaaagcagtgtagttccagtggaatcaaaaccatttcttcggaagggttctcgaacgagccctggtgttggtcccgttgttaacaagataagaacttctcctcactcagaggaatctttgggaaacagcacaaatatgattgagactcaagaggatgaggtacttggtagtgcctctgatcctgtgagtcagcatcaagagccagatgttgtgtcagtcggcctttcaaatgatgctgtggaaccagaagctctggtaaatgatagcctgacatgtagtgagacacaacatgttgacccagtttcccctgatcgtaatgatcacttaaaaaatgttgcagaatcgtcattgcaagttcaagctgaagaagaatcaaccatctccccaagtgcttgggtggaaatagaggagcatcaggccatgtcccctggtaacaacggctcatctcaagtaactacttcagccaatgttgcaccagctggactgtcaagtcctcgtgtccgtcattctttgtcccagatgctgcaagaagaaattaacggaccagataatattgagtggggaaatgctgaaaatcctcctgccattgtgttccaaaaggatgccccaaaaggactgaagaggctcttaaagtttgctcggaagagcaagggagatggtaatttgactgattggtctagtccgccagttttctctgaaggagaggatgatgttgacagtgtactcagaaaggcttcgcttcatacaaggaactatgaaccatactctactcaatcaaatattagcagatttgacgatcagagttcttcacataagtcacaagagaaccgtgatgcagctgcaggacctgcaactaaagctgcaacaaggtcattcttctctctttcagcgtttagaggcagcaaaccaaatgaaatgaagtttcgctaatcctagaggcgcatgtggagtactggagtcagattctgcgaaactttcaatttttcgttcactgtcgttgtagcatactagcatgcatgatgcattcatccctatacttctggcatttcttttcacttcttttcttgtcgtagtactgtgttgccgggtctttgtacatgctatatgcccttgttctgttgttctcagagatttaaacagagctcttgttcttaaaccttatgtttcggatgtcaaagcgactacagatcgctacattggcatcaatacgaatgctttgcgtatattgtcatcaatacgaatggtttgtgacagaggatgtctgtttcccaaattctttacaaaattacatagacaaatgctg

SEQ ID NO: 5866 - DNA, 1049 bp, Malus domestica
aagatcagtcctgggatcatgctgttgatttttactaaagctagcagtcatgttcctcttaagattctgtctatagaggatggtactgttctcaaatcctttaaccatctccttcatcggaataagaaggtggatttcatcgaacagttcaacgagaagcttcttgtaaagcaagaaaatgagaaccttcaaattcttgatgttcgcaattttgagatgacagaagtaagcagaactcaattcatgaccccatcagccttcatatttctatatgagaatcagttattcttgacgtttcggaatcgaacagtggctgtttggaactttagaggagaacttgtgacttcatttgaggatcatcttttgtggcatcccgactgcaataccaataacatatatattactagtgatcaggatcttattatttcttactgcaaggctgattctgatgatccattgtctgaaggaaatgccggatccatcaatatcagcaatatcttgactggaaaatgccttgctaagataagagcaaccaacaacgctgaaaaagaatgcatttgtagtggtgaggcttgtggcagcagttgcaattcgaagaagcggtccctttcctcccgaattaggagtacagttgcagaagccttggaagacattactgccctcttctacgacgaagagcgcaacgagatctacacgggcaataggctcggtctagtcacgtatggtctaactaatagtttctccaagtttattctccatgtccattagattctttcttggtcatctagatgtttgatttgatctcgctgccccccaccgcaacaactcccttgaactgtaccattaattccctcttgtacccttaatccctttgttttaccttaaatccgatttctttcctcgtgtctgttgagcttgagaacttcttgtaccattagtctcttcgttttacctgaattccgatttctttcatggtggtgtaatataaatgtagaattgagtttgcctcggtcctttggacgctctttttatctaatttttgcctcgtg

SEQ ID NO: 5867 - DNA, 1887 bp, Artemisia annua
acagcgagtcctaggccgtgtaatgggcggagagtagtggcgaaaaagcgaaggaggggtggatgtggtgaggggtttttgaatagtgttaagaagttgcaaaggagggagatttgttctagacgcgataggtcgtttagtatgtgtgatgctcaagagcggtttaggaatattagattgcaggaggagtatgatacccatgatccaaagggacactgctctatggtattgccgtttcttaagaagaggtcgaaaattgttgagattgttgctgctcgcgatatagtttttgctcttgcacaatctggaatctgtgctgcatttagtcgagaaaccaaccagcgaatatgctttctgaatgttagccctgatgaagttataagaagcttgttttacaataagaacaatgattcactcattacggtttcggtctatgcatcagacagttttagttccttgaaatgtagaacgacagggatcgaatacatacggaggggtaagccagatgcaggttttgctctttttgagtccgagtctttgaagtggcctggttttgtggagtttgatgatgtgaatgggaaagtacttaccttctcagcacaagatagcatttacaaggtgtttgatttgaaaaactacatgatgttgtactccatatcagataaaaatgtacaagaaatcaaaattagccctggaatcatgttgttgatatttaataaagctagtggtcatgtcccattaaagattctctccattgaagatggaactgttctgaaaactttcaaccatctccttcatcgaaataagaaggtggattttattgagcagtttaatgaaaagcttcttgtcaagcaagagaatgaaaatcttcagattcttgatgtacgaaactctgagttaacagaagttagcagaacagaatttatgacaccatcagccttcatatttctatatgagaaccagctgttcttgacattcagaaacagaacagtggctgtttggaacttccgtggggagcttgtgacttcatttgaagatcatttactgtggcatccagactgcaacactaacaacatatatattacgagtgatcaggatcttataatatcttactgcaaagctgattctgatgagtctgaaactgaaggaaatgcagcaggttccatcaatataagcaatattctgacaggaaaatgccttgctaaagtaaaggcaatgaatggtgcaataatagatgactgtctttgcagtagcattaacaaagctagtgggtctagtagcaaaagatgcacgtgcaactcaaagcagcgaatccagggtagaaggatcacaagctctgtttcagaggccctggaagatatcactgctcttttctatgatgaagaacgtaatgagatctatactggtaataggcttggcttagtccatgtgtggtctaattagaggggtgttggtttggaagtatggggcttgattggggttgatacccgaaaaattgggaatcctccatatgcaaagggtttggttttagaaatacttgcgcggttctcattctcattttcccttgttagtaagctcaaactcgtaatttatttctgactgcaaaccgaacaccgcctaactgcatggttatctccttcgtttcccttttggctggctcggtcttacaaccagatggatgaattatccatggtctggctgcatgaggagcacttaatgtaccgttaatccttctttgaatagtcatgttgttttcttgcccttgtagttttcttgcccttgtcgtttatccattgaatgtatttttatctcctttgactcattttgagccgctgattgttactttcctgagtttttagtacacatacttctgtaaaacgcactcgt

SEQ ID NO: 5868 - DNA, 2492 bp, Ceratodon purpureus
gcaggctgagagtagcgaacttggagagcgagaggaggccgcagcagcagcagcccaggcacagagcaggctgagtcgaggcacagtcgaggcgagggtttgcgaggccacgctcccagggtttggtgggcgacggacgtgcaattgcgcaattgcgccggctgtgcagcggggcccgtgattcggacgctgggggggagtgctcggagcgcgggtgggaggggatggccatgggctgcgaggcgaggtgagggaggtgcgattgaggggttggggttggggacgacggagcggggccatgcgatggcggggtttggcgagcggagttgtgcgggcgaggaggtgtagggtttgcggaggggcggggtggagttcttgggagtgaggcgagcgggggcgatggtggtgagggatcggggcatgtagggcgaggttgtggggtcgggcaggcagttgggcgcggcgggcggtggtcggggaggagcggggatggagaaggcgaggatgcagagcagtccgaggccgacgtgcgggcggcgcatagtggcggggaagcgtccgcggccggacgactcgaagaactgcgtgcggaagctgctgaagcgggagattagccgcgcggggaactgggcgttcaaccggacgaactcgcaggagaagttccggaactttcatctgcaggaggaatttgatacacatgaccctaaggcacatcatttcttgaagctaccgtttctgaagaagaggtcgaggatagtggagattgtggctgcgcgggatacggtgttcgcactgacacattcaggaatatgtgctgcctttagccgagatacgaacaagaggatatgttttctgaacatcagcgccgacgaagtgattcggagccttttctacaacaagaacaacgactcgttaataacggtgtcggtttatgcgtctgataatttcagctctttgaagtgcaggacaacacccatcgagtacatccgtaggggtcagcctgacgcaggttttcctcttttcgagtcagaatcactgagatggcctggatttgtggagttcgacgatgtgaatgggaaggtcctgacgtactcagcacaagacagaatctacaaggtgttcgacttgaagaattatacaatgctgtattctatatctgacgagcacgtgcaagagattaaaatcagccccgggatcatgctcctgatcttcgacagggcacagagccacgtgcctctgaagattctctcgatagaggatggttcggtcctgaaggcgttcaaccatctgctacatcgtaacaagaaggtggacttcatcgagcagttcaacgagaagttgctggtgaagcaagagaatgagaatcttcagattcttgatgtgcggaactctcagctgacggaggtgagcaggacggagttcatgacaccgtcggcgttcatattcctgtacgagaatcagctattcctgacgttccggaacaggacggtggcggtgtggaacttcagaggggagctggtgacgtccttcgaggatcacttgctgtggtacccggactgcaacacgaacaacatatacatcaccagcgaacaggatctgatcatctcgtactgcaaagcgcacccagacaactccgcggaggaggttggttcgatcaacatcagcaacatcctgaccgggaaatgccttgcaaagatcagggcggatgacccgagcgtgggtatcagcccgcggacacgggcgaactcttcgaacatcagaagctcggtgcaggaagctctggaggatgtgacggctctgttttatgacgaggagaggaatgagatatatacagggaaccggcatggattggttcatgtgtggtccaactaggcgccaactgagatcagttgtagttgattatgtgtcactctctggacataacgtgggaatatggtgggctatgtaaggcaaggtaagggaggtgggacccctggcgtctgcgatgatcgttaggtggttgtgtgcctgtagacccagctgtgggggcctgttggcagttttgtagtcttggagtctaaccaacttgggttgttggatgcgatgaagttgggatgcgctttttgtgaaggcggaggttgatggtgttcaagtatttcaagaggctattttgctgtggagacaggctgcatgtgtgtattcggagtatggtgggcgcagaagagatggatggccgtggttgagagagttgttgtgtactaactggatgcaagcatttcgcaatccgttgctggctttgtatgagcggacaagagcctcggcctgtcaattggaaacgtcgtgtacaagaaatggaagagacaaatgaatagtgtaggctgaatcttttttgggaaagctgttgctttctggataaatttataagtgtatactctgtagatcaggtgaggttgatggactctttaatgtcgtcagtgtaatttataatccgaacgcctctaatcttaatcgcg

SEQ ID NO: 5869 - DNA, 1300 bp, Cryptomeria japonica
  misc_feature (1272)..(1272): n is a, c, g, or t
gatgcaggatttgctttgtttgagtccgagtcattgaaatggcctggatttgtggagttcgatgatgtcaatggaaaggtccttacctattctgctcaagatggaatctataaggtgtttgacttaaagaactatacaatgttgtattcaatatcagatgaacatgtccaagagataaagattagtccagggattatgttactgatattcgacagggctagtgggcatgttcctctcaaaatcttgtctatagaggatggtactgttttaaaagcattcaatcacctgttacatcgcaataaaaaagttgatttcattgagcagttcaatgagaagcttcttgtaaagcaagaaaatgagaaccttcaaatacttgatgttcgaaatgcacaattgactgaagtaagcagaacagagtttatgacaccgtcggctttcatttttctttatgagaatcagttattcttgacattccgcaatcgtacagttgctgtatggaatttcgaggagagctggttacatcatttgaagaccatttgttgtggcatccagattgtaacacaaataacatatatataactagtgatcaagatttgattatttcttactgcaaggcacatcctcattcttcagatgaagaagaaaatgttggttccataaatataagcaacatattaactgggaagtgtctcgccaagatccgtgccaatgatccaaacgttcaaattagtcctagaaatcgtccaaatgcatctgcaatcagaagtactgtacatgaagctcttgaagacatcactgcccttttttatgatgaggagcggaatgaaatatatacaggaaataggcatggtttggttcatgtatggtcaaattgaggtgcccacaaagcgtgcaaattatttacagcaatgggtgcttgattgtttaaggatccgtggtcgtaagttgatagcagatgtgaagtgttcgatgtaatccaaattatgcggatctgtggttgtaagttgatagcagatgtgaagtgttcgatgtgatccaaattatgctacatgcttacatttatcatatattggagtccctgaacgtcaagcatattctaaatagaatagggcttatagactgtggaagttcgattttttacgaacttgtaatggtgatgtctgttgtagaagaatttgtccctgtaaatctgtattttggagtacaacttgccgtttctactgtgtaattgttcccaaggtaattttacctatgttcaattagttttgtccncatgtaatgctcaattttttttggctgt

SEQ ID NO: 5870 - DNA, 1211 bp, Cycas rumphii
  misc_feature (310)..(310): n is a, c, g, or t
  misc_feature (703)..(703): n is a, c, g, or t
  misc_feature (705)..(705): n is a, c, g, or t
gttgatctgtcctgctgctgttgcttctgccatggcgcggtggaggagttacatttgatgctgtcgtttgctcatatgagtggtaaaggtcgaggaatttctttcagggaagaagaattatctggctgtcagtaaatggacggaagaagggtttccgtgagtcctcgaccttgtagtgggcgccgtgtcgtggccgggaaacggcagcgcgtggatgatttttccaactgtgtgaggaagcttcagagacgggagattgggaccagtgggaacagggcttttaatatcaccaatgcgcaggagaagtttnggaattttcagttgcaggaagagtttgatactcatgatccaaaagcacattggtttttgaagctgcaatttcttaagaaaagatcgaaaatcatagaaattgttgcagctcgtgatattgtatttgccctggcacaatctggtgtttgtgcagcatttagtagagaggcaaacaagaaaatatgcttcctgaacatcagcccagatgaagtgattcgcagtctcttttataataagaacaatgattcgcttattacagtgtctgtatatgcctcagataatttcagttcattaaaatgccgaacaacccctattgagtatatccgaaggggccaaccagatgcaggctttgctttatttgaatcagagtcattgaagtggcctggttttgtanantttgatgatgtcaatggaaaggttctcacctattctgctcaggatggcatctataaggtgtttgacttgaagaactatacaatgttgtattcaatatcagatgaacatgttcaagagataaagattagtccaggtataatgttacttatatttgacagggccagtggtcatgttcctctaaaaattttatctatagaggatggcactgttttgaaagcctttaatcacctgctgcatcgcaataaaaaggttgatttcattgagcagttcaatgagaagcttcttgtgaagcaagaaaatgagaacttgcaaatacttgacgtcaggaatacacaattgactgaagtaagcagaacagagtttatgactccatcagccttcatttttctctatgagaatcagttattcttgacattccgcaatcgaactgttgctgtatggaattttcgaggagagctggttacatcatttgaggaccacttgttgtggcatcctgattgtaacac

SEQ ID NO: 5871 - DNA, 2210 bp, Gnetum gnemon
gtttagagttggagcttcgtaattagggtttgagatcgcgattcccgagaaggattattggaggccaagggaggagatttcgttgtcgaagatttgaaacgacatgagatctgttgttgaaaggattgagtgaagtgatggagttgcagagttagggtttgaggttgaggaatggttgaggtgaggagaaagatgtggtgtacaacggcggagaagagccgttgttgaaggaggagtgagtgctgtttttgtgtattcatgcggcgggagctgcggagttagggtttgaaagcgagctttggaagtaatggagccgaggaaggtgtcgtcgagcccgcggccgagctctggaaggcgagttgtggcgggcaagcgccggcgtctcgattgttcgcagaactgcgtgcggaagctccagcgccgcgagatcggcaccgttggcaaccgcgccttcaattccaccaatgcgcaggagaagttccgaaattttcagcttcaagaagaatttgatacttatgatccaaaggcgagctggtttttaaaactgcaattcttaaagaagcgatccaagatcatagaaattgttgctgcacgcgatatcatatttgggttggcccagtccggtgtatgtgcagcatttagtcgagaggcaaacaagaaagtgtgctttttgaatataagcccagatgaagtgattcgaagcttgttctacaacaagaacaatgagtcgcttatcactgtatccgtttatgcttctgacaatttcagttctttaaaatgcagaacgaccccaattgagtacatcagaaggggcaaacctgatgcaggcttcgctttgtttgaatcagagtcattaaaatggccgggctttgtagagtttgatgatgtaaatgggaaagtactgacctattctgccgagcataagatttataaagtatttgatttgaaaaactacaatatgctgtactcaatatctgatgagcaggtgcaggagataaagataagtccaggaattatgttgctgatatttgagagaacggctagtcatgttcccttgaagatattatctatagaggatggtacggtgcttaagtcattcaatcatttgttgcatcgcaataagaagatagattttatagagcagtttaatgagaagcttcttgtgaagcaggaaaacgaaaatctccaaatacttgatgtcaggaatgcacaactgactgaagtgagccgaactgagtttatgacgccgtcggcttttatctttttatacgaaaatcaattatttttgacattcaagaatcgcactgttgctgtatggaattttcggggagagcttgttacatcttttgaagatcatttactgtggcatccagattgtaacactaacaatatatatattacaagtgatcaggatttgatcatttcttactgcaaggcacatccccaaggttcggatgaggaggaaaatgttgggtcgataaatattagcaacattttgactggaaaatgccttgcaaaaattcgcgcaaatgatcctaatgttcgcgtaagtccaagaaataggccaaatgcttcttttattagaagcactgtgcaagatgcactagaagacatcacagctctcttctatgatgaggagaggaatgagatctacactggtaatcggcatggcttaatacatgtatggtcaaactaaattacattgtaacatgtacatcctttcgtaatcattcaaaaaaggtttgaatgtgatattgagtgataatagcagcggggaacacgaataatgcaagctgattatcacttaaacctaggtctagagaaatatatgctctagtttcctagagttttgggaggtcatgtatttcaaatattcgatctttctagaatggcagcatagtaaattgcaatttcttatctttacagcgcgatcacagagggtacctaattgtaatattttttcattttttagtttcagctgcttgacgactctgatctgtgattattgcttttgtaactttgcatctccaggagtgcataaactattgagtggattacaagattgaaatatattttgatttgaattttatatggttctgacagattacgtttgtaattatggatctgaggcagttcttggaactcaactggtaaggacagacttatctaggcttttggaaacgtgcaatgaatgaggacagtgatttgtt

SEQ ID NO: 5872 - DNA, 416 bp, Ipomoea nil
aagagattaaaatcagtccaggaattatgctgttgatatttaccaaagctagtgcctatgttcccctaaagattctttctattgaggatgggactgttctcaaatcgttcaaccatctgcttcatcgtaataagaaggtcgacttcattgaacagttcaatgaaaagctacttgtcaagcaagaaaacgagaatcttcagattcttgacgtccgcaattctgaactgacggaagtcagtaggaccgagttcatgacaccatcggctttcatatttctgtacgagaaccagctattcttgacgttcagaaacagaacagttgccgtttggaacttccgtggggagctcgtaacttcatttgaggatcaccttttgtggcatccagactgcaatactaacaacatttacattactagt

SEQ ID NO: 5873 - DNA, 1408 bp, Actinidia deliciosa
  misc_feature (128)..(128): n is a, c, g, or t
  misc_feature (149)..(149): n is a, c, g, or t
  misc_feature (176)..(176): n is a, c, g, or t
  misc_feature (278)..(278): n is a, c, g, or t
  misc_feature (871)..(871): n is a, c, g, or t
  misc_feature (896)..(896): n is a, c, g, or t
  misc_feature (922)..(922): n is a, c, g, or t
cagaattcgcacgaggattcgaacttttttacaataaaaacaatgattctcttatcacagtctctgtttatgcttctgacaattttagttccttgaaatgcagaaccacaagaatcgagtacataagnaggggtaagccagatgcaggntttgctctttttgagtctgagtcactnaaatggcctggttttgtggagtttgatgatgtaaatgggaaggtactcacttattctgcacaagatagcatatacaaggtgtttgacttgaaaaactacacnatgttgtactcaatatcagacaaaaatgttcaagagattaagatcagtccaggcatcatgttgttgatttttaataaagctagtggccatgttcctcttaagattctttcaatagaggatggcacagttctcaaaactttcaaccatctccttcatcggaataagaaagtggatttcatagaacagttcaatgagaagcttctcgtcaagcaagaaaatgagaatctccagattcttgatgtccgcaattatgagctgagagaagtcagcaaagctgaatttatgactccatcagcatttatatttctctatgagaaccagttgttcctgacatttagaaacaggactgtggcagtttggaacttccgaggggaactagttacttcatttgaggatcaccttttgtggcatcctgactgcaacacgaacaatatatacatcacaagtgaccaggatcttataatttcttattgcagagctgattccgatgatctgtcaacagaaggaaatgcgggttctatcaacgtcagtaacatcttaactgggaaatgccttgccaaaatacgggcaaccaccagttctcccacggaagnatgcagttgtagtgggcgttgtggnggcagaagttgcaactccaagaagcngatccaagcttctgggattagaagcactgttgcagaagcccttgaagacatcaccgccctcttctacgatgaagaacgtaacgaaatctataccggcaataggcatggcctggtccatgtatggtctaactgaaggctgtatcttccctcgcggcccttgcagactataccattgatcttccagatgaattgtattcatcctgcttccagctgcaagaacaaactggaactgtaaaaagttcttttataagcatctctcttttatgctttacattcatctctcgtgtttctctctttattctttctagggacggatttttccccctttccatcaatgaattttttccttcccttttgttattaacgggtagggttctttgtaagttttgagttcttttaatgctctttcgtgttgtagatgtgctttataactcaagtctctcttgatgagctgcaggcaggtattttaaattaataactggttgc

SEQ ID NO: 5874 - DNA, 1948 bp, Medicago truncatula
gcaaaaagaagagagagagagatgaaaatttggtggtggtggaagtgatgacaatggacgaaagaaggcgtggagtttggtcttgtcggcgcatagtagcaaccaaaggtgaatcctcaaacaatggttccaaaccaaacatcaagatcaacaacaaaaacatcatcaagaagcttcaaactcgcgagatttctcctaaacctcatcgttcctttgttgctgctacttcaccacatagattccagaacatgcgtttgactcatcaatttgatactcatgatcctaaacatcattcttctccttcaccctttttgccttttttgatgaaaagaactaaggttgttgagatcgttgctgctaagaatattgtctttgctcttgctcattctggtctttgtgctgcttttagtagagaaacaaatgagaggatttgctttttgaatatctgccctgacgaagtcatccgcagcctcttctacaacaagaacaatgactcacttattacagtgtctgtttatgcttctgagaatttcagttctttgaagtgcagatcaacaaggattgaatacataaagagggccaagccggatgctggttttcctcttttccagtccgagtctttaaaatggcctggatttgtggaatttgatgatgttaatgcaaaggtcctaacatactctgcgcaggatagtatatacaaggtcttcgatcttaaaaactacactttgctatactcgatttcagataggaatgttcaagagatcaaaatcagtcctggcatcatgttattaatattcaatagagcaagtggtcatattccactgaaaattatatccattgaggatggcacagttctcaaagcattcaatcatctactccatcggaataagaaggtggacttcatagagcaattcaatgaaaagcttctagtcaagcaggaaaatgagaaccttcaaattcttgatgttcgaagttctgagctgatggaggtaagcagaaccgagttcatgactccttcagcatttatctttctgtacgaaaatcagttattccttactttcagaaatcgaacagtttctgtctggaactttcgtggcgaacttgtcacatcatttgaggatcacttgttatggcatccagactgcaacacaaacaacatatacataacaagtgatcaggacctgattatatcgtactgcaaagctgaatctgaagatcaatggatggaagccaatgccggttccatcaatgtgagcaacatcttgacagggaaatgtgtggcgaaaattaatgctgcaaattgcatctccaaggtggacgattgcagtagtacttgcagctgcaaacacacggattcatctcaattaaggagctcggttgcagaggctttggaagacataactgccctcttttatgatgaagaccggaacgagatctatactggtaatagacatggttttgttcatgtatggtccaactaatagagaaaaaaaaatggctttcgtgtttcttcactggcttcgtgaacgaaggaaaagaatcctcatgcttgggtttgtacttttgctgatgtgtaattactgcagtggatgattctactgccaaaactgcctcaggaccgggtctggatcctctccttccaccctctatgtctctctctctctcattgatttttcttgaaagagtggatattgactcgggattgtaggcgttatttgacatgtgattatacaactgcatttgtttagccagttatatagtgaattgttcaggtaaaactgttatgcatgtgtttctttcacttttatacaggtcttagagaatttgactttgtagatagtttgtgtacagtgaagtcactgccaagtattttgtgtcagatgagagacatccattattacttacttcatcctggaattcttaggggactttggctgtgtttggtaac

SEQ ID NO: 5875 - DNA, 1993 bp, Arachis hypogaea
aattgaattgaattgaagttgtggatttgagaccgaagagagagagagagaatggaaggaagaagaatatcagcaagatatagcagcagaagaatagttgcaagcaaaggtggaagaagaagaagagcttccagcaatggcagtgttaaccataacagcatcgtcaagacgctccaatcccgcgagatttgtcccaagccccaccgtgcattcgcaacaaccactgcacaccagagattcagcaccatgcgcttggttcaagagtatgacactcatgatcgtaaaccttcttctaccaattcttcttcttcttcttctccttcttccattttgcccttcttcatgaaaagaagcaagcttgttgagatcgttgctgctaagaacttggtctttgcgctttgccattctggtctttgtgctgcttttagtagagatacaaatgaaagggtttgctttttgaacgtgtcccctgatgaagtaattcgaagtctcttctataataagaacaatgactcacttattacagtgtccgtttatgcttccgaaaacttcagctccttaaaatgcagatccactgggattgaatacatacgaaggggtaggccagacgatgggtttcctctctttgagtccgagtccttgaaatggcccggttttgtagagtttgacgatgttaacggaaaggtcctaacttactctgcacaggatagtgtatacaaggtctttgatcttaaaaactatacattgttatactccatctcagataggcatgttcaagaaatcaagatcagccctggtatcatgttattaattttcaatagatccagcggccatattccccttcagattctgtccatcgaagatggcacagtcctcaaatcattcaatcacctacttcatcggaataaaaaggtggatttcatagagcaattcaatgaaaagcttctggtcaagcaagaaaatgagaaccttcagattcttgacgttcgaaatgctgaactgacagagataagcagaactgagttcatgactccatcagcatttatcttcctatatgagaatcaactgttccttactttcagaaaccgaacagtttctgtgtggaactttcgcggagaacttgttacgtcatttgaggatcacctgttatggcatcctgattgcaatacaaataacatatacataacaagtgatcaagatctgatcatatcttattgcagggctgattccgatgttcaatggttggaaggaaatgctgctggctccattaatgtcagcaatatcttgaccgggaaatgtctcgctaaaattaatgcgtcgaatagcagcaccaaatcagatgagtgcagtggaactggttgcagttgtcggcgcaatcattcatctcaaataaggagcactgtggcggaggctttggaggacataactgccctctttttcgatgaagatcgaaatgagatatataccggtaacagacatggtctcatccatgtatggtctaactaaatacaatattttcatgttttctatgtgccgtacagatcaaggaactccatgttccgctttttgtgcttgagctgtgatttgatagctgggaacacagaaagacaaaatttatgtaggaaaattgtacctatctccaacttcaagcacatttttgtgtctctttatctctgtacctctgtccagtcctagctaccgagctcaacgtttatgatgggattgttacaggcaatgtaccatttgttcatgtgttgttaagtagcaataggtgatatgcataggaccagttggagtgaattagttacttgagtaacaaaaaaaaatgatgcatattatatattttttactttgatttaggttcaaagggttttgggtgtatagtgcaatgaatattttaggtttatgagacagatgagaaatagtactcgtattataatgatttcttggaattcaaaggtggtaactgtgtgtgttgaaaaggcacattaca

SEQ ID NO: 5876 - DNA, 863 bp, Capsicum annuum
caaaaatgttcaagagataaaaatcagtccaggaatcatgctcctaatatttaccaaagctagcggctatgttcctttaaagattctctctatcgaggatggtactgttctcaaatctttcaaccatctgcttcaccggaataagaaggtagatttcattgaacagttcaatgaaaagcttcttgtcaaacaggagagcgaaaatcttcagattcttgatgtccgcaattctgagttgacagaagtcagcagagccgaattcatgaccccatcagcattcatatttctgtatgagaatcagttattcttgacgttcagaaatagaacagtagctgtttggaacttccgtggggagctggtgacttcatttgaggatcacctattatggcaccctgactgcaatacaaacaacatttatattactagtgatcaggaccttattatttcatattgcaaagctgatcctgatgatcccttatcagaagcaactgcgggatcgatcaatatcagcaacattttaacaggcaaatgccttgctaagataaaggcaaccgacagccgtcccacggatgattgcagttgcagtaccagttgcaaggagcatggtggcagaagttgcaacgctaagaagcgtatccaagcttccagaattaggagcacagttgcagaagccctggaagatatcactgcccttttctacgatgaagagcacaatgagatctatactggaaacagtcttgggctgatccacgtgtggtctaactgaaggttgactaatcccgcgttctttgaatatgtcgagggaacacaaacatgacacaagaagaatcttactattagaatgccatctctctctctctctc

SEQ ID NO: 5877 - DNA, 2459 bp, Physcomitrella patens
gtcgggagagcccgtagcgcaataagcaggggcttcgctggccgagggtttcctgaggatcttcctccaccactctcacgaattcgtcatttgtttcccaaggtctacgcgattctgttggaagagtagtcctaagtgttagagaggtttgttgcgctcccgctgaatcgttttggctgccttttgggtgatggagagagttgttggtctgtggtgggttgcgggtggttcttcgtggtcttgcgttgaagcgagacgttgcaagggaatttatagaattgtggaggagtagaagcgtttgaagtgagtttctaagagtgagtggaggaagaacaagcactagggaaatggttgggaaggactagggcaggtagggtaaggttgttgtggagggcggttcggtagtggtgggcggtggcgtggagtgtgaggaatggaatcggtaagtaaggtgaggatgcagagcagccccaggccaacgtacggacggcggattgtggccaggaagcggactcgacctgatgataccaagaactgtgtccgcaagctgttgaagcgggagataagtcgtgcagggaactgggcttttaaccggacaaattcccaggagaagtttcggaactttcatttgcaggaagaatttgatactcatgaccctaaggctcatcattttttgaagctaccgttcctgaagaagagatcaaggatagtagagattgtggccgctcgagatactgtgttcgcgttaacgcactccgggatctgtgctgcctttagtagagatacaaacaagaggatatgctttctcaatatcagggatgatgaagtgattcgaagcctattttacaacaagaataacgactcattgatcactgtgtctgtttatgcctctgacaacttcagttctttgaagtgcaggacaacacctattgagtacatccggaggggacagcctgatgctggatttcctttgttcgaatcagaatcgctcaggtggcccgggtttgttgagtttgatgatgttaatgggaaggtccttacatactctgctcaagacagaatctacaaggtgttcgatttgaagaactatacaatgctgtattctatttctgacgagcatgtgcaagaaatcaaaataagccctggaattatgttattgatttttgacagggcacaaagtcatgtgccactgaagatactttcgatagaggatgggtcggttctcaaggccttcaatcatctgctacatcgaaacaagaaagttgacttcatcgaacagttcaatgaaaagctgcttgtcaagcaagaaaatgagaatcttcagattcttgatgtaaggaattctcaactcacagaagtcagccggacagaattcatgacaccctcggcatttatttttctgtacgagaatcagttatttctcactttccgcaacaggactgtagcagtgtggaattttagaggagagctggtgacctcatttgaagatcacttgctgtggtatccggattgcaacacaaacaacatatacataaccagtgaacaagatcttatcatctcttactgcaaagctcatccagataactctgtcgaggaagttggttccatcaacatcagcaacatcttgactgggaagtgtcttgcaaagattagggcagatgatccaagtgtcaggatcagcccccgtgcacgtgcaaattcttcaaacataagaagttcagtgcaggaagctcttgaggatgttactgccctattttatgatgaagaaagaaatgagatatatactgggaatcgacatggattggttcatgtttggtcgaattaggtgcattgggtgacttgtagttcagcatcttttacttctgttggatagagtcttggaaatcttctcgccattctttggccaagatcaagtcaggctgaggctatcatctccatgctctgtgtcgtgcgtagagaatcagaatatcagctgttgacatcaataccagcagtcccgtaatctccctccgctgggtatatgtgacgttaaaaatcatggttcgcacttctgaaggcagtggcagctacggcgattgtattcaagtctcacttcaggacttttctcttggctgtgaagacgggctgtgattttgcattctggcactcatggaatttcaaaaggagggaaagcaagatcttcagagtagatgtatcagaatctcgattgatacgtcctctctgcatttgatttccagctttgtaacaatcccctcaaatagccgcttaccagtaccgaatttcatgtacaagaatgaacttaatgaattgttagtgtaggttatcctctataagaaagctcttgctttctagataaatttataagtgcacactctgtagatcaatcaggtttcaaggaacattgaatgtggtcactgtaatttttaatttgaaggcctctcaattataatttcatcctg

SEQ ID NO: 5878 - DNA, 907 bp, Cajanus cajan
agccgagagagtaataaacggatatgctttttgaatgtcagtcctggtgaagttataagaagtctgttttataacaaaaacaatgactcacttatcacagtttctgtatatgcttcagacggttacagttctttgaaatgcagaagcacaaggatcgaatacataaggaggggtaaaccagatgctggctttgctctttttgaatccgaatctctgaagtggccgggttttgtagagtttgatgatgtaaatgggaaggttttaacgtactcagctcaagacagcatatacaaggtatttgacctgaaaaactataccatgctgtactctatttcggataaaaatgtccaagagattaagatcagtccgggaatcatgttgttgatattctctaaggcaagtagccatgttccgctcaaaatcctttcaatagaagatggtaccgtcttgaagtctttcaaccatctcctttataggaacaagaaggtagattttattgaacaattcaatgaaaagctacttgtcaagcaagaaaacgagaaccttcaaattcttgacgtgcggacttttgagctaacagaagttagcagaagtgagtttatgacaccgtctgcatttatttttctatatgagaatcaattattcctgacatttcgaaatcgcactgtggctgtgtggaacttccgtggagagctggtaacttcctttgaggatcaccttctgtggcatcctgactgcaacacaaacaatatatatataaccagtgatcaggatcttatcatatcctactgtaaagctgattctgatgattcattggctgaaggaaatgcaggttccatcaacgtcagcaacattttaactggaaagtgtcttgccaaaataagagcaagcaacagctttccagtgg

SEQ ID NO: 5879 - DNA, 2128 bp, Pseudotsuga menziesii
agaaacccatttacccgtttctctatgatgcgcaatttccccaaaccttccacgcggtggctacgctgttgttttcttcagcggcatggactcggcaagggtctctgaggggtcttgtgatgtcatctggaatttataacgcagctcgggtggttttgaaatgcaaacgcagtacctagggttcgatctgtccaatattctctgctgcgatggtgcgaagcgtatgccttttttgacgctgttgtttgctgcgatggtgcgaagcagatgccttttttgacgctgttgcttgcggcgaaggaagaataggtgtattcggcatccttgaatatggaggggagaagggttgccgtgagccctcgaccttgcagtggccggcgcgtcgtggccgcaaaacggcaacgggtggacgcttcagctaataactgcgtacgtaagcttcagaggcgggagatcggcaccagtggcaacagggctttcaatatcactaattcccaggagaagtttcgaaattttcagttgcaggaggaattcgacacttatgatcccaaggcacattggtttttgaagctgcagttccttaagaagaggtcgaaaattatagaaattgttgcagcacgtgatattgtttttgctttgtcccaatctggtgtttgtgcagcttttagcagggaggccaacaagaaaatatgctacctgaatataagcccagatgaagtgatacgcagcctcttttacaataagaataatgattctcttatcacagtgtcagtatatgcctcagacaatttcagttcactgaaatgcagaacaacacccattgagtatattcggaggggtcaaccagatgcaggttttgccttattcgagtccgagtcattgaaatggcctggttttgtagagtttgatgatgtgaatggaaaagttctcacctactctgcccaggatggcatctataaggtgttcgacttaaagaactacacattgttgtattcaatatcagatgaacatgttcaagagataaagatcagcccagggataatgttactaatatttgaaagggccagtgggcatgttcctttaaaaatcctatctatagaggatggcactgttttaaaagcatttaatcacttattgcatcgcaataaaaaggttgactttattgagcagttcaatgagaaacttcttgtaaaacaagaaaatgagaacctacaaatacttgatgttcggaatgcgcaatcgactgaagtaagtagggcagagttcctgaccccatcagcatttatttttctgtatgagaatcagttattcttgacattccgcaatcgtacagttgctgtatggaatttcagaggagagctggttacctcatttgaggaccacttgttatggcatcctgattgcaatacaaataacatttatattactagtgatcaagatttgattatttcttactgcaaggcacttcctctttcttctggctcagaagaaaatgttggttctataaatataagcaacatattaactggaaagtgcctggctaagattcgtgccaatgatccaaatgttcagattagtcctagaaatcgtccaaacgcctctacaatcagaagtactgtagaagaagcacttgaagacatcactgccttattctacgatgaagagaggaatgaaatatatactggcaactggcatggcttggttcatgtctggtcaaactgattaatggctgtaacttgtgcatatccagtcaatcatacactgcgtttgatgtcaaattctcaatcacttggtggtaacctgaaagcaatgttgctaattcttcaaagtgtccggattatgctccttgatagcattgagcattgatatgaaagttttgtgttatttgatagcagtgatatagaaaggagctcatggcaccagaattctagttgagagttttgtttacaggtacaatcaacaagtgtgtttgattggttactggttaggttgtcttagaatgtgactctgagcaatgcacaaattgcagaaaattgcaattgatgcagtagatagtttagtcttctgtaaatctgtattctgaattgtaattgacctgtattacatgcaagggtctttaatttaatat

SEQ ID NO: 5880 - DNA, 1373 bp, Rhizophora mangle
ggaaaggtcctaacttactctgcacaagacagtatctacaaggtttttgaccttaagaactatacaatgctctactctatatcagataagcatgtacaagaaatcaagatcagtccgggcatcatgctgttgatcttcaacagagccagcagccatgttcatcttaaaattttatccatagaagatggcacagttctgaaagcattcaaccatttacttcatcgtaacaaaaaggtggacttcattgagcaatttaatgaaaagcttcttgtcaagcaggagaatgagaatcttcagattcttgatgttcgaaatgcgttgctgatggaagtcagcaaaactgagttcgtgactccttcagcatttatttttctatatgaaaaccagttgtttcttacattcagaaatagaactgttgctgtatggaacttccgtggagagcttgtaacttcatttgaggatcacttactgtggcatcctgactgcaatacaaataacatatatataacaagtgatcaggatcttataatatcttactgcaaggccgaatctgatgaccagtggatggaagcaagtgctggatccatcaatgtaagcaatattttgacaggaaaatgtttggctaagataaatgcatccaacgacagtcacaagggtggtgaatgcagcagcagttctggcaattcaaaggagagtcattctacaataagaagtacagttgcagaggctttggaagacataactgccctcttctatgatgaagagcgcaatgagatttacactggtaataggcatggtttggttcatgtatggtctaactagggagcaaggggcattaagtttgaaatccacaacagtggagacatcaagtagcccatcacgcattatggtactgaggattgggtgactttgggtgaattggattagtaccttgcttcaaagtgaattgtaccattatcctaggtcgtgtatcaagttgtagatttacgttccaggtatgtaagatgccttgattaagatgcctagaagtgaggcaactttattaaatcagtgagagttaaaagagacataacatataatgtattgttgatttgtattctttcttctgtttagctaaactaatagtgagtttgcttattttgagctctgccatgtgtagatgggtaaagttgacttcgggcaaggaactttttgtaggtatcaaatgttcagaaacattgttggctatggtctatgggtgatgtaaatggcacggaacaactgaactccgctgacaatagaaacttattgtgcatgcctgtatagttggatgaaaggagatgcgtcggttgggagctggccattatcttaaacatttgaactcattttataag

SEQ ID NO: 5881 - DNA, 1719 bp, Selaginella moellendorffii
agggcagggtaatagtgcgcgttgcgccttctttctcctcggttcttcgattctccggcgctagcgctctggggggacgattcctttgcgcgatgacaatgcagggctgaaggcgctactcctgccgctggcgctcgaggtctcgccgcgagggtttggtgctttggttagggattgtggggaggcatggattccaagaagctgcaagtgagccccagaccctcgtccggccggcgcatccaagcgggcaagcggccacgccctgacgattactgcggcaacagtgtccgaaagctcatgaggcgagagatcagccgcgcgggcaactgggcgttcaatcggacaagctcccaggagaagtttcgaaacttccagctccaggaagagtttgatacccacgatcccaaagcgcacagatgcttgaaacttccattcttaaagaagaggtccaagatcgtggagatcgttgctgcccgtgacatcgtttttgctttggcgcattcgggcatttgtgctgctttcagcagagaaacaaataagaagatctgttttctcaatatcagctccgacgaagtcatcagaagccttttctataacaaaaacaacgactcgctcatcactgtttcagtatacgcatctgacaatttcagctcactaaaatgcaggacaacacccatcgaatatattagaagaggacagcctgacgctggatttcctttgttcgaaacagaatcattgcgttggcccggcttcgtggagttcgacgacgtgaacggaaaggtgctaacgtattccgcacaggatcggatttacaaagtttttgatctcaaaaactacaccatgctgtactctatatctgacgagcatgtccaagagattaagataagtcctggcattatgctgctcatatttgacagagcggcgagccatgttcctcttaaaatcttgtccatcgaagatggttccgtcctaaaggcgtttaaccatctcctccaccgcaacaagaagctcgacttcatcgagcaatttaacgagaagctgctagtgaaacaggagaacgagaacctccaaatccttgacgtacggaacgcccaactgacggaagtgagcaggaccgaatttatgacaccgtcggccttcatctttctgtacgagaaccagttgttcctcacgtttcgcaaccgcactgtcgccgtgtggaacttccgcggcgagctggtcacttccttcgaggaccacctcttgtggtacccggactgcaacacaaacaacatctacatcaccagcgagcaggacctcatcatctcctactgcaaggcccagggatgcgacgaagagacaggctcgatcaacatcagcaatatcctgaccgggaagtgcctggcaaagatccgcgccgacgatcccagcgtcaaagtgagcccgcggtgtcacgcaaactcgtccaacatccgaggctcggtccgtgaggcactcgaggacgtgacggcgttgttctacgacgaggagaggaacgagatttacactggtaacaggcaggggcttgtccacgtttggtccaactgatagatctacgagagagagagcgggcgttcttttgtccgtgctagaagatcctcatcgctccttggttcgtaactccttttttaaatgcgttcttctggtctcacggcaggcgatatttatctctctcgtggcaaagtttcttatgtctctttc

SEQ ID NO: 5882 - DNA, 1721 bp, Selaginella moellendorffii
ggcagggtaatagtgcgcgttgcgccttctttctcctcggttcttcgattctccggcgctagcgctctggggggacgattcctttgcgcgatgacaatgcagggctgaaggcgctactcctgccgctggcgctcgaggtctcgccgcgagggtttggtgctttggttagggattgtggggaggcatggattccaagaagctgcaagtgagccccagaccctcgtccggccggcgcatccaagcgggcaagcgaccacgtcctgacgattactgcggcaacagtgtccgaaagctcatgaggcgagagatcagccgcgcgggcaactgggcgttcaatcggacaagctcccaggagaagtttcgaaacttccagctccaggaagagtttgatacccacgatcccaaagcgcacagatgcttgaaacttccattcttaaagaagaggtccaagatcgtggagatcgttgctgcccgtgacatcgtttttgctttggcgcattcgggcatttgtgctgctttcagcagagaaacaaataagaagatctgttttctcaatatcagctccgacgaagtcatcagaagccttttctataacaaaaacaacgactcgctcatcactgtttcagtatacgcatctgacaatttcagctcactaaaatgcaggacaacacccatcgagtatattagaagaggacagcctgacgctggatttcctttgttcgaaacagaatcattgcgttggcccggcttcgtggagttcgacgacgtgaacggaaaggtgctaacgtattccgcacaggatcggatttacaaagtttttgatctcaaaaactacaccatgctgtactctatatctgacgagcatgtccaagagattaagataagtcctggcattatgctgctcatatttgacagagcggcgagccatgttcctcttaaaatcttgtccatcgaagatggttccgttctaaaggcgtttaaccatctcctccaccgcaacaagaagctcgacttcatcgagcaatttaacgagaagctgctagtgaaacaggagaacgagaacctccaaatccttgacgtacgaaacgcccaactgacggaagtgagcaggaccgaatttatgacaccgtcggccttcatctttctgtacgagaaccagttgttcctcacgtttcgcaaccgcactgtcgccgtgtggaacttccgcggcgagctggtcacttccttcgaggaccacctcttgtggtacccggactgtaacacaaacaacatctacatcaccagcgagcaggacctcatcatctcctactgcaaggcccagggatgcgacgaagagacaggctcgatcaacatcagcaatatcctgaccgggaagtgcctggcaaagatccgagccgacgatcccagcgtcaaagtgagcccgcggtgtcacgcaaactcgtccaacatccgaggctcggtccgtgaggcactcgaggacgtgacggcgttgttctacgacgaggagaggaacgagatttacactggtaacaggcaggggcttgtccacgtttggtccaactgatagatctcagagagagagcgagcgttcttttgtccgtgctagaagatcctcatcgctccttggttcgtaacttctcttttaatgcgttcttctggtctcacggcaggcgatatttatctctctcgtaagagcaggcaaagtttcttatgtctcattc

SEQ ID NO: 5883 - DNA, 2164 bp, Helianthus annuus
gtttcgatctttctctctcttgccctttttgtagagagagaaacacaagttttttgctgttttggctacatacctgccatataaacagatttagggcacatattattcaaatcaccgaatatcttcaaattcttctgcatcaattgcttctatttgtgcagattcttcttcagcatcatgaacaagctaaaagccctaattatttgttcgagatttagggtttttttgcacctctttttcaaattgctgtaattgtgttgtaaatttgcaattgagtgttgaatgtgctggattcaagcacaggaagacaggatatgtatacaaattaggtttctagggttttgatttgtgtaattgcggtgttagaaagggaaacgatggacggacggaggataacggcgagtccacgtgtctccactggccggagagtggtggcgaagaagcggccgcgtggcggagctgatgcgtttttgaatagtgttaagaagcttcagaggagagagatttgttcgaagcgagatcggtcttttagtatgtgtgatgctcaagagagattcagaaacatacgtttgcaggaagagtatgatacccatgatccaaagggacaatgctctacggtattgccgtttctcaagaaaaggtcaaaaattgttgagattgttgctgctcgtgatatagtttttgctcttgcacaatctggaatctgtgcagcatatagccgagagactagccagaggatatgctttctgaatgtcagccctgacgaagttattagaagcttgttttacaacaaaaacaatgattcactcattacggtttcagtctatgcctcagacagctttagctccttgaaatgtagaaccactggaatcgaatacatacgaagaggtaagccagatgcaggttttgctctttttgagtcggagtctttgaaatggcccggttttgtggagtttgatgatgttaatggcaaagtacttacgttctcagcacaagatagcatctacaaggtgttcgatttgaaaaattacatgatgttatactccatatcggataaaaatgtccaagagatcaaaataagccctggaatcatgttgttgatatttaataaagctagtggtcatgtccctctcaagattctctccattgaagacggaactgttttgaaaactttcaatcatctccttcaccgtaataagaaggtcgatttcatcgaacagtttaatgaaaagcttcttgtaaagcaagagaatgagaatcttcagattctcgatgtacgcaattctgaattaacggaagttagcaggacagaatttatgaccccatcagccttcatatttctctatgagaaccagttgttcttgaccttcagaaaccgaacagtggctgtctggaacttccgtggggagcttgtgacgtcattcgaagatcatttgttatggcacccagactgcaacactaacaacatctatatcacaagtgatcaagatcttatcatttcttactgcaaagctgattcggaggattcttcaaccgatggaaatgcagcggcaggttccatcaatatcagcaatattctaaccggaaaatgtcttgctaaagtaaaggcgatggatggtgcaatggttaatgattgtatttgcagtgacgttgtcaaatctagtggtaaaagatgcaggtgcaactcaaagcagcgggcccaaggtcggaggatcacaagctctgtttcggaagcattggaggacatcaccgcccttttttatgatgaagagcgtaacgagatttatactggtaacaggctcggtttggtccatgtctggtccaactaagggggtgtctggtttgagagtatgagtttgatgcccgtaacatcgggaatcttttatatataccctttgtgttaacctctcatacccatatagattcctgattttaaaccaaaccaaaccgaaccaaatcaaacaccacctaagtgttgagttgtctgtcttctttcccttttggtatgctcggtccgtcataattgagatggatgaattgtcgtatggtttgttgcgtgtgcatcaagtagtgtatcatgaagttgtcttttgagcagttgaagttgttttcattgttttgtaggttatttatgaaagttatttttaactcttttgactcattg

SEQ ID NO: 5884 - DNA, 2067 bp, Ambrosia trifida
atccttcttcctcttctccatttcattctttctctctctaaccccttttctagagagagaaacacaaattttactcaaataaattcaaactctcgtacatcaattgttattattatattattatttctccatatatttcctcagaacctcaaacaaattaaaagccctaataatatgttccaggatcttaacctttattagggtttcttttacatcaattgtgttgtaattattattaattaagtatatgagtatatgtaagttgttgtgttagggttttgatttgtgtgactgtgttgtaagtaaaagatggatggaaggaggataacggcgagtccacgtgtatctagtgggaggagagtggtggcgaagaagaggccacgtggcagtggggatgggtttttgaatagtgttaagaagcttcagaggagagagatttgttcgaagagggatcggtcttttagtatgtgtgatgctcaagagaggtttagaaatattcgtttgcaggaagagtatgatacccatgacccaaagggcaatgctctacagtattgccatttctcaagaaaaggtcaaaaatagttgagattgttgctgctcgtgatattgtctttgctcttgcacaatctggaatctgtgcggcgtatagccgagagactagccagaggatctgttttttgaatgtcagtcctgatgaagttattagaagcttgttttacaataagaacaatgattcactcattacggtttcagtctatgcctcggacagttttagctccttgaaatgtagaaccactggaattgaatacatacgaagaggtaaaccagatgcagggtttgctctttttgagtcggagtctttgaaatggcctggttttgtggagtttgatgatgttaatggcaaagtacttacattttcagcacaagacaacatctacaaggtatttgatttaaaaaattacatgatgttatactccatatcagataaaaatgtccaagagatcaaaataagccctggaatcatgttgttgatatttaacaaagctagtggtcatgtccctctcaagattctctccattgaagatggaactgttttgaaaaccttcaatcatctccttcaccgaaacaagaaggtcgatttcattgaacagtttaatgaaaagcttcttgtcaagcaagataatgagaatcttcagattcttgatgtacgcaattctgaattaacagaggttagcaggacagaatttatgacaccgtcagcctttatatttctctacgagaaccagttgttcttgaccttcagaaaccgaacagtggctgtatggaacttccgtggggagcttgtgacatcatttgaagatcatttgttatggcacccagactgcaacactaacaacatttatattacaagtgatcaagatcttatcatttcttactgcaaagccgattcagatgattctacaagcgatggaaatgcaggagcaggttccatcaatatcagcaatattctaacaggaaaatgtcttgctaaagtaaaggcgatgaatggtgcaacagtcgatgattgtatttgcagtgaaatagtcaaatctagtggtaaaagatgcaggtgcaactcaaagcagcgggcccagggtcggaggatcacgagctctgtttcagaagcactggaggacataactgcccttttctatgatgaagagcgtaacgagatctatactggtaacaggctcggtttggttcatgtctggtctaactaagggggtgtctggtttgagagcatgggtttgatacccgtaacatcgggaatcttatatataccctttgtatcaacctcaagccccgtattgattcctgattgtaaaccaaaccgaaccgaaccaaacaccacctaagtgttgagttgtctgtcttctttcccttttggtatgattggtccgtcataattgagatggatgaattgtccaatgcctttgttgcgtgtgcatcgagtaatgtatcatcaagctgtcctttgggcagttgaagttgtttttatccttttgtaggtgttatttatggaagtta

SEQ ID NO: 5885 - DNA, 1331 bp, Ambrosia trifida
tatcgctagtaataattctggtagttatgatgttgtgagagtatacgcaacttaacttctattccgggggttcaaaactttacttcattttcagtcattcataccttcagattcaaatcaaaacaaaaccaaaccaaaccctagtttaatttatactgtaattctatcatcatcatcatcatccagttacttactactaatagtcagttacggaatgtttaccttgtgaatgtacggcaatggaaggttccagtagtagcagcagaaggaggagagtccttgctacgaagaagcgtgactggaccaactgcctctcccttaacaacagccttaaacggattcacagacgtgagatttcttccaaacgacaccgttctgtttcactcaccaattctcttcatcgatttaagaacatccgcttaacggagcaatatgatactcacgatcctaagggacaatcgtcatttgtattaccatttttgatgaaaagggcaaaagtcattgaaatagtggcagcacatggtatagtatttgctcttgcaagttctggtgtttgtgcagcttttagtagagatacaaacacgaggatatgtttgttgaatatatttccagatgaagtcatccgtagcttgttttacaacaaaaataacgactcattaattacagtttctgtatacgcttctgacaatttcagttcactcaaatgcagatcaacaagaatagaatacatacaaagaggccaaccagatgctggttttcctttgtttgaatcagagtctctgaaatggcctggttttgtggagtttgatgatgtcaatgggaaggtgcttacctactctgcacaagatagcatatacaaggtcttcgacctgaagaattatacactgttatactctataacacacaaagatgtagaagagatcaagatcagtcctgggatcatgttattgattttcgctagggctcagagccatgttcctctgaaaatattatcaatagaagatggcacagttttaaaggaatttaatcatttacttcatcgcaataagaaggtggattttatagaacagttcaatgaaaagcttcttgttaagcaagaaaatgagaatcttcagattcttgatgtacgaaatgctgaggtgaaagaagttgctaaaactgagttcatgactccatctgcatttatttttctatatgaaaatcagttattttaacattcagaaaccaaactgttctgtatggaattttcgaggagagcttgtgacatcattcgaggatcatgagttatggcattcggactgcaatacaaataacatctatataacaagtga

SEQ ID NO: 5886 - DNA, 1745 bp, Amorphophallus konjac
aagccttttctataataaaataacgactcactaattactgtctcagtttatgctgcagacaactatggctctttgaaatgtagaacgaccaggattgagtatatcaagagggggaaacccgatgttggctttccactgtttgagtccgaatcactaaaatatcctggttttgtagagtttgatgatgtaaatgggaaggttctcaccttttctgctcaggacagcatttataaggtgttcgacctgaaaaactacacactgctgtattctatatcagataggaatgtccaagaaatcaagattagcccaggtataatgttgttgatatttgaaagagctagcagccatgtccttctcaaaatactctccatagaggatggcactgtcctcaagtccttcaatcatctacttcatcggaacaaaaagatcgattttatagagcagttcaatgaaaagctccttgttaagcaagaaaatgaaaatctccaaattcttgatgttcggaactcccagttaacagaagtcagcagaaaagagtttacaactccgtcagcatttatatttttatatgagaatcagttatttttgacatttcgcaatcgcacggtagctgtttggaactttcgaggtgagcttgttacatcttttgaggatcacctcttgtggcatcctgactgcaacacaaacaacatctacattacaagtgatcaggatcttataatttcttactgcaaggctgaatctgatgactcagcagatggccatgcagctggatccataaatatcagcaacatactcactggaaaatgccttgcaaaaattcatgcgaacagttccgaaaagctgattcatgcctccagatttcgaaacacagtgacagaagcattagaggacataactgccctttactatgatgaagatcgcaatgaaatctacactggaaatagacagggtcttgtccatgtatggtccaactaaattaactaatggtctgtttactaacgactcggcttattattgttggccccgtttcgccacatggcacaaattgtcgtcatgtgatgtatgcatgtgtatccttgccaattagtttcatcattgatctgtttggttaaatggtatcttagtttatcaaactttctttgttgtaatcgctgtagagatcaggcgattgtattcttttctacaagtgtctgagtggagatcttgaaaagaaaaaggatttgtatctgtgaaaacttggacaaatgatggttatttgaaaaaaatactagtcgtagcatcttattcataccagcattccatttccagtttgccatggggaagggatcggggggtgcaaatctgtgatcttgtctacgatgaaccgtgccatgtttaagttaccgaaattattggtaaggcgcactaggttggcactctatacacactagtggaaaaaaggagatcactctgcccatttttcctgtaaagctagtatgacaggcaaaatattgatccagtgaggagggggcagcattgtctcggctggcgatattggaatttgtccagggaaagtgatgccagagatcacaaaggtttttgggagttgttggcttttctgcctggagcatgttcctgaggtctttcacaacatgagaggctttatttgtgtctcgtgaagaattagagcagaaatcgtaagacgacgattactttttcaggcttgatgtaacatttcaactttacacttccaccgttttacc

SEQ ID NO: 5887 - DNA, 1370 bp, Arnica chamissonis
gactagtagtcagatgtagcggtttctactcggtggaattccaattggaaagttaatttcgaattcttacattctgaatgtacggcaatggaacggtttggtagtggcggcggcggcggtggcagcgggattgcgatggagagtagcagcggtagtagcaggccgccaccacactgcggcggtcggaggagagtggttgctaccaagaagcgtgactggggcaactggctctcggtcaaaaacagcgtcaaaaagattcatagacgtgagatttcttccaaacgacaccgttccctttccatcaccaattccgtccaccgctttaggaacatccggttgacggagcaatatgacactcatgatcccaagggacaatcatcatttgtattaccattcttgatgaaaagggcaaaagtcattgaaatagtggcagcacatggtatagtatttgctcttgcaagttctggtgtttgtgcagcttttagtagagatacaaacaagaggatatgtttcttgaatatatatccagatgaagtcatccgtagcttgttttactaataaaaataacgactcgttaattacggtttctgtatatgcttcggacaatttcagttcactcaaatgcagatcaacaagaatagaatacatacaaagaggccaaccagatgctggttttcctctgtttgaatcagagtctctgaaatggcctggttttgtagagtttgatgatgtcaatgggaaagtgcttacctactccgcacaagatagcatatacaaggtctttgacctgaagaattatacactgttatactctataacagacaaagatgtagaagaaatcaaaatcagtcctgggatcatgttattgattttcactagggctcagagccatgttcctctgaagatattatcaatagaagatggcacagttttaaaagattttaatcatttacttcatcgcaataagaaggtggattttatagagcaattcaatgaaaagcttcttgttaagcaagaaaatgagaatcttcagattcttgatgtacaaaatgctgaggtgaaagaagttggtagaactgagttcatgactccatctgcattatttttctatatgaaaatcaattatttctaacattcagaaaccaaacggtttctgtttggaattttcgaggagaaggcttgtgacatcgtttgagggatcatgagttatggcattcagactgcaatacaaataacatccatataacaagtgaccaaggtcttataatttctttctgcaaaggtgattcaaatgatcaacgaattagtggtaaagctggttctattaatatcagcaacatatggactggtaaatgtgtggctaaaataaa

SEQ ID NO: 5888 - DNA, 1602 bp, Cirsium arvense
agaaaaggaatggaaggattcgggggtagcaggaataggagaataacgatggctagcagcaccggtaatggcggaaataggcgtccaccgctgtgtggtggtcggagaagagttgttgccaccaaaaagcgtggctggaccaacccactggcggtcaacaataccgtcaagaagcttcaaagacgcgagatttgttctaaaccccaccgttcctcatcaattacgaaatctcttcaccggttctgcaacttccggttgacggagagatacgatatccatgatcctgtgggacaatgttcattggtattaccattgttgatgaaaagagcaaaagtcattgaaatagttgtagtacatgatattgtctttgctcttgcaagttctggtgtttgtgcagcttttagtagagataccaacaagaggatatgtttcttaaatatatatccagatgaagtcattcggagcttgttttataacaaaaataatgagtcattaattacagtgtctgtatatgcttcagataacttcagttcgttgaaatgccgatcaataagaatagaatacatacaaagaggcaaacccgatgaaggctttccgctttttgagaccgagtctttgaaatggcccggctttgtggagtttgatgatgtcaatgaaaaggtgcttaccttctctgcacaggatagcatatacaaagtctttgatctgaagaactatacattgttatactcgatagctgaccaacaggtcgaagaaatcaagatcagccctggcatcatgttgctgattttcagtagggctcagagccatgttcctttgaagatattatctatagaagatggcacagttctaaaagatttcaatcatttacttcatcggaataagaaggtggattttattgaacaattcaatgaaaagcttcttgttaagcaagacaacgagaatctccagattcttgatgtccgcaatgctgaggtgaaagaagttgctagcaccgagtttatgactccatccgcatttatatttctgtatgagaatcagctttttctaacttttagaaatcaaactgtttccgtctggaatttccggggggagcttgttacgtcatttgaggaccatgtactatcgcatccagactgcaacactaacaacatctatatcactagtgatcaagacctcatagtttccttctgcaaggcagataatgaaccgttgactgatagaagaggagctggttctattaatataagtaacatatggactgggaaatgcatagcaaaaataaatgcgagcaatgcggtttcctccaagcaggatgatgaagaagatggaagctcatctaatcaaaggcagattgaagtgaacatggttgaagaggcactggaagacataacatccctctactatgacgaagagcgcaatgaaatctatacaggtaacagtaacggtttggtccatgtttggtccaactgaaaagatggaacatgatatatgttgtggcagagtttacatacaagacaccaatagttatgtctgttctaagtacataaacatgtgtgttgtgtgctcttattaggatgaataatatccatatctatatat

SEQ ID NO: 5889 - DNA, 1052 bp, Cirsium arvense
aggagggagatttgttcgaagcgggatcgagcttttagaatgtgcgatgctcaggagagattcagaaacatccgcttgcaggaggagtacgatactcatgatccaaagggacactgctccatagtattgccgtttcttaaaaaaacggtcaaaaatcattgagattgttgcagctcgtgatatagtatttgctcttgcacaatctggagtttgtgctgcattcagccgagagactaatcagagaatatgctttctgaacgttagtcctgatgaagttataagaagcttgttttacaataagaacaatgattctctaattacagtgtcggtctatgcttcagacagttttagctctttgaaatgcagaacaacaaggatcgaatacatacggagaggtcaacctgatggtggttttgctcttttcgagtcggaatctttgaaatggcctggttttgtggaatttgatgacgtgaatggaaaggtgttgacgttttcagcacaagatagcatttacaaggtgttcgatttgaaaaattatacgttgctgtactcaatatcggataaaagtgtacaagagatcaaaataagcccaggaatcatgttgttgatatataataaagttagcagtcatgttcctctaaagattctctccattgaagacggaactgttctaaaatcttttaatcatctccttcaccgaaacaagaaggtggatttcatcgagcaattcaatgaaaagcttcttgtcaagcaagaaaacgaaaatctccagattcttgatgtacgcaattccgacctaacggaagttagccgaacagagtttatgaccccatccgcattcatctttctgtacgagaaccaattatttctgacttttagaaaccgaacagtagctgtatggaacttccgtggggaacttgtgacttcttttgaagatcatttattgtggcatcccgattgcaatactaacaatatatacatcacaagtgatcaagatcttattatttcgtattgcaaagccgagtccgatgatcctttaacagaaggaaatg

SEQ ID NO: 5890 - DNA, 1316 bp, Fagopyrum esculentum
gcccttgcaatgtctggtctctgtgcagcattcagtcgagacacaaatgaaaagtgtgcttttgaatatcagtgaagatgaagtgatacggagcttgtctacacaaaacaatgatcccttatcactgtttcagtttatgcttctgtacagtttcagctcattgaaatgcagatcaacaaggatagagtacataaagagaggcaaacctgatgctggtttcgcactgtttgaatccgagtcacttaaatggcctggtttgtagagtttgatgatgtaaatgggaaggtgctcacgtattctgctcaggacagtgtttacaaggtgtttgacttgaagaactatagaatgctgtactcaatttctgaccaaaatgttcaagagataaaatcagcccaggcattatgttactgatatttaataaaggagttagccatgttcctttgaaaatcctttctatagaggatggcactgttctcaaatcattcaatcatctcattcatcggaataaaaaggtggacttcatcgaacagttcaatgaaaagctccttgtaaagcaggagaatgagaatcttcagatccttgatgttcgtaattctgacttgagggaagttagcagaactgaattcatgacgccatcggcatttatctttctttatgagaatcagttgtttttgacttttcgaaatcgaactgtggctgtatggaatttccgtggggaacttgttacttctttcgaggatcatcttctgtggcattctgattgcaacactaacaatatatacattacaagtgatcaagatctcataatttcatattgtaaagcagatgcagacgatccaaaagcagaaggaactgcaggctcaatcaatgtaagtaacatcctgagtggaaaatgcctagccaagataaaagtggaaaagaaatctgatgaaggagaagatatcagcagcagcggtagcagcaatggcggtagcggtagcagcagcagcaggcggaggaactcaagaaagcgtgcacatgcctcgaggatggggagatcagtggaggaagcgctggaggatatcacagccctcttttatgatgaagagaggaatgagatttacactgggaatagtcatggtcttttgcatgtatggtccaactgaggccctccccaaaggttgtaccatactgtctgtatgcgttatggatgccaaatttctcctttttattgtactttgatttacccttaatgttattgttttatagggaagttgcgtctgtttggagtggattcattgttttgggtatggatttgtatgccacctgatttgcta

SEQ ID NO: 5891 - DNA, 1767 bp, Flaveria ramosissima
gagtttcacccaatcgttgtcataactcataagcatcatcaattagcagcaatcagtatctgctgctgctatacgatcgcaattgagaacttcaatcgcataacacagtgaatgatactatatggaaggcattggtggtagcagaaatcggaggtttacgacgtcaagcagcggcagcaatggtggcagtagaacaccgctgtgcagtggtcggcggagagtggttgctacgaagagaggtggctggagcaacccattggtggttaacaacactgtcaaaaagcttcaacaacgcgaaattacatccagcccccatcgttctgcttcaatcaccaaatcgctgctccgatttcgcaacttccggttgacggagagatatgatatccatgaacctgtgggacgatgttcattagtattaccattgttgatgagaagagcaaaagtgattgagatagtggttgtacataatattgtctttgctcttgctggttccggtgtttgtgcagcatttagtagaggttcaaacaagccgatatgtttcttgaatgtctatccagatgaagtcattcggagcttattttataataagaataatgactcgctaattacagtgtcggtatatgcttcagataacttcagttccttgaagtgtcgatcaataagaatagaatacatacaaagaggcaaacctgatgaaggttttcctctttttgagaccgagtctttgaagtggcctggatttgtggagttcgatgatgttaatgaaaaggtgcttaccttctctgcgcaagatagcatatacgaggtctttgacctgaagaactatacactgctatactcaatagcagacagacaggtagaagaaatcaagatcagccctggcatcatgttactgattttcagtagggctcagagccatgttcctctgaagatactatctatagaagatggcacagttctaaaagatttcaatcatttacttcatcggaacaagaaggtggattttatcgagcaattcaatgaaaagcttcttgttaagcaagataatgagaatctccagattcttgatgtgcgcaatgccgaggtcatagaagttggaagcaccgagtttatgactccgtcagcatttatttttctgtatgagaatcagctatttctaacctttagaaatcaaactgtttcagtttggaactttcggggggaacttgttacatcatttgaggaccatgttttatcacatccagactgcaatactaacaacatctacataactagtgatcaagatctcatagtttcattctgcaagacaaataatgatcagtcgactcatacaagagctggttcgataaatatcagcaacatctggaccgggaaatgcatagcaaaaataaatccaagcaccgcgattccctcaaaggatgaacaagaaggaagctcaagcaatacaaggcaggttgaagtgaatatggttgaagaggcactggaagacataacagccctttatttcgacgaagaacataatgaaatctatacaggtaacagtaacggtttggttcatgtttggtccaactgaaagttggaatgtagagcaggatatcaaaagttatgcccgttttaagtacatagattaaagtgtgtgcgcatatgcacttgagacttatatatatgtgtagggatggtctaactcgactatgcagacttttaatagttgagttgcagaatagattatagtgtgtgtgtgttatttaatttacttttgttgttagg

SEQ ID NO: 5892 - DNA, 1459 bp, Flaveria ramosissima
agtttcacccaatcgttgtcataactcataaccatcatcaattagcagcaatcagcatctctgctgctgctgctgctatacgatcgcaattgagaacttcaatcgcataacacagtgaatgatactatatggaaggcattggtggtagcagaaatcggaggtttacgacgtcaagcagcggcagtagcggtggtagtagaccaccgctgtgcggtggtcggcggagagtggttgctacaaagagaggtggctggagcaacccattggtggttaacaacaccgtcaaaaagcttcaacaacgcgaaattacatccagcccccatcgttccgcttcaatcaccaaatcgctactccgatttcgcaacttccgattgacggagagatacgatatccatgaacctgtgggacgatgttcattagtattaccattgttgatgagaagagcaaaagtgattgagatagtggtggtacataatattgtctttgctcttgctggttctggtgtttgtgcagcatttagtagaggttcaaacaagccaatatgtttcttgaatgtctatccagatgaagtcattcggagcttattttataataagaataatgactcgctaattacagtgtcggtatatgcttcagataacttcagttccttgaagtgtcgatcaataagaatagaatacatacaaagaggcaaacctgatgaaggttttcctctttttgagaccgagtctttgaagtggcctggatttgtggagttcgatgatgttaatgaaaaggtgcttacctactctgcgcaagatagcatatacaaggtctttgacctgaagaactatacactgctatactcaatagcagacagacaggtagaagaaattaaaatcagccctggcatcatgttactgatattcagtagggctcagagccatgttcctctgaagatactatctatagaagatggcacagttctaaaagatttcaatcatttacttcatcggaacaagaaggtggattttatcgagcaattcaatgaaaagcttcttgttaagcaagataatgagaatctccagattcttgatgtgcgcaatgctgaggtcatagaagttggaagcaccgagtttatgactccgtcagcatttatttttctgtatgagaatcagctatttctaacctttagaaatcaaactgtttcagtttggaactttcggggggaacttgttacatcatttgaggaccatgttttatcacatccagactgcaatactaacaacatctacataactagtgatcaagatctcatagtttcattctgcaagacgaatgatgatcattcaactcgtacaagagctggttctataaatatcagcaacatctggactgggaaatgcatagcaaaaataaattcaagcaccgcgattcgctcaaaggatgaacaagaaggaagctcaagcaatacaaggca

SEQ ID NO: 5893 - DNA, 1311 bp, Flaveria ramosissima
aagggacattgctctatggtattgccattcttaagaaacgtcaaaataattgagattgttgctgcttgtgatatagtctttgctctggcacaatctggagtctgtgctgcattcagcagagaaactaacaagagaatatgctttttaaacgtgagtcctgatgaggttataagaagcttgttttacaataagaataatgattcactcattacagtatcagtttatgcgtctgacagctttagttccttgaaatgcagaacaacaagaatcgaatacatacgacgaggacaacctgatgctggttttgctctttttgagtcggaatctttgaaatggcctggttttgtggaatttgatgatgtgaatggaaaggtgctgacattttcagcacaagattgcatctacaaggtgtttgatttgaaaaactatacgatgttgtactccatagcagataaaaatgtacaagagattaaaataagtcccggaatcatgttattgatatataacaaagctagcggccatgtccctctcaagattctctctattgaagatggaaccgttttaaaatcttttaatcatctccttcatcgaaacaagaaggtggatttcattgagcagtttaatgaaaagcttcttgtcaagcaagaaaatgagaatctccagattcttgatgtacgcaactctgttctaacagaagttagcaggacggaatttatgacaccatcagcattcatatttctatatgagaatcagttattttttgacgttcagaaatcggacagtagctgtgtggaactttcgtggggaactagtgacttcatttgaggatcatttattgtggcatcccgactgcaacacgaataacatttacattacaagtgatcaggatcttattatttcgtattgcaaaaccaagtctgatgattctcccacacaaggaaacgaaggatctataaatatcagcaacattttgaccggaaaatgtcttgccaaaataaatgcaaaaaatggtgttcctttacatgaatgtagttgttgtggcatcaacatgagatctaacaacagaagctgcaagtgcacatcaagaaaacgaatccgagcttctacaattacgagttctgttacagaagctcttgaggatattactgtcccttttctatgatgaagagcgcaacgagatttacactaggtaataggctcggattagttcatgtatggtctaactaaaggtatgctaaattacaactttttgttgtaaatatttctattggtcaggggtagtatatgaaattaccagtcataactgtaact

SEQ ID NO: 5894 - DNA, 1789 bp, Vinca minor
attatcatttctctagaaccctaatttttttttccgtaattgggttcctgagatttttaacagttttattgaaatctctcctacatagggtaaatcgaagaactcgaaaccctactgccagaacatgttcatttgccagaaatctattgggtgaaaattgaagctgatttatactacttagaagagatatgtgtgtgtgcctgcatgttgcattttctgtagataaatttttgtagacagaattgtttgtgtaataagatttagggttttttaaaaaaaaaaattggacggtagacgaataacggcgagtcctcggccttgctctgggaggcgtgtggtggcgaagaagcggcctcgcggtggtatggatggttttgtcaatagcgtcaagaagctccaaagacgggagatttcttcaaagcgtgaccgagctttcagcatgagtgacgcccaggagcggtttcgcaacatccgattgcaggaggaatatgatactcatgacccaaaggggcaatttaccatggtgctgccgtttctccggaaacgatctaaaattattgaaatagttgctgcacgtgatgttgtctttgctcttgcacaatctggaatctgtgcagcattcagtagagagactaacgagaggataagctttctgaatgtcagtcctgatgaagtcataagaagcttgttttacaataaaaacaatgattcactcatcactgtttcagtttatgcttctgataatttcagctcgttgaaatgcagaaccacaagaattgaatatatacgaagaggaaagccagatgcaggtttccccctctttgaatcagaatcgctgaagtggcctggttttgtggagttcgatgatgtaaatggcaaggttctcacttattcttctcaagatagcatatacaaggtattcgatttgaagaactattccatgttgtactccatatctgataaaaatgtgcaggagatcaagatcagcccaggaataatgttgctgatatttactaaagctagcggtcatgttcccctgaagattttatcaattgaggatggaactgttctcaaatctttcaaccatctccttcatcggaacaaaaaggtggatttcattgaacagttcaacgagaagcttctcgtcaagcaggacactgagaatcttcagattcttgatgtccgtaattctgaattaacagaagttagcagaactgagttcatgaccccatcggcattcatatttctgtatgagaaccagctattcttgacattcagaaatcgaacagtggctgtttggaacttcaggggcgagcttgtgacttcattcgaggatcaccttctatggcatccagactgcaacacaaataacatttacatcacaagtgatcaggacttaattatctcctattgcaaagccgattctgacgatccagtatcagaaggaaatgctggttcgatcaatatcagcaacatactgacagggaaatgtctcgccaaaataaaagcaaacaacagtcttcccgtggacgattgcacctgcaatgctgactgtggtgggaagagttgcaacgcaaagaaacgagccaaagctgctaatatgagaagcagtgttgctgaagccttggaagacatcactgcactgttttatgacgaagagcgcaatgagatttataccggaaacaggcttggtctggtccatgtgtggtctaactagagtttgtggcagaatctcattcctaacccgtgcttctatgatagttcttacggatgaaattcattcagcaac

SEQ ID NO: 5895 - DNA, 2166 bp, Aquilegia formosa
agatttaagaaaaaggacccgttttatttatagttttcgttagaacaccgggatctgacaattttaccggaaacgatgcaaattctttaccggtttctgacatttccgatacaatatatttttcaaaattaaaaaaaggaaactttcacaattgaattacaggagagaaagtaagagagagtgaaagaaggagtgtgagggtttttttttttgttttcgccatggtggtgaagagaagagaaacccgagaaaccctaataataaaactagttattagtgtgatcgattgttgcgaatgaatgaagttgtattacctactttagagctaaattagtttcaatatctttcgatttataagaaagatggataagaaatcgcatgttagacttcgagttcgagttacagctagcaaacgagaaagagaattgattcctcgtacttcacttcttcgaaagtttcgtgatagtgaaacttttaactctgttaagaaacttcaaaggcgagagattggtggattgaggaatatttgtagtggtgcttcttctaatgctcaagaaaaatttaggaattttcaacttcaggaggaattcgatacatatgatccgaaagctcatttgtttttaagattacagtttcttaaaaagagatccaagattatagagattgttgcagcaaaagatgttatatttgctcttgcacagtcgggcctctgtgctgcttttagtcgctcatccaatacacggatttgctttctgaatattagccctgatgaagtgattcgaagccttttctataacaaaaataacgagtcacttattacagtatccgtttatgcgtcagatcatttcagctcattgaagtgcaggactactcccatcgagtatattaggcgaaatcaattggatgctggattccctctatttgaatcagaatcactgaagtggcctggttttgttgaatttgatgatgtaaatggcaaagttttgacttactcagcacaggatggcatttacaaggtgttcgatctcaagaactactcattcttgtactcaatatctgataaaaatgtccaggaaatcaagatcagtccaggaatcatgctgttaatattccatagagctgttggttatgttcctctgaaaatattatccattgaagatggaacagtattgaaatctttccaccacttgctgcaccgtaacaagaaggtcgattttatcgagcaattcaatgagaagcttctggtcaagcaagaaaacgagaaccttcaaatacttgatgtaagaaactcagagctgactgaagtcagccgtacagaatttatgactccatctgcttttatcttcctctatgagaaccacttgttcttgacattccggaatagaacagttgctgtttggaattttcgaggggagctagttacctcatttgaagaccacttgttatggcaccctgactgcaacacaaacaacatctacatcactagtgatcaagaccttattatctcatactgtaaagctgaggaagcacctgacgaagatggagaatttggtgcagttggctctatcaacatgagtaatatcttaactggaaagtgcattgcaaagatatgttcgaatgaccctaatctccgaatcagtcctcggggtagaatgggggggaggtcagttattcagagcactgtacgcgaagctctcgaagatgtgactgcactcttctatgatgaggaccgcaatgagatctacactggaaacaagcaaggacttatccatgtatggtccaattagctgtaaaatttagtaaaagcgaaaggatgagtaaaactatccaacttgtatcataccgacttgtgtttttgacttactgctgtgtgtttataagttaatgcttccttgtgttgctttcgttgtgtagcttcattttgcaagtagtgatgaagtctttacaattggttgttcagaactcttgatcatttatagaagtgagaaaagcagaaggctttatatggttacaattctgaattgggaataactatttcttatttagaaatttgtgaaatattgcaactattaaaaatctcttggcacccaatcacatttagaagggtctcaaagaagaattggtgagtgaaagttcaatctactatatctagtacaaattccttca

SEQ ID NO: 5896 - DNA, 1527 bp, Centaurea maculosa
  misc_feature (497)..(497): n is a, c, g, or t
  misc_feature (598)..(598): n is a, c, g, or t
  misc_feature (1006)..(1006): n is a, c, g, or t
  misc_feature (1081)..(1081): n is a, c, g, or t
  misc_feature (1087)..(1087): n is a, c, g, or t
  misc_feature (1180)..(1180): n is a, c, g, or t
acacagcgtcagaagcttcaaagacgtgagatttcttcaaacctcttcgttctccatccatcaccaaatcactccatcgattttgcaatttccgattgacggagagatatgatatccatgatcctgtgggacaatgttcattagtattaccattgttgatgaaaagagcaaaagtcattgaaatagtggtggtacatgatattgtctttgctcttgcaagttctggtgtttgtgcagcttttagtagagataccaacaagaggatatgtttcttaaatatatatccagatgaagtcattcggagcttgttttataacaaaaataacgagtcattaattacagcgtctgtatatgcttcagataacttcagttcgttgaaatgccgatcaataagaatagaatacatacaaagaggcaaacccgatgaaggctttccgctttttgagaccgagtctttgaaatggcccggctttgtggagtttgatgatgtcatgaanaggtgcttaccttctctgcacaggatagcatatacaaagtctttgatctgaagaactatacattgttatactcgatagctgaccaacaggtcgaagaaatnaagatcagccctggcatcatgttgctgattttcagtagggctcagagccatgttcctttgaagatattatctatagaagatggcacagttctaaaagatttcaatcatttacttcatcggaataagaaggtggattttattgaacaattcaatgaaaagcttcttgttaagcaagacaacgagaatctccagattcttgatgtccgcaatgctgaggtgaaagaagttgctagcaccgagtttatgactccatccgcatttatatttctgtatgagaatcagctttttctaacttttagaaatcaaactgtttccgtctggaatttccggggggagcttgttacgtcatttgaggaccatgtactatcgcatccagactgcaacactaacaacatctatatcactagngatcaagacctcatagtttccttctgcaaggcagataatgaaccgttgactgatagaagaggagctggttctatnaatatnagtaacatatggactgggaaatgcatagcaaaaataaatgcgagcaatgcggtttcctccaagcaggatgatgaagaagatggaagctcatcnaatcaaaggcagattgaagtgaacatggttgaagaggcactggaagacataacatccctctactatgacgaagagcgcaatgaaatctatacaggtaacagtaacggtttggttcatgtttggtccaactgaaaagatggaacatgatatatgttgtggcagagtttacatacaagacaccgatagttatgtctgttctaagtacataaacatgtgtgttgtgtgctcttattaggatgaataatatccatatatatatgtatagggttaccttctacattgagtatgtaggcttattataggggtttgagttgcagaattgaatgataaatgcaatattatgagcc

SEQ ID NO: 5897 - DNA, 1111 bp, Lotus japonicus
gtaatatatcaatgcttcatgatggtgatacttgtaccttgtttttatcttgtagcatatacaaggtgtttgacctgaaaaactatacaatgttgtactccatttctgataaaaatgtccaagagattaagatcagtccggggatcatgttgctgatttttgccaaagcaagtagccatgtgccgcttaaaatcctttcaatagaagatggactgttttgaaatcattcaaccatctcctttatcgtaataagaaggtggattttattgagcagttcaatgagaagctacttgtgaagcaagaaaatgaaaaccttcaaattcttgatgtgcggacttttgagctaactgaagttagccgaagtgaatttatgacaccctctgcattcatctttctatatgagaaccagttattcctgacattccggaatcggactgtggctgtgtggaacttccgtggagagcttgttacttcctttgaggatcacctcttgtggcatcctgattgcaatacaaacaatatatacataaccagtgaccaggatcttatcatatcctactgcaaagctgattctgatgactcagtgactgaaggaaacgcaggctctatcaatgtcagcaacattttaactgggaagtgtcttgccaagataagagcaagcaacagcttcccaatggaggacaattgcagttgctgtgaaacttcttcaggtaacagttgtaattccaggaagcgaaagcatgcctccaaaattaggagcacagttgcagaagccctggaagatattactgctcttttctatgatgaagaccgcaatgagatctataccggcaacaggcacggtttagtccatgtctggtctaactgatgtattatggatttactaccctttgtaaacttcttgggtttttcttcatgtggacaaaagattttccggatctgctttatagaacttctgggaggagtagcgccattgagtgatcttgcaatgatcattttgttcatccgtactttggcgcatttgttatgtagctagtaacatatctgtatggaagtgctatgctggtaacagagcacgtgttgcttctgctgtaatctatatttggattta

SEQ ID NO: 5898 - DNA, 1410 bp, Arachis hypogaea
gagagaccaatgaacggatatgcttcttgaatatcactccagatgaagttatcagaagcttgtttttactaacaagaacaatgattcacttatcacagtttctgtctatgcttcagacagttacagtctttgaaatgcagaagcacaaggattgaatatataagacgggttcaatcagatgctggttttgctcttttcgaatctgagtcattgaaatggccaggttttgtggagtttgatgatgtaaacgggaaggtactcacgtactctgctcaggatagcatctacaaggtgtttgacctaaaaaactatacaatgttatactccatttcagataaaaatgtacaggagattaagatcagtccggggatcatgttgttgatttttgctaaatcaagcagccatgtcccacttaaaattctttcaatagaagatggtactgttttgaagtctttcaatcatctccttcatcggaataagaaggtggattttatagaacagttcaatgaaaagcttcttgtgaagcaagaaaacgagaacctccaaattcttgatgtgcggacttttgagataacagaagtcagtagaagtgaatttatgacaccatctgcatttatattcctgtatgagaatcaattgtttcttacatttcgaaatcgaactgtggctgtctggaacttccgtggagaacttgtaacttcttttgaagatcacctcttgtggcatcctgattgcaacacaaacaacatatatataaccagtgaccaggatctcatcatatcatactgcaaggctgattctgatgattcgttatctgaaggaaatgcgggatccatcaatgtcagcaacattctaactggtaagtgccttgcgaagataaaagcaagcaacagctctcccattgtaaaccaatgtagttgcggcgacgattgttcaggtagctgtcgtaacacgaggaaacaaaaacatgacaccaaaactaggagcacagttgcagaagctttggaagatattactgctctcttctacgatgaagagcgcaatgagatctacacgggcaatagccacggtctggttcatgtctggtccaactgatgtgttgctatatttattgtgccttgttccttgtattatcttcctttttttccatgattagaagtgtgatgagttaaaggccaatgcagcattgtatgattcctgtaactggtctcacctggacacctagtggtacaaagcttaattgttgttggaggtgataattctatgttataggttaagtttgtttcttaggtagcaagaaatctgtattaagtgaaatactctgttcggataactagccaaaagttgtgtatcctgtaatttacattacatttatggatccacctcttggatggaaatgtgaataatgtt

SEQ ID NO: 5899 - DNA, 1321 bp, Capsicum annuum
gcacgaggcacggattgaatacattcggaggggtaaaccagatgctggttttgctttattcgagtcagagtcattaaaatggcctggttttgtggagttcgatgatgtcaatgggaaagtgcttacttactctgcccaggatagcatatacaaggtatttgacctgaagaattacacaatgttatattcaatctcggacaaaaatgttcaagagattaaaataagcccaggaatcatgttgttgatatttactaaagctagtggccacgtgcctctgaagattttgtccatcgaggacggtactgttcttaaatcttttaaccatcttcttcaccgaaataagaaggtggatttcattgaacagtttaatgaaaagcttcttgtcaagcaagagaacgagaatcttcagattctggatgtactcaattctgagttgacagaagttagcaggactgagttcatgaccccctcagcattcatttttctgtatgagaaccagttgttcttgacattcagaaacagaacagtagctgtttggaacttccgcggggaggttgttacttcatttgaggatcaccttttatggcatcctgattgcaataccaacaacatttacataactagtgatcaggacctaattatttcatactgcaaagctgattctgatgatcccttatctgaaggaaatgcgggatctattaacatcagcaatattctgactggcaaatgccttgctaaaataaaagcaaccagtggcaaggccactgatgattgtagtgctagttgcagtgtgcctggtagaagaagttgcaactcaaataagcgggtccaagattccagaattcggagcactgttgcagaagccctagaagatattactgcccttttctacgatgaagagcgcaatgagatctatactggaaacaggcttggattggtccatgtatggtctaactgactaattatcctgctcccctgatgtcttgaggttgttactgatggaggaaagcctcaggtaacattttaccattggtgtggtgttttttagtcttatacccaaaggaatggtttgagttgtgtcttcaatttactttgaactgtaccgtctgtttgtaatgttgttgcttgggtgattgcccttttagatgaggtgttctagatgatttctagtgtgctgctagtacttttgcaacttagggctgtctactgagtcgtagtcagagagagctagttaaccagtaagtctcatttgattcagccattctgatgctttaaatggttgagagaacagtgcaatgtttaagtgacgctgcttttggtt

SEQ ID NO: 5900 - DNA, 2476 bp, Physcomitrella patens
gatcgaaccccatcgagggagggatctcgtagaattgcagggctcgggtcattcccatgagaagctgaactgctggaagggttaaggtgtttacagctgcactggtgccgaatggttgtggtggttatggctggaatttgagagtgagtttgagagtggtgggcagcgtactactgcggtgtggggcattcgttttttggtttttgcgggtttttgtggccatgctatggcgagactcagtgagagtcgttgtggtggaggaggtgccttggaagtgtaggagagttgacggccagtcgttggagagatagagcgagaaagagaccgataggaaggagacgagaggaaagcggaagatgggagggaaacggttctgatgcatcaggtcatgtagggcaaggtcctgccagacgtgagttggggttaccttgggtcgtcggttgggaggtcgaggtatggagtcgatgagcaaggtgaggatgagcccgaggccgacatgcgggcgccgaatagtggctggaaagcgtccacgacctgatgactccaagaactgtgtgcggaagcttctgaagcgggaaataagtcgggcagggaattggtcgttcaaccgtaccaactcgcaggagaagttccggaactttcatcttcaggaggagtttgatacgcatgatcctaaggcccatcagttcttgaaactaccattcttgaagaagagatccagaatagtggagattgtggctgctcgagatacagtgtttgcattgacacattcaggaatatgtgccgcctttagcagagacacaaacaagaggatatgctttctcaacatcagtgccgatgaagtgatccgcagccttttttacaacaagaacaacgattcgttaataactgtgtctgtttatgcttccgataacttcagctcattaaagtgcaggacgacacccattgagtacatccggagggggcagcctggtgcaggattttctctttttgagtcagaatctttgagatggcccgggttcgttgagtttgatgatgtcaatgggaaggttctcacatattctgcacaagatagaatttacaaggtgtttgatctgaagaattacacaatgctgtattctatatctgacgagcacgtgcaagaaatcaaaataagccctgggattatgctgttaatctttgacagagcacagagtcatgtgcccctgaagattctgtccattgaagatggttccgtcttgaaagcttttaatcatcttcttcatcgaaacaaaaaagttgactttattgaacagttcaacgagaaactgcttgtcaagcaagaaaatgagaatctgcaaattcttgatgttaggaactctcaaatgacagaagtaagcagaactgagttcatgacaccctccgcattcatattcttgtatgagaatcagctatttcttacattccgcaacagaacggttgctgtgtggaactttaggggagagctggtcacgtcgtttgaggatcacctactatggtatcctgattgcaatacaaataacatatatatcaccagtgaacaagatctcatcatttcatattgcaaggctcacccggacaattctgccgaggaagttggttctattaatatcagcaacatcctgactgggaagtgtctcgcaaaaattagggcggatgaccctagtgttggagtcagccctcgaacgcgttccaattcctcaaatatcagaagctctgtgcaggaagctctagaggatgttactgctttgttttacgatgaagaaaggaacgagatttacactggaaaccggcatggactagtgcatgtttggtcaaactaggtttatctggggaaatttacagttcgttagatttttcttatctggtgggtatactcgtgataaatctttggctactcttcatgtcgacaatctctgttgtgtgtcaaaacacgacctcagctgatgttaccgattcagcagttgggcaatctttcaactggctgtacccgatgtaagaatcttggatgtcacttctcgagacagtggtggaacttatcaaggctgaggtgggaatgtacgtgatggtgttcttcatcagcatgcgttctgatgtagaggctggctgtgactccgcatactggtactgttgggcttattagagatggtaaagcgtcagtaacgcttagtttgttcgtccgagctgctgtatctcaattgatacttggaatacgcattcaatatccagcttttggatcaacggaccggtataggaccctggcagtttcgaacactatgtacaagaaacgatccagacaagttattagtgaaggttatcctttttgagaaagcttttgctttctggataaatttataaatgtatactttgtagatgagctagagtttcaagaaaaacagaatgtggtcactgtaattttaaagcttgaggcctcagtaaaatcatgattgattaatat

SEQ ID NO: 5901 - DNA, 1631 bp, Cajanus cajan
gattgtagcagcacgtgacattgtttttgcacttgcacagtctggtgtatgtgcagcatttagccgagagaccaatgaacggatatgcctcttgaatgtcagtcccgatgaagtcataaggagtttgttttataataaaaacaacgactcactcatcacagtttctgtctatgcatcagacagttacagttccttaaaatgcagaagcacacgaattgaatatataaggagggttaaaccagatgctggctttgctctttttgaatctgaatcacttaagtggccaggatttgtagaatttgatgatgtaaatgggaaggtactcacatactccgcgcaggatagcatatacaaggtgtttgacctgaaaactatactatgttgtactccatttcagataaaaatgtacacgaaattaagatcagtccagggatcatgttgttgatttatgctaaatcgagtagccatgtcccacttaaaatcctctcaatagaagatggtacggttttgaaatcgttcaaccatctccttcatcggaacaagaaggtggatttcattgaacaattcaatgaaaagctccttgttaaacaggaaaatgagaacctccaaattcttgatgttcggacttttgagctaacagaagttagcagaagtgaatttatgacgccatctgcatttatatttctctatgaaaaccaattattcctgacatttcgtaatcgaactgtggctgtgtggaacttccgtggagaacttgtaacttcttttgaggaccacctcctgtggcatcctgactgcaatacaaacaacatatatataaccagtgaccaggatctcattatatcatactgcaaggctgattctgatgattcattgtctgaaggaaatgcaggatccattaatgtaagcaacattttaactggcaagtgtcttgcaaagattagggcgagtaatagccttccgaaggtgaaagaatgcagttgcggtgatgacaactgttcaagtggtggtggatgtaatttgggaaaacgaaagcgtgtctccagaattcggagcacagttgctgaagccttggaagacattactgctctcttctacgatgaagagcgcaacgagatctatacaggcaataggcacgggctggttcatgtctggtctaactaaataatgtattgttggatttattgttgtcttttgttttcttattagcatttatccaaggttgcggtgatgatcctcacttgctatgcgaatttctgggagagttgtaaccatttagtgttcttgtataatttttttagattttggcatctacgtcgtaggcaagtataatccgtaggtggcaacagctctgtatcaagtaatattgtttgtatgttggtagctcaccacatgtttatgctgtaatctatattacatttatggtgtgggctctttgtagcgaaatatgtgaatagcgttctctcttctctgcccgtttctttctttgatactttgccttgtggggactacagtgtagtgacctacttgctctcacatggattgttggagctgtaaagggaaagtaatcagcagtgttgtagctgatttacactggctccattttgtacttcattcaattcaattattgt

SEQ ID NO: 5902 - DNA, 1169 bp, Taxus baccata
tctatttgtacagtgagcatgtttgggaagtgaatctctctgataaaactaattcagggaaacaatggagggcaaaagagtttctgcaagccctcggcctagtagtggtcgcagagttgttgcagggaaacggaaacgatcgtacgagtataataactgtgtgcgaaagcttcaaaggagagaaataggaagcattggcgacaaggccttcagcagcaccaattcgcaggaaaggttccggaattttcagttacaggaggaatttgacacctatgatccaaaggcaagttggtttttaagactgcaatttctgaagaagagatcaaagatcattgaaatagttgcggctcgggatataatatttgctttggcacagtctggtgtttgtgcagcatttagtagagagataaacaaaaagtttgcttcttgaatataagtccagacgaagtgattcgcagcctgttttataataaaaacaatgaatctcttattacagtgtcagtctatgcttcagataactacagttcactgaagtgcagaacaactccaattgagtatattaggagaggtcaaccagatggtggttttgctttatttgagtcagagtctctgaggtggcctggttttgtagagtttgatgatgttaatgggaaagtcctgacattttctgctcaagatggtatttacaaggtgtttgatttgaagaactatacacttctgtactcaatatctgataaaaatgttgaggagataaagatcagtccaggtataatgctgttaatatttaaaaaatctttcagtggaagtcatgttcctttgaagatcttaaatatagaggatggcaccgttttgaaatcctttaatcatctattgcatcgtaataaaaaggttgatttcatcgagcagttcaacgagaagcttcttgtaaaacaagaaaatgaaaatctccaaatacttgatgttcggaatactcagttgactgaagtcagcaggacagagttcatgacaccatctgcttttattttcttgtacgagaatcaattatttttgacatttcgtaatcgaactgttgctgtatggaatttccgtggagagctggtgacgtcgtttgaagaccacttgttatggcatcctgattgtaatacaaataacatatacattactagtga

SEQ ID NO: 5903 - DNA, 1684 bp, Ambrosia trifida
aactcaataagagttcagtaggagagttgagtttgtgttcaaacattcaatcccaatcactcaatcaatcaatcggtggctacttctgctaccaccaccaccaccaccacatggaagcaaccggtagcagaaaccggcggattacgacgtcaagcagtaggcgtagagtagttgctacaaagaatgctggctggaccaaccctttgctgcctaataacactgtcaaaaagcttcatcgacgtgaaattacctctcttcgtcatcgttccgcttctgtttccaactctcttcaccgattccgtaacttccgcttgacggagagatacgatatgcatgatcctgtgggacaatgttcaatggtattaccattgttgatgagaagagcgaaagtgattgagatagtggtggtacatgatattgtctttgctcttgctagttctggtgtttgtgcagcatttagcagaggtacaaacaagacgatatgcttcttaaatatatatccagatgaggtcattcggagcttgttttataataagaataacgactcactaattacagtgtcagtatacgcttcagataactttagttcattgaagtgccgatcgataagaatagaatacatacaaagaggcaaacctgaagaaggctttcctctttttgagaccgagtctttgaagtggcctggatttgtcgagtttgatgatgttaatgaaaaagtgcttacctactctgcgcaagatagcatatacaaggtctttgacctgaagaactatgcactgttgtactcaataacagacagacaggtagaagaaattaagatcagtcctgggatcatgttactgatatttagtcggggtcagagccatgttcctctgaagatactatctatagaagatggcacagttctaaaagatttcaatcatttactacatcggaacaagaaggtggattttatcgagcaatttaatgaaaagctgcttgttaagcaagacaatgagaatctccagattcttgatgttcgcaatgctgaggtcaaagaagttggaagcactgagtttatgactccatcagcatttatttttctgtatgagaatcagttatttctaacctttagaaatcaaactgtttcggtttggaactttcggggggaacttgttacatcattcgaggaccatgtgttatcacatccagactgcaataccaacaacatctatataacgagcgatcaagatctcatagtttcattctgcaaggctgataatgatcaggcaactgatagaagagctggttctataaacatcagcaacatctggactgggaaatgcatagcaaaaataaactcaagcaatgcgattccatcaaaagatgaacaagaaggaagctcaagcaacacaaggcaggtcgaagtgaacatggttgaagaggcactggaagacataacagccctttattttgacgaagaacacaatgaaatctataccggtaacagtaacggtttggttcatgtttggtctaactgaaatattaatagttatgcccgctttaagtatatagagtaaagtgtgcgcgcgggctcttaagatttatatatatgtgtaggggtgcgtctaaatcgagtatgcagatttataatgtttagttgcagaaatgactaataaagtgtggtgttattaacaaaaaagaa

SEQ ID NO: 5904 - DNA, 1581 bp, Ambrosia trifida
tcataagagttcagtgagagagagagagtttgagttttgtgttcaaaacattcaatcccaatcactcgaatcaatcgctggctacttctgctaccatcacatggaagcaaccggtagcagaaaccggcggattacgacgtcaagcagtaggcggagagtagttgctaccaagaatgctggctggaccaaccctttgctgcctaataacactgtcaaaaagcttcatcgacgtgaaattacctctcttcgtcatcgttccgcttctgtttccaactctcttcaccgattccgtaacttccgcttgacggagagatacgatatgcatgatcctgtgggacaatgttcaatggtattaccattgttgatgagaagagcgaaagtgattgagatagtggtggtacatgatattgtctttgctcttgctagttctggtgtttgtgcagcatttagcagaggtacaaacaagacgatatgcttcttaaatatatatccagatgaggtcattcggagcttgttttataataagaataatgactcactaattacagtgtcagtatacgcgtcagataacttcagttcattaaagtgccgatcgataagaatagaatacatacaaagaggcaaacctgaagaaggctttcctctttttgagaccgagtctttgaagtggcctggatttgttgagtttgatgatgttaatgaaaaagtgcttacctactctgcgcaagatagcatatacaaggtctttgacctgaagaactatgcactgttgtactcaataacagacagacaggtagaagaaattaagatcagtcctgggatcatgttactgatatttagtcggggtcagagccatgttcctctgaagatactatctatagaagatggcacagttctaaaagatttcaatcatttactacatcggaacaagaaggtggattttatcgagcagtttaatgaaaagctgcttgttaagcaagacaatgagaatctccagattcttgatgttcgcaacgctgaggtcaaggaagttggaagcaccgagtttatgactccatcagcgtttatttttctgtatgagaatcagttatttctaacctttagaaatcaaactgtatcagtttggaactttcgtggggagcttgttacatcatttgaggaccatgtgttatcacatcccgactgcaataccaacaacatctatataactagcgatcaagatctcatagtttcattctgcaaggctgataatgatcaggcaactgatagaagagctggttctataaatatcagcaacatctggactgggaaatgcatagcaaaaataaactcaagcaatgcgattccgtacaaaggatgaacaagaaggaagctcaagcaacacaaggcagattgaagtgaacatggttgaagaggcactggaagacataacagccctttattttgacgaagagcacaatgaaatctataccggtaacagtaacggtttggttcatgtttggtctaactgaaatattaatagttatgcccgctttaagtatatagagtaatgtgtgtgcgcgggctcttaagatttatata

SEQ ID NO: 5905 - DNA, 1320 bp, Cirsium arvense
cagaggagggagatttgttcgaaaagggatcgtgcttttagaatgtgcgatgcgcaggagagatttagaaacatccgattgcaggaggagtacgatactcatgatccaaagggacactgctccatcgtattgccgtttctcaagaaacgttcaaaaatcatcgagattgttgctgctcgtgatatagtatttgcgcttgcacaatctggagtttgtgctgcattcagccgagagactaacgagagaatatgctttctgaacgttagccccgatgaagttattagaagcttgttttacaataagaacaatgattcactcattacagtgtctgtttatgcttcagacagctttagctccttgaaatgcagaacgacaaggattgaatacatacggcgaggtcaacctgatgccggctttgctctttttgagtcagaatctttgaaatggcctggctttgtggagtttgatgatgtgaacggaaaagtgctaacgttctcagcgcaagatagcatttacaaggtgttcgatttgaaaaactatacgttgttgtactccatatcagacaaaagtgtacaagagatcaaaatcagtccgggaatcatgttgctgatatataataaagccagcggttacgttcctctcaagattctctctattgaagatggaactgttttgaaatcgttcaatcatctccttcatcgaaacaagaaggtggatttcattgagcagttcaacgagaagcttctcgtcaagcaagaaaacgagaatctccagattcttgatgtgcgcaattctgacctaacggaagttagccgaacagagttcatgaccccatcagcgttcatctttctgtacgaaaaccaattattcctgacgttcagaaaccgaacggtggctgtatggaacttccgtggggaactcgtgacctcgttcgaggatcatttgttgtggcatcctgactgcaacactaataacatatacatcacaagcgatcaggatcttattatttcgtactgcaaagccgagtccgatgatcctttaaccgaaggaaatggttcgataaatatcagcaacatattaacggggaaatgccttgctaaaataaaggcgaaagatggtgttccgatggaggagtgtgattgtggaagcggaagcggaagcagttgcaagtgcaggaggccgggaaagcgaatgagaagggaaatgagttcagtgacggaagctttggaggacataacggcccttttctatgacgaagagcgtaacgagatatatacaggtaacaggctggggttagtgcatgtatggtctaactgatgt

SEQ ID NO: 5906 - DNA, 1934 bp, Pteridium aquilinum
ctgtgcaggtaagctcgagcttctgcctaacgcagcggaagaataggacgcctatacagacaggaagtgaaatctcttgttaccagcgtcacacagctactcttttccatcgccatcaccatcgacctttaccatcaatgaggccagcatgccctctcctttgtactaaggagtgcgattttttcatttccagttcttccccgatcgccttttttcaggctctttccaagcatttcgtgtctgccctggtgatcggaatgcagagaaagggcttgtaggcatcaaagcacgaggctttcaatcatctatatttgcagagtgaaagagaacttttagttctctgaaaatggagaccaagaagaagatacccagcagtcctcgaccttcttcaagtcgtcgtgtgcttgcaggcaagcgcgcatgccctgctgatgcatcatccaactgtgtcaagaagctcctcagacgtgagattagtgccagtggtaaccgggccttgaactgcacgaacgcacaggagaagtttcgcaacttccacctccaggaagagtttgatacttatgaccccaaaggaaactggttccttcagctcaatttcttaaagaagcggtcaaagattgtcgaaattgttgctgctagggaaatagtatttgcattggcacagtcaggagtctgtgctgctttcagcagggagactaacaagaagatttgctacctcaacatcagcccagatgaggtcattaggagtctttctacacaaaataatgattctctcataactgtctccgtgtatgcatctgataatttcagcaccctgaagtgcagaacgacacccattcaatacatccgcagaggacagcctgatgctggttttggtctctttggatcagagtcactgaagtggcctggatttgttgaatttgatgatgtgaatggcaaggttttgacatactcagctcaggacaaaatctacaaggtgttcgatttgaagaactatacgcccttgtattccataccagatgaccaggtctctgaaataaaaattagtccaggaattatgctgcttatctatgagagagccgctagccatgtgcctctcaagattctgtccatagaggatggcaccgtcctcaaggatttcaggcatcttctgcacagaaacaagaaagtcgattttattgagcaattcaatgagaaattgctcgtaaagcaggacaatgaaaaccttcaaattcttgatgtaaggaattctcagctgacagaagtgagcaggacggagttcatgactccctcggcgtttatttttttgtatgagaatcagctctttcttacattccgaaacaggacagttgtcgtctggaactttcgtggagagctggtcacctcttttgaggatcacctactctggcatcctgactgtaatacaaataacatatatatcacaagtgatcaggatctgatcatctcctactgcaagtctcatccacatgaatgtacagaggaagagagagttgggtcaatcaatataagcaacattcttacaggcaaatgcctggccaagatatgtgctactgattcgaatgtcaaagtcagcccgagagagagagctaactcttctcctgtacagagctcggtacgggaagctttagaggatattactgctctcttctatgatgaagagaaaaatgagatctatacaggtaacagacatggaagggtgcatgtttggtcaaattgatctcttcgaggtaggtgcagtggatatgtggaagaggttttaatggacaaggacctgtgctgactcaacagcggttgagaaagccagacgagggaaataggagcaacttttaaaggggtttgaagaggttcagctcgatgagcctttgctgatgcttatacttcttccctggatgatcatgcttctgatgattgtg

SEQ ID NO: 5907 - DNA, 397 bp, Scabiosa columbaria
aaaaactataccatgctctactccatatcagataaaaatgtacaagagattaagatcagtccaggaataatgttgctgatttttacaaaagctagtggacatgttccacttaagattctttcaattgaagatggaactgtcctcaaatcgtttaatcatctccttcaccgtaacaaaaaggtggattttatcgaacaattcaatgagaagcttcttgtcaagcaagagaatgagaatcttcaaattcttgatgttcgcaattccgagcaaactgaagtaagcagaaccgaatttatgacaccatcagcgttcatatttctatacgaaaaccagctattcttgacgttcagaaaccgaacagtggctgtgtggaactttagaggagagctggtgacat

SEQ ID NO: 5908 - DNA, 1295 bp, Valeriana officinalis
tttacaataaaaacaacgattcacttataacagtttcagtctatgcttctgacaattttagctctctaaaatgcagaaccacaaggatcgaatacataaggaggggtaaacctgatgctggttttgctctatttgaatctgaatcattgaaatggcctggttttgtcgaatttgatgatgtaaatgggaaggttctcacatattctgcccaagatagcatatataaggtgtttgacctgaaaaactatacaatgctatactctatatcagataaaaacgtacaagagattaagatcagtccagggataatgttgctgatattcacgaaactgagtgggcatgttcctcttaagattctttcgatcgaagatgggactgtcctaaaatcttttaatcatcttcttcaccgcaacaaaaaggttgattttatcgaacagtttaatgagaagcttcttgtcaagcaagagaatgagaatcttcagattcttggatgtgcgtaattcggagcaaacagaagttagcagaacagaattatgacgccctcagcgttcatattcctatacgagaaccagttattcctgacattcaggaaccgtacagtggcagtctggaattttagaggggaattggtaacatcgttcgaggaccaccttctatggcatccagactgcaacactaataacatttacattactagtgatcaggatctcatcatttcttactgcaaagccgattctgatgatcctttagaaggaaccgcagggtcgataaatataagcaacatactaacagggaaatgcttagcaaaaataaaagcaagcaacggtgttccattgaagacctgcgattgcagctcaagcagttgtaatggcagaaactgcagcggaggaggaggaaataacagcgcgaggaagaagaggatacaagcatcatcgtcttccagaatgagaagcacggttgcagaagccctagaagacattactgctctcttctacgatgaagaacgaaacgagatttataccggtaatagactcggccttgttcatgtctggtctaattgaaaacacacaacatagtccaccttttgttttgttatgttgagagcgatgacttgtactatttgttttttggtgtagtcaattctacacacccttagtgtaccatttatttttcttgtgttttttcggcttcttttgtaaggcgtgagaaatgttaaatctgttattgtgttcttgtagatgcggttcgtgtaatttgtttattctgggttattttggcccgggaaattagatttg

SEQ ID NO: 5909 - DNA, 1110 bp, Amaranthus tuberculatus
tttgctctttttgagtccgagtcactgaagtggcctggttttgtagagtttgatgatgtaaatgggaaggttctcacatattcagctcaggacagtgtttacaaggtatttgatttgaagaactatacgatgctgtattctatatctgacaaaaatgttcaagaaattaagatcagccctgggatcatgctactgatatttaccaaaggtaccggccatgtaccacttaaaatactttccattgaagatggtactgttctgaaatcattcaatcaccttatccatcggaataaaaaggtggacttcattgaacaattcaatgaaaagcttcttgtcaagcaagaaaatgagaatcttcagattcttgatgttcgcaactcggagttaacagaagtcagtaaaactgattttatgacaccatctgcatttatttttctctatgagaaccaattattcttgacttttaggaacagaacagttgctgtttggaacttccgtggtgagctagtcacttcttttgaggaccatctcttgtggcatcctgactgcaacacaaacaacatatatatcactagtgatcaagatctaataatttcgtattgcaaagctgattctgatgatcccgtgtcagaaggaaatgctggttctatcaatgtgagtaacatcttgacaggaaaatgcttagcaaaaatcagagcagataactgctcagttttggaagatgattgcagttgcagcagcagcagtggtagctcttcaaagaagcgaatcaaagctgctagaatcagaagcacgcctgcagaagctttagaagacatcacagcccttttttacgatgaagaacgcaatgagatatataccggaaacaggcacggccttgttcatgtatggtccaactaagtgttgtatcttcccttagccttcaaatttggaaggctgttcattgtaatcaatatcgccttggacttgtattgataaaaacttgtttttcttatttgattttcgagtggctttcccttacgacacgactaatgtagttgtaagtaactaattggtatgttttctaaaatgaagttcaagcaatacaacttattttgttgcccaaaaaaa

SEQ ID NO: 5910 - DNA, 1146 bp, Musa acuminata
gcacgagaaaagaatatgcttcttgaacataagccctgatgaagtgattagaagcttattttataacaagaataatgattctcttatcacagtgtctgtttatgcatcagatcatttcagttccttgaaatgcaggacaactccaatagaatatatcaggagaaatcagttagatgctgggtatcctctttttgaatctgaatccctgaaatggcctggttttgtcgaatttgatgatgtgaatggcaaagtactgacctattcagcccaggatggcacttacaaagtttttgacctgaaaaactattcgtttctgtactccatatgcgacaaggatatacaggagatcaaaataagccctggcatcatgctgctgatataccaaagaactcagagccatgtaccattaaaaatactgtcaattgaagatggaaaagttttgaaatcttttaatcacttgttacatcgcaacaagaaggtcgacttcattgaacaattcaatgagaagctcctggtcaagcaagaaaatgagaatctgcagattcttgatgtgaggaattcaaatctcattgaagttagcaggaccgagtttatgacaccttctgcattcatcttcctctatgagaaccaccttttcttgacattcagaaataggacagtggcagtctggaattttcgtggagaacttgtcacctcatttgaggaccacctactgtggcacccagattgtaataccaacaacatttacataaccagcgaccaggacctgataatctcttactgcaaggctgaagatggatgcgacgaggagggagaagtgcctactgtcggttctatcaacatgagcaacatccttactggtaagtgcatcgcaaagatatgtccacttgatcctgcactccagatcacgcctcgcaagcgaggagacaacagccggtctaccatccggagcaccatcagagaagcactcgaggatgtcactgccctcttctacgatgaggataggaatgagatctacaccggcaacaagcaaggtttgatccacgtctggtctaattagttagaatgctcaagtatatatatctttttctcctgttgtttgtagctgtaataatcttacattttaaacagttaagcttatcgatc

SEQ ID NO: 5911 - DNA, 1998 bp, Phaseolus coccineus
  misc_feature (1990)..(1990): n is a, c, g, or t
ataagcgttggaaagcggtgagagtgaagagaaaaagagaatccaaattcggatttttgaaacgggatcgacgcccgttgaacaccttgactccgtttctattcttcttcactcagacattcatcatacaacacacacctctccatcgttgcttcccaccgattcacgaaaccctaattttggtggtccctgttacggggagcgaagagttagggttgcattcagctgaggtagccgatgcggcagcttcccctctgaggaaatggaaggtggcaggagaattactgtgagcccacgaccttgctgcggtcgaaggatcgttgctgccaagaagaggccgcgtgcagcggatggtttcgtcaacagcgtcaagaaacttcagagacgcgaaatcagctccaagcgtgatcgcgcgttcaccatgagcgatgctcaggagagattccggaatatccgcttacaggaggaatatgatacacatgatccaaagggtccttcaaccatggtgttaccgtttctgagaaaaagatcaaagattattgagattgtagcagcacgagatattgtttttgctcttgcacaatcaggtgtttgcgcagcattcagcagagagaccaatcaaaggatatgctttttgaatgtcagtcccgatgaagttataagaagtctgttttataacaaaaataacgattcacttatcacagtttctgtatatgcttcagatggttacagttctttgaaatgcaggagcacaaggattgaatacataaggaggggtaaaccagatgctggctttgctcttttcgaatccgagtctcttaagtggccaggttttgtagagtttgatgatgtaaatgggaaggtattaacatactctgctcaagatagtatatacaaggtatttgacctcaaaaactacacgatgctgtactcaatttctgataaaaatgtccaagagattaagatcagtccgggaatcatgttgttgatttttgttaaagcaagtagccatgttccacttaaaatcctttcaatagaagatggtactgttttgaagtcattcacccatctcctttatcgtaataagaaggtagattttattgaacagttcaatgaaaagctacttgtcaagcaagaaaatgagaacctccagattcttgatgtgcggactttttgagctgacagaggtttgcagaagtgaatttatgacaccatctgcatttatctttttatacgaaaatcaattattcctgacgtttcgaaatcgaactgtggccgtgtggaacttccgtggagagcttgtaacttcgtttgaggatcacctcttgtggcatcccgactgcaatacaaacaatatatacataaccagtgaccaggatcttatcatatcctattgtaaagctgattctgatgattcactgtccgaaggaaatgcaggttccatcaacgtcagcaacattttaactggcaagtgtcttgccaaaataagagcaagcaacagctttccagtggataacaattgcagttgctgtggcaatccttcaggaagtggttgttgtaattcaaggaagcgaaaacatggttccaagatgaggagcacagttgcagaagctttggaagacattactgctctgttctacgatgaagagcgtaatgagatatatactggcaataggcatgggctagttcatgtttggtctaactgatgtgctattgaatttactgctgccctctgttttcctgttggattttctttgtgggtaaattggttgttcttatctgctatgagaactttcgggggatgtaactataagtggctttgaatcattaatttttttatccttgtcattcacgccttaggcgagtttgttctgtagttgtaagagatgcatgaaagtgctggtaactcaccggatgttgcttcttctgtaatctatatcttacattaatggagcggcttctatggaatatagcatgtgaattatggtanaaaaaaaa

SEQ ID NO: 5912 - DNA, 1241 bp, Cichorium intybus
tattgtcctttcccttgcagttccggtgtatgtgcagcttttagttagtagtatcccaacaagaggatatgcttcttgaatatttatccagatgaagtcattcttagcttgttttataataaaaataacgactcattaattacagtgtcggtatatgcttccgataacttcagttcactaaaatgccgatcaataagaatagaatacatacaaagagggaaaccggacgaagggtttcctctttttgagaccgaatctttaaagtggccgggatttgtggagtttgatgatgttaatgaaaaggttcttacctactctgcacaagatagcatatacaaggtctttgacctgaagaactacacactcttatactcgatagcggacaaacatgttgaagaaatcaaaatcagccctggtatcatgttactaatattcaaccgcggtcaaagccatgttcctttgaagatactatcaatagaagatggcacggttttaaaagacttcaatcatttacttcatcgaaacaagaaagtcgattttattgaacaatttaacgaaaagcttcttgttaaacaagacaacgaaaatctccaaattcttgatgtacgcaatgcggaagtgagagaagttggtagcacggagtttatgactccatccgcgtttatatttctatacgaaaatcaattatttctaacgtttagaaatcaaacggtttccgtgtggaattttcggggtgaacttgttacatcatttgaagaccatgcattatcacatccagattgcaatactaacaacatttatataacaagtgatcaagatctcattgtttctttttgtaaggcggataatgatcaattgacggatcgaagagctggttctataaatattagtaacatatggacgggaaaatgcatagcgaaaataaactcgagtaatgcgatttcgtgtaaggatgaagagggaagttcatcggtaaatggaaaacgaattgaagtgaatatggttgaagaggcacttgaggacataaccgcgctttattttgatgaagaccgcaatgaaatttatacggggaatagtaacggtttggttcatgtttggtctaactaattaatggtgtgtagttatgttgtgttgtggtgaagaataattacatgtattttaatagttatggatgtggtaagtaaatatatatataggttaatgtgtgtttgatgtttagatgatatagatatgttaaactt

SEQ ID NO: 5913 - DNA, 774 bp, Cichorium intybus
tgatgatgtcatggtaaagtactcacattttcagcacaagatagtatttacaaggtgtttgatttgaaaaactacatgatgttatattccatatcggataaaaatgtccaagaaatcaaaataagcgctggtattatgctcatgatatttaataaagcaagtggacacgtacccctaaagattctctcaattgaagacggaacagatttgaaaactttcaatcatctccttcatcgaaataaaaaggtggattttatcgaacagtttaacgaaaagcttcttgtgaaacaagagaacgaaaatcttcagattcttgatgtgcgtaattctgagttaacagaagttagtaggacagaatttatgacaccatcagcattcatatttttatatgaaaatcagttgtttttgacatttagaaaccgaacagttgctgtgtggaattttcgtggggaattagtgacttcatttgaagatcatttgttatggcatccggattgtaatactaacaatatatacatcacaagtgatcaagatcttattatttcatattgtaaagccgattctgatgatcctttaacacaaggaaatgcaggttcgatcaatatcagcaatattctaacgggaaaatgtctcgcaaaagtaaaggcaaaaaacagcgatggaaatacatcggatgattgtatttgtgtatcgagtggggcccacaaaaggtgcaggtgcaacttaaaacaacggatggcgcgacggaggattacaagctctgttacagaagct

SEQ ID NO: 5914 - DNA, 937 bp, Cynara scolymus
  misc_feature (171)..(171): n is a, c, g, or t
  misc_feature (285)..(285): n is a, c, g, or t
  misc_feature (455)..(455): n is a, c, g, or t
  misc_feature (482)..(482): n is a, c, g, or t
  misc_feature (541)..(542): n is a, c, g, or t
  misc_feature (728)..(728): n is a, c, g, or t
gcgggcagggaattcatcatttgtattaccattcttgatgaaagggcaaaggtcattgaaatagtggcagcacgtggtatcgtatttgcccttgcaagttctggtgtttgtgcagcttttagtagagatacaaacagaggatatgttttatgaatatctttccagatgaantcatccgtagcttgttttacaataaaaataacgagtcactaattacagtatccgtatatgcttcagacaacttcagttcactgaaatgcagatcaacacaaatagaatacattnaaagaggcaaaccagatgctggttttcctctttttgagtccgagtccctgaagtggcctggctttgtggagtttgatgatgtcaatgggaaggtacttacctactctgcacaagatagcatatacaaggtctttgacctgaagaattatacactcttatactctatagcngacaaaaatgtagaagaaatcaagatnagccctggcatcatgttattgattttcagtagggctctgagccatgttcctcttaagannctatcaatagaagacggcacagttctaaaagatttcaatcatttacttcatcggaataagaaggtggattttatagagcaattcaatgaaaagcttcttgttaagcaagaaaatgagaatctccagattcttgatgtacgcaatgctgaggtaaaagaagttggtagaacagaattcatgaccccntccgcatttatttttctgtatgagaatcagctgtttctaacatttagaaatcgactgttctgtttggaacttccgagagagctgtgacatcgtttgaggatcatgtactatggcattccgactgcaataccaataacatatatataactagtgaacaagaccttataatttctttctgcaaggatgattcagatgatcaatggactgat

SEQ ID NO: 5915 - DNA, 792 bp, Elaeis guineensis
gtatcaggcctctgtgctgcttttagtcggacaacaaacaaacgtatttgcttcttgaacatcagcccagatgaagtgattagaagtctcttttataataagaacaatgattcacttatcacagtgtcagtttatgcatcggaccacttcagttccttgaaatgcaggacaactccaatagagtacatcaggaggaatcaattaaatgctggattccctctttttgaaacagagtctcttaagtggcctggttttgttgaatttgatgacgtaaatggcaaagtactaacatattcagctcaggatggcatctacaaggtttttgacctaaagaactacaactttttgtactcaatatcggataagaatgtgcaggagataaaaatcagtccaggaatcatgctgttaatattccaaagaactcctggttatgttccattgaagatactctcaatcgaagatggaacagttttaaaatctttcaatcacttattgcatcgcaataagaaggttgactttattgagcagttcaatgagaagcttttggtcaagcaagaaaatgagaacctccagattcttgatgtgaggaattctgtgttaactgaagttagcaggactgagttcatgactccttcagcattcatctttctgtatgagaatcatcttttcttgacattccgaaacaggacagttgctgtatggaatttccgtggagagctggtcacctcctttgaagaccatttgctgtggcatcctgattgcaataccaataacatctacatcaccagtgac

SEQ ID NO: 5916 - DNA, 2122 bp, Arachis hypogaea
tgagcagtatagtggagtcagattcgaaatacggaattttgaaaaaggggatcgaaagagagaagacgacccattgaattcgtggactcacttcccgattcttcatctccttccttccctcactcactctcacacaacaacaacatactcactcgccaaaaccctaacccttttcttttacccctttctggctttcttctttcaacggacctgagatcttagggttccttcttcctggctctacatgttgtagcggaaaccgcgttttccccgaatcatcgctgtgttcctccaattcacggtgatgtgcgaatttggggttcgattattctgagaaaaaaaataaagaaagagagggagtgagtgtgctggtggtggtgatatggaaggtgggaggaggattacggtgagtccaagaccatgctgtgggcggagaatcgtcgcaaagaagaggccgcgtcgtggtggcacggtggatgggttcgtaaacagcgttaagaagcttcagagacgtgaaatcagctccaagcgtgatcgcgctttcagcatgagcgatgctcaggagaggtttcggaatatccgcttgcaggaagaatatgatacacatgacccaaaaggtccttcgtctgtggtattgccctttctaaggagaagatccaagattattgagatagtagcagcacgggatattgtttttgtctcttgcacagtctggtgtttgtgcagcatttagccgagagaccaatcaaaggatatgtttcttgaatgtcagccctgacgaagttataagaagtctgttctacaacaaaaacaatgactcgcttatcacagtatctgtctatgcatccgacagttacagttctttgaaatgcagaagcacaaggatagaatacattaggaggggtaagccagatgctggatttgctctttttgaatctgagtctttgaagtggccaggttttgttgaatttgatgatgtaaatgggaaggtactcacatactctgcacaagatagcatatacaaggtatttgaccttaaaaactatacaatgttgtactccatttctgataaaaatagtccaagagattaagatcagtccggggatcatgttgttgatttttgctaaaacaagtagccatgtcccgctgaaaattctctcaatagaagatggtactgtcttgaaatcattcaaccatctcctttgtcggaataagaaggtggattttattgagcagttcaatgaaaagctacttgtcaagcaagaaaatgagaaccttcagattcttgatgtgaggactttcgatctaacagaagttagcagaagtgaatttatgacaccatctgcctttatctttctctacgagaatcaactattcttgacatttcgaaataggactgtggctgtgtggaacttccgtggtgagcttgttacttctttcgaggatcacctcttgtggcatcctgactgcaatacaaacaatatatatataacgagtgatcaggatctcatcatatcctactgcaaagctgattctgaagattcattgaccgaaggaaatgcaggctccatcaatgttagcaacatcttaactggcaagtgccttgccaaaataagagcaagcaatagcttcccaattgagaacgaatgtagttgcggtgatgattgttcgggtagccgttgtaactcaaagaagcgaaagcattcctccaaaattaggagcacagttgcagaggccttggaagatattactgccctcttctacgatgaagagcgcaatgagatctacacgggcaataggcatggtctagttcatgtctggtctaactgatgtattgttcaatttattgttggcttgcgctttcctattggtttttgttcatgagtacgttgattgcttaatctactattagaactttcggcagctgtaacctttaagtggtctttgtatcattcaatttttcccccacttatttttaaatgtcatctacgcgttaggtaagtttgttatgtgtagtggtaacaaatgtctattaagtcatgtcccatgctggtaactcgccggatgttgcatttgttgtaatctatatttctaatatttacttcaatagagcggcttctgt

SEQ ID NO: 5917 - DNA, 1959 bp, Cajanus cajan
ttttatgaaatacgatccacagcaaagatgttttgttgaagtggtgagaatggaagaaaagaggcgtggaggttggtgtggtcgacgagtagtggcaagcaaaagagggagtagtgatggcaatgtctccgacaatggctccaacagcagaagcagcaacatcagtgtcatcaagaagcttcaaagccgcgagatttcttcgaagcctcatcgtgcttttgcttctgccactgtttcccacagattccgcaccatgcgcttgacgcatcaatatgacactcatgatccctccaaggctcgctcttcccttttgcccttcttgatgaaacgaactaaagttgtcgaaattgttgctgccaaaaacgtggtattcgccctttaccattctggtttgtgtgcagcttttagtagagtaacgaatgaaaggatttgctttttgaatgtctgccatgatgaggtcatccgcagcctcttctacaataagaacaacgactcacttataacagtatctgtttatgcttctgagaatttcagctctttgaaatgcagatccacaaagattgaatacatacagaggggcaaaccagaagctggatttcctcttttccaatctgaatctttgaaatggcctggatttgtagagtttgatgacgtcaatggaaaggtcctgacttactctgcacaagatagtatttacaaggtctttgatcttaaaaactacaccatgctatactcgatttcagataggcatgttcatgaaatcaagatcagtcctggcatcatgttattaattttcaatagaaccagtggtcacattcccctcaagattatatccattgaagatggcacagttctcaaagcattcaaccatctacttcaccggaataagaaggtggacttcatagagcagtttaatgaaaaacttctagtcaagcaagaaaatgagaaccttcagattcttgatgttcgaaatgctgagctgatggaggtaagcagaaaggtgttcacgactccatccgcatttatcttcctgtacgagaatcagttgttccttactttcagaaatcgaacggtttctgtttggaacttccgtggggagcttgttactacatttgaggaccaccagttgtggcatacagactgcaatacaaataacatatacataacaattgatcaggatctcattatctcttactgcaagccagattctgatgaccaatggatggaaggcaatgctggatccattaatgtcagcaatatcttgaatgggaaatgtgtggctaaaattgatgcacgaagtagcagcatgaaggctgaaaagtgcagcagtagtggttgcagcatctgtgagcaaagtcattcatccctattaaggagttcagttgcagaggctttggaggacatcactgccctattttatgatgaagatatgaatgagatatatactggtaacagacatggtcttgttcatgtatggtctaactaatgacaagagattcctgtttcttctggctccatggtccaaggaatcccaagtttgggttttgcttttgctgatcggataatttcagcattgtaatgtataacattagttgatgtgaaactattacgtagcactctacagtggtggatttcatagtttgtgtagatataaaccagttagttaaatagtgtattatctaagccttttttggtttgagtttttagcctttttttagaggtttgatcttctagtttctgtatagtaaaatcaccaccgaaaatgagggagatgagacatatatattccttgtattagtttgtcctggaattcatagaggacatgtcatgagggttagaaaaaaaagggcagattgtatggagtttatatctcatatatctatactactggcgtagatttcactataatggagacctctattgttatgatgttattttgacacaatggaatattgagta

SEQ ID NO: 5918 - DNA, 1732 bp, Helianthus annuus
ctatacttctcttcccggaggaaaacgatcaccaatctccgtcgcaatcagtggctgcttctgctactactgctccacaattccaattcagcactccaatcgaacatcagttgatgagaccacatggacgcgattggcagcagcagcggtggtagcagaaaccggaggattacgacgtcaagcagcgccggtaacggcggtagtaggtcaccgttgtgcggtggtcggaggagagtggttgctacgaagaatgatggatggagcaacccgttgttggcgaataataccgtgaagaagcttcagcgacgtgagattacctcaaatcggcatcgttctggtgctattactaagtccgttcaccggtttcggaactttcggttgacggagagatacgatatgcatgatcctgtgggacaatgttcgttggtattaccattgttgatgagaagagcaaaagtgatcgagatagtggtggtacatgatatcgtctttgctcttgctagttctggtgtttgtgcagcatttagtagaggtacaaacaagacgatatgtttcttgaatatctatccagatgaagtcattcggagcttgttttataacaagaataacgactcgctgattacagtgtcggtatatgcttcagataacttcagttcattgaaatgccgatcgataagaatagaatatatacaaagaggcaaacccgatgaaggctttccgctttttgagaccgagtctttgaagtggcctggatttgtcgagttcgatgatgttaacgaaaaggtgcttacctactccgcacaagatagcatatacaaggtctttgacctgaagaactatacactgttatactcgataaccgacagacaggttgaagaaatcaagatcagtccgggcatcatgttactgatattcagtaggggtcagagccatgttcctctgaagatactatctatagaagacggcacggttctaaaagatttcaatcatttacttcatcggaacaagaaggtagattttatcgagcagtttaatgaaaagctgcttgttaagcaagacaacgagaatctccaaatacttgatgtgcgcaatgctgaggtcaaagaagttggaagcacggagtttatgacaccgtcagcgtttatttttctgtatgagaatcagttatttctaacctttagaaatcagactgtttcggtttggaactttcggggggaacttgttacatcatttgaggaccatgttttatcgcatccagattgcaatactaacaacatctatataactagtgatcaagatctcatagtttcattttgcaaggctgataatgatcaggcgactgatacaagagctggttctataaatatcagcaacatctggactgggaaatgcatagcaaaaataaactcaagcaatgcgatgccgtcaaaggatgaacaagaaggaagctcgagcaacaaaaggcaggttgaagtgaacatggttgaagaggcactggaagacataacagcgctttactttgatgaggaacacaatgaaatctataccggtaacagtaacggtttggttcatgtgtggtctaactgaagtattaataggtatgcccgttctaagtatatatagtaatgtatgtgcgcgggctctttaagacttgatatatatatgtgtaggagtgtgtctaaatcgagtatgcagatttataatgtttgagttgcagaaatgactaataagt

SEQ ID NO: 5919 - DNA, 1302 bp, Sequoia sempervirens
agcaccaattcacaggagaggttccggaattttcagttgcaggaagagtttgatacttatgatcccaaggcaaatggttttactttcaaggttgcagttcctaaataagagatcaaggatcatagaaatagttgcagctcgagatataatatttgctttggcacagtctggtgtttgcgcagcattcagtagagagacaaacagaagggtttgcttcttgaatataagtcccgatgaagtgattcgcagtctgttctataataagaacaatgattctcttattactgtgtcagtctatgctttggatagctacagttctctgaagtgcagaacaacaccaattgagtatattaggagaggtcaacctgatggaggttttcctttatttgattccgagtcactaaggtggccaggttttgtagagtttgatgatgtgaatgggaaagtactgacattttctgcccaagatggtgtttacaaggtgtttgatttgaagaactatacacttctgtactcaatatctgataaaaatgttgaggagataaagatcagtccaggtataatgctgttaatatttaaaaaatcttccagtggaagtcacgttcctttgaagatctcaaatatagaggatggcactgttttgaaatcctttaatcacctattacatcgtaataaaaaggttgacttcatcgagcagttcaatgagaagcttcttgtaaagcaagaaaatgaaaatctccaaatacttgatgttcggaatacacagttgacagaagtgagcaggacagagttcatgactccatcagcttttattttcttgtatgagaatcagttatttttgacatttcgtaatcgagctgttgctgtatggaatttccgaggagagctagtaacatcatttgaagaccacttgttatggcatcctgattgcaatacaaataacatttatatcactagtgatcaagatttgatcatctcttactgcaaggcctatcctcaaggatgtgatgaaaaaaatgcaggctcaataaacataagcaacatcttgacagggaaatgccttgctaagattcgtgccaacgatccgaatgtatgtgtaagctctcgcaatcggcccaatgcatcggtaatccaaagcactgttgaagaagctcttgaagatattacagcattgttctacgatgaggaaagaaacgaatttatacgggcaacagacaggggttgatacatgtctggtcaaactgactgaggtccttgaaacaatcttgatatcaattagaaagtgacacatactgtcatttg

SEQ ID NO: 5920 - DNA, 1771 bp, Amorphophallus konjac
ggaggaggagggggtgaggttgtggtgggatggagaaccacaagaggtcgctcctgcggatgagggtccgggtgacggcgaggaagcgggggcgggaggtcaacgcctgcggcggctcctcctccgggaggaagcgctcggggcgcggctgcgtcaacaactcggtgcggaagctccagcgccgggagatcggcgggtttcctaggattgcccgggggagctcctccaatgcccccgagaagttccgcaacgtccaactccaggaagagttcgatacttatgatcccaatgctcattggtttctaagactacagtttcttaagaagagatccaagataattgaaatagtttcagcaaaggatgttatctttgctttggcgcagtctggtctatgtgctgcttttagccggaccacaaacggacgtatttgtttcttgaacataagtcaagatgaagtcataaggagtctcttttataacaagaacaatgactcattgatcactgtgtcagtctatgcatcagatcacttcagctctttgaagtgcagaactactccaatagagtatattaggcgaaatcaacttgatgctggatttcctctcttcgagacagagtcactcaagtggcctggttttgtagaatttgatgatgtaaatggaaaagtactgacctattctgcccaggatggcatttacaaggtctttgatctgaagaactactcctttctgtattcgatatctgataaaaatgtacaggagataaaaatcagcccaggtattatgctattaatattccacagagctcctggttacgttcctctgaagatactttctattgaagatggaaccctgttgaaatcgttcaatcatttgttacaccgtaacaagaagattgattttattgagcagtttaatgagaagctgttggtgaaacaagaaaatgagaacctgcagattcttgatgtgaggaattcagagttgacagaagtcagcaggacagagtttatgactccgtctgcattcatcttcctttatgagaaccacctgtttttaacatttaggaataggacagttgctgtctggaacttcaagggagagctggtcacgtcctttgaggatcacctgctgtggcacccagactgtaatactaataacatatacataaccagtgaccaggacctgataatttcctattgcaaggctgaagagggatgtgaagatgagggagaagtttctgcagtgggttccatcaacatgagcaacatccttacaggcaaatgtattgcaaagatatgctcaaatgacacagccctacagattaaccctcgaagcaggaacgcaaccggtcgatcctacatccgaagcaccgtcagggaagcacttgaggacgtcaccgcgctcttctacgacgaggaccggaatgagatctacacaggcaacaagcagggtttgatacatgtctggtccaactgacggttcgtcacagatagatctttgtggcattcagagagtggctcttgtatatgaatacatttcggtgcttgtggaatcagtcggcttcctcatgattttgtataatgcatgcatgtagagtattggcaccccatctaaaagccttctttcattactggggcgattgttgttattgtaaagtgttaaaactttcacaggagtcaaaattacttacaacctgcttggtaagacagaagttcgtgttggcccctacttttgcgtgaagtttatgttgccatgccaacaatggtggatgttgg

SEQ ID NO: 5921 - DNA, 1726 bp, Arnica chamissonis
ctattcaaatcaaaaccctctctcaaatctcaattcaactcaatcttcttcttattatattctgaaattcagaagatcatcatctagctagtagtaatcagctgtagcggcttctgcttgctggaattccaattggaaaatcaatttcggactacttacattctggatgagcggcaccggaagggttgtttggtagtggtggtggaggcggcggcagctcgagaattacgatggagagcagcagcggtagtggtagtagcaggccgccctacggtggccggaggagagtggttgctaccaagaagcgtgactgggccaactggctgttggtcaacaacagcgtcaagaagattcatagacgtgaaatttcttccaaacgacgccgttccttctccattaccaattccttcgaccgctttaggaacatccggttgacggaacaatatgatactcatgatcccaagggacaatcgtcatttgtattaccattcttgatgaaaagggcaaaagtcattgaaatagtggcggcacatggtatagtatttgctcttgcaagttctggtgtttgtgcagcttttagtagagatacaaacaagaggatatgcttcttgaatatctttcctgatgaagtcatccgtagcttgttttacaataaaaataatgactcgttaataacggtttctgtatatgcttcagacaatttcagttctctcaaatgcagatcaacaagaatagaatacatacaaagaggtcaaccagatgctggttttcctctgtttgaatcagagtctctgaaatggcctggttttgtggagtttgatgatgttaatgggaaggtgctcacatattctgcacaagacagcatatacaaggtctttgacttgaagaattatacattgctatactctatagaagacaaagatgtagaagaaatcaagatcagtcccgggatcatgttattgattttcactagggctcaaagccatgttcctttaaagatactatcaatagaagatggcacagttttaaaagattttaatcatctacttcatcggaataagaaggtggattttacagagcaatttaatgaaaaagcttcttgttaaacaagagaaatgagaatctccagattcttgatgtacgaaatgcggaagtaatagaagttggcagaactcagttcatgactccatctgcattatttttctttatgaaaatcagttatttctaacattcagaaaccaaactgtttctgtttggaattttcgaggagagcttctgacatcatttgaggatcatgagttatggcatgcggactgtaatacaaataacatctatataacaagtgatcaagatcttataatttctttctgtaaaggcgactcaaatgatcaaagaacaagtgggaaagccggttctattaatatcagcaacatatggaccgggaaatgtgtagctaaaataaactcaagaaacgcgattcttaatgaaaataagaagcaaaagatgattgcaagtcatatggttgcagatgcacttgaagagataacagccctttacttcgatgaagaacgcaacgagatttatactggtaataatcgcggtttagttcatgtttggtcaaactgaagactacaaaagatcagtagctttaattaaacagaatcaagtgtgtatgatactaaatatgattggttttaggctttgtggagtgtgcagcagatgtggt

SEQ ID NO: 5922 - DNA, 955 bp, Cirsium arvense
cttttaatatgtgtgatgctcaggagaggttcagaaatattctattgcaggaggagtatgacacccatgatcctaagggacactgctctacggtactgccatttcttaagaaaaggtcaaagattattgagattgtagctgctcatgatatagtatttgctcttgcacaatctggagtatgtgcagcattcaaccgagaaactaacaagaggatatgctttctgaatgtcagtcctgatgaagttataagaagcttgttttacaataaaaacaatgattcactcattacagtttctgtatatgcttcggacagctttagttccttgaaatgtagaacgacaaggatcgaatacataagaagaggtcaaccggatgctggttttgctcttttcacatcagaatctttgaaatggcccggctttgtagagtttgatgatgtaaatgggaaggtactcacattctccgcacaagatagcatttacaaggtgttcgatttgaaaaattatacgatgctatactccatatcagataaaaatgtacaagagatcaaaataagtcctggaatcatgttgttgatatttaataaatctagtggccatgtccctctaaagattctctctattgaagatgggactgttttaaaatctttcaaccatctccttcatcgacataaaaaggtggattttatcgagcagttcaatgaaaagcttctcgtcaagcaagaaatgagaatcttcaaattcttgatgtacgcaattccgacctaatagaagttagcaggacagaattcatgactccatccgcattcatctttctgtatgagaaccagttatttctaacattcagaaaccgaactgtggctgtatggaacttccgaggggaacttgtgacttcttttgaggatcatttattgtggcatcccgactgcaacactaacaatatatacatcacaagt

SEQ ID NO: 5923 - DNA, 1494 bp, Flaveria ramosissima
tttttagcgtttgatttgtgttgttgcgagatagaggggtggtgaaaggggagacgatggacggaaggaggataatggcgagagcacgctttccactgggcggagggtggtggcgaagaagcggcagcgtggtggcgctgatgggttttgaatagtgttaagaagcttcagaggaaggagatttgctccaaacgagatcgttctttcagtatgtgtgatgctcaagagagattcagaaacatacgcttacaggaagagtatgatacccacgatccaaagggacattgctctacggtgttgccatttcttaagaaaaggtcaaaaattgttgagattgtagctgctcgtgacatagtatttgctcttgcacaatctggaatctgtgctgcatatagccgagagactagccaaaggatatgttttttgaatgtcagtcctgatgaagttataagaagtttgttttacaataaaaacaatgattcactcatcaccgtttcagtctatgcatcagacagtttcagctccttgaaatgtagaactactggaattgaatacatacgaaggggcaagccggatgcaggttttcccctttttgagtcggagtctttaaaatggcctggttttgtggagtttgatgatgttaatggcaaagtacttacattttctgcacaagatagcatctacaaggtgtttgatttgaaaaattacatgatgttatattccatatcggataaaaatgtccaagagattaaaataagccctggaatcatgttgttgatttttaataaagctagtggtcatgtccctctcaagattctttccattgaagatggaactgttctgaaaacttttaatcatctccttcatcgaaataagaaggtggatttcattgaacagtttaatgaaaagcttcttgtcaagcaagagaacgaaaatcttcagattcgtgatgtacgtaattctgaattaacagaaattaacaggacagaatttatgacaccatcagccttcatatttctctatgagaaccagttgttcttgacattcagaaacagaacagtggctgtctggaacttccgtggcgagcttgtgacttcatttgaagatcatttgctatggcatccagactgcaacactaacaacatttatatcacaagtgatcaagatcttatcatttcttattgcaaagctgattcagatgattctgtagcagaaggaaatgcagcaggttccatcaatatcagcaatattctaacaggaaaatgccttgctaaagtaaaggcaatggatggtgcagcagtcaatgaatgcatttgcagtgagattatcaaatctagtggtagaagatgcaggtgtaactcaaagcagcgggcccagggtaggaggatcacaagctctgtttcagaagccctggaggacatcactgccctcttctatgatgaggagcgtaatgagatttatactggtaataggctcggtttagtccatgtctgg

SEQ ID NO: 5924 - DNA, 1969 bp, Pinus pinaster
atgggagggaaattcgcctaaattatcctattcgaaatttagatcggggaagagtggcgattgcgtataatatttctgtggaaaaattgtttcttccatgtaatcggaccgctagtttctcgcaaatttgaaacagacactaccctgccctttcagcagggcctgccgttacagatttttactgtaattgcagctcgggcagccattaaatctattgaaaacccttgctgaatcgaggggttatgttcggaggcagtgtttgttgagatttagacgaaagagagaatggacgggaagaaaatttctgcgagtccgcggccaagttttggccgtcgcgtggtggccggaaagcggcgacgggtagatgactgtcacaactgcgtgaagaagcttcagagacgggagatcggttccatcggcaacagggccttcaacagcactaatgcgcaagaaaaattccggaattttcagctgcaggaagagtttgacacctatgatccaaaagcacactggtttttaaagttgcagttcttaaagaagagatccaaaatcatagaaatagttgcagcacgggatattatatttgctttggcacagtctggtgtttgtgcagcatttagtagagagacgaatagaaaagtttgcttcctgaatataagtccagatgaagtgattcgcagcctgttttataacaagaacaatgagtctcttatcactgtgtcagtttatgcttcagataacttcagctcactgaaatgcagaacaacaccgattgaatacattagaaggggcaaaccagatgcaggttttgctttattcgagtcagagtcgttgaagtggccaggttttgtagagtttgatgatgtaaatggaaaagtccttacttattctgctcaagatggcatctacaaagtttttgatttgaagaattatacaatgttgtactcaatatctgatgaacaagttcaagaaataaagataagtccaggcataatgttattaatatttgagagaacttctggtcatgttccactgaagatcttatccatagaagatggtacagttttaaaatccttcaattttttgttgcatcgcaacaaaaaagtggatttcattgagcaattcaatgaaaagctccttgtaaaacaagaaaacgagaacctccaaatactagatgttcggaattcacacatgactgaagtgagcaggacagagtttatgacaccgtcagcctttattttcttgtatgagaatcaattatttttaaccttccgcaatcgcactgttgctgtttggaatttccgaggagtgctggtgacatcttttgaagaccacttgttatggcatcctgactgcaatacaaataacatctatatcaccagtgaccaagatttgataatttcttattgcaaggcccatcctgatggatctgatgaagaagaaaatgtgggctccataaacatgagcaacatcttgactggaaaatgtcttgctaagattcgtgcaaatgatccaaacgtaaggattagtcctagaaatcggccaaatgcatcggcaatcagaagcactgttcaagaagctctcgaagacattactgctcttttctatgacgaggagagaaatgagatctacactggcaatagacatggtttaatacatgtctggtcaaactgatcagtttgttttaaaattggaaatccagtcaatcattcaaagcacgtttgaatgttaatgtagtagttatgatggttgccgggcataagaaatatggcagctgtgaatgtcatcaattccactaagttttggagatgtctgatctataatcgcacaatgtttggctggttctgtattttaggtcttttagttctttgttattttgtaagagctgaatcgttacagtagcatgcacccatccttgagtgtttattttactaccataggatcaaatcactaagcacaattgtgttgg

SEQ ID NO: 5925 - DNA, 463 bp, Lippia dulcis
gatcagtcctggaatcatgcttttgatattcacaaaaagccaaggcgcgtccccttgaagattctctcaattgaagatgggactgttttgaaatcgtttaaccatcttcttcatagaaacaagaaggttgatttcatcgaacagttcaatgaaaagcttctagtcaagcaagagaatgagaatctccagattgttgatgtacgcaatgttgagataacagaagttagccggactgagttcatgaccccttctgcattcatatttctatatgagaaccaattattcctgactttcagaaaccgcacagttgctgtctggaacttcagaggggaacttgtgacctcatttgaggatcaccttttatggcatcctgattgcaacactaacaacatatatatcacaagtgatcaagatctcatcatctcgtattgcaaagcagattctgatgaaccgttatctgatg

SEQ ID NO: 5926 - DNA, 1410 bp, Plantago ovata
gagagattagagagagagtgtgaaatctcaatccctaatcaaaggagggaaattcaattaggtttcgtttcttgctcctctgtttgaaaaaatttcagcgtcaattttaggcggtaaaccagaatagactcgccaattaccattcccttcggcttcgccagatttagggtttcactcctcatccccacctcactcatttcccagttcatgtgtgcctaattttgctggatttgtgcataattcattttcgctagggtttgatttttagtggtcgagatggatgggaacgggaatgggagtgggaggaggattacggcgactccacggccgtgtaatggtcggcgagtggtggcgaagaagcggccgcgtggtgctatggatgggtttgtgaacagtgtgaagaagctgcagaggagggagatttcagccaagagggatcggtcctttagcatgagtgatgctcaggaacggttccgtaacattcgattgcaggaggaatatgatactcatgatcctaagggacacagttctttgacattaccatttctgaaaaggaggtctaagataatagagatagttgctgctcatgacatagtgtttgctcttgcgcaatcaggcatatgtgcagcatttagccgagagaccaatgagagcatatgcttcttgaatgttagccccgacgaagtcatccggagcttattttacaacaaaacaatgattcactcatcactgtttctgtctatgcgtcagataattttagctccttgaaatgcagaaccacaaggatcgagtacataagaaggggtaaaccagatgccggtttcccacttttcgagatggagtcattgaagtggcctggctttgtggaatttgatgatgttaacgggaaggttcttacttattctgctcaagatagcatatacaaggtgttcgacttgaaaaactatacaatgctgtattccatttctgataaaaatgttcaagagatcaagatcagtccaggaatcatgttattgatattcacgaaaacccaaggtgctgttcctttgaagattctctcaattgaggatggtactgtcctaaaatctttcagccatctccttcatagaaacaagaaggttgatttcattgaacagttcaacgagaagcttcttgtcaagcaggaaaatgagaatctccagattctagacgtacgtaactctgagataaccgaagttagtaggaccgagttcatgaccccttcggcgtttatatttctgtacgagaatcaattgtttctgacattcagaaaccgaactgtcgctgtttggaactttagaggggagttagtgacgtcatttgaggatcacctattatggcatcctgattgcaacaccaacaatatatacattacaagtgatcaggacctca

SEQ ID NO: 5927 - DNA, 1691 bp, Pteridium aquilinum
cttctcgttttctacagagggcgtcgacccgcaacttcgccatagccgcttccttgcaggtgcctcttctcctcttcatcgaggtccctgtacagccttccgcagacagtctcattgaagctttctgtatacagcttctttgctggttcgctcttggatgatggctctggtgtgcttgcggaggctactccatcgaacattgatccgccttgtggatcagagacagagagttctccatagccgattgtaacactgacctggctattctgtctgcacgggtgcaatctagagcaagaacagactgacttacatgatttgactcgtgcttatatcatagttctttggagagcctttgcctcagtagaggcgcttcttgtctctgctacatagtctcaatggaaagcaagaagaagatttcaagcagcccaaggccttcttgtagccggcgtattctcgcaggaaagcgggcatgcccatttgattcttcatctaattgcactaagaagctcttcaggcgcgagatcagtgcctcaggaaaccgcacattcaactgcactaatgcccaggagaagtttcggaactttcagctccaggaagagtttgatacctatgatccaaaaggaaactggtttcttcagctcaattttttgaaaaagcgatcaaagataaccgaaattgttgctgccagagatgtggtgtttgcattggcgcaatcaggagtctgtgctgcgtttagcagggagactaataaaaagatatgctacctgaatatcaaccctgatgaagttattaggagtcttttctacaacaagaacaatgactctcttatcacggtctcagtttatgcttctgatcatttcagcaccctgaaatgtcggacaacacctatacaatacattcgcagaggacagccagatgctggctttggtctttttggatcagagtcattaaaagtggccaggctttgttgagtttgatgatgtgaacggcaaagttctcacttactcggctcaggatggaatttacaaggtatttgacttgaagaattacactcacttgtactcgatatcggatgagcatgtctcagaaatcaagataagtccaggaataatgctactgatctatgaaagatgtgctagtcatgttcctttaaaaatattgtcaattgaggatggcactgtactcaaggacttcaagcatcttctgcacagaaataagaaggttgattttattgagcaatttaatgagaagctactggtgaagcaagacaatgaaaaccttcagattcttgatgtaagaaattctcaactaactgaagttagcaggacagagttcatgactccttcagctttcatattcttgtatgaaaatcagctatttctgacgttccgcaacaggactgttgtcgtttggaacttccgtggggaacttgtgacatctttcgaagatcacctgctgtggcatccagactgcaacacaaacaatatatatattaccagtgatcaggatttgatcatatcgtattgcaagtctcatccccaggattgtgcagaggaggagagagttggctcaatcaacataagcaatattctgactggtaaatgtcttgcgaaaatatgtgcaaccgactcaaatgtgaagattagcccaagagagagagtgaactcctcccctgtaatgagtactataag

SEQ ID NO: 5928 - DNA, 924 bp, Artemisia annua
cgtgtctctactgtaacagacaaagatgtagatgaaatcaagatcagccccgggatcatgttactgatttacaaaagggctcaaggtcatgttcctctgaagatactatcaatcgaagatggcacagttctaaagaattttaatcatctacttcatcggaacaagaaagtggattttatagagcagttcaatgaaaagcttcttgtaaagcaagatgatgagaatcttcagatacgtgatgtacgcaatgctgacgtgaaagaagttagtaaaaccgagttcatgactccatctgcatttatttttctatacgagaatcagctgtttttgacattcagaaatcgtactgtttctgtttggaacttccgaggagagcttgtgacatcatttgaggatcacgagttatggcatgcagactgcaatacgaacaacatctatatcacgagtgatcaagacgttataatttctttctgcaagagtaacttaaatgatcaatggactgatgagaaagctggttcgattaatatcagcaacatatggacgggaaaatccgtagctagaatcaactcaagcaatgcagttctgagtgaagatgtaaataagaagcaaaaaatgattggtggtaacatgattggagaggcacttgaagacataacagccctatactatgatgaagagcgaaacgagatttatacaggaaatggccatggtttggttcatgtttggtctaattgaataccataagagattaataggtgatgccacgttaagttaatagcttaaagtgtgtagattatgaagtgtgaatggttttaggtcaccaagttgattatgtgaagatatagggtttggtgtttgagttggacgattgtttcatgttcttactggtatttaatgtgaataaatggctaaagtttttccggt

SEQ ID NO: 5929 - DNA, 1060 bp, Citrus sinensis
gataacgggtccggaaattccccgggtcgcccacgcgtccgatcaaattagatccgggcatcctgttattaattttcaatagatctagtagtcatgttcctctcaagattctatctatagaagatggcacagttctcaaggtcttttatcatctgctgcatcgaaataaaaaggtggacttcattgaacaattcaatgaaaagcttcttgtctagcaagaaaacgagaatctcctgatccttgatgtacgaaatgctgagctgatggaagttagcataactgaattcatgactccatcagcatttatctttctgtatgagaaccagctgttcctaacgttcataaatcaaactgttgctgtatggaattttcgtggagaacttgtaacttcatttgatgatcacctgtattggaatcaggactgtaacacaaataaaatttattataacaagggatcaggatattattatttcttattgcaaggataaacctgaggaatcaaagggatgaaaggaaatgttggatcattcaatggcaatcaataatttgaagtggaaaaatggcaggacaaaaaaaaaggcaaaaaaattaacaaaccaaaggtagatgagaaattataaaagacaataatcgagaagttaaaaaaatttaaaataaaatctcctatataacaaccgcgggtaggaaaaaggccttgaaagaaattaatttcctattttttcaatttaaaaaatcaatgaaatactaaaccccgataattaaacatgaagtttgctaatttatggggttattattaaattcactaatatattagaaaaaaagatggttcatcgtagatttatgggatagattaggttgtatactaagaataaatatgtttttgttttttgtttatttttaaacaaaacataaagatacataacattttgacatttccttgttagataaaaacatatacctaatatatataaaatgtcaaatttatgattttagataattacctctctctaatttagtaataaataagatattctatatattataagatctcattataaga

SEQ ID NO: 5930 - DNA, 1585 bp, Lactuca sativa
gagacgacgagatcgggagtataagcaatgtgactgtgggcttcatactttaccaattttattaatacaagtaatcgggaagattcgcctttttcgtcgtttcgattcaaatccattcaattatatgattctttgaaatctagtagcattcagaagatcatcatctactcagaactaatcaactctcgcggcgtatacttcctggaattccgattgcaaaaatgtgttttcaatacctagattcttaatgaaggggaatacaagggtttggtagtggtactggtactgctactgacagcagcagcagaattatgatggcgagcagcagcggtagtggtggtagtaggccgccgccacactgcggtggtcggaggagagtggttgctacgaagaagcgtgactggaccaactggctctccgtcaacaacagcgtcaagaagattcaaagacgtgagatttcttccaaacgccaacgttccgtttccatcagcaattccgtccaccggtttaggaacatccgcttgacggaacaatatagtacccatgatcccaaggaaagttcatcatttgcattaccattcttgacaaaaagggcaaaagttgttgaaatagtggcaggacgtggtatcatattcgctcttacaagttctggtgtttgtgcagcttttagaagagatacaaaaaagaggatatgtttcttgaatatcttcccagatgaagtcatccgcagcttgttttacaataaaaataacgactcattaattactgtgtctgtatatgcttcagacagtttcagttcactcaaatgcagatcaacaagaatagaatacatagaaagaggcaaaccagattctggttttcctctttttgagtctgaatccctcaagtggcctggctttgtggaatttgatgatgtcaatgggaaagttcttacctattcagctgaagatagcatatacaaggtgtttgacttgaagaattatacactgttgtactctgtagcagacaaaaatgtagaagaaatcaagatcagccctggtatcatgttattgatttacagtagggctgcaagtcatgttcctcttaaaatactttcaattgaagatggaagtgttttaaaagatttcaatcatttacttcatcgaaacaaaaaggtggaattcatagagcaattcaacgaaaagcttcttgttaagcaagaaaatgaaaatctccagattcttgatgtaagaaatgctgatgtgaaagaagttggaagaacagagttcatgacaccatctgcattcatatttctatatgagaatcaacttttttttaacatttagaaaccgaagtgtttctgtttggaatttcaaaggagagcttgtgacatcatttgaggatcatgtgttatggcatccagattgtaatactaataacatctacataactagtgatcaagatcttataatttccttctgcaaacctactgattcagatgatcaatccactatttatggagatggaaaagttggttcgattaatataagtaatatatggactggaaaatgtgtggctaaaataaactggaggaatgcgtgtttaa

SEQ ID NO: 5931 - DNA, 2040 bp, Medicago truncatula
acaacactttcaaaaacatttcattctctttcacttcacacacacttcacattttccccatttcatttcttgatctatatctatcttcattctctttgattttcatttttcattttcaatttctatttattttcaatttcattttctccccccaaaaatttgaaaaacctagatccaaatttgaaactcagaatttcaattttagggtttttatacggtgaattgtgaacggtggctccttcatcggagggagttggccgtgaaatggaaggtggtggtggcagtggtggtgggaggagagttagttcaagtccaagaccttgttgtggccggcgtgtggtggcgaagaagaagcaaggtcgtggtggtgccggtgatgggtttatcaacagtgttaggaagcttcaaagacgtgaaatttctaccaaaagtgttcgtgggtttagtatcactgatgctcaagaacgattccgcaatatccgtttgcaggaagaatatgatacatatgatccaaaaggtccttcttccatcgtattgccatttttgagaaaaaggtcaaaaattattgaaattgtagcggctcaagacattgtttttgcccttgcacaatctggcgtgtgtgcagcatttaaccgagagaccaatgaaaggatctgcttcttgaatattagtcctgatgaagttataagaagcttgttctataataaaaataacgactcacttatcactgtttctgtctatgcttccgatagttacagttctttgaaatgcagaagcaccaggattgaatatataaggagggttcagccagatgctggatttgctcttttcgaatctgagtctttgaagtggccaggttttgtagagtttgatgatgtaaatgggaaagtactgacatactctgcacaggatagcatatacaaggtgtttgacttgaaaaactattcgatgttatactctgttgctgataaaaatgtacaagagattaagatcagtccggggatcatgttgttgatttatactaaagcaagcagccatgtccctctaaaaatcctctcaatagaagatggtactgttttgaagtcattcaaccatcttattcatcggaatagcaaggtggacttcattgagcagttcaatgaaaagcttcttgtcaagcaagaaaatgagaacctccaaatccttgatgtacggacttttgagcttacggaagttagcaaaacggaatttatgacgccatctgcatttattttcctgtatgagaatcaattgttcctgacctttcgaaatagaactgtggctgtgtggaacttccgtggagaacttgtaacttctttcgaggatcaccttctgtggcatcctgattgtaacacaaacaacatatacataaccagtgaccaggatctcatcatatcatactgcaaggctgattctgatgagtcattgtctgaaggaaatgcgggatccatcaatatcagcaacattttaaccggtaagtgtcttgcgaagataagggcaagtaatagctttcccattgcaaaggaatgcaactgcggcgacgactgttcaactgatggttgtaattcaaggaagagaaagcaggcctcctccagaataaggaacacagttagagaagccttggaagacattactgctcttttctatgatgaagatcgcaatgagatctatacaggcaacaggcatggtctggttcatgtgtggtctaactgatgtattgttgaatttgttctgaccttgtgatttcttattggcttgtctccttggttgttgtgatttgtgatagtcctgtcctcacccctcacctgctatgagagcttctgggggaactgtaacttttatgtgatcttgtacaatattgttttgtccttgtcacttgcaacttaggcatgttctgcatgtggcaacaaacatgtattaagttatactgtgtttttttttttttttgagggaagttatactgtatgctggtaacttacaatatgtatgtttatgttgtacaataaatatgagatgttggat

SEQ ID NO: 5932 - DNA, 2058 bp, Pinus taeda
attcgaaatttagatcgtggtagagtggcgatcgcgtataatatttctgtggaaaaattaatatcttccatgtaatcggaccgctagtttctcgcaaatttgaaacaggcactaccctgccctttcagcagggcctgccgttacagatttttactgtaattgcagctcgggcagccattaaatctattgaaaacccttgctgaatcgaggggttatgttcggaggcagtgtttgttgagatttaaacgaaaaagagaatggacgggaagaaaatttctgcgagtccgcggccaagttttggccgtcgcgtggtggccggaaagcggcgacgggtagatgagtgtcacaactgcgtgaagaagcttcagagacgggagatcggttccatcggcaacagggccttcaacagcactaatgcgcaagaaaaattccggaattttcagctgcaggaagagtttgacacctatgatccaaaagcacactggtttttaaagctgcagttcttaaagaagagatccaagatcatagaaatagttgccgcacgggatattatatttgctttggcacaatctggtgtttgtgcagcatttagtagagagacgaatagaaaagtttgctttctgaatataagtccagatgaagtgattcgcagcctgttttataacaagaacaatgagtctcttatcactgtgtcagtttatgcttcagataacttcagctcactgaaatgcagaacaacaccgattgaatacattagaaggggcaaaccagatgcaggttttgctttattcgagtcagagtcgttgaagtggccaggttttgtagagtttgatgatgtaaatggaaaagtccttacttattctgctcaagatggcatctacaaagtttttgatttgaagaattatacaatgttgtactcaatatctgatgaacaagttcaagaaataaagataagtccaggcataatgttattaatatttgagagaacttctggtcatgttccactgaagatcttatccatagaagatggtacagttttaaaatccttcaattttttgttgcatcgcaacaaaaaagtagatttcattgagcaattcaatgaaaagctccttgtaaaacaagaaaacgagaacctccaaatactagatgttcggaattcacacatgactgaagtgagcaggacagagtttatgacaccgtcagcctttattttcttgtatgagaatcagttatttttaaccttccgcaatcgcactgttgctgtttggaatttccgaggagtgctggtgacatcttttgaagaccacttgttatggcatcctgactgcaatacaaataacatctatatcactagtgaccaagatttgataatttcttattgcaaggcccatcctgatggatctgatgaagaagaaaatgtgggctccataaacatgagcaacatcttgactggaaaatgtcttgctaagattcgtgcaaatgatccaaatgtaaggattagtcctagaaatcggccaaatgcatcggcaatcagaagcactgttcaagaagctctcgaagacattactgctcttttctatgacgaggagagaaatgagatctacactggcaatagacatggtttaatacatgtctggtcaaactgatcagtttgttttaaaatttggaaatccagtcaatcattcaaagcacatttgaatgttaatgtagtagttatgatggttgccgggcataagaaatatggcagctgtgaatcatcaattccactaagttttggagatgtctgatctataatcgcacaatgtttggctggttctgtattttaggtcttttagttctttgttattttgtaagagctgaatcgtttcggtagcatgcacccatcgttgagtgtttattttacaccataggatcaaatcactaagcacaatgtgttggcatatgcaaaactgtagcagaggaaaagtagcatctaacattgtaaaacattaaactgattttcttgcatccctatcctgagtttataatgttatctgagaaattagatcgatgattacc

SEQ ID NO: 5933 - DNA, 1941 bp, Oryza sativa
cacgaggcaatctcatctccctcctccccccccccctcattttctctctcctctttctctctctctcttcctcccaatctgcgaagcgagagagagagagagagagctcgaggcgagctctccccgcccttctcccaaaccctaatccttccgccgcgcggaggagagccgcgtctcgggcgcgcgcgtggaggcgtgaagcgatctgtattggtggaggggaggggaggggatggaggcgcggcggatctcggcgagcccgcggccgtgcagcgggaggagggtggtggcgaggaagaggccgaggcacgaggcggcggtgaacagcgtgcggaagctgcagcggcgggagatcagctcctgccgcgaccgggccttctccatgagcgccgcgcaggagcgcttccgcaacatacagctccaggaggagtttgacacccatgatcctaaggaaaacagcttgctactaccttacttgaggaaaaggtcaaaaattattgagatagttgcagcacgcgacatagtttttgctttatcacagtccggagtgtgcgctgcttttagtagagagacaaataggagaatatgctttctgaatggaagtccagatgaagttatccgcagtttattctacaacaagaataatgagtcactcattacagtatcagtgtatggttctgaaaatttcagtgccttgcgatgcaggacaactcggatagagtatatacgccgagcaaaaccagatgctggtttccctctttttgagagtgagtccttgaaatggcctggattcgtggaatttgatgatgtcaatgggaaggttttaacttattctgctcaagacagtacttacaaggtgtttgacttgaaaaactacactctgctgtattctatatcagataagaatgttcaagaaataaagataagtcctggtataatgctattgatttacacaagaacaagcagctctgttcctctgaagattctttccattgaggatggtaccgttttgaagtccttcaaccacctcctccatcggaataagaaggttgatttcattgaacagttcaatgaaaagctcctggtcaagcaggaaggagagaatcttcaaatacttgatgtacggaacttccaattaacagaagtgagcaggaccgagttcatgactccatcggcctttatctttctctatgagttgcaactgttcctgactttccggaatcgatctgtagcagtttggaatttccgaggtgaactagttacatcatttgaggaccacctgttgtggcacccagactgcaataccaataacatatacataacaagtgaccaagatctaattatttcttactgcaaagctgattccaacgattcatcttcagaagaaaatgctggctcaataaacatcagcaacatactgactgggaaatgcttggccaaaattaaggccagcgatttgtgcaagcagaagaaagcctggaagttccagagtacagccttggaggccctcgaggacatcacagcgctgtactatgacgaagagcgtgacgagatctacactggaaaccggcaaggcctcgttcatgtgtggtcgaattgaccgtgaatactgctttttgccaacaaggtgttggtcatctgtaattgaattgatttaacgactgcctcaggtggtgccggccacgaagaggtctgtgttgaggtgattcatatttatttcggcgaatactggtctcctaccattctaagccccccacatttgttgtagaattaacaattgttgttagtttcacatagactgtagcattggggagatgttgatgatacctttcggcttagtttcatgtcagttcttaaacctgtacggctgtaatgtaccttcatggtagcctctatgctatctgatgaaatagtgatatctctttctgctgaacaggtgcc

SEQ ID NO: 5934 - DNA, 1708 bp, Tragopogon dubius
tttcccaattgagctcgagttcagtggagttcgtttccaggagcgaaaggatcaccccatccttgtcgtcaccatcatcaattaggtcgcaatcagcaaccgctgctgcagctattgctactagaattggaaatcagtgaactttgatgaaaggatatggagggttttggtggtaacggtggtagcagaaataggagaattacgatggcgagtagcacgggaagtggtggaagtagaccgccaccgctgtgtggcggtcggagaagagtggtcgctacaaagaagcgtgggtggagcaacccgttatcagtcaacaacagcgtcaaaaagcttcaaagacgcgagatttcctccaaaccccatcgttcctctgcaatcaccaaatctctccaccgttttcgcaatttccgcttgacggagagatacgatattcatgatcctgtgggacaatgttcattagtattaccattgttgatgaaaagagcaaaagtgattgaaatagtggtggtacatgacatcgtcttttctcttgcaagttctggtgtttgtgcagcttttagtagagatacaaacaagaggatatgtttcttgaatatttatccagatgaagtgattcgaagcttgttttataataagaataacgactcattaattacagtgtccgtatatgcttcggataacttcagttcactgaaatgccgatcaataaggatagaatacatacaaagaggcaaacccagtgaagggtttcctctttttgagaccgaatctttgaagtggcctggttttgtggagtttgatgatgtcaatgaaaaggttttaacctactctgcgcaagatagcatatacaaggtctttgacttgaagaactacacattgttatactcaatagcggacaaacaagtagaagaaatcaagatcagcccgggcatcatgttactaatattcagtaggggtcaaagccatgttcctttaaagatactatcaatagaagatggcacagttttaaaagacatgaatcatctacttcatcgcaacaaaaaggtggattttatcgaacagtttaacgaaaagcttcttgttaagcaagacaacgagaatctccaaattctcgatgtgcgcaatgcggaggtgaaagaagttggtagcacggagtttatgactccatctgcatttatttttctttatgagaatcagttatttctaacctttagaaatcaaactgtttcggtttggaactttcgcggggaacttgttacttcatttgaagaccatgttttatcgcatccggactgcaatactaataacatatatataactagtgatcaagacctcatagtttctttctgcaaggctaataacaatcagttgactgatcaaagagcagcgggttctattaacattagcaacatatggactgggaaatgcatagcaaaaatcaattcgacaaatgcggtgtcagagggaaggtcgagaaatgaagtgaacatggtggaagaagcgttggaagacataacggctctttattttgatgaagatcgaaatgaaatttatacgggtaatagtaacggtttggttcatgtttggtctaactaaataatggactgtaataatagttatgtccatcctctcctaagtatatagtttcataggtgtgtttgtttacatttaacataaatattactaaatttccgatttgtgttttgac

SEQ ID NO: 5935 - DNA, 2044 bp, Triphysaria pusilla
aatgctccactcttttacctttgctctcagacaaactcacacggagaggatgatggagaagcagagaaatagatgaattattttgtatgcgtaggccacctatgcaattgtataaacatcgaacaagtattccacaaaggcaattgtttagaaattgcagaaagtgagcttttgttcggtgtgcaatattgtttagggttttgatttctgtgtgaaagagggtcgggggttgaaaaattatataaccggagatggacgggaggagaataacagcgaatccacggccgtgctctgggaggcgcgtggtggcgaagaagcggccccgcggtggtttggatgggattgttaacagcgtcagaaagctgcagaggagggagatatcttcgaagcgagaccgaagtttcaccatgagtgatgctcaggagcggtttcgcaacattcgcctgcaggaggaatatgatactcatgatcctaagggcttttgtcccttgtcactgccctttcttaagaagcgatcaaaagttattgaaatagttgctgcccgtgatattgtttttgctctcgcccagtctggtgtttgtgcagcttttagccgagagactaaccagaggatatgctttctgaatatcagtcctgacgaagttatacgcagcttattttacaacaagaacaacgactcactcatcactgtttcagtttacgcttcggataattttagttccttaaaatgcagaaccacaaaaatcgaatacatactaaggggtaaacctgatgccggttttccgctctttgagtcggagtcattaaagtggcctggctttgtagagtttgatgatgtaaatgggaaagttcttacttattctgctcaagatagtatctacaaggtgtttgacttgaaaaattacacaatgttgtattccatttcagataaaaatgttcaagagattaagatcagcccaggaataatgctgttgatattcacaaagactcaaggcagtgtacctttgaagatactctcaatcgaagacggaactgtactaaaatcattcactcatcttcttcatagaaacaagaaagtcgatttcatcgaacagttcaatgagaagcttctcgtcaagcaagagaatgagaatctgcagattcttgacgttcgcaattctgatttgactgaggttagccggaccgaattcatgacgccatctgcgtttatatttctatacgagaaccagttattcttgacattcagaaaccgaaccgtggccgtctggaacttcagaggggagctcgtcacgtcatttgaggatcacctgctgtggcatcccgattgcaatactaacaacatctacatcacgagcgatcaggacctcatcatctcttactgcaaggccggttctgatgagccgttggctgatgaaagtgcgggctcctttgacgtagctgatttcttgtccgggctgaggcccggcacaatcaacatcagcaatatcctgacaggaaagtgcctcgcaaagatcacggccagcaacagtctccccatcgacaagcgcagctgttgtgccaactgtaatgacggccaagactgcagcaattccaaaaggtgcaaaaaagaaagttcctcttcgcgaaatacaagcactgttgctgaggccttgaaagatattaccgctctcttttatgatgaggaacgaaacgagatctacacaggaaatcgacacgggctggtccacgtgtggtctaactgaaagtctgtgtcgttaaaataccatttttactgtgttttgctcttggttacactataacatgcccttttctagcttgatgtattcaacggagggttttacgtgttgtgatatctagaagttctttgtattgttattcgatttgtttggagttctgttgccctattcggatatcaggtcgttgcatttgagtgagcttactgtcttaatagatcgagtagctgtgtgtaagttacactctgtaaatttgattcctgtttttgaatgatttggttatatgtattggattcttgattcggcctttc

SEQ ID NO: 5936 - DNA, 1435 bp, Distylium racemosum
gcgagatcggcagcattggcaataaggccttcagcagcaccaattcgcaggagaggttccggaattttcagttgcaggaagagtttgacacttatgatcctaaagcaaattggtttctaaggctgcaatttctaaagaagagatcaaagatcattgaaatagttgcagctcgtgatattatttttgctttggcgcaatctggcatttgtgcagcatttagtagagagacaaacaaaaaagtttgcttcttgaatataagtccagatgaagtgattcgcagcctgttctacaacaagaacaacgattctcttatcacagtctccgtttatgcgtccgataacttcagttcactgaagtgcagaacaacgccaattgagtatattaggaggggtcaacctgatgctggttttgctttatttgagacagagtcactgagatggccaggttttgtagaatttgatgatgtgaacggaaaagtccttacatattctgctcatgatggtatatacaaggtgtttgatttgaagaactatacactgttgtactctatatctgataagaaagttgaggagataaagatcagtccaggaataatgctgctaatatttaaaaaatcttccaatggaagtcatgttcctctgaagatcttatctatagaggatggcactgttttgaaagcctttaatcacctattgcataagggtaaaaggttgatttcattgagcagttcaatgagaagcttcttgtaaaacaagaaaatgaaaaccttcaaatacttgatgtccggaatgcacagttgacagaagtgagcaggacagagttcatgacaccgtcagcttttattttcttgtatgagaatcaattatttttgacattccgtaatcggactgttgctgtgtggaacttccgaggagagttagtaacatcatttgaagaccacttgttatggcatcctgactgcaatacaaataacatttatattacgagtgatcaagatttgatcatttcttactgtaaggcccatcctcaaggactggatgaaggaaatgcaggctcaatcaacataagcaacattttgactgggaaatgccttgccaagattcgtgccaatgatccaaatgtacggataagttctcggaatcgacctaatgcatcagcaattcatagcactgttcaggaagcacttgaagacattaccgcattgttctatgatgaggaaagaaatgaaatttacacgggcaatagacaggggttggtgcatgtctggtcaaactgattagtccttttgaaggttgaaaacccggttaatcaactgtgaaggataattgctgttggttgaacgaacattgttatctggcatcgaatagtacttctgctgggttccaaggatgcctgttctattattgtgtacttctggctccattttgtaattgta

SEQ ID NO: 5937 - DNA, 1423 bp, Arnica chamissonis
aaaggatcatccaatcgttgtcctaagcataatcaattagcatcaatcagtagctgctgctgcttttaatgctctagggttgcaatttacaacttcaatcggaaattggtgaatgaaagaatatggaagggattggtggtagcagaaatcggaggattacgatgtcaagcagcacgagtaatggccggagtaggccaccgctgtgcggtggtcggaggagagtggttgctacaaagaatggtggctggaacaacccgttgttggccaacaacaccgttaaaaagcttcagagacgcgaaattacatcccaacccccatcgttccgctgccatcaccaaatctcttcaccgatttcgcaacttccgattgacggagagatacgatatgcacgatcctgtgggacaatgttcattagtattaccattgttgatgagaagagcaaaagtgattgagatagtagtggtacatgatattgtctttgctcttgcaagttctggtgtttgtgcagcatttggtagaggtacaaacaagacgatatgtttcttgaatatctatccagatgaagtcattcggagcttgttttacaataagaataatgactcgctaattacagtgtcagtatacgcttcagataacttcagttcattgaagtgtcgatcaataagaatagaatacatacaacgaggcaaacctgatgaaggctttcctctttttgagaccgaatccttgaagtggcctggatttgtggagttcgatgatgttaatgagaaggtgcttaccttctctgcgcaagatagcatatacaaggtctttgacctgaagaactatacgatgttatactcaatagcggatagacaggtagaagaaatcaagatcagccctggcatcatgttactgatattaagtaggggtcagagccatgttcctctgaagatactatctatagaagatggcacagttctaaaagatttcaatcatttacttcatcggaacaagaaggtggattttatcgagcaattcaacgaaaagcttcttgtcaagcaagacagtgagaatctccagattcttgatgtgcgcaatgctgaggtcaaagaagttggaagcaccgagtttatgactccgtcggcatttatttttctgtatgagaatcagctattcctaacctttagaaatcaaaccgtttcagtttggaactttcgaggggaacttgttacatcatttgaggaccatgttttatcacatccagactgcaacactaacaacatctatataactagtgatcaagatcttatagtttcattctgcaaaactgataatagtcagtcgactgatacaagagctggttctataaatatcagcaacatctggactgggaaatgcatagcaaaaataaattcaagcaatgtgattcggtcaagggatg

SEQ ID NO: 5938 - DNA, 774 bp, Lippia dulcis
ttctgcacaagatagcatatacaaggtatttgacttgaaaaactatacaatgctgtactccatttcagataaaaatgttcaagagattaagatcagtccaggaatcatgctattgatattcacaaagacaaacagcggcgttcccctgaagattctctcaattgaggatggaactgttttaaaatctttcaaccatctccttcacaaaaataagaaggtagatttcattgagcaattcaatgaaaagcttctcgtcaagcaagaaaatgagaacctgcagattcgtgatgttcgcaataccgatgtaactgaagttagcaggaccgagttcatgaccccctctgccttcatatttttatatgagaaccagttattcttgacattcagaaaccgaacagttgctgtgtggaatttcagaggggagcttgtaacctcatttgaggatcaccttctgtggcatcctgattgcaatactaacaacatatacatcactagcgatcaggacctcatcatctcttattgtaaagctgattctgaagaaccattgtctgatggaaatgctggctcgataaatatcagcaacatcttaacagggaagtgcctagcaaagatcaaggcaagcaacagtgtccccatagatgaaggcagctgcagcacgagctgtggtggcagggactacaagacaagtaagcgtctcaaaacttcaagaattaggagcaccgttgcagaagccttggaagatataacagctctcttctacgacgaagacagaaa

SEQ ID NO: 5939 - DNA, 1258 bp, Trigonella foenum-graecum
cgagtctgagtctttgaagtggccaggttttgtagagtttgatgatgtaaatgggaaagtactgacatactctgcacaggatagcatatacaaggtgtttgacctgaaaaactatacaatgttgtactctgttgctgataaaaatgtacaagagattaagatcagtccggggatcatgctgttgatttatactaaacaagcagccatgtcccactgaaaatcctctcaatagaagatggtactgttttgaagtcattcaaccatcttattcatcggaatagcaaggtggactttattgaacagttcaatgaaaagcttcttgtcaagcaagaaaatgagaacctccaaatccttgatgtacggacttttgagcttacagaagttagcaaaacggaattcatgacaccatctgcatttatattcctatatgagaaccagttattcctgacatttcgaaatagaactgtggctgtgtggaacttccgtggagaacttgtgacttcttttgaggatcatcttctgtggcatcctgactgcaatacaaacaacatatatataaccagtgaccaggatctcatcatatcatactgcaaggctgattctgatgagtcattgtctgaaggaaatgcgggatccatcaatgtcagcaacattttaactggcaagtgtcttgcgaagataagagcaagtaacagctttcccattggaaaggaatgcaactgcggtgacgattgttcaagtggtggttgcaattcaaggaagcgaaagcagccctccagaataaggagcacagttagagaagccttggaagacattaccgctcttttctatgacgaagatcgcaacgagatctatacaggcaacagacatggtctggttcatgtatggtctaactaatatattgttgaatttgttctgaccttgtgatttctttatgacttgtctcttggttgttgtgaattgtgattgtgatagttctgtcctcacccctcacctgctatgagagcttctgggggaactgtaaccttatgtgatcttgtatcatattgtgtttttttcttgtcacctgcaacttatgcatgtttattcttcaggtggcaacaaacatgtattaagtgatactgtatgccagtaatatgtatgtttatgttgtacaataaatgtatgaaatgttgaagtactgtttgcgacccgattgtttctttaacttgttacgttctggtggcatacaatgtagtgatctgtttgtgattacaaa

SEQ ID NO: 5940 - DNA, 2100 bp, Aristolochia fimbriata
cggagaccgggagtgaaaaacgctgggtagtgccagggcccaggatagtgcgaaacgctggaacgaccaactgggggcggaggtgggaagggggaaagctttcttctttgttccttcctcaatcaaaattgaagcaaaggcacaaacccgtaacttgaatttcctgattccggtcttgatgatgtaaacggccctgagaggttttatgaatcccgcagcgaaagccgaaaggcttttggtgatttgtttgacatactcgcctcttttcagtttttctttctgttttgccttcaatgtgggtttgatttgattctgagaaagcgagtgcgatggagaataagaagtcgcttcttcgactccgcctccgagtcaccgcccgtaaacgctcgcgggcgctgaagcagtgcgattctgtcaagaagctgcgagagagctactcgtgtaattcggtgaaaaaactgcaacagcgagagattggagctctcagaaagatgggtcgaggggcggcatcgaatgcacaggagaaattccgaaattttcagctacaggaagaatttgatacctatgatccaaaatcccattggtttcttaggttacaatttcttaagaagagatccaaaattattgagatagtagctgcaaaggatgttatatttgccctggcacagtcaggtctctgtgctgcttttagtcggacaaccaatcaacggatttgttttctcaatatcagccctgatgaagttattagaagcctcttctataacaagaataatgactctctgatcactgtatcggtttatgcctctgatcattttagctccttgaagtgccggacaacccctattgaatatattaggcgcaaccaattggatgctgggttccctctttttgaatctgagtcactaaggtggcctggttttgttgaatttgatgatgtgaatgggaaagtgctaacttattctgcacaggatggtatttacaaggtctttgatcttaagaactactcgttcctgtattcaatatctgacaaaaatgttcaagagataaaaatcagtcctggagttatgcttctaatattccacagagctccgggatatgtgcctcttaaaatactttcaattgaagatggaagtgtgctgaaatcttttaaccacttattacatcgtaacaagaaggttgattttatcgagcagttcaatgagaagcttctggtcaaacaagaaaatgagaatttgcaaattcttgatgttaggaactcgaaactgacagaagtaagcagaactgagttcatgactccatctgcattcattttcctgtatgaaaaccacctcttcttaacctttctgaacagaactgttgctgtttggaatttttggggggagctagttacttcatttgaagaccacctgttgtggcaccctgattgcaacaccaacaatatttatataaccagtgatcaggacctaataatatcatactgtaaagcagaggagggatctgaggatgatggtgaaggttgtgcaataggatccatcaacatgagcaacatcttgacaggtaaatgcattgccaagatatgcgccaatgaccccaatctccagatcagcccacgaggcagagttgggcgatcctggatacgaagcacagtcagggaagcacttgaagatgtcacggcacttttctatgacgaagacaggaatgagatttatacgggcaacaagcaaggtttgatacatgtgtggtcaaattagtccaagatgcagtagccaaatggtgtgtataagatctcctttacaagcttgtattatacatacaatcccattttctgactaaaatttacacataaatgtgatgtacagaatgatttggggtattacttttttgttgttgtactagagttgcataatgaagagagaatctcttggatatggtttggatctgctggttaaatatctttaaacaccaaggtattctggtcttgctgtaagaaaaggcgagctttctgaaagaactctacaccaaaaagacccccattgccatctccataagaaagtgaagcataacaagggctaaggtcttcagtgatcagtagtggtagaa

SEQ ID NO: 5941 - DNA, 1911 bp, Brachypodium distachyon
cccaaatctccgagccgggctccctcccaaaccctaggcctttctcgccggggcgccaacctccccctagtcactcgcacccgcacccggcgatgtctcccgtcgtgtccgcctgacgcgatctgtctgtgcggcggggagttgcggcgagagcccaggcggattgcggggatggagcccaggcggatctcggcgagcccccggccatgcagcgggcggcgggtcgtggcgtcgaggaagaggccgaggcaggaggcggtcgtcagcagcgtgaggaagctgcagcgccgggagatcagcactcgccgggaacgctccttcgctatgaactccgcacgggagcgcttccgcaacatacagctgcaggaagagtttgacactcatgatcctaaggaaaacagtttgctactaccttacatgaggaaaaggtcaaaaattatcgagatagttgctgcgcgtgatatagttttcgctttatcacagtcaggagtgtgtgctgcttttagtagagtgacgaataagagaatatgctttctgaatgggagtccagatgaagttatacgtagtttattctacaataagaacaacgagtccctcattactgtgtcagtatatggctctgaaaatttcagtgccttgcgatgcaagacaactccagtagagtatatccgcaggggaacaccagatgctggtttccctctttttgagacagagtccttgaaatggcctggtttcgtggaatttgatgatgtcaatggaaaagttttaacttattctgcccaagacagcacttacaaggtgttcgacttgaaaaactacacactgctgtattccatatctgacaagaatgttcaagaaatcaagatcagtcctggtataatgctattgatttatacaagagcaagcagctctattcctctgaagattctttctatcgaggatggtacagtcttgaagtccttcagtcacctccttcatcggaataagaaggttgatttcattgaacagttcaatgaaaagctcctggtcaagcaggaaggagagaatcttcaaatacttgatgtacggaacttccaattgactgaagtgagcaggactgagttcatgactccatctgcctttatctttctgtacgagctccagctgtttttgacttttcggaatcgatctgtagcagtttggaatttccgaggtgaactagtaacatcatttgaggatcacctgttgtggcaccctgactgcaataccaataacatatacataaccagtgatcaagatcttattatttcttactgcaaggctgattccagttccagtgattcatctccagaagaaaatgctggctctataaacatcagcaacatactgacaggaaaatgtttggccaaaataaaggctgatgatttgtgcaagaagccaaagaaggcatggaagtttcagagtacaatgtcagaggctcttgaggacatcacggctctatactatgatgaagagcgagatgagatctacacgggcaaccgtcaaggccttgttcatgtgtgggctaattgaaatctgaaacagcagatttcagggacgatgttttgtttggttataactgaatcaattaaaccctcaggcggtgctgagttgaataggtttcaaggctcccgtactaggctgtttatttatgccattctagtgtccagccattctctaccgacagaagatttgttgtagagttaacttttgtcgtgtgctttaccatagcctgtagccttggttgaggcatcgtctttctactatgtatccgaatgagctctcaaagaactgtactgatgtaatgtactttctggttgcactcaaagtggccgacttgtgcactttagagaacaagaaatacattatattcactcgtttgtttcttttgta

SEQ ID NO: 5942 - DNA, 1020 bp, Cenchrus ciliaris
  misc_feature (324)..(324): n is a, c, g, or t
  misc_feature (890)..(890): n is a, c, g, or t
ggataatgctattgatttatacaagaacaagcagctctgttcctctgaagattctttccattgaggatggtacagtcttgaagtcctttagccaccttctccatcgtaacaagaaggtggatttcattgagcagttcaatgaaaagcttctggtcaagcaggaaggagagaatcttcaaattcttgatgtaaggaactttcaattgacagaagtgagcaggactgagtttatgactccatctgcctttatttttctgtatgagctgcaactgttcctgactttccggaatcgatcggtagccgtttggaactttcgaggtgaantggtcacatcatttgaagatcacctgttgtggcaccctgactgcaacacgaacaacatatacataacaagtgatcaagatcttattatctcatactgcaaggctgattccactgattcatcttcagaagaaaatgctggctccataaacataagcagcatactgacggggaaatgcttggcaaaagtaaaccccggaaacggaaattcgtgcaagcaaaagaaagcatggaagttccagaatacagtctcagaggcccttgaggacatcacagctctgtactacgatgaagagcgtgatgagatctacactggcaaccggcatggccttgtccatgtgtggtcgaactgaaagctgaaactacagcttgcacctgcactatggtgatcttcacctgtatgtgtattaacagctagcaccccatgtggttgggggcaactaagaggaccccccaagcccttggggctgaggtacctgtgagatgcttcattttttgaggcgattcttatttatccctgcctgccagccaatagttctgcatccccaagatttgttgtagaattgacntgcgtcatgtgttgccgccgtaggctgtagcttttggaaatgttgaatgtctcgcaactcagtctcagagtgagtccaagtgtaacggatgtaccttgctcagctgctcgtaatgaaatttattcgttga

SEQ ID NO: 5943 - DNA, 704 bp, Taraxacum officinale
tgcttcctgaatgtaacccctgatgaagttataagaagcttattttacaacaagaacaatgattcactcattacagtttccatgtatgcttcagacagctttagttccttgaaatgtagaacaacaagaatcgaatacataaggagaggtcaaccagatgctggttttgctctttttgaatcagagtctttgaaatggcctggatttgtggagtttgatgatgtaaatgggaaggtactcacattctcagcacaagatagcatatacaaggtgtttgatctcaaaaactatatgatgttatattccatatcagacaaaaacgtacaagagatcaaaataagtcctggaatcatgttattaatatacaaccaatcaagtggccatgtccctctcaagattctctcaattgaagatggaatagttctaaaatccttcaaccatctccttcaccgaaacaaaaaagtcgatttcatcgaacaattcaacgaaaagcttctcgtgaaacaagaaaacgaaaatctacagattcttgatgtaagaacttcagaggtaatagaagtgagcaggacggaattcatgacaccatcagccttcatctttctatacgagaatcagttgttcctaacatttaggaaccgaactgtcgctgtttggaacttcaggggcgaactcgtaacttcattcgaagaccatttgctatggca

SEQ ID NO: 5944 - DNA, 741 bp, Setaria italica
gttatccgcagtttattttacaacaagaataatgattcactcattactgtgtcagtgtatggttctgaaaatttcagtgctctgcgatgcagaacaactcgaatagagtacattcgacgtggacaaccagatgctggtttctctctttttgagactgagtccttgaaatggcctggatttgtggagtttgatgatgtcaatgggaaggttttgacttactctgctcaagacagcacttacaaggtgttcgatttgaaaaactacacattgctgtattcggtatctgataagaatgttcaagaaataaagatcagcccaggaataatgctattgatttatacaagaacaagcagctctgttcctctgaagattctttccattgaggatggtacagtcttgaagtccttcagccaccttctccatcgtaacaagaaggtggatttcattgaacagttcaatgaaaagcttctggtcaagcaggaaggagagaatcttcaaattcttgatgtaaggaactttcaattgacagaagtgagcaggactgagtttatgactccatctgccttcatttttctgtatgagctgcaacttttcttgactttccggaatcgatcagtagcagtttggaactttcgaggtgaactggtcacatcatttgaagatcacctgttgtggcaccctgactgcaacacaaacaacatatacataacaagtgatcaagatcttattatttcatactgc

SEQ ID NO: 5945 - DNA, 2016 bp, Setaria italica
atttctcacccatctccgtccccctgtttctctttctctctcttcaccccccaatctccgagccgagctcgagctcccaaaccctaggcctcaccggggagtcagctccgctgcgccagctatgccgttcgccgtggaggcttgacggggccggccccccaagtttatctcttcggcggcgagcgcggcggggttgctgtgggaggccgggcggcggggggcggagatggagccgaggcggatctcggcgagcccgcgcccgtgcagtgggcggcgggtggtggcgaggaagaggccgcggcaggagtcggtcgtgagcagcgtgcggaagctgcagcggcgggagatcagttcccgccgcgaccgcgcctgcgccatgaccgccgcccaggagcgcttccgcaacataacgctgcaggaagagtttgacactcatgaccctaaggagaactgcttgctactcccttacttgaggaaaaggtcaaaaatcattgagattgttgcagcacgtgatatagtctttgctctttcacagtcaggagtatgtgctgcttttagtagagagacaaatcagagaatatgctttctgaatggaagtcctgatgaagttatccgcagtttattttacaacaagaataatgattcactcattactgtgtcagtgtatggttctgaaaatttcagtgctctgcgatgcagaacaactcgaatagagtacattcgacgtggacaaccagatgctggtttctctctttttgagactgagtccttgaaatggcctggatttgtggagtttgatgatgtcaatgggaaggttttgacttactctgctcaagacagcacttacaaggtgttcgatttgaaaaactacacattgctgtattcggtatctgataagaatgttcaagaaataaagatcagcccaggaataatgctattgatttatacaagaacaagcagctctgttcctctgaagattctttccattgaggatggtacagtcttgaagtccttcagccaccttctccatcgtaacaagaaggtggatttcattgaacagttcaatgaaaagcttctggtcaagcaggaaggagagaatcttcaaattcttgatgtaaggaactttcaattgacagaagtgagcaggactgagtttatgactccatctgccttcatttttctgtatgagctgcaacttttcttgactttccggaatcgatcagtagcagtttggaactttcgaggtgaactggtcacatcatttgaagatcacctgttgtggcaccctgactgcaacacaaacaacatatacataacaagtgatcaagatcttattatttcatactgcaaggctgattccactgattcatcttcagaagaaaatgctggctctataaacataagcagcatactgacggggaaatgcttggcaaaagtaaattccggaaacggaaattcgtgcaagcaaaagaaagcatggaagttccagaatacagtctcagaggcccttgaggacatcacagctctgtactatgatgaagagcgtgatgagatctacactggcaaccggcatggccttgtccatgtgtggtcgaactgaaagctgaaaccacggctttcacctacaccatggtgatcttcacctgtatgtgtattaacagctagtaccccatgtggtggggggctacgaagaggacccccagcccccggggccaaggtacctgtgagatgcttcattttttgaggcgattcgtatttatccctgcctgccaatagttctccatccccgagatttgttgtagaattgacattcgtcatgtgttttcaccgtaggctgtagcttttggaaatgttgattatgtctctcgactcagtctcagagtgggttcaagtgtaacggatctactttgctcagctgctcgtaatgaaatttattcgttgatgagttctcattccgttgaaatgatgccttcactattaatctaacatatgttcagacctggggaaccctatcct

SEQ ID NO: 5946 - DNA, 1898 bp, Zea mays
atttcccttcatccatctccgtaatcctgcctttctctctcttctgtcttctcccctgattctccaagccgagctcgagcttccaaaccctaggcctcaccggggagccatatccgccacgccagcgatgcctctcgccgcagcggcttgacggggcctgcccccaaatctacctcttcagcggagaggcgctgcgtggttgctgtgggaggcgcggcgcgggtcggaaatggagccgaggaggatctcggcgagcccgcgcccgtgcagcgtgcggcgggtggtggccaggaagaggccgaggcaggaggcggtggtgagcagcgtgcggaagctgcagcgccgggagatcagctcacgccgcgaccgcgccttcgccatgagcgccgcacaggagcgctttcgcaacatacatctgcaggaagagtttgacactcatgatccaaaggagaacactttgctactcccttacttgaggaaaaggtcaaaaattattgagatagtcgcagcgcgtgatatagtctttgctttatcacagtcaggagtatgtgctgcttttagtagagaggcaaatgagagaatatgttttctgaatggaagtccagatgaagttatccgcagtttattttacaacaagaataatgactcactcattaccgtgtcagtatatggttctgaaaacttcagtgctctgcgatgcagaacaacccggatagagtacattcggcgaggacaaccggatgctggtttccctctttttgagtccgagtccttgaaatggcctggatttgtagagtttgatgatgtcaatggaaaggttttgacttactctgctcaagacagcacttacaaggtgtttgatttgaaaaactacacattactgtattcggtgtcagataaaaatgttcaagaaataaagatcagccctgggataatgctattgatttatacaagaacaaatagctcggttcctctgaagattctttccattgaggatggtacagtcttgaagtccttcagccaccttctccatcgtaacaagaaggtagatttcattgaacagttcaatgaaaagcttctggtcaagcaggaaggggagaatcttcaaattcttgatgtaaggaacttccaattgacagaagtgagcagaactgagtttatgactccatctgcctttatttttctgtatgagctgcaactgttcctgacgttccggaatcgatcagtagcagtttggaactttcgaggtgaactggtcacatcatttgaagatcacctgttgtggcaccctgactgcaacacaaacaacatatacattacaagtgatcaagatcttattatttcatactgcaaggctgactcaactgattcctcttcagaagaaaatgctggctctataaacataagcagcatactgaccggcaaatgcttggcaaaaataaaccctggaaattcgtgcaagcaaaaggatccatgcaagcagaagaaagcatggaggttccagaatacagtctcggaggccctggaggacatcacagctctatactatgacgaagatcgtgacgagatctacactggcaaccggcatggccttgtccatgtgtggtcgaactgaaagccgaaatagtggcggctttcacccacagcatggtgatcttcacctgtatgtgtattaacagcttgtacctcacatggcaggggggcacgaagacggaccccccagccaccaggtacggacgtgatgcttcattgttgaggcaattcttatttatcccaccagcgtggcaagagctctcaccacataggcacccattcagaaatcagaacaccccctccccgatttgttgtaggattgacaatcgttgtgcgttttaaatatagcatgtgtgttaattttt

SEQ ID NO: 5947 - DNA, 1995 bp, Pennisetum glaucum
gagagtaggtggtggtatcgtcatttgggctggtacttggagagtaggtggtgtattggcaatgtcccctctgtgtctctcttctctcttctctcccccctatctccgaaccgtgcccgagctcccaaaccctaggcctcaccggggagtcggctccgctgcgccagcgatgccgctctccatggaggcttgacggggccgcccccaaagtttatcccttccgcggcgagcgcggcgtgtttgctgtgggagaccgggcggcggggggtgcggagatggagccgaggcggatctcggcgagcccgcgcccgtgcagtgggcgacgggtggtggcgaggaagaggccgcggcaggagtcggtcgtgagcagcgtgcggaagctgcagcgacgggagatcagctcccgccgcgaccgcaccttcgccatgaccgccgcccaggagcgcttccgcaacataacgctgcaggaagagtttgacactcatgacgctaaggagaacagcttgctactcccttacttgaggaaaaggtcaaaaatcattgagatagttgcagcgcgtgatatagtctttgctctatcacagtcaggtgtatgtgctgcttttagtagagagacaaatcagagaatatgctttctgaatggaagtcctgatgaagttatccgcagtttgttttacaacaaaaataatgattcactcattactgtgtcagtatatggttctgaaaatttcagtgctctgcggtgcagaacaactcgaatagagtacattcgacgtggacaacctgatgctggtttccctctttttgagactgagtccttgaaatggcctggatttgtggagtttgatgatgtgaatgggaaggttttgacttactctgctcaagacagcacttacaaggtgtttgatttgaaaaactacacattactgtattcagtttctgataagaatgttcaagaaataaagatcagcccagggataatgctattgatttatacaagaacaagcagctctgttcctctgaagattctttccattgaagatggtacagtcttgaagtcctttagccaccttctccatcgtaacaagaaggtggatttcattgagcagttcaatgaaaagcttctggtcaagcaggaaggagagaatcttcaaattcttgatgtaaggaactttcagttgacagaagtgagcaggactgagtttatgactccatctgcctttatttttctgtatgagctgcaactgttcctgactttccggaatcgatcagtagcagtttggaactttcgaggtgaactggtcacatcatttgaagatcacctgttgtggcaccctgactgcaacacgaacaacatatacataacaagtgaccaagatcttattatctcatactgcaaggctgattccactgattcatcttcagaagaaaatgctggctctataaacataagcagcatactgacagggaaatgcttggcaaaagtaaaccctggaaacggaaattcgtgcaagcaaaagaaagcatggaagttccagaatacagtctcagaggcccttgaggacatcacagctctgtactatgatgaagaacgtgatgagatctacacaggcaatcgccatggccttgtccatgtgtggtcgaactgaaagctgaaactacagctttcacctgcaccatggtgatcttcccttgtatgtgtgttgacagctagcaccccaatgtggtggggggctacgaagaggaccccccataccctggggctgaggtacctgtgagatgcttcatttttttgaggcgcttcatatttatctctgcccgccaaccaatagttctgcatctccccaatatttgttgtagaaacattgtcatgtgttttcactgtaggctgtagcttttggaaatgcttaatgtctcgcaactcaagtctcagagtgagtccgagtgtaacggatgtaccttgctcagctgctcgtaatgaaatttattcgttga

SEQ ID NO: 5948 - DNA, 745 bp, Nuphar advena
atatgcttcttgaacatcagtccagacgaagtgatcagaagtctcttctataacaaaaataatgactcattaattaccgtatcagtctatgcttcagattgttttagctccttgaagtgcagaacaactcctatagaatatatcagaaggaatcaattagattctggatatgctctctttgaatcggaatctctgaaatggcctggttttgtggagtttgatgatgtgaatggaaaagttctgacttattcagcccaggatgggatatacaaagtttttgatttgaagaactactcctttctctactcaatacctgacaaagacattcaggaaatcaaaatcagtccaggtataatgcttctaatattcaacagagcccctggctatgttcctcttaagatactctccattgaagatggaaccgtattaaaatcttttaatcacttgctgcatcgcaacaagaaggttgatttcattgagcagtttaatgagaagctcctggtcaagcaagaaaatgaaaacttgcagattcttgatgtaagagattcggagataacagaagttagccggacagagtttatgattccttcagctttcattttcctctatgagaaccacctcttcttgacattccgtaaccaaacagttgctgtgtggaattttcgaggagagcttgtcacttcgtttgaggaccacttactatggcacccagattgcaatacgaataacatttatatcactagcg

SEQ ID NO: 5949 - DNA, 2008 bp, Sorghum bicolor
ccatctccgtatccctgtttctctctctctctcttctccccccaatctccgagccggagctcgagctcccaaaccctaggcctcagccggggagccatctccgccacgccagcgatgcctctcgccgcagcggcttgacggggcgtgccccatcccaaacctacctctcggcggagagcgcggcgtagttgctgtaggaggcccggcgtgggtgagaaatggagccgaggcggatctcggcgagcccgcgcccgtgcagcgggcggcgggttgtggcggccaggaagaggccgaggcaggaggcggtggtgagcagcgtgcggaagctgcagcgccgggagatcagctcccgccgcgaccgcgccttcgccatgagcgccgcgcaggagcgcttccgcaacatacagctgcaggaagagtttgacactcacgatccaaaggagaacacttcgttactcccttacttgaggaaaaggtcaaaaatcattgagatagttgcagcgcgtgatatagtctttgccttatcacagtcaggagtatgtgctgcttttagtagagagacaaatcagagaatatgctttctaaatggaagtccagatgaagttatccgcagtttattttacaacaagaataatgattcactcattactgtgtcagtatatggttcagaaaacttcagtgctctgcgatgcagaacaactcgaatagagtacattcggcgaggacagccagatgctggtttccctctttttgagtctgagtcattgaaatggcctggatttgtagagtttgatgatgtcaatgggaaggttttgacttactctgctcaagacagcacttacaaggtgtttgatttgaaaaactacacactactgtattcggtgtctgataagaatgttcaagaaataaagatcagccctgggataatgctattgatttatacaagaacaagcagctcggttcctctgaagattctttccattgaggatggtacagtcttgaagtccttcagccaccttctccatcgtaacaagaaggtagatttcattgaacagttcaatgaaaagcttctggtcaaacaggaaggagagaatcttcaaattcttgatgtaaggaacttccagttgacagaagtgagcagaactgagtttatgactccatctgcctttatctttctgtatgagctgcaactgttcctgacattccggaaccgatcagtagcagtttggaacttccgaggtgaactggtgacctcatttgaagatcacctgttgtggcaccctgactgcaacacaaacaacatatacattacaagtgatcaagatctcattatttcatactgcaaagctgactcaactgattcatcttcagaggaaaatgctggctctataaatatcagcagcatactgactggcaaatgcttggcaaaaataaaccctggaaattcaagcaagcaaaagaaagcatggaggttccagaatacagtctcggaggcccttgaggacattacagctctgtactatgacgaagatcgtgatgagatctacactggcaaccggcatggccttgtccatgtgtggtcgaactgaaagctgaaactgtggtggccttcacccacaggcacggtgatcttcacctgtatgtgtattaacagctagtacctcacgtggcggggggcatgaagaggacccccagccaccaggtacgtatgcgatgcttcatttttgaggcaattcttatttatctcagcatgccaagagctctctagatacattcagaaatcagaacccaccagatttgttgtagaattggcaactgtgcgttttcgctgtagcatgtagcttttgggagtgccgatgatgtccctccctcaactcggccacagagcgagttcaagtgtaacggatgttccttgcaagtaatgaatttcattcgttgagttctcatttcgttgaaaaatgccatgagttatgtatgttcagaaatgtggaatcctatactcttgagt

SEQ ID NO: 5950 - DNA, 1966 bp, Sorghum bicolor
atttcccttcatccatctccgtatccctgtttctctctctctctcttctccccccaatctccgagccggagctcgagctcccaaaccctaggcctcagccggggagccatctccgccacgccagcgatgcctctcgccgcagcggcttgacggggcgtgccccatcccaaacctacctctcggcggagagcgcggcgtagttgctgtaggaggcccggcgtgggtgagaaatggagccgaggcggatctcggcgagcccgcgcccgtgcagcgggcggcgggttgtggcggccaggaagaggccgaggcaggaggcggtggtgagcagcgtgcggaagctgcagcgccgggagatcagctcccgccgcgaccgcgccttcgccatgagcgccgcgcaggagcgcttccgcaacatacagctgcaggaagagtttgacactcacgatccaaaggagaacacttcgttactcccttacttgaggaaaaggtcaaaaatcattgagatagttgcagcgcgtgatatagtctttgccttatcacagtcaggagtatgtgctgcttttagtagagagacaaatcagagaatatgctttctaaatggaagtccagatgaagttatccgcagtttattttacaacaagaataatgattcactcattactgtgtcagtatatggttcagaaaacttcagtgctctgcgatgcagaacaactcgaatagagtacattcggcgaggacagccagatgctggtttccctctttttgagtctgagtcattgaaatggcctggatttgtagagtttgatgatgtcaatgggaaggttttgacttactctgctcaagacagcacttacaaggtgtttgatttgaaaaactacacactactgtattcggtgtctgataagaatgttcaagaaataaagatcagccctgggataatgctattgatttatacaagaacaagcagctcggttcctctgaagattctttccattgaggatggtacagtcttgaagtccttcagccaccttctccatcgtaacaagaaggtagatttcattgaacagttcaatgaaaagcttctggtcaaacaggaaggagagaatcttcaaattcttgatgtaaggaacttccagttgacagaagtgagcagaactgagtttatgactccatctgcctttatctttctgtatgagctgcaactgttcctgacattccggaaccgatcagtagcagtttggaacttccgaggtgaactggtgacctcatttgaagatcacctgttgtggcaccctgactgcaacacaaacaacatatacattacaagtgatcaagatctcattatttcatactgcaaagctgactcaactgattcatcttcagaggaaaatgctggctctataaatatcagcagcatactgactggcaaatgcttggcaaaaataaaccctggaaattcaagcaagcaaaagaaagcatggaggttccagaatacagtctcggaggcccttgaggacattacagctctgtactatgacgaagatcgtgatgagatctacactggcaaccggcatggccttgtccatgtgtggtcgaactgaaagctgaaactgtggtggccttcacccacaggcacggtgatcttcacctgtatgtgtattaacagctagtacctcacgtggcggggggcatgaagaggacccccagccaccaggtacgtatgcgatgcttcatttttgaggcaattcttatttatctcagcatgccaagagctctctagatacattcagaaatcagaacccaccagatttgttgtagaattggcaactgtgcgttttcgctgtagcatgtagcttttgggagtgccgatgatgtccctccctcaactcggccacagagcgagttcaagtgtaacggatgttccttgcaagtaatgaaattcattcgttgagttctcatttcgttg

SEQ ID NO: 5951 - DNA, 1837 bp, Glycine max
gtgaagcggtgactctgagaatggaaggaaggatgcgtggaggttatagtggtcgacgcatagtagcaagcagaagagggagtggcaaaggcaatgtcaacatcatcatcaacaacaacaacaacaacaacaacaaaaacaacaccaatgtcatcaagaagcttcagagccgtgagatttgctcgaagcctcatcgagcttttgcttctgtcactgcctctcacagattccgctcaatgcgcttgacgcaccaatacgacactcatgatccctccaagactcgctcttccctttggcccttcttgatgaaaagaactaaagttgtggaaattgtggctgcaaaaaacgtggtctttgctctttaccattctggtttgtgtgcagcttttagtagagaaaccgatgagaggatttgctttttgaatgtttgccctgatgaagtcattcggagcctcttctataataagaacaacgactcactcatcacagtatccgtttatgcttctgagaacttctgctctttgaaatgcagatccacaaagattgaatacatacgaagaggcaagccggatgctgggtttcctcttttccaatctgaatctttgaaatggcctggatttgttgagtttgatgatgtcaacggaaaggtcctaacttactctgcacaagattgtatttacaaggtctttgatcttaagaactacaccctgctatattcgatttcagataggaatgttcaagaaatcaagatcagccctggcatcatgttattaatttacaatagaaccagcggtcatattcccctgaagatcatatccattgaagatggcacaattctcaaagtgttcaaccatctacttcatcggaataagaaggtggacttcatagagcaatttaatgaaaagcttctagtcaaacaagaaaatgagaaccttcagattcttgatgttcgtagttctgagctgatggaagtaagcagattggagttcatgactccatcggcatttatctttctgtacgagaatcagttgttccttagtttcagaaatcgaacagtttctgtttggaacttccgtggggagcttgttacttcatttgaggatcaccagttgtggcatccagactgcaacacgaacaacatatacataacaagtgatcaggatctcattatatcttactgcaaggctgattctgatgatcaatggattgaaggcactgctggctccattaatgtcagcaatatcttgaccgggaaatgtgtggcgaaaataactgcaataagtagcagtgccaaggcggacgagtgcagaagtagtggttgcagctgcaagaaaagtcattcatgcctaatgaggagtccagttgcggaggctttggaggacatcactgccctcttttatgacgaagacagaaatgagatctatactgggaacaggcatggtcttgttcatgtatggtcaaactaatgacaaaagttggaacctatccgtgtttggtttttcccttttgatgatgggaacatttcagtattggatccaagctacctcagcattctaaccttagttgatgtgaaactattacatagcacttagcaattgtggatttgtgcaagagataatctgttaaaagactattaaccagaagtttcaagaaaagtttgtgtatgcttttgttaggtcttttagaagtttgaccttatagtttctgtatagtacaatcaatactgaaaattgaggcatattacttgtatgctgcagttaatatttttttctgaactgagacccctgctgttatgctacgattttatgatacaatggaatattgaatgtttttcttc

SEQ ID NO: 5952 - DNA, 3539 bp, Glycine max
tcgagttttatcgaaatgtactttaattaaaaattaaaaaaatgttattttctaagtttctttcatcaaattaaatgttcaacattataatgactaatgtaatcaaaatttcagtttgcatactgacttggtgttccaagcacttgacttcttctgcaaaagctggattatttctttgtaatgtgaggccaattgagtggctgacattttagctaatatcggggtgtttgtgctataccttcggatgcctttcagtccttgatgtttatggactcccaagggtgatccctttctgttttgttttcaacttcgcactaatcaaaagaatcattctaacatctatataagaacattgcacacaaaaaaacacagagcataaacaaagccacaaccaaaaaaatcatagaactcacatagaacgtacataacaaattaaccctaaaatcaaaacctaaccttcaaggatagtatcccgtacccatctgctccctaacgtgtcctcgtgatggaaagaaaatcctagtggattacccatctgcttcgaacctgaagaggtcttctatgttggttcttggtcatttgtttctcaagtcttaaaagtagctacgatatacaatttattattatttatgctacaaagctatgatatgaatcctacagtaaagaagatgttcatgtaaagcggtgactgtgagaatggaaggaaggaggcgtggaggttatagtggtcgacgcatagttgcaagcagaagagggagtggcaaaagcaatgccaacaacaacaacaacaacaacaacaaaaacaacaacaacatcaatgtcatcaagaagcttcagagccgcgaaatttggtcgaagcctcatcgagcttttgcttctgtcactgcttctcacagattccgctctatgtgcttgacgcaccaatacgacactcatgatccctccaagactccctcttccctttggcccttcttgatgaagagaactaaggttgtcgaaattgtggctgcaaaaaacgtggtctttgctctttaccattctggtttgtgtgcagcttttagtagagaaactgatgagaggatttgctttttgaatgtttgccctgatgaaatcattcggagcctcttctacaataagaacaacgactcgctcattacagtatctgtttatgcttctgagaacttcagctctttgaaatgcaggtccacaaagattgaatacctacgaagggggaagccggatgctgggtttcctcttttccaatctgaatctttgaaatggcctggatttgttgagtttgatgatgtcaatggaaaggtcctaacttattctgcacaagattgtatttacaaggtctttgatcttaagaactacaccatgctatactcgattttagataggaatgttcaagaaatcaagatcagccctggcatcatgttattaatttacaatagaaccagcggtcatattcccctaaagattatatccattgaagatggcacagttctcaaagtgttcaaccatctacttcatcggaataagaaggtggacttcatagagcaatttaatgaaaagcttctagtcaagcaagaaaatgagaaccttcagattcttgatgttcacaattctgagctgatggaggtaagcaggacggagttcatgactccatcagcatttatctttctatacgataatcaattgttccttactttcagaaatcgaacagtttctgtttggaacttccacggggagcttgttacttcatttgaggatcaccagttgtggcacccagactgcaacacgaacaacatatacataacaagtgatcaggatctcattatgtcttactgcaaggcagattctgatgatcaatggattgaaggcactgctggatccattaatgtcagcaatatcttgaccgggaaatgtgtggcgaaaataattgcaacaagtagcagtgccaaggcagacgagtgcagcagtagtggttgcagctgcaagcaaagtgattcatgcctaatgaggaattcagttgcggaggctttggaggacatcactgccctcttttatgaggaagacagaaatgagatctatacggggaacaggcatggtcttgttcatgtatggtgtgaatctccatatctgagaagcattgcagaaatggacggattggggagaggggcaagcatgggtcttggtctccctccttcaacatccttcctatcggtcaagttgtgccttggtgacttgttggtcatgggttcgaatccggaaacagcctctttgcatatgcaagggaaaggctgcgtacaacatccctcccccataccttcgcatagcgaagagcctctgggcaatgggtattcgttaatgcttctgagaaattcaactctttcaaatgcagatccacaaacattgaagtttgataatctcaacggaaaggtcctaacttactcagcagaagatagtatttacaaggtctttgatcttaaagactataccctgctatactcgatttcagataaacatgttcaagacatcaagatcagggagcttgttacccaatttgaggatcaccagtttgtgacaaggttaggctgcaatacaaacaacacatacataacaagagatcaagatttcattatctcttactgcaaggcagattctgatgatcaatggatggaaggcaatggtaaccgtctttgagactagttgttctttgatttctgaatggagtaatcataaacatctcttaatttgttaaagtgatcttattatctttataatttgcttcttggcacaactggttccattaatgtcagtgatatcttgacctggaaatgtgtggctaaagtcgacgcaacaagtagcagcatcaaggcagagtgcaacaagtaacagtttttgcagctgcaacaagcaaagtcattcatgcctactactaaggagttcagttgtagaggttttggatgaagtcactgccctcttttatgatgaagatagaaatgagatatatgctggtaacaaacatggtcttgttgatgtatggtctaactaatgacaagtgttttcctgcttttgctaatgggattatttcagaataggatttctctaaaatccaagttgcctcagcattgtaacattagcttatgtgaaattagtttttatgtaaagtgcaatcactactgaattatttttaaggcagatgagacattactcatctttaaacattagattagaagaaaatgaagcctgaggataaatagtaactaaagttactctcggaataacttatcatttcgtttgtcctggaattcaaaaagtgcagattatatgagattttatacctcatctgtgtcattggtttaaatctctataaatctgttttcattttaggcatgatcttgtgtgctggtgttggaataatgttcacttgctataccgccacttcttttctttttaagatttttcctcggccctgagaaccgtattgttatgctgttatttttcacatggcataatcaatattttacttcaac

SEQ ID NO: 5953 - DNA, 1925 bp, Saccharum officinarum
tctcttctccccccaatctccgagccggagctggagctcccaaaccctaggcctcaccggggagccatctccgccacgccagcgatgcctctcgccgcagcggcttgacgaggcgtgccccccaaacctacctcttcggcggagagagcggcgtggttgctgtgggaggcgcggcgtgggtgggaaatggagccgaggcggatctcggcgagcccgcgcccgtgcagcgggcggcgggtggtggcggccaggaagaggcagaggcaggaggcggtggtgagcagcgtgcggaagctgcagcgccgggagatcagctcccgccgcgaccgctccttcgccttgagcgccgcgcaggagcgcttccgcaacatacagctgcaggaagagtttgacactcatgatccaaaggagaacactttgctactcccttacttgaggaaaaggtcaaaaatcattgagatagttgcagcgcgtgatatagtctttgctttgtcacagtcaggagtatgtgctgcttttagtagagagacaaatcagagaatatgctttctgaatggaagtccagatgaagttatccgcagtttattttacaacaagaataatgattcactcattactgtgtcagtatatggttctgaaaacttcagtgctctgcgatgcagaacaactcgaatagagtacattcggcgaggacaaccggatgctggtttccctctttttgagtctgagtcattgaaatggcctggatttgtagagtttgatgatgtcaatgggaaggttttgacttactctgctcaagacagcacttacaaggtgtttgatttgaaaaactacacgctactttattcggtgtctgataagaatgttcaagaaataaagatcagccctgggataatgctattgatttatacaagaacaagcagctcggttcctctgaagattctttccattgaggatggtacagtcttgaagtccttcagccaccttctccatcgtaacaagaaggttgatttcattgaacagttcaatgaaaagcttcttgtcaagcaggaaggagagaatcttcaaattcttgatgtaaggaacttccagttgacagaagtgagcagaactgagtttatgactccatctgcctttatctttctgtatgagctccaactgttcctgacattccggaatcgatcagtagcagtttggaactttcgaggtgaactggtcacatcatttgaagatcacctgttgtggcacacggactgcaacacaaacaacatatacattacaagtgatcaagatcttattatttcatactgcaaggctgactcaactgattcatcttcagaagaaaacgctggctctataaacatcagcagcatactgactggaaaatgcttggcaaaaataaatcctggaaattcatgcaagcaaaagaaagcatggaggttccagaatacagtctcggaggcccttgaggacatcacagctctgtactatgacgaagatcgtgacgagatctacactggcaaccggcatggccttgtccatgtgtggtcgaactgaaagctgaaactgtggcagctttcacccacagcacggtgatcttcacctgtatgtgtattaacagcttgtgcctcacgtggcagggggcatgaagaggaaccccagccaccaggtacgtatgcgatgcttcatttttgaggcaattcttatttatctcagcatgccaagagctctctccacccaatcagaaatcagaaccatccagatttgttgtagaattggcaatcgttgtgcgttttcactgtagcatgtacctttttgggaatgccgattatgtccctcaactcagccacagagcgagttcaagtgtaacggatgttccttgcaagtaatgaaattcattcgttgagttctcatttacccacaat

SEQ ID NO: 5954 - DNA, 1579 bp, Panicum virgatum
agttggggtacaaatgctggactccgctcctagccaggaagagtttgacactcatgaccctaaggagaacagtttgctactcccttacttgaggaaaaggtcaaaaatcattgagatagttgcagcccgtgatatagtctttgcactatcacagtcaggagtatgtgctgcttttagtagagagacaaatgagagaatatgctttctgaatggaagccctgatgaagttattcgcagtttattttacaacaagaataatgattcactcattactgtgtcagtatatggttctgaaaatttcagtgctctgcggtgcagaacaactcgaatagagtacattcggcgtggacaaccagatgctggtttccctcttttcgagactgagtccttgaaatggcctggatttgtggagtttgatgatgtcaatggaaaggttttaacttactctgctcaagacagcacatacaaggtgtttgatttgaaaaactacacattgctgtattcggtatctgataaggatgtccaagaaataaagatcagccctgggataatgctattgatttatataagaacaagcagctctgttcctctgaagattctttccattgaggatggtacagtcttgaaatccttcactcacctactccatcgtaacaagaaggttgatttcattgagcagttcaatgaaaagcttctggtcaagcaggaaggagagaatcttcaaattcttgatgtaagaaacttccaattgacagaagtcagcaggactgagtttatgactccatctgcctttatttttctgtatgagctgcaactgttcctgactttccggaatcgatcggtagcagtttggaactttcgaggtgaactggtcacatcatttgaagaccacctgttgtggcaccctgactgcaacactaacaacatatacataacaagtgatcaagatcttattatttcgtactgcaaggctgattccactgattcatcttcagaagaaaaagctggctctataaacataagcagcatactgacaggaaaatgcttggcaaaaataaaccccggaaatggaaattcatgcaaacaaaagaaagcatggaagttccagaatacagtatctgaggcccttgaggatatcacagctctgtactacgatgaagagcgtgatgagatctacactggcaaccggcatggccttgttcatgtgtggtcgaactgaaagctgaaagctttcacctgaagcatggtgatcttcggcttcacctgtatgtgtattaacagccagcacctcatgtggtggggctatgaagaggaacccccagctcccaggggcccaggtacctagagatgcttcattttttgaggcgattctttatttatccctgcctgccaatagttctccaaccattcagaacccctcagatttgttgtagaattgacgctcatcatgcgttgtcaccgtagcctgtagcttctggaagtgttgatcatgtccctcaactcagtccgagagtgaggtcaagtgtaacgaatgtaccttgctcgtaatgaaatttattcgttgagttctcatccgttg

SEQ ID NO: 5955 - DNA, 1710 bp, Cephalotaxus harringtonia
gcgctcgtacgagtataataattgcgtgagaaagcttcaaaggcgtgagatcggaagcattggcaacaaggccttagcagcaccaattcccaggaaaggttccggaattttcagctgcaggaggagtttgacacctatgatcccaaggcaaattggtttttaagattgcaatttctaaagaagagatcaaagatcatcgaaatagttgcagcgcgggatataatatttgctttggcacagtccggtgtttgtgcagcatttagtagagagacgaacaaaaaagtttgcttcttgaatataagtccagatgaagtaattcgcagcctgttttataacaagaacaacgactctcttatcacagtgtcagtctatgcttcggataactacagttcactgaagtgcagaacaactccaattgagtatattaggagaggtcaaccggatggtggttttgctttatttgaatcagagtcactgaggtggccaggttttgtagagtttgatgatgtcaatgggaaagtcctgacgttttctgctcaagatggtgtttacaaggtctttgatttgaagaactatacacttctatactcaatatctgataaaaatgttgaggagataaagatcagtccaggtataatgttgttatttttaaaaaatcttccagtggaagtcatgttcctttgaagatcttaaatatagaggatggcactgttttgaaatccttcaatcacctattgcatcgtaataaaaaggttgatttcatcgagcagttcaatgagaagcttcttgtaaaacaagaaaatgaaaatctccaaatacttgatgtccggaatacactcttgacagaagtgagcaggacagagttcatgacaccatcagcttttatttcttgtatgagaatcaattattcttgacattccgtaatcggactgttgctgtatggaatttcagaggagagctagtgacatcatttgaagaccacttgttatggcatcctgattgcaatacaaataatatttatattactagtgatcaagatttgatcatctcttactgcaaggctcatcctcaaggatgtgatgaaaaaaatgcaggttcaataaacataagcaacatcttgactgggaaatgccttgctaagattcgtgccaatgatcctaatgtatgtataagttctcggaatcggcctaatgtatcagtaatccaaagcactgttcaagaagctcttgaagatattactgcattgttctatgatgaagaaagaaatgaaatttacacaggcaacagacaggggttgatacatgtctggtcaaattgactgtggctcttgaaacccagttaatcttttaaaagcaatcttgaatgtcaattctaaactggcaattgcttttaagttgtgagaaacaatggcagctggcatggaatattacttccactgggctcttaggatgcctgttctataaatactgtacttttggcttttcttgtaattgtacgtaattgttcatgtatcattcgggaagagttgaagaactgttttaacactcttatcaagtgttaaatgttgtgaaaaatcattatgctaactatctatgaaacaaagcttcctttttcttatgaagcgtttcaaagaatgttttggatcctctggtgagccatactgcttgtaattcttaaagatgagtgctgctaaattgtgttctcattgtg

SEQ ID NO: 5956 - DNA, 1395 bp, Ambrosia trifida
cagttaccgaatgcttaccttgtgaatgtacggcaatggaaggttccagtagcagcagaaggaggagagttgttgctacgaagaagcagcgtgactggaccaactgcctctccgttaacaacaacagcgttaaacggattcacagacgtgaaatttcttccaaacgacaccgttctgtttcactcaccaattctcttcatcgatttaagaacatccggttaacggagcaatatgatactcatgatcccaagggacaatcgtcttttgtattaccatttttaatgaaacgggcaaaagtcattgaaatagtggcagcacatggtatagtatttgctcttgcaagttctggtgtttgtgcagcttttagtagagatacaaacacgaggatatgtttgttgaatatatttccagacgaagtcatccgtagcttgttttacaataaaaataacgactcgttaattacggtttctgtatatgcttcagacaatttcagttcactcaaatgcagatcaacaagaatagaatacatacaaagaggccaaccagatgctggttttgctttgtttgaatcagagtctctgaaatggcctggttttgtggagtttgatgatgtcaatgggaaggtgcttacctactctgcacaagatagtatatacaaggtttttgacctgaagaattatacgctgttgtactctataacagacaaagatgtagaagaaatcaagatcagtcccgggatcatgttattgattttcactagggctcaaagccatgttcctctgaaaatattatcaatagaagatggcacagttttaaaggaatttaatcatttacttcatcgcaataagaaggtggattttatagaacagttcaatgaaaagcttcttgttaagcaagatagtgagaatcttcagattcttgatgtacgaaatgctgaggtgaaagaagttgctaaaactgagttcatgactccatctgcatttatttttctatatgaaaatcagttatttttaacattcaaagaccaaactgtttctgtatggaattttcgaggagagcttatgacatcattcgaggatcatgagttatggcattcggactgcaatacaaataacatctatataacaagtgatcaaggtcttataatttcattctgcaaaggtgattcaaatgatcaacgaattagtgggaaagcgggttctattaatatcagcaacatatggactgggaaatgtgtagctaaaataaactctggcaatgcaactcttagtgaagatagaaagcaaagaacgactgaaactcatatggttgcagaggcgcttgaagagataacagccctttactttgacgaagaacgaaacgagatttatacaggtaataattacggtttggttc

SEQ ID NO: 5957 - DNA, 343 bp, Scabiosa columbaria
agctagtgggcatgttcctcttcaaattctttcgatcgaagatgggaccgtcctcaaatccttcaatcatctccttcaccgtaacaaaaaggtggattttattgagcagttcaatgagaagcttcttgtcaagcaagagaatgagaatcttcagattcttgatgttcgcaattctgagcaaactgaagtaagcagaactgaatttatgacgccatcagcattcatatttctatatgagaaccagttattcttgacgttcagaaaccgaacagtggctgtttggaactttagaggggagctggtgacatcatttgaggatcaccttttgtggcatcctgactgc

SEQ ID NO: 5958 - DNA, 1871 bp, Zea mays
atttcctttcatccatctccgtatggaccgtatccctgtctctctctcttctccccctcccccccaatctccgaggcgagctcgagctcccaaaccctaggcctcactggggagtcacctccgccactccagcgatgtctctcgccgcagcggcttgacggtgcctgcccccaaatctacctctccgttagagagcgcggcgtggttgctgcgtgaggcgcaccggggtctgcaaatggagccgaggcgcatatcggcgagcccgcgcccatgcagcgggcggcgggtagtggccaggaagaggccgaggcaggaggcggtggtgagcagtgtgcggaagctgcagcgccgggagatcagctcccgccgcgaccgcaccttcaccatgagcgccgcgcaggagcgcttccgcaacatacagctgcaggaagagtttgacactcatgatccaaaggagaacgcttcactactcccttacttgaggaaaaggtcaaaaatcattgagatagttgcagcgcgtgatatagtctttgctttatcacagtcaggagtatgtgctgcttttagtagagagacaaatcggagaatatgctttctgaatggaagtccagatgaagttatccgcagtttattttacaacaagaataatgattcactcattactgtatcagtatatggttctgaaaacttcagtgctctgcgatgcagaacaactcgaatagagtacgttcggcgaggacaaccggatgctggtttccctctttttgagtccgagtccttgaaatggcctggatttgtagagtttgacgatgtcaatggaagggttttgacttactctgctcaagacagcacttacaaggtgtttgatttgaaaaactacacattactgtatttggtgtctgataagaatgttcaagaaataaagatcagccctgggataatgctattgatttatgcaagaacaagcagctcggttcctctgaagattctttccattgatgatggtacagtcttgaagtccttcagccacctcctccatcgtaacaagaaggtagattttattgagcagttcaatgaaaagcttctggtcaagcaggaaggagagaacctccaaattcttgatgtaaggaacttccaattgacagaagtgagcagaactgagtttatgactccatccgcctttatttttctacatgagctgcaactgttcttgacattccggaatcgagcagtatcagtttggaactttcgaggtgaactggtcacgtcatttgaagatcacctgttgtggcaccccgactgcaacacaaacaacatatacatcacaagcgatcaagatcttattatctcgtactgcaaggctgactcaactgattcaacttcagaagaaaatgctggctctataaacataagcagcatactgtccgggaaatgcctggcaaaaataaacactggaaactccaatgcttgcaaggaaagaaagaaggcgtggaagttccggaacacagtctcggaggcccttgaggacatcacggctctgtactacgacgaggatcgcgacgagatctacactggcaaccggcacggccttgtccatgtgtggtcgagctgaaagctgaaactgcggggcggctttcaaccgtagcacggtgatctggtcttcacctgtgcgcgtattaacagctactagtgcctcacgtggcacgggggtggggggcacgaaagagggaccccccaagccactcaagtgacagttcttatttatctcagcatgccaagagcactgtccatcattctgaaatcagaggccccccagatctgttgtaacggacgtaccttgcaagtaatgaaatccattcgttgatctgaaa

SEQ ID NO: 5959 - DNA, 531 bp, Populus trichocarpa
ctttttgtttttttctctgcagtccagggatcatgttgttgattttaactaaaagtggtggctgtgttcctcttgagattctttcgatagaggatggcactgttctcaaatctttcaatcatctccttcatcggaataagaaggtggatttcattgaacagttcaatgagaagcttcttgtcaagcaagaaaatgaaaatctccagattcttgatgtccgcgactttcagctaatagaagttagcagaactgagtttatgacaccatcagcatttatatttctctatgaaaaccagctattcctgacatttagaaatcgaactgtggctgtttggaacttccgaggagagcttgtaacttcttttgaggatcaccttttgtggcatcctgattgcaatactaataatattcacatcacaagtgatcaggatcttataatttcttactgcaaggctgattctgacgatcccttgtctgaaggcaatggatcccatcatatcagcaatatcttgactgggaaatgtcttgcta

SEQ ID NO: 5960 - DNA, 1228 bp, Panicum virgatum
gctcaagacagcacatacaaggtgtttgatttgaaaaactacacattgctgtattcggtatctgatcagaatgtccaagaaataaagatcagccctgggataatgctattgatttatataagaacaagcagctctgttcctctgaagattctttccattgaggatggtacagtcttgaagtccttcactcatctactccatcgtaacaagaaggttgatttcattgagcagttcaatgaaaagcttctggtcaagcaggacggagagaatcttcaaattcttgatgtaaggaatttccaattgacagaagtcagcaggactgagtttatgactccatctgcctttatttttctgtatgagctgcaactgttcttgactttccggaatcgatcggtagcagtttggaactttcgaggtgaactggtcacatcatttgaagatcacctgttgtggcaccctgactgcaacacgaacaacatatacataacaagtgatcaagatcttattatttcgtactgcaaggctgattccactgattcttcttcagaagaaaatgctggctcaataaacataagcagcatactgacaggaaaatgcttggcaaaaataaaccctggaaatggaaattcatgcaagcaaaagaaagcatggaagttccagaatacagtatctgaggcccttgaggacatcacagctctgtacttcgatgaagagcatgatgagatctacactggcaaccagcatggccttgttcatgtgtggtcgaactgaaagctgaaagctttcacctgcagcatggtgctcttcagcttcacctgtatgtgtattaacagccagtacctcatgtggtggggctatgaagaggaacccccagctcccagggcccaggtacctagagatgcttcattttttgaggcgattcttatttatccctgcctgccaatagttctccatccatccagaaccccctcagatttgttgtagaattgacactcaacagcgttttcaccttagcctgtagcttttggaaatgttgatcatgcccctcaactcagtcccagagtgagttcaagtgtaacggatgtaccttgctcgtaacgaaatttattcgttgagttctcatccgttgaaatgcttccattgtgatgtaccatatgccccgaactgggaatcttaatcctgcatgtctgggttctgaaggcctcgtgagaggagtaatgcttgctgg

SEQ ID NO: 5961 - DNA, 702 bp, Cedrus atlantica
tacagggccgagtgggcatgttcctttaaaaattttatctatagaggacggcactgttttaaaagtacatttaatcacctgttgcatcgcaataaaaaggttgactttattgagcagttcaatgagaagcttcttgtaaaacaagaaaatgagaacctacaaatacttgatgttcggaatgcacaattgactgaagtaagcagggcagagttcctgaccccatcggcatttattttcttatgagaaccagttattcttgactttccgaaatcgcacagttgccgtatggaatttcagaggagagctggttacctcatttgaggaccacttgttatggcatcctgattgcaatacaaataacatttatattactagtgatcaagatttgattatttcttactgcaaggcacttcctctttcttctggcgcagaagaaaatgttggttcaataaatataagcaacatattaactggaaagtgcctggctaagattcgtgccaatgatccaaatgttcagattagtcatagaaatcgtccaaatgcgtctacaatcagaagtactgtagaagaagcacttgaagacatcactgctttattctatgacgaagagaggaatgaaatatataccggcaattggcatggcttggttcatgtctggtcaaactgattaaatgcctgaatgttgtgcacatcctgttaatc

SEQ ID NO: 5962 - DNA, 579 bp, Olea europaea
gcctcagataattttagttcgttgaaatgcagaaccacaaggattgaatacattcgaaggggtaaaccagatgctggttttcctctatttgagtcagaatcattgaaatggcctgggtttgtggagtttgatgatgtaaatgggaaggttcttacttattctgcacaagatagcatatacaaggtgtttgacttgaaaaattatacgatgttgtactccatctcggataaaaatgttcaagagattaagatcagtccaggaatcatgttactaatatttaccaaggctagcggctatgttcctctaaagattctttcaattgaggatggaactgttcttaaatctttcaaccatctgcttcatcgaaacaagaaggtggatttcattgagcagttcaatgaaaagctactagtcaagcaagagaatgagaacctccagattcttgatgtccgcaattctgagttaacagaagttagcagaacagagttcatgactccatctgcatttatatttttgtacgagaaccagttgttcctaacttttagaaaccgaacagtagctgtttggaacttccgtggg

SEQ ID NO: 5963 - DNA, 1875 bp, Phalaenopsis aphrodite
ctgagagagacgggatctgatcatctgagagccccttcttacttgtttcttccaggtgtagccatgggagacctcgtctaaaccctaaccctagctctcggcagttgtaccgcttaccgatatactctctatcgctccccgcccatccttcggacgagcggcggcggcggagccggagccggagccgggatggagaatcacaagagaaatgttccccgtcctcgggttcgagtaacggctaagaggcgggggaaggagtcggaatcctccacaggatcctcgaaaaagccgcggaaaggagagtgcgtgaattcagtcaccaagctccagcggcgcgagatcggagggtttcctagaatcgctcggggcacctcgtcgaatgcacccgagaaattccggaacatacagcttcaggaggaatttgatacctacgatcacaatgttcattggtttttaaaattacaatttctcaaaaagagatctaagatcatagagatcgttgctgcaaaggacgttatatttgctcttgctcagtctggtctctgtgcagcctttagtcgcacaactaacaaacgcatatgcttcttgaatataagccctgatgaagtaattagaagtcttttctataacaagaacaatgaatcactgatcacagtatcagtttatgcttccgaccacttcagctccttgaaatgtaggaccactccaatagaatatataaggcggaatcaacttgatgctggattcgcgctttttgagactgaatctctaaaatggccaggatttgttgaatttgatgacgtcaatggcaaagttcttacctattcagctcaggatggaatatacaaggttttcgacctaaagaactactcctttttgtactccatatctgataaaaatgtacaggagattaagatcagtccggggatcatgttattgatatgtcgtagaagtcctggttttgttccattaaagattctttcaattgaagatggcacagttttgaagtctttcaatcacttgttacaccgaaacaaaaaagtcgacttcatcgagcagttcaatgaaaagcttctagtaaagcaagagaatgaaaatcttcagattctagatgttaggaattcagaattaactgaagttggaaagacacaattcgtgactccttcggctttcatcttcctctatgagaatcatcttttcttgacatttagaaacaggacggttgcagtttggaatttccgcggagaattagtcacctcctttgatgatcacttgttgtggcacccagactgtaacacaaacaacatctatattaccagtgatcaggatttgataatctcgtattgcaaatcagaaggatgtgaagatgaagcttctgcagttggatcaattaacatgagcaatattcttactggaaagtgcatcgccaaaatatcagcaaatgacccattaatacagatgagtccgcggaaaggaggagatgcgagcagatcttccattaggtgtagcgttcgtgaagccctggaagatgttacagcattgttctatgatgaggataggaatgagatctacactggaaacaaacaaggattgatacatgtctggtcaaattagagcttttacggctctcaatgttagctcggaattcaagtaatttagctgtaagatatgtgccaattttttcttcagagacgaaggtgctcgtgcgtatcatcatcgtaggaaattagggcatgtataattgtttttttttttgacatttctgctggaactttgcatggtttgtgtggcacttggtaatgtaatattggccatgtaatgtgatgtatgatagtctgaacgattaggttgattattctttctcttgagagctga

SEQ ID NO: 5964 - DNA, 1307 bp, Lippia dulcis
gttgctgcccgagatatagtctttgctcttgcgcaatctggtgtctgtgctgcatttagccgagaaactaaccagaggatatgcttcctgaatgtttgtcctgatgaagtaattcggagtttattttacaacaaaaataacgactccctcatcacggtttctgtttatgcttcagataactttagttccttaaaatgcagaaccacaagaattgaatacatacggaggggtcaacccgatgctggtttcccactgtttgagtctgaatcattgaagtggccgggttttgttgaatttgatgatgtaaatggaaaggttcttacttattctgcacaagacagcatatacaaggtgtttgacttgaaaaactatacaatgctatattccatttcagacaagaatgttcaagagattaagatcagtccaggaatcatgctattgatatttacaaaatccgcagccagtgttcctcttaagattctttcaattgaggatgggactgttttgaaatccttcatccatgttcttcacagaaacaagaaagtggattttattgaacaattcaatgaaaagcttcttgtcaagcaagagaatgagaacctccagatcgttgatgtgcgcaataatgacataactgaagttagcaggacagaattcatgaccccatccgcctttatatttctatatgagaaccaattattcctcactttcagaaaccgaacagttgctgtttggaacttcagaggggagcttgttacttcgtttgaggatcaccttttgtggcatcccgattgcaataccaacaacatatacatcacaagtgatcaggacctcatcatttcttattgcaaagctgattctgatgaacccttatctgatggaaacgcaggttctatcaacatcagcaatatcttgacggggaagtgccttgctaagataaaggtaagcaacagcctccccatggacgaatgccattgcagtgccagttgtggtggcaaaaactgcaactcaagaaagcgaatcaaagcttctagaattagaagcactgttgccgaggccctggaagatatcactgccctcttctatgatgaagaccgcaatgaaatctatacaggaaacaggcttggtcttgtccacgtatggtctaactaaaggcggccattttacccccattaccatacggacgaggctcaaaattagttcgttagttatggcaatttcacgcctttcggtccgtcttacccctcataaacagggggggtattcattcgcctatcgtgttgtgtgtttctagaagtcttcttttc

SEQ ID NO: 5965 - DNA, 741 bp, Carthamus tinctorius
cgggcacagagctagagccatgttcctctgagatactatcgatagaagacggcacagttctgaaagatttcaatcatctacttcatcggaataagaaggtggattttatagagcaattcaatgaaaagcttctcgttaagcaagaaaatgagaatctccagattcttgccgtacgcaatgctgaggtgaaagaagttggtagaacagagttcatgactccatcagcatttatttttctgtatgagaatcagctatttctaacatttagaaaccgaaccgtttccgtttggaacttccgaggagagcttgttacatcgtttgaggatcatatactatggcattccgactgcaataccaataacatctatatcactagtgaacaagaccttataatttcattttgcaaggatgattcagacgaccaatggactgatggaaaagctggttctattaatatcagcaacatatggaccgggaaacgcataggtaaaataaactcgagcaatgcaactccgaatgaagatggtaaccaccgaagtaagattggaggtaatatggttgcggaggctcttgaagacataacagccctttactacgatgaagaacgcaatgagatatatacgggtaatagtcatggtttggttcatgtttggtccaattgagattagttaaatagattgtaattaagcagcttataatgtttgtatcctaatcctaatcctaattctaatgctagtgatg

SEQ ID NO: 5966 - DNA, 999 bp, Triphysaria pusilla
aagagattaagatcagtccaggtatcatgctattgattcttacgaaatcccacggtggtgttcctttgaagatcctctcaatcgaggacggtactgttctgaaatcttttagccatctccttcacaaaaacaaaaaggtcgatttcatcgaacaatttaacgagaagcttctcgtcaagcaagagaacgagaatctccagattgtcgacgtccgtaatactgagataactgaagttagcaggaccgagttcatgaccccatctgcatttatatttctatacgagaaccaactatttctgacgttcagaaaccgaacagtggccgtttggaacttcagaggagagcttgtgacgtcgttcgaggatcaccttttgtggcatcctgattgcaataccaacaacatatacatcacgagcgatcaggatctcatcatttcttactgcaaagctgatgctgaagaaccattatctgatggacatgctggttcgatcaacatcagcaatatcttgactggaaagtgtctcgcaaagataaaggcgagcaatggcctccccacgagcgaatgcttctgcagcttaaattgtggcggcaaaaactgcagcagcagcagcagctctaggaagcgcaagtcgacttccagtggaattcggagcactgtagcagaggccctcgaagacatcactgccctcttctacgacgaggatcgcaacgaaatctacacagggaacaggcttggtcttgtccatgtctggtctaactaaagcccgggctagtgtgagcctgattacattcaagaaatatatatttatctatttatatatctagtcttcgatttctttcacttcacccccatatagagggggatattcgggatgatgtataatatgcatttctagagtttgttgtgtcgacttttcagtgtgactttggctaagttgatgttggatcgttttgcgctgtagttgtgatttgtaacttggggctcataattgagagcta

SEQ ID NO: 5967 - DNA, 1284 bp, Utricularia gibba
ctggttttgtggaatttgatgatgtgaatgggaaggtgcttacatactcagcacaagacagcatatataaagtttttgacttgaaaaactatacgatgctatattccatttcagataagaatgttcaggaaattaagataagtcctggaatcatgctactgatattcacaaaaaaagaaggttgcgttcctttgaagatactctcgattgaggatggtacggtcttgaaatcttttaagcagcttcttcatagaaacaagaaggtggatttcattgaacaattcaatgaaaagcttcttgtcaagcaagagaatgaggacctgcagattgttgatgttcgaaatggagatataacagaagttagtcggactgaatttatgacaccctctgcatttatatttctatatgagaaccaattgttcctcacatttagaaatcgcacggtggctgtttggaattttaggggggaattggtaacttcatttgaggatcatctcttgtggcatcctgattgcaataccaacaacatatacattactagtgatcaggacctgatcatttcttattgcaaagcagattcagatgatcgattaacagatggaaatgttggttctattaatatcagcaacattttaactggaaagtgccttgcgaagataacagcaagcaacagcgtttccgcaaatgaatgtgactgcagcttgagctgtgggggcaggaaatgcaggtcaagaaagcacatccgggcttccggaatgaggagcacagctgcagaggccttggaggacataactgccctcttctatgatgaagatcgcaatgagatatacactgggaataaacatggccttctccatgtttggtccaactagaagcctactcggttggtagcttcttttcttgaggaccagaagcaagtatctagtaggatttcagtatcaaatgctttcattgtagttggtgttatccccatggaggtggataacacgaggtctcttgccgagacatattcttggggtgttgattgttagaatgatgggcgctgagcacggaagacgcctcgcgccctttgtgttgtagatgtgctagatagatctactgtgttagacttgcctgtgtaactgctaccaccatcagtcaatttggattcagttttcttagaataaaagtacttgtttttgcaggaactggaggctgttttgtatactttgtaacatatggaccaagtcacttgtctatgcatccagtgtgctggaattatagaaacaaaaaaaaaaaaaaacc

SEQ ID NO: 5968 - DNA, 1921 bp, Hordeum vulgare
ctcccgtgccaccccaaatctccgagccgagctcccaaaccctagccgagctcgccggtgatggcccccgtcgcggcggcgtgagtggggatctgttgcgcgcggcgtgggcggggggttgcggcgggaggagggaggcggattggcggggatggaggcgaggcggatctcggcgagcccccggccgtgcaacggccggcgggtggtggcgaggaagaggcccagacaggaggcagtcgtcagcagcgtcaggaagctgcagcgccgggagatcagctctcgccgggaacgctccttcgccatgaactccgcgcaggagcgcttccgcaacatacagctgcaggaggagtttgacactcatgatcctaaggagaacaatgcgctactgccttacattaggaagaggtcaaaaattattgagatagttgcagcacgtgatataatttttgctttatcacaatccggagtatgtgctgctttcagtagagtgatgaataagagaatatgctttctgaatggaagtccagatgaagttgttcgtagtttattctacaacaagaacaatgattcactcatcactgtgtcagtgtatggttctgaaaatttcagtgccttgcgatgcaagacaactcggatagagtatatacgccgtggaacgccagatgctggtttccctctttttgagacagagtccttgaagtggcctggatttgttgagtttgatgatgtcaatggcaaggttttaacttattccgctcaagacagcacttacaaggtttttgacttgaaaaactacaccctactgtattccatatgtgacaagaatgttcaagaaataaagatcagtcctggtataatgcttttgatttatacaagaacaagcagctctattcctctgaagattctttctattgaggatggtacagttttgaaattcttcaaccacctcctccatcggaataagaaggtggatttcattgaacagtttaatgaaaagctcttggttaagcaggatggagaaaatcttcaaatacttgatgtacggaacttccacttgactgaagtgagcagtactgagttcatgactccatctgccttcatctttctgtatgaactccagctgtttttgactttccggaatcggtctgtagcagtttggaatttccgaggtgaactagtaacatcatttgaggatcacctgctgtggcaccctgactgcaataccaataacatttacataaccagtgatcaagatattatcatttcttattgcaaggctgattccagcgattcatcttctgaagaaaatgctggctctataaacatcagcaacatactgacagggaaatgcttggccaaaataaaggctggcaatttcgacaagcaacagaagacatggaagttccagaatacaatcacagaggctctggaagacatcacagctctgcactatgacgaagtgcgcgatgagatctacaccggcaaccgccatggccttgttcatgtgtgggcgaactgagagccgagacaacagatttcaggggacaaacaaggtgttgttcatttgcaggcggaccaatttaacaaccaagcctcaggtggtgctggccgcgaagaggtcttgggtctccagccgttagcaatttgttgatgtggattgtggtgttgtttaccaacagaagatttgttgtagagttagtgcttgtcatgtgctttaccatagcctgtagtagcctcggagatttctcagggcgagctctcaaaactgtatctcatgtaatgtattaccttcctggtagtaaactctgctacccgaaatagtgaaacctcattctgtctgtcaatgcgtcgggctcttgcagtttctgagtttgtatctttcaacctcaacatttgaaatctgtgacgcagaaaatttctt

SEQ ID NO: 5969 - DNA, 1573 bp, Zingiber officinale
  misc_feature (466)..(466): n is a, c, g, or t
cccgttcgggtgcgcttccgcgtgagagccaaaaagcatggccttgaagccggcggctccggctcttccgacgcccggaagcgccggaggcagttggactgcaccaactccgtccggaagctgctgtgccgcgagatcggcggccacccccgcatggcccgctgctcctcctccgatgccgccgagaagttccgcaacttccagctccaggaggagtttgatacttatgataacaatgttaactggtttgtaaaattgcaatttcttaaaaagagatcaaaaattattgagattgtttcagcaaaagatattatatttgcccttgcacaatctggactgtgtgctgcttttagccgaacaactaacaaaaggatttgctgcttgaatataagcccagatgaagtgattaggagccttttttataacaagaacaatgactcccttattacagtctcagtatatgcancagttttcagttcgttgaagtgcaggacaactccaattggatacattaaaaggaaccaattagatgctggattcccactttttgaaagtgaatctcttaaatggccaggctttgtcgaatttgatgatgtaaatggcaagatcctaacttactcagcacaagatggcatctacaaggtttttgatctcaagaactactcatttctttatgcaatttcagataagaatgtccaggagatcaagatcagcccaggaataatgctgttaatattcaatagagaacctcattgcgttccattaaagatactctcaattgaggatggaactgtgttgaaatcgtttaaacacttgttacaccggagcaagaaggttgattttattgagcaattcaatgagaagcttctcgttaagcaggaaaatgagaatctacagatttttgatgtgagaaattcagagattacagaggttagcaggacagagtttatgacaccatcagcttttatctttctgtatgagaatcatcttttcctaacattccgaaataggacaattgctgtttggaatttccgtggtcagctagtcacctcttttgaagatcatttgctgtggcatccagattgcaacacaaataatatttacataactagtgatcaagatctgataatttcatattgtaaggctgaagaggggcatggcaatgatggagaagtctcgaccgttggttccatcaacatgagcaacatcctgactggcaagtgcatagccaaaatatctgcttctgatcctgcagttcagatcagtcctcgcaaaagaggtgacacaggtagatctttgatcagaagcactgtcagagaagcacttgaagatgtgacagcactattttttgacgaggataggaatgaaatttacacaggcaacaagcaaggtttgatacatgtatggtcaaattagttgcctgtaagttcctaggattgttgcctagctgtaatatattgaacacattctgagatctaaattcaaatcttcccttgtgaggtatgctttgacagcgtccttgtatttgtttgcatctttgtggagcagatgtaatccattgcagagtttgatg

SEQ ID NO: 5970 - DNA, 1965 bp, Avena sativa
tccactccctacccctccacccccaaatctccgagccgagagctcccgaaccctagctcacgcgcccgcgccggcgatggctctcgctgtgcacgcgtgaagggggggatctactgttatccgtggcggcggggcggggagtctgcgggcgagagaggcgggcgggcatggaggcgaggcggatctcggcgagcccccggccgtgcaacggccggcgggtggtggcgaagaagaggcccaggcaggaggcgcccgtcagcagcgtcaggaagcttcagcggagggagatcagctcacgccgcgaccgctccttcgccatgaactccgcgcaggagcgcttccgcaacatacagctgcaggaagagtttgacactcatgatccaaaggagaacagttcgctactaccttatgtgaggaaaaggtcaaaaattattgagatagttgcagcacgtgatatagtttttgctttatctcagtcaggagtatgtgctgcttttagtagagtgacaaataagagaatatgctttctgaatgggagtccagatgaggttgtccgtagtttattctacaacaagaacaatgattcactcattactgtgtcagtatatggttctgaaaatttcagtgccttgcgatgcaagacaactcgaatagagtatatacgccgtggaaagccagatgccgggttccctctctttgagacagagtccttgaaatggcctggatttgtggagtttgatgatgtcaatggaaaagttttaacttattcagctcaagacagcacttacaaggtgtttgacttgaaaaactacacactactctattccatatctgacaagaatgttcaagaaataaagataagtcctggtataatgctattgatttacacaagaacaagcagctccattcctctgaagattctttctattgaggatggtacagttctgaagttcttcaaccaccttctccatcggaataagaaggtggatttcattgaacagttcaatgaaaagctcttggtcaagcaggatggggagaatcttcaaatacttgatgtacggaacttccagttgactgaagtgagcagtactgagttcatgactccatctgccttcatctttctgtatgaactccagttgtttttgactttccggaatagatctgtggcagtttggaatttccgaggtgaactagtaacatcatttgaggatcacctgttgtggcaccctgactgcaataccaataacatatacataaccagtgatcaagatcttattatttcatactgcaaggctgattccagtgattcgtcttcagaagaaaatgctggctctataaacatcagcaacatactgacaggaaaatgcttggccaaaataaaggctggggatttcagcaagcaaaagaagacatggaagttccagagtacaatcacagaggctcttgaggacatcacagctctgtactatgacgaagagcgtgatgagatctacacgggcaaccgtcatggccttgttcatgtgtgggcgaattgagagctgaaaaatcagacttcagggacaagttgtgctcattggcagccgaatcaatttaacaacaaagcctcaggtggtgctggccatgaagaggtcttgagtctccagtctttagtcatttattcatgtgaagtgtggtgtccagctgttctctgctcatagaagagttgttgtagagttagaacttgatgtgctttaccctgtagggagctctcaagctgaaatagatttctgagatgtctcagggtgagctctcaagatgtacccttgtaatgtaccttcctggtagtcatctctccctacctgaaatagtgaattctcattctaccgatgagtttggtgatctggtcgctccagacaagtgtaaggaaggaaggacacattgtaaaagagaaatacattaccttataattgaaaaggtgatcctgtt

SEQ ID NO: 5971 - DNA, 1967 bp, Avena sativa
tccactccctacccctccacccccaaatctccgagccgagagctcccgaaccctagctcacgcgcccgcgccggcgatggctctcgctgtgcacgcgtgaagggggggatctactgttatccgtggcggcggggcggggagtctgcgggcgagagaggcgggcgggcatggaggcgaggcggatctcggcgagcccccggccgtgcaacggccggcgggtggtggcgaagaagaggcccaggcaggaggcgcccgtcagcagcgtcaggaagcttcagcggagggagatcagctcacgccgcgaccgctccttcgccatgaactccgcgcaggagcgcttccgcaacatacagctgcaggaagagtttgacactcatgatccaaaggagaacagttcgctactaccttatgtgaggaaaaggtcaaaaattattgagatagttgcagcacgtgatatagtttttgctttatctcagtcaggagtatgtgctgcttttagtagagtgacaaataagagaatatgctttctgaatgggagtccagatgaggttgtccgtagtttattctacaacaagaacaatgattcactcattactgtgtcagtatatggttctgaaaatttcagtgccttgcgatgcaagacaactcgaatagagtatatacgccgtggaaagccagatgccgggttccctctctttgagacagagtccttgaaatggcctggatttgtggagtttgatgatgtcaatggaaaagttttaacttattcagctcaagacagcacttacaaggtgtttgacttgaaaaactacacactactctattccatatctgacaagaatgttcaagaaataaagataagtcctggtataatgctattgatttacacaagaacaagcagctccattcctctgaagattctttctattgaggatggtacagttctgaagttcttcaaccaccttctccatcggaataagaaggtggatttcattgaacagttcaatgaaaagctcttggtcaagcaggatggggagaatcttcaaatacttgatgtacggaacttccagttgactgaagtgagcagtactgagttcatgactccatctgccttcatctttctgtatgaactccagttgtttttgactttccggaatagatctgtggcagtttggaatttccgaggtgaactagtaacatcatttgaggatcacctgttgtggcaccctgactgcaataccaataacatatacataaccagtgatcaagatcttattatttcatactgcaaggctgattccagtgattcgtcttcagaagaaaatgctggctctataaacatcagcaacatactgacaggaaaatgcttggccaaaataaaggctggggatttcagcaagcaaaagaagacatggaagttccagagtacaatcacagaggctcttgaggacatcacagctctgtactacgacgaagagcgtgatgagatctacacgggcaaccgtcatggccttgttcatgtgtgggcgaattgagagctgaaaaatcagacttcagggacaagttgtgctcattggcagccgaatcaatttaacaacaaagcctcaggtggtgctggccatgaagaggtcttgagtctccagtctttagtcatttattcatgtgaagtgtggtgtccagctgttctctgctcatagaagagttgttgtagagttagaacttgatgtgctttaccctgtagggagctctcaagctgaaatagatttctgagatgtctcagggtgagctctcaagatgtacccttgtaatgtaccttcctggtagtcatctctccctacctgaaatagtgaattctcattctaccgatgagtttggtgatctggtcgctccagacaagtgtaaggaaggaaggacacattgtaaaagagaaatacattaccttataattgaaaaggtgatcctgttgt

SEQ ID NO: 5972 - DNA, 351 bp, Sarracenia psittacina
  misc_feature (1)..(1): n is a, c, g, or t
nagttcaagagattaagatcagccagggatcatgctgttgatctttaccaaagctagtggccatgttcctcttaaaattctatcaatcgaggatggtacagttctcaaaactttccatcatctcctccatcggcagaagaaggttgatttcattgaacagttcaatgagaagcttctcgtcaagcaagaaaatgagaatctgcagattcttgatgtccgcaattctgaactaacagaagttagtagaactgaatttatgactccatcggcatttatatttctgtatgagaaccagttgttcctgacatttaggaacaggacagtggctgtttggaacttccgaggggagct

SEQ ID NO: 5973 - DNA, 1359 bp, Silene vulgaris
ttgtaaatagcgtcaggaaattgcaaaggagagaaatttcctccaaacattatcgtgcatttagtatgagtgatgcccaggaacgctttcgcaacatttgtttgcaggaagagtatgatacacatgatcctaaagaccagtgccccacaatcttgccgtttctgaggaagagatcaaaaatcattgaaattgtagctgcgcatgacattgtttttgctcttgcacagtctggtatatgtgcagcgtttagtcgagaaacaaaccagaggatatgcttcttgaatgtcagttcagacgaagttataagaagtttgttctacaacaaaaataatgattcccttatcaccgtttcagtatacgcttctgacaatttcagctctttgaaatgcagaacgacaaggatcgaatacataaagagaggaaaacctgatgctgggtttgctcttttcgagtccgaatcactgaaatggcctggttttgtcgagtttgatgatgtaaatggaaaggtgcttacttattctgctcaggacagtgtttacaaggtctttgacttgaagaactatacaatgctctattccatttctgacaaaaatgttcaggagattaaaaatcagcccgggaatcatgttactgatatttactaaaagaatctagccatgttcctctaaaactttgtctatcgaggacggtacagttctcaaatcattcaaacagctcatcaatcgaaataagaaggttgatttcattgagcaattcaatgagaagcttcttgtcaagcaagaaaatgagaatcttcaaattgttgatgttcgtaactcagagataactgaagtcagcaaaactgactttatgactccatctgcctttattttcctatatgagaaccaattgttcctgacttttaggaacagaacagtggcagtgtggaatttccgtggagagcttgtaacgtctttcgaggaccatctcttgtggcatcctgactgcaacacaaacaacatatacatcacaagtgaccaagaccttatcatttcttactgcaaggcagattctgaggacgtgttgcctgaagtaaatgcgggttcgattaatgtgagtaatatattaactggcaaatgcctggcgaaaataaaatcggataactgtgccattgccgaagatgattgtagtagcagtggtaccagcagcaagaaccgaggaagagttgcaagcataagagcacacctgccgaggctttggaagacattaccgctctgttttatgatgaagaacgcaatgaaatatataccggaaacaagcatggtcttgttcatgtatggtccaactaaatgatgtatcttctctacatcgttgcctttg

SEQ ID NO: 5974 - DNA, 1552 bp, Artemisia annua
gttaagaagattcaaaggagggagatttgttctaaaaaggacgcgcgtttggtaaatgtgatgatgctcatgaaaaattccgaaatattcgtttacaggaggagtatgacactcatgatccaaagggacatatcccgactgtattgccgtttcttaagagaaggtcacagattgttgagattgtggctgctcatgatatcgtatttggtcttgcacagtctggagtctgcgcagcattcagtcgggaaactaacaagaggatatgctttctgaatatcagtcctgatgaagttttaagaagcttgtttttcaataaaaacaatgattcactcattacagtttccgtctatgcttcaaacagttttagttccttaaaatgtagaactacacctatcgaatacataaggagaggtcaaccagacgctggttttgctctgtttgaatcagaatctttgaaatggcccggctttgtagagtttgatgatgttaatgggaaggtactcacgttctcagcaaccgacagcatttacaaggtgtttgacttgaaaaactatacgctgttatacactatatcagataaaaatgtaaaagagatcaaaattagtcctggaatcatgttgttgagatataataaatcaagtggtcatgttccactcaagatactctctattgaagatggaactgttttaaaatctttcaaccatctccttcatcgaaataagaaggtggattttattgaacagttcaatgaaaagcttctcgtcaagcaagaaaatgagaatcttcagattcttgacgtacgcaattccgagctgatagaagttagcaagtcagaatttaagactccatcagcattcatctttctgtatgaaaaccaattatttctgacattcaaagaccgatcagtagctgtctggaacttcaaaggtcaacttgtgacttcatttgaagatcatgagttgtggtatcctgattgcaatactaacaatatatacataacaagtaatcaggatgttatcatttcatattgcaaagctgactctggtgatccgttatcagatggaaaagaaggttcgataaatatcagcaatattctgacaggaaaaagccttgctaaagtaacggcaacaaacaatctacaattagatgaatgtggttgcagtgacagtgtacgcagtggaagatgcaactgctacttacgaaatcgcaccgcaaattccaggattgtaagctctgttgctgaagcgctggaggacatcactgccctttactacaatgaagaacgtaacgagatatatactggcaataggcttggcttgatccacatgtggtctaactgaaggctttctatgtcaatgcaataaagttctttgattagtttattatgtttttaaactaataacttaagtgcttgtcatttctgtagttttaacaaaattttcattatgaccaatcttctgtcttttttggtgcacacaaggcctacctcgaaggagtcttgtatatgcagaattggttatgcaaatgatatttttgacctttaagaaaagct

SEQ ID NO: 5975 - DNA, 1123 bp, Festuca arundinacea
  misc_feature (717)..(717): n is a, c, g, or t
ggcacgagggcgaggcggatctcggcgagcccccggccgtgcaacggccggcgcgtggtggcgaagaagcggcccaggcaggaggcgcccgtcagcagcgtcaggaagctccagcgcagggagatcagctcccgccgcgagcgctccttcgccatgaactccgcgcaggagcgcttccgcaacatacagctgcaggaagagtttgacactcatgatcctaaggagaacagttcgctactaccgtacgtgaggaaaaggtcaaaaattatcgagatagttgcagcacgagatatagttttcgctttatcacagtcaggagtatgtgctgctttcagtagagtgacaaataagagaatatgctttctgaatgggagtcctgatgaagttgttcgtagtttattctacaacaagaacaatgactcgctcattactgtgtcagtatatggctctgaaaatttcagtgccctgcgatgcaagacaactcgtatagagtatatacgccgtggaaagccggatgccggttatcctctctttgagacagagtccttgaaatggcctggatttgtggagtttgatgatgtcaatggaaaggttttaacctattctgctcaagacagcacttacaaggtgtttgacttgaaaaactacacactgctgtactccatatctgacaagaatgttcaagaaataaagataagtcctggtataatgctattnatttatacgagaacaagcagctctattcctctgaagattctttctattgaggatggtacagttctgaagttcttcaaccaccttctccatcggaataagaaggtggatttcattgaacaattcaatgaaaagctcttggtcaagcaggatggggagaatcttcaaatacttgatgtacggaacttccagttgactgaagtgagcagtactgagttcatgactccatctgccttcatctttctgtatgaactccagttgtttttgaccttccggaatcgatctgtggcagtttggaatttccgaggtgaactagtaacgtcatttgaggatcacctgttgtggcaccctgactgcaataccaataacatatacataactagtgatcaagatcttattatttcttact

SEQ ID NO: 5976 - DNA, 1230 bp, Elaeis guineensis
  misc_feature (737)..(737): n is a, c, g, or t
  misc_feature (746)..(746): n is a, c, g, or t
  misc_feature (752)..(752): n is a, c, g, or t
  misc_feature (806)..(806): n is a, c, g, or t
  misc_feature (818)..(818): n is a, c, g, or t
  misc_feature (821)..(821): n is a, c, g, or t
ctacgaagcgagagtgagagagcttctcttcggtagccatggagtttgggcagaccttaaccctagctccatgccgtcccctctctccccagtgagctaacctcacgtctcccccgcctcccggctgtcggagtagaggtagaaggaggctgaggtggggcgccgagatggaaaaccacaagaagtcgcagctgagggtccggttccgggtgacggcgaggaagcgcggcctggagtcgagctccggcgagggatccgcccggaagctcagggagcgggacaacgccaactccgtgaggaagctccaccaccgcgagatcggcgggttccctcggatggcccggggcaccgccacgaactcgccagagaagttccgcaacatgcagcttcaggaggagtttgatacatatgatcacaacatccatttttttctaagactgcaatttctaaagaagaggtccaaaatcattgagattgttgcagcaaaagatgtcatatttgctcttgcacaatcgggtctctgtgctgcttttagtcggacgacaaacaaacgcatatgtttcttgaacataagccctgatgaagtgattagaagcttgttttacaataagaataatgagtcactcatcacggtgtcagtttatgcatcggaccatttcagttccttgaagtgcaggacaactccaatagagtatattaggaggaatcaattggatgctggctatcctctttttganactgagtcnctaaantggcctggttttgttgaatttgatgatgtaaatggcaaagtactaacttattcngctcaggatggnacntacaaggtatttgacctgaagaattactcctatctgtactcgataagtgataagaatatacaggagatcaaaataagtccaggaatcatgctgctaatataccagaggactcctggttatgttccactgactatcctgtcaattgaagatggaacagtgttgaaatctttcaatcacctgttacaccgtaacaagaaggttgacttcatcgagcagttcaatgagaagcttctggtcaagcaagagaatgagaaccttcagattcgcgatgtgcggaactcgaacctgattgaagtgagccgatctgaattcatgaccccctcagcattcatcttcctctatgaaaaccagctcttcttaacgttccggaacaggacagttgcagtgtggaatttccgcggagaactcg

SEQ ID NO: 5977 - DNA, 1663 bp, Orobanche aegyptiaca
gcgcggtggtttagatgggtttgttaacagcgtgaagaagctgcaaagaagagagatatcatctaagcgtgaccgctccttcagtatgagtgatgctcaagagcgctttcgtaacatttgcctgcaggaggaatatgatactcatgatcccaagggatattgttctttatcattgccgtttctaaagaagaggtcgaaaattattgagatagttgctgcccgtgatattgtctttgctcttgcgcaatctggtgtctgtgcagcattcagccagagtccaaccagagaatatgtttcctgaatgtttgttttgatgaagttattcggagctgttttacaacaaaaataatgattccctcatcacggtttctgtttacgcctcagataattttagttctttaaaatgcagaaccacaaggatcgaatacatacgaaggggtaaacctgatgctggtttcccgctgttcgtgtctgagtccttgaagtggcccggttttgtggaatttgatgatgtaaatgggaaggttcttacttattctgcgcaagatagcatatacaaggtgtttgacttgaagaactatacaatgctatactccatttcggataaaaatgtacaagagattaagatcagtccaggtatcatgctgttgattcttacaaaaacccatggtggtgtccctttgaaaattctctccatcgaggacggtacaattctgaaatcttttagccatctccttcataaaaacaagaaagtcgatttcatcgaacagttcaacgaaaagcttctcgtaaagcaagagaatgagaatctccagattgttgacgttcgtaatactgagattacggaagttagcaggaccgaattcatgaccccatctgcatttatatttctgtacgagaacaactgtttctgacgttcagaaaccgaacggtcgctgtttggaacttcagaggggagctcgtgacctcatttgaggatcaccttttatggcatcctgattgcaatactaacaacatttacattacaagtgatcaggacctcatcatttcttactgtaaagctgattcggaagaaccattatctgaaggacatgctggttctatcaatataagcaatatattgacggggaagtgccttgcgaagataaaagcgagcaacggtctccctgcgaacgagtgcaattgcagcttagattgcggtggcagaaactgcagctcaaggaaacgcaacgaaacttctaggattcggagcactgtagcagaggcccttgaagatataactgctctgttttacgatgaagatcgtaatgaaatctacactgggaatagacatggtcttgttcatgtctggtctaactagagggaggggggggggggggcatttgctgcttttttccgacgttaaatctgtaatcttggcaatttcgtgcatttagtttgtctaccccccataggagggggtatatttggaatgatgttgtatacattgttagagtttgttaaaaatcgactttttttttgggtgtgaaagtcttcggattgtttcatgttgtagattgtgtttcataaccttggggctctcaggtgggagctttaaaacttggaaatcttgtaatttttctttgagttagaagtgatatattggctagtgttctgaatgcgt

SEQ ID NO: 5978 - DNA, 2028 bp, Triticum aestivum
cctcgtgtgccaccccaaatctccgagccgagctcccaaaccctagcctccggcgccggcgatggccctcgtcgcgtcggcgtgagacgggatctgtcgcgcgcggcgtcggcggggagttgcgggcgggcgggagggagtcgggctggcggggatggaggcgaggcggatctcggcgaccccacggccgtgcaacggccggcgcgtggtggcgaggaagaggccgaggcaggaggcggtcatcagcagcgtcaggaagctgcagcgccgggagatcagctcccgccgggaacgctccttcgccatgaactccgcgcaggagcgcttccgcaacatacagctgcaggaggagtttgacactcatgatcctaaggagaacaatgcgctactaccttacattaggaagaggtcaaaaattattgagatagttgcagcacgtgatatagtttttgctttatcacaatcaggagtatgtgctgcttttagtagagtgacgaataagagaatatgctttctaaatgggagtccagatgaagttgttcgtagtttattctacaacaagaacaatgattccctcattactgtgtcagtatatggttctgaaaattttagtgccttgcgatgcaagacaactcgaatagagtatatacgtcgtggaacaccagatgctggtttccctctttttgagacagagtccttgaaatggcctggcttcgttgagtttgatgatgtcaatggaaaggttttaacttattccgctcaagacagcacttacaaggtttttgacttgaaaaactacaccctactgtattccatatctgacaagaatgttcaagaaataaagatcagtcctggtataatgcttttgatttatacaagaacaagcagctccattcctctgaagattcttaatattgaggatggcacagttttgaaattcttcaaccacctcctccatcgaaataagaaggtggatttcattgaacagtttaatgaaaagctgttggtcaagcaggatggagagaatcttcaaatacttgatgtacggaacttccagttgactgaagtgagcagtactgagttcatgactccatctgcctttatctttctgtatgaactccagttgtttttgacattccggaatcgatctgtagcagtttggaatttccgaggtgaactagtaacatcatttgaggatcacctgctgtggcaccctgactgcaataccaataacatatacataaccagtgatcaagatcttattatttcttactgcaaggctgattccactgattcatcttcagaagaaaatgctggctctataaacatcagcaacatactgacagggaaatgcttggctaaaataaaggctggcaatttcaacgagcaaaagaagacatggaagttccagaatacaatcaccgaggctcttgaggacatcacagctctgtactatgacgaagagcgtgatgagatctacaccggcaaccgccatggccttgttcatgtgtgggcgaactgagagctgagaaagcaaatttcagggacaaacaagatgttgttcgtttgcaggcggaccaatttaacaaccaagcctcaggtggtgctggccgcgaagaggtcttgggtctccagccgttagcaatttgttgatgtggattattgtggtgtcgagctgctctttaccgacagaagatttgttgtagagttagtgcttgtcatgtgctttaccatagcctgtagtagccttggagatgtctcgaggcgagctctcaaactgtacctcatgtaatgtgccttcctggtagttaactctgctacctgaaatagtgatacctcattctgtctgtcatgtgtctggttgttgttgagtttgggatcttgtaaacataaacaattggaatatgtggcatagaaaacgccttctactctgacgagagatggttgacggcaaaaatcatttttttgaggaacagttggtcactttattgctcaataataaggggtacctcggccgcgaccacgcta

SEQ ID NO: 5979 - DNA, 1277 bp, Guizotia abyssinica
ggtggatgagaggatatctcagaatatttccatcaccaccgcggtagtggcccagctctcaggcatatgtccggttgaggtgcatgcggtcttcgtaacaatatgatactgaggagttctggggacactccccattaaaattaccattctcgacgaaaaggacaaaagtcattgaaatagtagcggcgcatggtatagtatttgctcttgcaagttctggtgtttgtgcagcttttagtagagatacaaacaagaggatatgcttggtgaacatctatccggatgaagtaatggcggagcttgttttacaataaaaataacgactcgttaataacggtttctgtgtatgcttcggacaatttcagttctctcaaatgcagatcaacgcgtatagagtacatacaaagaggtcaaccagatgctggttttcctctgtttgaatcagagtctctgaaatggcctggttttgtagagtttgatgatgtcaacgggaaggtgttgacatattctgcccaagacagcatatacgaggtctttgacttgaagaattatacattgttatactctatagcagacaaagacgtagaagaaatcaagatcagtcctgggatcatgttattgatcttcactagagctcagagccatgttcctttaaagatactatcaatagaagatggcacagttttaaaagattccatcatttactcatcggaataagaagtggattttatcgagcatttaatgaaaagcttcttgttaagcaagagaacgagaatctccaaattcttgatgtacgaaatgctggagtgaaagaagttggtaaaactcagttcgtgactccatctgcgtttatttttctctatgaaaatcagctatttttaacattcagaaaccaaactgtttctgtttggaattttcgaggagagcttctgacatcatttgaggatcatgagctatggcattcggattgcaatacaaataacatctatataacaagtgatcaagatcttataatttctttctgcaaagatgactcaaatcatcaaagaactagtgggaaagcagccggttctattaatatcagcaacatatggactgggaaatgtgtagctaaaatacactcgagcaatgcgattcttaatgctcatcagaagcaaaagacgaatgcaagtcaattggttgcagatgcacttgaagagataacagctctttatttcgatgaagacgcaatgagatttatacaggtaataatcgcggtttagttcatgtttggtcaa

SEQ ID NO: 5980 - DNA, 1062 bp, Pseudoroegneria spicata
atttatacaagaacaagcagctccattcctctgaagattctttctattgaggatggcacagttttgaaattcttcaaccacctcctccatcgaaataagaaggtggatttcattgaacagtttaatgaaaagctcttggtcaagcaggatggagagaatcttcaaatacttgatgtacggaacttccagttgactgaagtgagcagtactgagttcatgactccatctgcctttatctttctgtatgaactccagttgtttttgacattccggaatcgatctgtagcagtttggaatttccgaggtgaactagtaacatcatttgaggatcacctgctgtggcaccctgactgcaataccaataacatatacataaccagtgatcaagatcttattatttcttactgcaaggctgattccactgattcatcttcagaagaaaatgctggctctataaacatcagcaacatactgacagggaaatgcttggctaaaataaaggctggcaatttcaacgagcaaaagaagacatggaagttccagaatacaatcacagaggctcttgaggacatcacagctctgtactacgacgaagagcgtgatgagatctacacgggcaaccgtcatggccttgttcatgtgtgggcgaactgagagccgagaaagcaaatttcagggacaaacaaggtgttgttcgtttgcaggcggaccaatttaacaaccaagcctcaggtggtgctggccgtgaagaggtcttgggtctccagccgttagcaatttgttgatgtggattgtggtgtcgagctgctctttaccgacagaagatttgttgtagagttagtgcttgtcatgtgctttaccatagcctgtagtagccttggagatgtctcagggcgagctctcaaactgtacctcatgtaatctaccttcctggtagttaactctgctacctgaaatagtgaaacctcattctgtctgtcaatgtgtctggttgttgttgagatttggatcttgtaaacataaacaattggaatatgtggcatagaaaacgccttctactca

SEQ ID NO: 5981 - DNA, 2050 bp, Oryza sativa
acccacctcttctccttccttccccccctcgactccccaccaccaaattccccctcaaaccctagctagctccacctcctcctcctccttcgaaaccctagcctcaccaccccccgccacgagggaggagcgagcggcgcagtggtggacggcggcggcggcgggatggaggggcccaagaggtcgcagctgagggtgcggctccgcgtgacggcgcggcggaggggcggcgacggcggcgcggacggcggagggagcgggggcggaggcggcggggccgggggcaggaagcggctgctggacgcgccggccttcaactcggccgcgaagctgcagcggcgcgagatcgggggcaggcagctcgccgcgcgcggcgggggcgccgcgtccgccgtgcccgagcggttccggaacatgcatctccaggaagagttcgatacgtatgatcacaatgcccacctatttgtgaagctgcagtttcttaaaaagagatccaaaataattgagattgttgcagcaaaagatatcatatttgctcttgcgcactctgggttgtgtgctgcttttagtcgagttacaaataagcgcatatccttcctgaatttaagcccagatgaagtcatccggagcttgttctacaacaagaacaatgattcacttattactgtgtctgtttatgcgtcagaccattttagcacattgaagtgcagaacaaccccaatcgagtatataaggaggaatcagttagatgctgggtttcctctttttgaaacagaatctctgaagtggcctggctttgtggagtttgatgatgtgaatggaaaagtactcacctactcagctcaggatggtatctataaggtcttcgatttgaagaattactcttttctatattcaatacctgacaccaatgtgcaggagataaaaataagtccaggaatcatgctcttgatatatgaaagaacaccatgtcatgttcctttgaagatattgtcaattgaagatggaagaccactaaaatccttcacgcatttgttgcaccgtaataagaaaattgattttatcgagcaattcaatgaaaagctccttgtcaagcaagaagatgagaaccttcagatacttgatgtacggagttctgagctaattgaagtcagtgttaccaagtttatgactccatcagcattcatttttctgtacgagaacaatctcttcttgacattccgaaacaggacggttgctgtatggaattttcgaggagagctcgtgacctcatttgaagaccatttgctttggcatcaagattgtagcaccaacaatatctacattaccagtgatcaggatctgattatctcatactgcaaatctgaggcaggggttgatgatggtacagtacctccaattgggtctatcaacatgagtgacattatgactggcaaatgcatcgccaagattgctgctaatgatcccaccctccgtattggccctcgcaagaatggtaactctgagaggtcctcaatttggagcaccattccagaagctcttgaagatgtcacagcgcttttttatgacgaggacaggaatgagatctatactggcaacaggcatgggctggtgcatgtgtggtccaactaggttgtaatatgtatatgtacatacgcccttttcgatttgaccagaagattggattagccattgtgcaccatcatcccctgcctggtgatcaccttagtttttgtatttttggtcttttggcaaagaatgttattcccttgtcagtcaagagaaaaatgtagttaccctgtatatatcttttgtaatgccctgtcatataccatgttcttggcagctggcctctctgtcccaaccacgaaacatctggcaggaaccatctaactaattaagcttctcattcctttcggtgtttattcttcgaaagaattggcgcagcaacattgcgttcactttatctttgagcatttggaagatatctatgctccatagaatgtaccatttttttctgaccccaaggttctagactaatggcagacct

SEQ ID NO: 5982 - DNA, 1224 bp, Centaurea maculosa
cgagagaatatgctttctgaacgttagccccgatgaagttatcagaagcttgttttacataagaacaatgattcactcattacggtgtctgtctatgcttcagacagctttagctccttgaaatgcagaacaacgaggatcgaatacatacggcgaggtcaacctgatgccggttttgctcttttcgagtcggaatctttgaaatggcccggttttgtggagtttgatgatgtgaatggaaaagtgctgacgttctccgcacaagatagcatttacaaggtgtttgatctgaaaaactatacattgttgtactccatatcggacaaaagtgtacaagagatcaaaatcagtccgggaatcatgttgctgatatataataaagctagcggttacgttctctcagatcctctctatgaagatggaaccgttttgaaatctttcaatcatcttcttcatcgaaacaagaaggtggatttcatcgagcagttcaacgagaagcttctcgtcaagcaagaaaacgagaatcttcagattcttgatgtacgcaactctgacctaacggaagttagccgaacagagttcatgaccccatcggcgttcatcttcctgtacgaaaaccagttattcctgactttcagaaaccgaacggtggctgtatggaacttccgtggggaactcgtgacctcgttcgaggatcatttattgtggcatcccgactgcaacactaataatatatacatcacaagtgatcaggatcttattatttcgtactgcaaagccgagtctgatgatcctttaaccgaaggaaatggttcgataaatataagcaacatattaacagggaaatgccttgctaaaataaaagcaaaagatggtgttccgatggaggagtgtgattgtggaagcggaagcagttgcaagtgcaggaggtcgggaaagcgaatgcgaagggaaatgagttcggtgacggaagctttggaggacataacggcccttttttatgacgaagagcgtaacgagatatatacaggtaacaggctggggttggtgcatgtatggtccaactgatgtgtagtaatttcaaccccttctaaaattagaaaggggtttttgtttattggagagagagatattggttttgtaagcaggatatggatatggatatggatgtgttgtttttaactgttaaaaaagaggtaatatgtgaatggttggataattatg

SEQ ID NO: 5983 - DNA, 769 bp, Platanus occidentalis
gtcagccctcgcccttgttgtggtcgccggatttggctagaaacggccacgcgtcgatggattcgtgaacagcgtgaagaagcttcagagacgggagatatgttcgaagcgtgaccgtgcttttagtatgagcaatgcccaggaaaggttcaggaatatacgtctgcaggaggaatatgatactcatgatcccaagggtcattgttccctggtattgccttttctaaagaagcgatcaaaaattattgagatagtggctgcacatgatattgtctttgctcttgcacaatccggtgtctgcgcagcttttagcagagagtttgatgatgtaaacggcaaggttctcacttactccgcacaggacagcatatacaaggtattcgacttgaaaaactacacaatgttatattccatatcagataaaaatgtacaagaaattaagatcagtccaggtataatgctgttgatattttcaagagctagtagctatgtcccactaaagattttatcaatagaggatggcactgtactcaaggctttcaaccatctcttcatcgaaataagaaagtggacttcatagagcagttcaatgaaaagcttcttgtcaagcaggagaatgaaaatcttcagattcttgatgtccgtaatgctgagctaacagaagttagcagaactgaattcatgactccgtcagcatttatatttctgtatgagaatcaattgttcttgacgtttcgaaaccggacagtggctagtttaggaaacttac

SEQ ID NO: 5984 - DNA, 2106 bp, Sorghum bicolor
accacctgaaccttttcccttcgtccccatctctcgtctctcccctcctccagcccgacccggcgacctccattccgaaccctagccccctaccaccactgcggcctgcctcctctgggcgggtcctgcccagatccagcacaggaggttaagcaggaggcgggcgggcgggcgggcggtggatggacgggccgaagcggtcgcagctgcgggtgcgcctccgcgtcacggcgcgccggcgtggcgccgacggcgacggcgccgggggcgcggccgggcccggagggcggaagcgccggatggaggcccccgtcctcaactccgccgccaagctgcagcgccgcgagatcgggggccgccagctcgccgcgcgcggcggtggccccgccgccgccgtgcccgagcgcttccggaacatgcagctccaggaggagttcgatacatatgatgccaatgctcacctatttgtgaagctgcagtttcttaaaagaagatccaaaattattgagatcgttgcagcaaaggatatcatatttgcccttgctaattccgggctttgtgctgcttttaaccgagtaacgaacaagcgcatagccttcttgaatttgagcccagatgaagtgattcggagcttgttctacaacaagaacaatgattcccttattactgtttcagtttatgcatctgacaatttcagcacattgaagtgcagaacaaccccgattgagtatattagaaggaatcagttagatgctgggtttcccctctttgaatcagagtctctgaaatggcctggatttgtggagtttgatgatgtcaatggaaaagtactcacatattcggcgcaggatggtatatataaggtatttgatttgaagaactactccttcctatattcgataccagatgaaaacgtgcaggagataaagatcagtccaggaatcatgctcttgatatacgacagaacaccaagttatgttccattgaagatattatcaattgaagatggaaagccactgaaatcttttaagcacttgttgcaccgcaacaagaaaattgatttcattgagcagttcaatgagaagctccttgtcaagcaagaggatgaaaacttccagatacttgatgtgcggagttctgagctaattgaagtcagtgtctccaagtttatgaccccttcagccttcatttttctatatgagaacaatctcttcttgacattccgaaacagaactgtcgctgtatggaacttccgaggagagcttgtgacttcatttgaagaccacttgctttggcatcatgattgtagcaccaacaatatttacatcactagtgatcaggatcttattatctcatactgcaaatccgaagcagtggctgaggatggtacagttattccagttggatccatcaacatgagtgagattatgactggcaagtgtatcgccaagattactgccaatgatcctgccctaagtgtggcccctcacagaaatgatcgcagcaagcggtccttgggctggagcaccgttccagaagctctggaggatgtcacagcactgttttatgatgaggacaggaacgagatctacaccggcaacagtcatggactggtgcatgtatggtcgaactagatagtaacatgtgcatacatttcgcccttttggtttgacttggctagcttgacttcattctgtataatccccggcttggggctcacctagcttttgtatctggcaatagaatgtgtttccttgagcaattgtgaatgcaaattgttcttgtaaatatcctgtgttcgtctaccttactcaagtaacatagaaattagcctccaaatctaactttgttggatgcatcctgccatgtttctggcagaaagagagtgaagacctggagctctgacctgctgtttatgttattgttattttcacatgtgtaggatttgcaaaatggttgtgttctgttgagagcattgttgtcagaacttgctacttaagttagttgtggttcttttgtctaagctgctgaatagtcgtttttgaagccttggatgatccacctttaattattggttaatccatacctgattgagctcagtattct

SEQ ID NO: 5985 - DNA, 2107 bp, Sorghum bicolor
aaccacctgaaccttttcccttcgtccccatctctcgtctctcccctcctccagcccgacccggcgacctccattccgaaccctagccccctaccaccactgcggcctgcctcctctgggcgggtcctgcccagatccagcacaggaggttaagcaggaggcgggcgggcgggcgggcggtggatggacgggccgaagcggtcgcagctgcgggtgcgcctccgcgtcacggcgcgccggcgtggcgccgacggcgacggcgccgggggcgcggccgggcccggagggcggaagcgccggatggaggcccccgtcctcaactccgccgccaagctgcagcgccgcgagatcgggggccgccagctcgccgcgcgcggcggtggccccgccgccgccgtgcccgagcgcttccggaacatgcagctccaggaggagttcgatacatatgatgccaatgctcacctatttgtgaagctgcagtttcttaaaagaagatccaaaattattgagatcgttgcagcaaaggatatcatatttgcccttgctaattccgggctttgtgctgcttttaaccgagtaacgaacaagcgcatagccttcttgaatttgagcccagatgaagtgattcggagcttgttctacaacaagaacaatgattcccttattactgtttcagtttatgcatctgacaatttcagcacattgaagtgcagaacaaccccgattgagtatattagaaggaatcagttagatgctgggtttcccctctttgaatcagagtctctgaaatggcctggatttgtggagtttgatgatgtcaatggaaaagtactcacatattcggcgcaggatggtatatataaggtatttgatttgaagaactactccttcctatattcgataccagatgaaaacgtgcaggagataaagatcagtccaggaatcatgctcttgatatacgacagaacaccaagttatgttccattgaagatattatcaattgaagatggaaagccactgaaatcttttaagcacttgttgcaccgcaacaagaaaattgatttcattgagcagttcaatgagaagctccttgtcaagcaagaggatgaaaacttccagatacttgatgtgcggagttctgagctaattgaagtcagtgtctccaagtttatgaccccttcagccttcatttttctatatgagaacaatctcttcttgacattccgaaacagaactgtcgctgtatggaacttccgaggagagcttgtgacttcatttgaagaccacttgctttggcatcatgattgtagcaccaacaatatttacatcactagtgatcaggatcttattatctcatactgcaaatccgaagcagtggctgaggatggtacagttattccagttggatccatcaacatgagtgagattatgactggcaagtgtatcgccaagattactgccaatgatcctgccctaagtgtggcccctcacagaaatgatcgcagcaagcggtccttgggctggagcaccgttccagaagctctggaggatgtcacagcactgttttatgatgaggacaggaacgagatctacaccggcaacagtcatggactggtgcatgtatggtcgaactagatagtaacatgtgcatacatttcgcccttttggtttgacttggctagcttgacttcattctgtataatccccggcttggggctcacctagcttttgtatctggcaatagaatgtgtttccttgagcaattgtgaatgcaaattgttcttgtaaatatcctgtgttcgtctaccttactcaagtaacatagaaattagcctccaaatctaactttgttggatgcatcctgccatgtttctggcagaaagagagtgaagacctggagctctgacctgctgtttatgttattgttattttcacatgtgtaggatttgcaaaatggttgtgttctgttgagagcattgttgtcagaacttgctacttaagttagttgtggttcttttgtctaagctgctgaatagtcgtttttgaagccttggatgatccacctttaattattggttaatccatacctgattgagctcagtattct

SEQ ID NO: 5986 - DNA, 2020 bp, Fagopyrum esculentum
atcctttcaatagaggatggtactgtgctaaaatcattcaatcatctcattcaccggggcaaaaaggtggacttcattgaacagttcaatgaaaagctccttgtaaagcaagagaatgagaatcttcagatccttgatgttcgcaattccgagttaagagaagttagcagaactgaattcatgaccccgtctgcatttatttttctttacgagaatcaactattcttgactttcagaaaccgaactgtggctgtatggaatttccggggagaacttgttacatcgtttgaggatcatctgttgtggcatccagactgcaacactaataacatatatatcacaagtgaccaagatctcattatctcatactgtaaagcagattcggatgaattactgtcagaaggaactgctgggtcaatcaatgtgagcaatatcctgacgggaaaatgcctagcaaagataaaggttgacaactgcagtcaaacaggagaggacgtggagagcagtggcagcaacaggcgtagctctagtagaaaacggacacaggcatcaagattaaggagctccgtccaggaagctctggaagatataacggcccttttctacgatgaagaaaggaatgagatttatacaggcaatcgacacggtctggtgcatgtatggtccaactgagggcaaggcttataatagaagctttgtttgtagcatacgttgtcatttgtgtgtaaaagtacggtcgtgtatgttttaggaatattgtcattccattttaatgattacgtctttctttcaacacagcaagggttattttggagtctagtaaatttaatttgcacatttgaggtgaccagagagtaactggtgtaatggttcagttggtaaaatgatgtttgtgcatgaaatgattcattatatcaagatggtacttgctgttggatagaatgaaaaaccactattaaaagatttgatcaacttcatattgcattacagtaataatctcttacaagacacccaaatcagaataatgatgtgttaagcctggctcgaatccagtccactggctaaatcattttcagttaccttgttgattcccagtccttaagcttcttacttccctttggtttttctattggcttattcatccccgccattttcgcattgtacttggcccgaagtggatcattgtacgtccacggattgttccaatcagtagtatcctcattaacaaggtgagtccatttggtccggccactgcgtccaaagtgcttaacttgcataacctttggcaatattgtcttgtccatcttatcttcaccagtgggggcggagaaatcgcgggtgaggatgtttccagagccagcttgttcatcattatctgactggaagaaggcacccttgtggtaatacttctgcataaacctccacttctgcttggggactgcaactgttcttgggttcctcctttcccactccctcctctcttcctctgtcatattcctcaccttctctatctcttccttctccttcaacatggcctctctagcctccctgtccctctttatcctccctatctctctccccttccagctctcgtactctccgcctcgttcaactcgtcgtccgtctcaacatctccaatgttggcctcctcggcttccaagttcttctgtataacctgctcctcttttatcttctccaccactatctgcttggtctccaccttcctctcctccattcgacgcctcaccgcctcctgcagggcctcctcctcggcttccaaccgctccctttccgctattgtatccctctctgatttcggaacgaacaccggtttcacaagcgctatccccgaaacgtcttcgtcctcggaatccgtctcgtactcagattcctcttcttcctcatcctcctgttcatcggcgatttcctcctccaatggcgccgtctcctcttgctgcctctgcaacagcctctctcgaatcctccttctacgctcctccaacgcatcctcatcctcttc

SEQ ID NO: 5987 - DNA, 848 bp, Amborella trichopoda
  misc_feature (23)..(23): n is a, c, g, or t
  misc_feature (209)..(209): n is a, c, g, or t
  misc_feature (228)..(228): n is a, c, g, or t
  misc_feature (243)..(243): n is a, c, g, or t
  misc_feature (363)..(363): n is a, c, g, or t
gtctggctctgaagatcttatcnaatagaagatggcacagttttgaaagcattcaaccatcttcttcatcggaataaaaaggtggacttcattgagcagttcaacgaaaagcttctggtgaagcaggaaaatgaaaacctccagattcttgatgttcggaattctgaactaacggaagttagcagaacggagttcatgacaccatcggncttcatcttcctttatganaaccaactattcttnactttccgaaatggaacggtggctgtctggaactttcgcggtgagcttgtgacctcttttgaagatcacatgctttggcacccggattgtaatacaaacaacatttacatcacgagcgancaggacctcatcatttcttattgtaaggctgaccccgatgactcatctgtcgaaggaaaagtcggttcgatcaacataagcaatatcttgactggaaagtgccttgcaaagatacatgcaaatgattcaaacgtgattgtgaacaagaataagccgaacaagaataagcggccgaggtttaggaacacagttgctgatgcccttgaggacataaccgcactcttctacgacgaagagcgcaatgagatatacacgggaaacaggcagggtctggtccatgtttggtccaattgattgattggactctctctctctctctctctctctctctctctcgcctggctcgtgcgagtgatgcacgtgatctaccctcccaggtcacgacacggtcttggggaattgtaggccttgtaattgtgtcacccaatgtccgtggcactgtaactgttacttgtccatttagtttttcctaattttctctctac

SEQ ID NO: 5988 - DNA, 1702 bp, Brachypodium distachyon
cgcgcgtgcgtgagtgccgtagggaggaggaggaggatggacggccccaagaggtcgcagctgcgggtgcggctccgggtgacggcgcgccggcgtggcgttgccgacggcgcggacaggttcggggcgggcggcagcggcgcgggcggcgggcggaagcggcgcctggacgccccgctcgtcaactccgcggccaagctgcagcgccgcgagatcgggggccgccagctcgccgcgcgcggagggggcgccgcggccgccgtgcccgagcggttccggaacatgcagctccaggaagagttcgatacatatgatcaggatgctcacctctttgtgaagctacagtttcttaaaaagcggtccaaaattattgagattgtcgcagcaaaagatatcatatttgctcttgctcattctgggctctgtgctgcttttagtcgagtaacaaacaagcgcatatccttcctgaatttaagcccagatgaagtgattcggagcttgttctacaacaagaacaatgattcacttatcactgtctcagtttatgcatcagacaattttagcacattgaagtgcagaacaaccccaattgagtatataaggaggaatcagttagatgcagggtttcctctttttgaaacagaatccctgaagtggcctggctttgtggagtttgatgatgtaaatgggaaagtactcacttactcggcacaggacggtatctataaggtgtttgacttgaagaactattcctttctgtattcaataccagataccaatgtacaggagataaagattagcccaggaatcatgctcttgatatatgatagaacaccaagttatgttcctttgaagatattatctatagaagatggaaagctactgaagtcattcaagcacttattgcaccgtggcaagaagattgatttcattgaacagttcaatgagaagctccttgtcaaacaagaagatgagaaccttcagatacttgatgtacgaagttctgagctaattgaagttggcatcaacaagtttatgaccccatcagcattcatttttttgtatgagaacaatctcttcttgacattccgaaacagaacagttgctgtatggaatttccgaggggagcttgtgacatcgtttgaggaccatttgctttggcatcaagattgtagcaccaacaatatttacattacaagcgaccaggacctgattatctcgtactgtaaatccgaggcagcgactaatgacagcactgcttctccgattggatccatcaacatgagtgacataatgactggcaagtgcattgccaagattgctgccaatgaccccaccctgagtatcgctcctcgcaagaatggtagcccctcaatctggagcactgttccagaagctctagaagatgtcacagcgctgttctacgacgaggataggaatgagatctacactggcaatagtcatgggctggtgcatgtgtggtctagttaggtagtaataatacatgtatatgtcacctttcgatctgatcagaagattgaatgcgttgctgcattctgtgtcattttcaggttgggtacctcattttgtattttggcaatagcatgtaattccttgagaagatgtagttttcctgtaaatattttgtgatgctctgttatctaccatattatagtagtaattcagaaattatcaagtcaca

SEQ ID NO: 5989 - DNA, 940 bp, Citrus sinensis
gtaactttcatttgctggaagaatatgatacatgtgacccaaaagacaattgtcccatggaactgctgccattcatgaagaagaggtcaaaggttactgagattgtggcagcacaagacattgtctttgctcttgctcaatctggtgtttgtgcagcatatagccgagagactaaccggaggatatgctttctaaatgccactgccgacgaagttgtaagaagcttgttttttaacaagtacaacgattcacttatcatcgtttcagtttatgcttcggacaatttcaattcgttgaaatgcaggagcacaagaattgaatgcataaagagaggtattgcagatgctggttttcctctttttgaatctgagtcattgaagtggcctggttttgttgagtttgatgatgtaaatggcaagatagtcacttactctgcagaggacagcacatacaaggtgtttgacatgaaaagttacacaatgctgtactcgatatctgataaaaatgttcaagaattgaagaccagtccaggggttatgttgttgatttttaacagaactggaggccatgttcccctgaagattctttcaatagaggatggttctgttctcaatcttttaaccatattattcatcggaataagaaggtggacttcatcgaactgttcaatgagaagctacttcttaagcaagaaaatgagaatctccagattcttgatgtcaacaattttgagctgacagaagttagcagcactgaatttgtgacaccatcggcattcatattcctatacgaggaacagctattcctgacttttagaaatcaaactgtgtctgtctggaactcccgtggggagcgtgtaacttcatttgaggatcaccttttgtggaatcccaattgcaacactaataacacctatatcaccactgatcaggaatttata

SEQ ID NO: 5990 - DNA, 2212 bp, Zea mays
ttaatgatatcatatatttataaactgaggtaggtctaagatggagtgattcctcagtcttcgaacaaacacaccgtagcccccctcctctcttccccaaacacacaccacaaccataaccacgaactacctgaacggctgaacaattcccttcgtcccatcttcctctcgtctctcccaccccccgacccgaccgggcggcctcctccccgaaccctagcccctctacaaccaccgcgtcctgcctcctctgggcggctccgccccagatccagcacagcaggttaaaaagggggcgggcaggcgttggatggacgggccgaagcggtcgcagctgcgggtgcgcctccgcgtcacggcgcgccggcgtggtgccgatggcgacggcgccgggggcgctgccgggcctggggggcgtaagcgccggatggaggcccccgtccgcaactccgtcgccaagctgcagcgccgcgagatcgggggccgccagctcgccgcgcgcggcggcggccccgccgccgccgtgcccgagcgcttccggaacatgcagctccaggaggagttcgatacatatgatgaaaatgctcacctatttgtgaagctgcagtttcttaaaagaagatccaaaattattgagattgttgcagcaaaggatatcatatttgcccttgctaattctgggctttgtgctgcttttgaccgagtaacaaacaagcgcatagccttcttgaatttgagcccagatgaagtgattcggagcttgttttacaacaagaacaatgattctcttattactgtttcagtttatgcggctgacaaattcagcacattgaagtgcagaacaaccccgattgagtatattagaaggaatcagttagatgcagggtttcctctctttgaatcagagtctctgaaatggcctggatttgtggagtttgatgatgtgaatggaaaagtactcacatattcagcgcaggatggcatatataaggtatttgaattgaagaactactccttcctatattcaataccagatgaaaacgtgcaggagataaagatcagtccaggaatcatgctcttgatatatgataggacaccaagttatgttccattgaagatactatcaattgaagatggaaagcaactgaaatcttttaagcacttgttgcatcgcaacaagaaaattgatttcatcgagcagttcaatgagaagctccttgtcaagcaagagaatgaaaacttccagatatttgatgtgcggagttctgagctaattgaagtcagtgtctccaagtttatgaccccttcagcattcatttttctgtatgagaacaacctcttcttgacattccgaaacagaacagtcgctgtatgggacttcagaggagagcttgtgacttcatttgaagaccatttgctctggcataatgattgtagcaccaacaatatttacatcacgagtgaccaggatctcattatctcgtactgcaaatctgaggcagtggctgaggatggtacagttgttccagttggatccatcaacataagtgagattatgacaggcaggtgtatcgccaagattactgccaatgatccttccctaagtgtacccggacgcagaaatggttacagcaagcggtcctcggactggagcaccgttccagaagctctggaggacgtcactgcactgttttatgatgaggacaggaatgagatctacaccggcaacagccatgggctggtgcatgtgtggtctaactagatagtagcatgtacatacatcatttcgcccttttgatttgacttggttagctttactgcatgctgtataatccttggctcgggggctcacctagcttttctatttggcaatagaatgtgtttccttgagcaattgtgattgcatagtgttcttgtaaatatcttttgttcagctaccttgttcaagtaacatagaaataggcctgccaaatgtaactttgctggatactgccagccaagtttcgggcagcaagagagtgaagacctgcagttctgaccatcatgttattgttattttcaagtgtgttgtagtgttcgttttgtctgtaagctgctgaattatcgtatctgaagccttggatgaaccacctttaattatcagttaatctgtacctgattgacctcagtattcttggtccggagaccaccctcctggtattatattaagaaa

SEQ ID NO: 5991 - DNA, 1255 bp, Saccharum officinarum
ctttgtgctgcttttaaccgagtaacgaacaagcgcatagccttcttgaatttgagcccagatgaagtgattcggagcttgttctacaacaagaacaatgattcccttattactgtttcagtttatgcatctgacaatttcagcacattgaagtgcagaacaaccccgattgagtatattagaaggaatcagttagatgctgggtttcccctcttcgaatcagagtctctgaaatggcctggatttgttgagtttgatgatgtgaatggaaaagtactcacatattcagcgcaggatggtatatataaggtctttgacttgaagaactactccttcctatattcaataccagatgaaaacgtgcaggagataaagatcagtccaggaatcatgctgttgatatatgatagaacaccaagttatgttccattgaagatattatcaattgaagatggaaagccactgaaattctttaagcacttgttgcaccgcaacaagaaaattgatttcattgagcagttcaatgagaagctccttgtcaagcaagaggatgaaaacttccagatacttgatgtgcggagttctgagctaattgaagtcagtgtctccaagtttatgaccccttcagcattcatttttctgtatgagaacaatctcttcttgacattccgaaacagaacagttgctgtatggaacttccgaggagagcttgttacttcatttgaagaccatttgctttggcatcatgattgtagcaccaacaatatttacatcactagcgatcaggatcttattatctcatactgcaaatccgaagcagtggctgaggatggtacagttattccagttggatccatcaacatgagcgagattatgactggcaagtgtattgccaagattactgccaatgatcctgccctaagtgtggcccctcgcagaaatggtcgcaacaagctctggagcaccgttccagaagctctggaggacgtcacggcactgttttatgacgaggacaggaacgagatctacaccggcaacagtcatggactggtgcatgtatggtctaactagatagtaacatgtgcatacatttcgcccttttgatttgacttggttagcttgactgcattctgtataatccccggctcggggcaccacctagcttttgtatctggcaatagaatgtgtttccttgagcaattgtgaatgcaaaggttcttgaaatatcttttattcatcgaccttggtcaagtaa

SEQ ID NO: 5992 - DNA, 1360 bp, Citrus clementina
ggaagaatatgatacatgtgacccaaaagacaattgtcccatggaactgctgccattcatgaagaagaggtcaaaggttattgagattgtggcagcacaagacattgtctttgctcttgctcaatctggtgtttgtgcggcatatagccgagagactaaccggaggatatgctttctaaatgccactgccgacgaagttgtaagaagcttgttttttaacaagtacaacgattcacttatcatcgtttcagtttatgcttcggacaatttcagttcgttgaaatgcaggagcacaagaattgaatgcataaagagaggtattgcagatgctggttttcctctttttgaatctgagtcattgaagtggcctggttttgttgagtttgatgatgtaaatggcaagatagtcacttactctgcagaggacaggcaaggcacatacacggtgtttgacatgaaaagttacacgatgctgtactcaatatctgacaaaaatgttcaagaatttaagatcggtccaggggttatattattgatttttaccagaactggagaccatgttcccctgaagattctttcaatagaggatggttctgttgtcaaatcttttaaccatattattcatcggaataagagggtggacttcatcgaactgttcaatgagaagctacttattaagcaagaaaatgagaatctccagattcttgatgtcaacaattttgagctgacagaagttagcagcactgaatttctgacaccatcagcatttatattcctatacgaggaacagctattcctgacttttagaaatcaaactgtgtctgtttggaactcccgtggggagcgcgtaacttcatttgaggatcaccttttgtggaatcccgattacaacactaataacatctatatcaccactgatcaggagcagataatttcttactgcagggacgattcagatgatcctcaatcaaaaggaaatgggtctataaatatcagccacatattgactgggaaatgccttgccaaaataagagcaagcgattcccattcccctgcctccagaattaggagcacggatgcagaagccttgaaagacattaccactctcttctatgatgaagcgcgtaacgagatctacacagggaataagcacggttcagttcacgtatggtctaggagttatcagtgccggtctcttctgtgaaaactccgcaaacacaaaggcattttcaggacatgttatgttttgattgatggtttcggtatactttatatataacagtcatgtattgttccattgcgctgtggcatccaagcacaacgcagcccccaaatggagaagagtttaaaattattcttt

SEQ ID NO: 5993 - DNA, 1722 bp, Hordeum vulgare
ccccccaaccaaagcaccgcgtcggcgtcccctccaaaccctagccccctgcgcgcacgagttgcgaggagggtaggaggatggacggccccaagaggtcgcagctgcgggtgcggctccgggtgacggcacgccggcggggcggcgacggagcggacagggccggaccgggcggtggcgctgggggcgagcggaagcggcgcatggacgccccactcatcaactccgcggccaagctgcagcgccgcgagatcggggggcggcagctcgccgcgcgcggcggtggcgccgcggccgccgtgcccgagcggttccggaacatgcagctccaggaagagtttgacacatatgatcatgacgctcacctatttgtgaagctacaatttctcaaaaaaagatcaaaaattattgagatcgtcgcagcaaaagatattatatttgctcttgctcattccgggctttgtgctgcttttagtcgagtaacaaataagcgtttatccttcttgaatttaagtccagacgaagtgattcggagtttgttctacaacaagaacaatgattcacttattactgtctcagtttatgcatcagaccaatttagcacattgaagtgcagaacaaccccgatcgagtatataaggagggaccaattagatgctgggtttcctctttttgaatcggaatctctgaagtggcctggctttgtggagtttgatgatgtaaatggaaaagtactcacttactctgcccaggatggtatctacaaggtttttgatttgaagaactattcctttctatattcgatacctgataccaatgtgcaggagataaagatcagtccaggaatcatgctcctaatatatgatagaatgccaagttatgttcctttgaagatattatctattgaagatggaaagccattgaaattattcaagcacttgttgcaccgtggcaagaaaattgattttattgagcagttcaatgagaagctccttgtgaagcaagaagacgagaaccttcagatacttgatgtacgaagttctgagctaattgaaatcagtattgagaagtttatgaccccatcagcattcatttttctgtacgagaacaatctcttcttgacattccgaaacagaacagttgctgtatggaatttccgaggagagcttgttacatcgtttgaagaccatttgctatggcatcaagattgtagcaccaacaatatttacattacaactgaccaggatctgattatatcctactgtaaatccgatgcagcgtctgatgacggtacagcttctccaattggatccatcaacatgagcgacattatgactggcaagtgcattgccaagattgcagcgaatgatccttcccttagcatcgcacctcgcaaaaatggtagcccctcaatctggagtagtatcccagaagctctggaggatgtcacagcactcttctacgacgaggacaggaacgagatctacactgggaacagtcaggggctggtgcatgtatggtccagttaggtagtatatatatacatgtcactttttgatctgttgagaagattggatgcactcagtgctgcattctgtatcatctccgggcttgtctacctctgcagtagaatgtaattcctggggggcagtaaaatgtagttccctgtaaatattgtgtgatattgtgtcatctaccatgctatagttagtttagaaaata

SEQ ID NO: 5994 - DNA, 1007 bp, Pseudoroegneria spicata
  misc_feature (29)..(30): n is a, c, g, or t
  misc_feature (32)..(34): n is a, c, g, or t
tatattcaatacctgatactaatgtgcannannnaaagatcagtccaggaatcatgctcttaatatatgatcgaacgccaagttatgttcctttgaagatattatctattgaagatggaaagccactgaaattattcaagcacttgttgcaccgcggcaagaaaattgattttattgagcaattcaatgagaagctccttgtgaagcaagaagacgagaaccttcagatacttgatgtacgaagttctgagctaattgaaatcagtattgagaagtttatgaccccgtcagcattcatttttctgtatgagaacaatctcttcttgacattccgaaacagaacagttgctgtatggaatttccgaggagagcttgttacatcgtttgaggaccatttgctatggcatcaagattgtagcaccaacaatatttacattacaactgaccaggatctgattatatcctactgtaaatccgatgcagcggctgatgacggtacagcttcttcacttggatccatcaacatgagcgacattatgactggcaagtgcattgccaagattgcagcgaatgatcctgcccttagtatcgcgcctcgcaagaatggtagcccttcaatctggagtagtatcccagaagctctggaggatgtcacagcactgttctacgacgaggacaggaacgagatctacactggcaacagtcaggggctggtgcatgtatggtccagttaggtagtatatatatacatgtcactttttgatctgatgagaggattggatgcactcagtgctgcattctgtatcatctctgggtttggctacctctgcagtagaatgttattccaggggggcagtatgagaaaatgtagttccctgtaaatatttgtgtgatagtgttatctaccatgctatagttagtttagaaaaagctcgtctacagctttctgtaggaaccttgtgtgctatttttaaggtaagtccatgaaatgatgcgttttttcgaca

SEQ ID NO: 5995 - DNA, 1861 bp, Oryza sativa
cacctactactccacttcgatggcaaccacagtgtagcacgagaccgaggaggcgccagctcgactccgcgcgagccgaggcctcgaaccctaacccccattcgatttccggcgagatgcccacccgcgtctgagccttgctcgtcggcggcgaggtggggtggggcggggggcgggggcggcgagggatggaggcgaggcgggtctccgcgaaccctcggccgtcctgcgtgcggagggtgctcgcgcggaagcggcggaggcccgaggcgacggcgaacagcgcgcggaagctgcagcggcgggagatctccgcgctgccgtgccgcgcgttctccgcgagcaccacgcgggagcggttccgcaacatccagctccaggaagagtttgatactcatgatcccaaggagatgggttcactactaccttacttgatgaaaaggtctgagattattgagatagttggagccagtgatatcatctttgctttatcacagtcaggagtatgtgctgcattcagcagagtctcaaaccagcggatttgctttctgaatggaagaccagatgaagtcattcgcagtttgttttacaacaagaacaatgactcactcattactgtatcagtttatggttctgaaaacttcagtgccttaagatgcaggacaactcgaatagagtatatacgacgggggaagccagatgctggtttccctcttttcgagacagagtccttgaaatggccaggttttgtggaatttgatgatgttaacgggaaggtgctgacttattctgcccaagacagtacttacaaggtgtttgacttgaaaaactacactttgttgtatacaatatctgataagaatgttcaagaaataaagatcagccctggcataatgctattgatatactcaagaaaaaagggctgtattccccttgacattctttctattgaagatggtaaacgcttgaagtcattcaaacaccttcttcatcgcaataaaaaagttgatttcattgagcaattcaatgaaaaacttctgatcaaacaggaaggggagaaccttcaaattcttgatgtaagaaacttccaatcaattgaagtaagcagaagtgaatttgtgactccttctgcgtttatctttctgtatgagatgcagctgttcctgaccttccgtagtagatcagtatccgtttggaatttccgtggtgaattagtcacatcttttgaggaccatatgttgtggcaccctgattgcaataccaacagtatttacatcaccagcaaccaagatcttattatttcttactgcaaggctgatccaaatgatccttcttcagaagaaaatgcttgctccataaatatcagtgagatcttaaccggaaaatgcttggccaaaataaaggcagggaaccttaacaagcaaagggtgtctaagttccaaagtacaccttccgaggcactgggggacatcacagctctgtactacgatgaagagcgtgaggagatatacaccggcaaccgactaggccttgtccatgtgtggtcaaattgatagttgctcaggcagtcaagctttccttcgggcaacagcaatcctcacctagcgtggcataatcggggagatactagctacaaccgtagttcatcatcggggagatactagcgtgcctgatcggtgtagctccaagggtgtttactgtttaccatatgtatcgttttggaaggtttgtcactgttagcgtgccatcttaccccccgagctatatatatctgattccaatctgagattcattgtctgttctgaattctgatggcgaagcgtacaacttcgggatcagagatgtcgttttgtgttctgaa

SEQ ID NO: 5996 - DNA, 1684 bp, Panicum virgatum
gtgcccgagcgcttccggaacatgcggctccaggaggagtttgatacgtatgatcacaacgctcacctatttgtgaagctgcagtttcttagaagacgatccaaaattattgagattgttgcagcaaaggatatcatatttgccttggctcattctggtctttgtgctgctttcaaccgagtaacaaacaagcgcatagccttcttgaatttgagcccagatgaagtcattcggagcttgttctacaacaagaacaatgattcacttattactgtatcagtttatgcttctgataatttcagcacattgaagtgcagaacaaccccaattgagtatattagaaggaatcaattagatgccggatttcctctatttgaatcagaatctctgaagtggcctggatttgtggagttcgatgatgtgaatggaaaagtactcacatattctgcacaggatggtatctataaggtctttgacttgaagaactactcctttctatattcagtaccagatgaaaatgtgcaggagataaagatcagtccaggaatcatgctcttgatatatgatagaactccaagttatgttccattaaagataatatcaattgaagatggaaagccactgaaattttttaagcacttgttgcaccgcaacaagaaaattgatttcattgagcaattcaatgagaagctccttgtcaagcaagaggatgaaaacttccagatacttgatgtgcggacttctgagctaattgaagtcagtgtctccaagtttatgaccccttcagcattcatttttctttatgagaacaatctcttcttgacattccgaaacagaacagttgccgtatggaattttcggggagagcttgtgacttcatttgaagaccatttactttggcatcatgattgtagcaccaacaatatttacattactagcgaccaggatctgattatctcgtattgcaaatcagaggttgtggcggaagatggtacagttactccgattggatccatcaacatgagtgagattatgacaggcaagtgcattgccaagatcgctgccagcgacccttccctcaatgtcacccctcgcagaaactgtcgcaagaagcggtcctctgtgtggagcacagttccagaagccctggaggatgtcacagcgctgttctatgatgaggacaggaacgagatctacaccggcaacagccatggcctggtccatgtgtggtctaactagatagtaacatgtacatagtttcgcccttttgattctgacatgaagatccgattagcttcactgcattctgtataatccctggccccagggctcacctagtttttgtatttggcgatgatagaatgtgtttccttgagcagctgtgcgaacgtgaagtgttcttgtaaatgtttatttattttgtattgtcatggcatctaccaagtttttttttagaaattagcctctcaatcaaacttcggtggatactgtctgccaagtttctggcggtgaggcagtaaacgtctgaagttccaagattaaatgtaatagcagcagtgataggtgaaatggtgtgtattgtaatagcaacagcttgaaatcctgatggctgcctgtggctcattgcatatagctataggttgctacatgatcctatgtgaagtgaagccctccttttttaatt

SEQ ID NO: 5997 - DNA, 1388 bp, Panicum virgatum
gatgaagtcattcggagcttgttctacaacaagaacaatgattcacttattactgtatcagtttatgcttccgataatttcagcacattgaagtgcagaacaaccccaattgagtatattagaaggaatcaattagatgctggatttcctctatttgaatcagaatctctgaagtggcctggatttgtggagtttgatgatgtgaatggaaaagtactcacatattccgcacaggatggtatctataaggtctttgacttgaagaactactcctttctatattcaataccagatgaaaatgtgcaggagataaagatcagtccaggaatcatgctcttgatatatgatagaactccaagttatgttcaattgaagatattatcaattgaagatggaaagccactgaaattttttaagcacttgttgcaccgcaacaagaaaattgatttcattgagcagttcaatgagaaactccttgtcaagcaagaggatgaaaacttccagatacttgatgtgcggacttctgagctaattgaagtcagtgtctccaagtttatgaccccttcagcatttatttttctttatgagaacaatctcttcttgacattccgaaacagaacagtcgctgtatggaactttcggggagagcttgtgacttcatttgaagaccatttgctttggcatcatgattgtagcaccaacaatatttacattactagtgaccaggatctgattatctcgtattgcaaatcagaggtggtggcggaagatggtacagttactccaattggatccatcaacatgagtgagattatgacaggcaagtgcattgccaagatcgctgccagcgaccctgccctcaatgccatacctcgcagaaatggtcgcaagaagcggtcctctgtatggagcacagttccagaagctctggaggacgtcacggcgctgttctatgatgaggacaggaacgagatctacactggcaacagccatggcctggtccatgtgtggtctaactagatagtaacatgtacatagtctcgcccttttgattctgacatgaagatccgattagctttactgcattctgtataatccctgacccagggctcacctagcttttgtatttggcaatagaatgtttccttgagcaattgtgagaacgcgaagtgattcttgtaaatgtttatttattttgttttgtcatggcgtctaccatgcttttttttaacatagaaattagcctctgaatcaaacatcggtggatactgcctgccaggtttctggcggtgagacagtaaacgtctgaagttccaagatcaaatgtaacagcagtgattggtgaaatgatgtgttttgtattagcattgtagcaacagcttgcaatt

SEQ ID NO: 5998 - DNA, 1839 bp, Triticum aestivum
tccaaaccctagccccgcgcgcgcgcgagttgcgaggagggcaggaggatggacggccccaagaggtcgcaggtgcgggtgcggctccgggtgacggcacgccggcggggcggcgatggagcggacagggccgggccgggcggtggcaccgggggcgagcggaagcggcgcctggacgccccactcatcaactccgcggccaaactgcagcgccgcgagatcggggggcggcagctcgccgcgcgcggcggcggcgccgcggccgccgtgcctgagcggttccggaacatgcagctccaggaagagtttgacacatatgatcatgatgctcacctatttgtgaagctacagtttctcaaaaaaagatccaaaattattgagatcgtcgcagcaaaagatattatatttgctcttgctcactctgggctttgtgctgcttttagtcgagtaacaaataagcggttatccttcttgaatttaagcccggacgaagtgatccggagtttgttctacaacaagaacaacgattcacttattactgtctcagtttatgcatcagaccattttagcacattgaagtgcagaacaaccccaatcgagtatataaggagggaccaattagatgctgggtttcctctttttgaatcggaatctctgaagtggcctggctttgttgagtttgatgatgtaaatggaaaagtactcacttactcggcccaggatggtatctacaaggtttttgatctgaagaactattcctttctatattcaatacctgataccaatgtgcaggagataaagattagtccaggaattatgctcttaatatatgatcgaacgccaagttatgttcctttgaagatattatctattgaagatggaaagccactcaaattattcaagcacttgttgcaccgcggcaagaaaattgattttattgagcaattcaatgagaagctccttgtgaagcaagaagacgagaaccttcagatacttgatgtacgaagttctgagctaattgaaatcagtattgagaagtttatgaccccgtcagcattcatttttctgtatgagaacaatctcttcttgacattccgaaacagaacagttgctgtatggaatttccgaggagagcttgttacatcatttgaggaccatttgctatggcatcaagattgtagtaccaacaatatttacattacaactgaccaggatctgattatatcctactgtaaatccgatgcagcggctgatgacggtacagcttcttcaattggatccatcaacatgagcgacattatgactggcaagtgcattgccaagattgcagcgaatgatcctgcccttagtatcgcccctcgcaagaatggtagcccttcaatctggagtagtatcccagaagctctggaggatgtcacagcactgttctacgatgaggacaggaacgagatctacactggcaacagtcaggggctggtgcatgtatggtccagttaggtggtatatatatacatgtcactttttgatgtgatgagaagattggatgcactcagtgctgcattctgtatcatctccgggtttggctacctctgcagtagaatgtaattcctggggggcagtatgagaaaatgtagttccctgtaaatattttgtgtgatagtgttatctaccatgctatagttagtttagaaaatgctcatctacagctttctgtaggaaccttgtgctatttttcatgtatgtccatgaaatgatgcattttcgacaaatttacatgtttcttgactctggtaatcatctttggaatttactgagagggcataactatgctatgtaccc

SEQ ID NO: 5999 - DNA, 2163 bp, Festuca arundinacea
  misc_feature (336)..(336): n is a, c, g, or t
  misc_feature (1183)..(1183): n is a, c, g, or t
  misc_feature (1188)..(1188): n is a, c, g, or t
  misc_feature (1212)..(1212): n is a, c, g, or t
  misc_feature (1221)..(1221): n is a, c, g, or t
  misc_feature (1626)..(1626): n is a, c, g, or t
  misc_feature (1635)..(1635): n is a, c, g, or t
  misc_feature (1647)..(1647): n is a, c, g, or t
  misc_feature (1655)..(1655): n is a, c, g, or t
ggcacgaggctttatctacttcaattttcttgtgggctttcacatccaaattcagctgccacctacataaatgtggctatgatggaagaaggtatgggaaatgttcatgttgctctaaggtatttgcatgaagcgctgaagtgcaacaaaagattgcttggagctgatcatatacagactgctgcaagctaccatgccatagccatagccctctccatgatggatgcatactccctaagcgtgcaacatgaacaaaccaccttacaaatactccaggagaaactaggagaagatgaccttcgaactcaggatgctgctgcttggctggagtatttngattcaaaagcattagaacagcaagaggccgctcggagaggcattccaaaacctgattcttctattgcaagtaaaggacatcttagtgtatcagatctacttgactacataagcccggaccaggaaagaaaagagagggatatgcaaaggaagtgcaggcgcgcaaagaataataccagagcccaacaaggtgaatcagttgaagaaaaggagaacttccagtatgactcaggatctctgcttgaagcagtcaaaaatgatttccaagaagcaaaactggaaccggaggctcctgttgtatcagtagtaacagaagaagtttatgctgtccatgatgagctgaagcaggtagaggctttatcacctgaagagtattctgatgagggttggcaagcagctactttaagagggaggtctgcaaatgtgcggaagaaaagcatccgcagaaggccagctctcgctaaattagcagttggtcgcatagaagatggtcgcactgcttctgttcaaaggactgatgtacagccacagacaaaagagcataaagaggaagctatctactcccctagccaactatcatttggcaactttttcaacagtgacaagttgaatggtgatcccgtcattactgaagacaagtcttgtaatgctacatccaaatcagaacagagcataaaacctacaggaattaacaggccaactagcatagcatccaagttggtatcgtacaaagacgtggcagcgtcacctcctggcacagtatggaaaccaattttggagcagaaggaagcaaaggagaaggatactgaagaagttactgatgtaacaccttcgtctgaggaagatnggaancttacagatgaagttgagaagtcnagtgatganggaagcaaagagattgtctcaagtcagccagaggggggcagtcattcagagaaagcttctgacagtgacggaagcacatctccgcacaagaaaacaagtggaagcaaactttcagcttcagcacctccgttcaatcctggatcgctcttatcagtgtcccatccttacagcacagtagcaatatatgatgctagtgttgttcttcagccaatcccaagtcaagcaatggagattcttcctcatgctgttgatactagagtgcctcgtggtcctcggtccaccttgtactaccgtactgggcattctttccaaaggaagcagggttatacacagagccagagcactattctgaggggtagcacctcccctccagccatgaatccccatgctgccgagtttgtgccnggaaaggcngtgcaacaaacngatttggntaatgggaaacatgtggccgattcagcggatcagcagttgacgccgcagacctcagatgaagtgaaagccgatattcatgctgcagacaaggcaggccaagtggagaagataactccaggtaaagggaaggaaaaccgaggggaagatgcgatgagagattcatacaaagcagagctggcaaggcagattctgctcagtttcattgtcaagtcggtccatgacagtttaggttcgactcgagctcaaccggacagaaagccaagtgtatcggatgaacccagtaacgaacagagcagcaacataaccaagcccacctcaactcgcaaagagttcgataaacaacccaaggcagccgaggtgccaaaaagcgagaaggatacagagggcttcacagtagtttcaaagcgtagaagaagcaagcaacacttcatgaaccccataaatggcctctactctcagcagtccatctgcacttcggtcagctgaggttcccgcgcgcacttcctg

SEQ ID NO: 6000 - DNA, 918 bp, Brassica juncea
atctggagtccagcaaatgtgtgttgcgtgcaattctctgcatattccaatcatttactggcatttggttcagctgattacaaggtctattgctatgatcttcggtatgtcaaaacaccttggtgcacattggctggccatgagaaagcggttagctatgttaaattcatggattcagagaccattgtcactgcttccactgataactctctcaagctttggaatctcaacaagacaaactccactggtttgtctactggtgcttgttcaatgacgtataaaggacatacaaatcaaaagaactttgtcggattatcggtcttggatggatacattgcctgtggttcagagaccaatgaggtatatagttactatagatccttaccaatgccaatgacttcatacaagtttggatcagtggatcccatatctggaaacgaatactttgatgacaatggacagtttgtgtcgagcgtctgttggagaaagaaatcgaatatgcttgtagctgcgaattctactggaaacatgaagctactaaaactggtttgacatttgtgggcgagtgagttcttttggaaaacaaatctctcaagtctgtatctaagacaacagtttgacttgaacctacgtttttgtcctggaaaacgttgatccctatatgaccatgacaggatatggttggcaaccaaatctcagagaagttgaagcaaaaaaaaagctgtctatgtctttgataatatatgattcttcttcatgtaactctatatgcgattaaactgagataaaagtatcgcagattcttgggaagttgattcagatttggtcttgcacaagttcggcatcaatgtgtaatgattagaggtatataatctgtaaaagtgtgtgcttaattatgtaattgttgttggataatta

SEQ ID NO: 6001 - DNA, 2576 bp, Brassica napus
agccttctctattaggtgacgcgtgtgggaggcgcgattggtgtccgcacatcgcaaggatgttttgtctggaacgtgagaccatcgctttcgtctttggtcccgtccgaagaaacttagtatataatggtacttcggtaagaagcagtatagatggatggtgacgagattgataggagaggcacgcggttccggaagtcatcccttctgggtagggatttgtagaaaagaagaatggatttgaagctccagggaagcaacttcaggccacttcaagtgggagacctttgaaaggaaaagccccttgattgatttaaacgtggttgatgtgcgtaatccagacagttgtgaacttcaacagcaaagctatatgaaaaatttaggcgtgccttcagtgacgagaaaacagtctatgtccacttggctagaagagcaatggtatacttgtccagaggaaataaatggagaagatatcggagaaaagtcgaatatatatgctcttggtgttcttctatttgagttgctatgccattgtgagtccagtgagatgcatgctgcaatgatggcggatttacgtcatcggattctcccaccagcatttctctcaagatacccaaaggaagctggattttgtctttggcttctacatcctgagccctcctcccgaccaacagctagagaaatactgaagtctgagttgatatgtgtggaggattcagttaaatcgaccgctgctgatgaggagatatctgagctgttacttcattttttgtcttcacttgaaaaacagaagaagaaaaatgcatctaagcttttgcaagacatccaaaccttggaggatgatatcaaggaggccgagcgaagatattcttcaagagcatctctggtgagatctcacgaagctactgaaagaaaagtgcagtcatctcccataggcgagggcagtacaactacttctggcgccttgtttgtaccaactgctaatacagacaggctgatgagtaatatccgtcaacttgaagatgcatatttcatcatgagatcacaaatgaagttatcggattctacggctagtgcccgttctgacaaaagccttctaaaggacaaggacaagtggtctgaaaaccaaaataaggatcaggatgcgagaaccaaaggaaaatcgtcagatcaacttgaagtgtttttcgaggggttgtgcaaatttgctcggtatagcaagttcgaaacctgtggaacaatcagaagtggagaccttttaaactccgccagtgtggtctgctcattgagttttgaccctgatgaggaacacatagcagctgctgggatatcaaagaaaatcaagatttttgacttcaacgcatttatgaatgaatctgtcggtgttcattatccactagtagagatggtcaacaaatcgaaattaagctgcgtttgctggaatagttacatcaaaaactacttggcctcgactgactatgacggtgtagtccagatatgggatgctgggactggacaaggattttcccaatacacagaacaccagaagagagcctggtcagttgatttttctccatctgacccgacgaaatttgtcagtggaagtgatgactgttcagtaaagctttggagcgtcaatgagaaacggtcattaggaacaatctggagtccagcaaatgtgtgttgcgtgcaattctcttcatattccaatcatttattggcatttgggtcagctgattacaaggtctattgctatgatcttcgttacgtcaaaactccttggtgcacattggctggccacgagaaagctgttagctacgttaaattcatggattcagagaccatcgtcactgcttccactgataactctctcaagctttggaatctcaacaagacaaattcctctggtttgtctcctggtgcttgttcaatgacgtataaaggacatacaaatcaaaagaactttgtcggattatcggtcttggatggatacatagcctgtggttcagagaccaatgaggtatatagttactatagatccttaccaatgccaatgacttcatacaagtttggatcagtggatcccgtttctggaaacgaatactttgatgacaatggacagtttgtgtcgagcgtctgttggagaaagaaatcgaatatgcttgtagctgcgaattctactggaaacatgaagctactaaaactggtttgacatttgtgggcgagtgagttcttttggaaaacaaatctcaaaaccctaatctctcaagtctgtatccaagacaaacagtttgacttgaacctacttttttgtcctggaaacgttgaatcctatatgaccgtgacaggctatggttggcaaccaaatctcggagaagtttgaagcaaaaaaaaaaaggctctctgcgtctgtgataatatttgattcttcttcgttagtaactgtatatgagatgaaagttctcagattcttcggaaagtgactcagatttggtcttgcacaaacaagttcggcatcaatgtgtaatgattagaggtatataatctgtacaagtgtgttcccatagcttcattat

SEQ ID NO: 6002 - DNA, 1961 bp, Brassica napus
tctacatcctcgtagccttcctcccgaccaacaagctagagaaatactgaagtctgagttgatatgtgtggaggagttcagttaaatcgactgcggctgacgaggagatatctgagctgttacttcattttttgtcttcacttgaaaagcagaagaagaaaaatgcatctaagcttttgcaagacatccaaaccttggaggatgatatcaaagaggccgagcgaagatattcttcaaaatcatcgctggtgagatctcatgaaattattgaaagcaaagtgcaatcatctcccataggcgagcgctgtacaactgcttctggcgccttgtttgtaccaactgctaatacagacaggctgatgagtaatattcgtcaacttgaagaggcatatttcttcatgaggtcacaaatgaagttatcggattctgcggctagtgcccgttctgacaaaagccttctaaaggacaaggacaagtggtctgaaaaccaaaataaggatcaggatgcgagaaccaaaggaaaatcgtcggatcaactggaagtgtttttcgaggggttgtgcaaatttgctcggtatagcaagttcgaaacctgtggaacaatcagaagtggagaccttttaaactccgccagtgtggtctgctcattgagtttcgaccctgatgaggaacacatagcagctgctgggatatcaaagaaaatcaagatttttgacttcaacgcatttatgaatgaatctgtcggtgttcattatccactagtggagatggtcaacaaatcgaaattaagctgcgtttgctggaatagttacatcaaaaactacttggcctctactgactatgatggtgtagtccagatatgggatgctgggactggacaaggattttcccaatacacagaacaccagaagagagcctggtcagttgatttttctccatctgaccctacaaaatttgtcagtggaagtgatgactgttcagtaaagctttggagcgtcaatgagaaacggtcattaggaacaatctggagtccagcaaatgtgtgttgcgtgcaattctctgcatattccaatcatttactggcatttgggtcagctgattacaaggtctattgctatgatcttcgttacgtcaaaactccttggtgcacattggctggccacgagaaagctgttagctacgttaaatttatggattcagagaccatcgtcactgcttccactgataactctctcaagctttggaatctcaacaagacaaattccactggtttgtctactggtgcttgttcaatgacgtataaaggacatacaaatcaaaagaactttgtcggattatcggtcttggatggatacatagcctgtggttcagagaccaatgaggtatatagttactatagatccttaccgatgccaatgacttcatacaagtttggatcggtggatcccatatctgggaacgaatactttgatgacaatggacagtttgtgtcgagcgtctgtgaaaaaaaatcgaatatgcttgtagctgcgaattctactggaaacatgaagctactaaagctggtttgacatttgtggcattggactccttgagtaactcttttgacagctgtttgaagtgaagcaatgcttttgcattggatacaatgatcctatatgaccacgacaggttggcaaacatacaaattttggagatgttgaagcaaaaagctgtatgtgataatatatgattcttcttcatgcaactccatatatgaaaagaatttatctgatttcttcggaagtgattcagatttggtctttggcgaggtcggcatcaatgtgtaatgatgagaggtatataagctgtacaagtgtgttcgcatagcttaactatgcaaatattgttggagatttttctgttagggataaatagagagataagaagcctctgtttattagttctcagttcagtaaaca

SEQ ID NO: 6003 - DNA, 1405 bp, Raphanus sativus
  misc_feature (530)..(530): n is a, c, g, or t
  misc_feature (596)..(596): n is a, c, g, or t
  misc_feature (617)..(617): n is a, c, g, or t
  misc_feature (902)..(902): n is a, c, g, or t
gcaaatttgctcggtatagcaagttcgaaacctgtgggacgatcagaagtggagaccttttaaactctgccagtgtggtctgctcgttaagttttgaccctgatgaggaacacatagcagcagctgggatatcaaagaaaatcaagatttttgacttcaacgcatttatgaatgaatctgtcggtgttcattatccactagtagagatggtcaacaaatcgaaactaggctgcgtttgctggaatagttacatcaaaaactacttggcctcgactgactatgatggtgtagtccagatatgggatgctgggactggacaaggattttcccaatacacagaacaccagaagagagcctggtcagttgatttttctccatctgacccgacaaaatttgtcagtggaagtgatgactgttcggtaaagctttggagcgtcaatgagaaacggtcattaggtacgatctggagtccagcaaatgtgtgttgcgtgcaattctctgcatattccaatcatttactggcatttggntcagcggattacaaggtctattgctatgatcttcggtatgtcaaaactccttggtgcacattggcnggccatgagaaagctgttagntatgttaagttcgtggattcagagaccattgtcactgcttccactgataactctctcaagctttggaatctcaacaagacaacttcctctgggttgtctcctggtgcttgttcaatgacgtataaaggacacacaaatcaaaagaactttgtcggcttatcggtcttggatggatacatagcctgtggttcagagaccaatgaggtatatagttactatagatcgttaccaatgccaatgacttcatacaagtttggatcagtggatcccatttctggaaacgantactttgatgacaatggccagtttgtgtcgagcgtctgttggagaaaaaagtcgaatatgcttgtagctgcgaattctacgggaaacatgaagctactaaaactggtttgacattgtggcactggactcctctttgagtaagttctttggaaagaaaacgtcttgactttgaagcgactgtttttgtcctggaaactgtgatcctatatatgaccatatgagagttcatgaaagacaaccaaatctcagagaagttgaagctcaaaaaaagctgtttatgcctgtgatagtatttgattcttcttcatgttaactctatatatgattagtttgagatcaaagttcgctgattcttcggaagttggttcagatttggtcttagcacaagttgtgcatcaatgtgtaatgagtagaggtatataatctgtacaagtgtttttctttaattatgtaattgttgttggatatttactgttgtgggataaatagagagaaaagagttc

SEQ ID NO: 6004 - DNA, 873 bp, Brassica rapa
  misc_feature (233)..(233): n is a, c, g, or t
  misc_feature (422)..(422): n is a, c, g, or t
acaatctggagtccagcaaatgtgtgttgcgtgcaattctctgcatattccaatcatttactggcatttggttcagctgattacaaggtctattgctatgatcttcgttacgtcaaaactccttggtgcacattggctggccacgagaaagctgttagctatgttaaattcatggattcagagaccattgtcactgcttccactgataactctctcaagctttggaatctcancaagacaaactccactggtttgtctactggtgcttgttcaatgacgtataaaggacatacaaatcaaaagaactttgtcggattatcggtcttggatggatacattgcctgtggttcagagaccaatgaggtatatagttactatagatccttaccaatgccaatgacttcatacaagtttggatcagnggatcccatatctggaaacgaatactttgatgacaatggacagtttgtgtcgagcgtctgttggagaaagaaatcgaatatgcttgtagctgcgaattctactggaaacatgaagctactaaaactggtttgacatttgtgggcgagtgagttcttttggaaaacaaatctctcaagtctgtatctaagacaacagtttgacttgaacctacgtttttgtcctggaaaacgttgatccctatatgaccgtgacaggttatggttggcaaccaaatctcagagaagttgaagcaaaaaaaaagctgtctatgtctttgataatatatgattcttcttcatatgtaactgtatatgagatgaaagttctcagattcttcggaaagtgactcagatttggtcttgcacaaacaagttcggctcaatgtgtaatgattagaggtatataatctgt

SEQ ID NO: 6005 - DNA, 1757 bp, Brassica napus
actaagcttttgcaagacatccagaccttggaggatgatattaaggaagccgagcaaagatattcttcaaatgcatctctggtgagatctcatggagctatggaaacaagactgcaatcatctctgatgagtaatatccatcaactcgaagatgcatatttcttcatgagatcacaaatgaagttatccaattccgcctgccattctgacaaaagccttctaaaggacagggacaggtggtctgaaaaccaaaatgagaatcaggatacgaaaaccaaaggaaaatcttcagatcaagtggaagtgtttttcgaggggctgtgcaaatttgctcggtatagcaagtttgaaacctgtgggacaataaggagtggagatcttttaaactctactgctagtgtggtatgctcattgagttttgacgctgaagaggaacacatagcagccgctgggatatcaaagaaaatcaagatttttgacttcaatgcgtttatgaatgaatctgtcggtgttcaatatccactagttgagatggtcagcaaatccaaattaagctgtgtttgctggaatagttacataaaaaactacttagcctcgactgactacgatggtgtagttcagatatgggatgcagggactggacaaggattctcgcagtatacagaacatcagaagagagcctggtcagttgatttttctccatctgacccgacaaaatttgtcagtggaagtgatgactgttcggtaaagctttggagcgtcaatgagaaacgttcattaggcacaatctggagtccagctaacgtgtgttgcgtgcaattctctgcatattccaatcacttattggcatttgggtcagctgattacaaggtctattgctatgatcttcggtacgtcaaaactccttggtgcacattggctggccatgagaaaactgttagctatgttaaatttatggactcggaaaccattgtctctgcttccactgataactctctcaagctttggaaccttaacaagactggtttatctcctggtgcttgtccattgacgtataaaggacatacaaatcaaaagaattttgctggattatcagttttggatggatacatagcatgtggttcagagaccaatgaggtatatagttattataaatccttaccgatgccaatgacttcatacaagtttggatctgtggatcccatttctggaaacgagtgcttcgatgacaatgggcagtttgtgtcgagcgtctgttggagaaaaaaatcgaatatgcttgtagctgcaaattctactggaaacatgacgctactaaaactggtttgacatttgtggctttggactccttgagtaacttctttggacagctgtttgaagtgaagcaatgcttttgcattggatacaatgatcctatatgaccacgacaggttgacaaacttacaaatcttggagatgttgaagcaaaaaagttgtatgtgataatatatgattcttcttcatgcaactccatatatgaaaagaattatttgatttctttggaagtgattcagatttggtctttggcgaggtcggcatcaatgtgtaatgataagaggtgtgttcgcatagcttaactatgcaagtattgttggagtattttctgtcagggataaatagagagaaagagctctgtctattagttctcagttcagtaaccttcattcatggctacttctcctcttcattattcgtctatttttcttttgatcatgtag

SEQ ID NO: 6006 - DNA, 929 bp, Brassica napus
cttagcctcgactgactacgatggtgtagttcagatatgggatgcagggactggacaaggattctcccagtatacagaacatcagaagagagcctggtcagttgattttttctccatctgacccgacaaaatttgtcagtggaagtgatgactgttcggtaaagctttggagcgtcaacgagaaacgttcattaggcacaatctggagtccagctaacgtgtgttgcgtacagttctcttcatattccaaccacttagtggcatttgggtcagctgattacaaggtctattgctatgatctcggtacgtcagaactccttggtgcacattgtctggccatgagaaaactgttagctatgtaaatttatggactcagaaaccattgtctctgcttccactgataactctctcaagctttggaatcttaacaagactggtttatctcctggtgcttgtccattgacgtataaaggacatacaaatcaaaagaattttgttggattatcagttttggatggatacatagcatgtggttcagagaccaatgaggtatatagttactataaatccttaccgatgccaatgacttcatacaagtttggagctgtggatcccatttctggaaacgagtgcttcgatgacaatgcgcagtttgtgtcgagcgtctgttggagaaaaaaaatcgaatatgcttgtagctgcgaattctactggaaacatgaagctactaaaactggtttgacatttgtggcattggactccttgagtaacttctttagacagctgtttgaagtgaagcaatgcttttgcattggatacaatgatcctatatgaccacgacaggttggcaaacatacaaatcttggagatgttgaagcaaaaagctgtatgtgataatatatgattcttcttcatgcaactccatatat

SEQ ID NO: 6007 - DNA, 637 bp, Brassica oleracea
tttattggcatttgggtcagctgattacaaggtctattgctatgatcttcgttacgtcaaaactccttggtgcacattggctggccacgagaaagctgttagctacgttaaattcatggattcagagaccatcgtcactgcttccactgataactctctcaagctttggaatctcaacaagacaaattcctctggtttgtctcctggtgcttgttcaatgacgtataaaggacatacaaatcaaaagaactttgtcggattatcggtcttggatggatacatagcctgtggttcagagaccaatgaggtatatagttactatagatccttaccaatgccaatgacttcatacaagtttggatcagtggatcccgtttctggaaacgaatactttgatgacaatggacagtttgtgtcgagcgtctgttggagaaagaaatcgaatatgcttgtagctgcgaattctactggaaacatgaagctactaaaactggtttgacatttgtgggcgagtgagttcttttggaaaacaaatctcaaaaccctaatctctcaagtctgtatccaagacaaacagtttgacttgaacctacttttttgtcctggaaacgttgaatcctatatgaccgtgacaggc

SEQ ID NO: 6008 - DNA, 837 bp, Cleome spinosa
cattacccgttagtagagatgtgcaacaaatctaaattaagctgtgtttgctggaatagttacataaaaactacttggcctcaactgactatgatggtgtggttcagatatgggatgctgggactggacaaggattttctcagtacacggagcatcagagaagagcctggtcagttgatttttctccatctgacccgacaaagtttgtcagcggaagtgatgattgttctgtgaagctttggagcatcaatgagaaacggtcgataggcacgatccggagccccgcaaatgtttgttgtgtgcaattctctgcttcctccaatcacttactggcattcggatcagctgattacaaggtgtactgctatgatctccggcatgtcagaacaccttggtgcacattagctggccatgagaaagctgttagctatgtgaaatttatggattcagataccatcgtttctgcatcgacagatagctctctcaagatgtggaatcttaacaatacaaacccatctggtttatctcccggtgcctgttcattgacatttcaaggacacacaaatcaaaagaattttgtcgggttgtcagttatggatggatacatagcctgcggttcagagaccaatgaggtatatagttattacagatctttatcaatgccgataacttcgtacaagtttggattggtggatcctctttcgggaaacgagttccatgatgagaatggacagtttgtgtcgagtgtctgttggagacgaaactcaaacatgctagttgctgccaactctaccggaaccatgaaactactgaaactggtttgacgcatacatatat

SEQ ID NO: 6009 - DNA, 2171 bp, Brassica rapa
tgaatccagtgggcgatgtgtggaggaatcagagaggagagtgatttggggtctgtgattggactctgtttctctagtcatgtttgattgggacgacgaagagcttactaatatgatatggggtgacgagggagagacaggcgaccatattgtgccttttaaagtaagaaacaggaaggaacaaggcgatgaatctaataaggcagttaagccagctgaaagtaaaactcaccttcatgatagtaagctgggggggagcagttcagggcaaaatattgagtgtatgagctcatggcctgactcatcagtatctaataatgctcgaaaagctgatccaggaccaggttcgagtgagccagctagatatgattcaacaagaagtgagaaagcgtctgaacttgcgaaaggccctgatatttttcatagcactgatgagagtaaagagcaaggtgatttcgatgagtatggatgggctaacattggtagctttgatgatcttgatcgaatgttcagtagtgatgtccctatatttggcgatggcagtctcagcggtgcagatgagttatggtcttcttctaaagatgtatccaagccgttaccatccattttggactctcaagatctaggattggatattagaactaagtttgagcaacaagagaaccagcagtttccattgactggagaaaccaatggtggtccatcatcccaagtgcgcctagagttcgtgtaaccccaaaagctgagcaatatcatgagcataagagacaatcctcagttgatgaccagccatatcaacaaaataaaatgatgaagttttcggaaatgttggggactcatgaggcaggggcatctcaagatccatacggtcagagaactctgtccaggagaaaatttgtaaaccagttgggaccgtcacgatcatctatgatgggtgttaatctgcagagtgagtctcaagggtctgggacatcacattatccacatatgccaaaccaatacatggctacttctggttttggtaatccatattctactgtgcctgtagtttcagccttccaacgtcctgatgttaacaagaatcagctgatgcatccttcctacaatccggcttctgctatctctgcaaacatggtaacagatgctgccgcacgaccttcaacaatgacgccgcaggaaaagctagaaaaacttaggcgcagacagcaaatgcaggcgatgcttgctattcagagacaacagcagcaatttcgtcaccaggttcctgtagcagatcagtcaattactcagcttgtcgacaaaactagtcttcaagggctaaccgcaataccttcctttgatcccaattcatctctggaactagatgattctggaaactttgctgctgctgttgataatccatcagaattctcggttctttatcggcttcaagatgttgtagcaaagttagatatggaaacaaggacttgtataagggatagcttattccgtttggctgatagcgcaggtcagagacatcacactagtgatacaccccacagtaataagactagccaggatgaccaggaggttattcctcaagaaaaatccagatatagatatgcagggatgctagacaccgaaactgtgaccaatcccacagacagaactgtggctcatttgctctttcataggccttttgatatgtctgcggcaaagcatacggaaggactagaatcaccatcttcttcgaagatgggaactgaagtaaaagggagttttcctagcacaagagagagtcacatgaataagcagaaagcaaaagaggaagatgtacctgcaggttcaactgctttagggtatgcatccaactcaggatccagtagcactgttggtgagagggttaatgaagcatcccaaggaaacaaaagaaagttgtgaagtatagaaaggtttaggtttgcggtgttagagagcagcctgaggaaatctgcagcgtaggcaacatctctctgcattgctagaaacaatctcctgtttactcctttcatgtaattaaatgttttctttttgttttttttaattgttgaataccctttcttattacacgtatttccatgagaaaacattttggaaaactcatgtagtttgctcttacaattttcttttcaaaccagatttgatctcttatt

SEQ ID NO: 6010 - DNA, 583 bp, Brassica juncea
aggaagaggaagaacaacgccattggctgcaacattggccactttgacaacgaaatcgatatgcaaggacttgagaccttccctggtgtgaaacgcatcaccatcaagccgcagactgataggtgggtgttccccgacaccaagtcaggcatcattgtgctagcggagggtcgtctgatgaacttgggatgcgccactggtcacccgagtttcgtgatgtcgtgctcgttcaccaaccaggtgattgcgcagcttgagctatggaacgagaagtcgagcgggaagtatgagaagaaagtatatgttttgcctaagcacttggacgagaaggttgctgcacttcacttgggaaagctcggtgctagactcaccaagctcaccaaggaccaatctgactatgtcagcatacccattgaaggtccttacaagcctggtcattacaggtactgagagaacaaaggactgagcgttcttcgtgtggtttttatgattaggccatttgagttggttttgggtttgctctggttgaggaatgtgagatattggtcttctgaggaggtttaccaaatattttttttaataa

SEQ ID NO: 6011 - DNA, 1628 bp, Brassica napus
cggcgcggaagtcagatggtgctcctcgcaacatctctcaacccaaggaccacgccgccgccgcaatcgcccgtgactccgccgccgttttcgcctggaaaggtgagacgcttcaggagtactggtggtgcacggagcgtgctctcgactggggcccaggtggtggtccagatctgatcgtcgatgacggtggcgacgccacgcttttgatccacgagggagtgaaggccgaggagatctttgagaagacgggtcaggttcctgatcccacttccactgacaaccctgagttccagatcgtgctttcgatcatcaaggaaggtctccaggttgatcctaagaagtaccacaagatgaaggagagactcgtcggtgtctctgaggagaccaccaccggtgtcaagaggctttaccagatgcaggaaagtggagcccttttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggaaagggttgtgccgctgccatgaaaaccgctggtgctagagtcattgtgaccgagatcgaccccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtcatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccattgaaggaccttacaagcctgctcactacaggtactgagagctgtttggttctcgttgtggtttgtctggaagagtggaagatattggtccgctgatgaagttgaccaaatatccttctgatgaataaggggtgattggctttgaaggttgtgcttgtttttcttctttttcttgaaacttaaattagcttttggttatgagttccctcttgatttgcttttctgttgtgatcaccgttgtactcttaaactaaaaatggaagagaggaaactattttccgtacccaaattttagagctttctttctctttcacggtttcacctttattatgttctttgcttcattgaatgtcgagctctcatttcaatttgggcattgcaatttatggtaggtatgtttaactaagtcgcaggactcatttataccacatttagtc

SEQ ID NO: 6012 - DNA, 544 bp, Brassica napus
gtacccttcgtaggatgttgtttccgtaagactgacatctttgtcaccaccaccggtaacaagacatcatcatggttgaccacatgaggaagatgaagaacaatgctattgtttgtcaacattggtcactttgacaacgagattgacatgctcgggctcgagaccttcccgggtgtgaagcgtatcaccatcaagccccagaccgacaggtgggtcttcccagacaccaagtccggaatcattgttttggctgagggtcgtctcatgaacttgggttgtgccactggtcacccgagtttcgtcatgtcttgctctttcaccaaccaggtgattgctcagcttgagctttggaacgagaagtcgagcggcaagtacgagaagaaggtgtacgttctacctaagcatttggacgagaaggttgcagcacttcacttgggaaagcttggagctaagctcaccaagttgacaaaggaccaatctgactacgtcagcattcccattgaaggaccatacaagcctgctcactacaggtactgagagaaga

SEQ ID NO: 6013 - DNA, 1775 bp, Eutrema halophilum
caatggcgttgcttgtggagaaaacctcgagtggccgtgaatacaaggtcaaggacatgtctcaggccgatttcggccgtctcgaaatcgagctcgccgaggtcgaaatgcccggactcgtctcttgccgtaccgaattcggaccttctcagccattgaaaggagctagaatcaccggatctcttcacatgacgatccaaactgccgttctcatcgaaaccctaaccgctctcggcgccgaggtcagatggtgctcttgcaacatcttctccacccaggaccacgccgccgccgcgatcgctcgcgattccgccgccgttttcgcctggaaaggggagactcttcaggaatactggtggtgcactgagagagctctcgattggggtcctggaggcggtcctgatctcatcgtcgacgacggtggtgacgcgacgctcttgatccatgaaggagtcaaggctgaggagatcttcgcgaagaccggtcagtttccagatccgacttccaccgataatcctgagttccagatcgtgttgtcgatcatcaaagatggtcttcaggttgatcctaagaagtatcacaagatgaaggagagattagtcggtgtttcggaggagacgaccactggtgttaagaggctttaccagatgcaggagactggtactctcttgttccctgccattaacgtcaacgattccgtcaccaagagcaaggtactcgatttaacttgtatggatgtcgtcactctctccctgacggtctcatgagagccactgatgtcatgatcgccggaaaggtcgctgttatctgcggttacggtgacgtcggaaagggttgtgctgcagccatgaaaaccgccggtgcacgtgtcatcgtcaccgagatcgacccgatctgtgcgcttcaagctctcatggaaggcctacaagttctaaccctcgaggacgttctctcggaagctgacatctttgtcaccaccactggaaacaaagacatcatcatggtcgaccacatgaggaagatgaagaacaacgccatagtctgcaacattggtcacttcgacaacgagatcgacatgctcgggctcgagactttccctggtgtgaaacgcatcaccattaagccgcagaccgacaggtgggtgttcccggacaccaagacaggcatcattgtgttagccgaaggtcgtctgatgaacttgggatgtgccactggacacccgagtttcgtgatgtcgtgctcgttcacaaaccaggtgattgcacagcttgagctatggaacgagaagtcgagcgggaagtatgagaagaaggtgtatgttttgcctaagcacttggacgagaaagtggctgcacttcacttgggcaagctcggtgctagactcaccaagcttaccaaggaccaatctgactatgtcagcatacccattgaaggtccctacaagcctgttcactacaggtactgagaagaagaagcaaagcagaaaaaaaagaggccaaagctttggttttatggttaaaggccgtttattggctatgctataatcctaatggcatttaattatttgagttggttcgggtctggtttggttgggaaaatttgaggtgattggtcttctgattaggttgatcaaatattggtatgaataaggggttgttgttcttggttttgagaggcttctttttgttttttttttttttgtttttgttttttttatttatatattatctcaagataaattagtttttgttttacactgtttgttaggcttattt

SEQ ID NO: 6014 - DNA, 806 bp, Brassica juncea
gggttgtgccgctgccatgaagaccgctggtgctagagtcattgtgactgagatcgatcccatctgtgccctacaggctatgatggaaggacttcaagttttgacccttgaggatgttgtttccgaagctgacatctttgtcaccaccaccggtaacaaagacatcatcatggttgaccacatgaggaagatgaagaacaatgctattgtgtgcaacattggtcactttgacaacgagatcgacatgctcggtctcgagaccttcccaggtgtgaagcgtatcaccatcaagccccagaccgacaggtgggtgttcccagacaccaagtccggaatcattgttttggctgagggtcgtctcatgaacttgggttgtgccactggtcacccgagtttcgtcatgtcttgctctttcaccaaccaggtgattgcccagcttgagctttggaacgagaagtcgagcggcaagtacgagaagaaggtgtacgttctacctaagcatttggatgagaaggttgcagcacttcacttgggaaagcttggagccaagctcaccaagttgacaaaggaccaatctgactacgtcagcattcccattgaaggaccctacaagcctgcccactacaggtactgagagaagaatggagagagcggtttgtttctttgtttggtctttgttctgaataaggattcttgttcttttgatggttgtgcttgttcttctttttctgaatttatctttaaacttaaattagcctttggtgatttgattttgttttgtgttcctcgttctactctttaaaaaa

SEQ ID NO: 6015 - DNA, 1456 bp, Brassica juncea
cgacgacggtggtgacgctacgcttcttatccatgaaggtgttaaggctgaggagatcttcgccaagacccgtcagctccccgacccgacttccaccgacaatcctgagtttcagatcgtgttgtcgatcatcaaagatggtcttcaggttgatcccaagaagtaccacaagatgaaggagagattggttggtgtctctgaggagacgaccactggtgtgaagaggctttaccagatgcaggagactggtgctctcttgttccctgccattaatgtcaatgactccgtcaccaagagcaagtttgacaacttgtatggatgtcgccactctctccctgacggtctcatgagagccactgatgtcatgatcgccggaaaggtcgctgttatctgtggttatggtgatgtcggaaagggttgtgctgcagccatgaaaaccgctggtgcacgtgtgatcgtgactgagatcgatccaatctgtgcccttcaggctctcatggaaggccttcaagttctaacccttgaggacgttgtctctgaagctgacatcttttgcaccaccactggaaacaaagacatcatcatggtcgaccacatgaggaagatgaagaacaacgccattgtctgcaacattggtcactttgacaacgaaatcgacatgctcgggctcgagactttccctggtgtgaaacgtatcaccatcaagccacagactgataggtgggtgtttcccgacactaagtcaggcatcattgtgctagccgagggtcgtctgatgaacttgggatgtgctactggccacccaagtttcgtgatgtcgtgctcattcaccaaccaggtgattgcacagcttgagctatggaacgagaagtcgagtgggaagtatgagaagaaggtgtatgttctgcctaagcacttggatgagaaggtagctgcgcttcacttgggcaagctcggtgccagactcaccaagctcaccaaggaccagtctgactacgtcagcatacccgttgaaggtccctacaagcctgttcactacaggtactgagaagaaaaagggaccaagctttggtggttcttcgtatgtttggttcgggtttggttggtctggttggagaaaatatgagatatggtcttcttatgaggttgaccaattattggtatgaataaggggttgttgttattgggggttttgagaggctgtttctttgttttgtttctcattttctattttatatcatttcaagatgaatcagtttcttttttacactcttcttaggcttatctaatttgatgttctttttatgggttctacttttcgaacaaaagaggaaacaatgtacgcaaagctatcttcggcttcatgttactagagatcttttctctgctttgaattgtatactgagatggtaaatccaaacattcaacttttgagctaaaaaaaaaaaaaaaaaaa

SEQ ID NO: 6016 - DNA, 793 bp, Brassica juncea
gagatcgatcccatctgtgccctacaggctatgatggaaggacttcaagttttgacccttgaggatgttgtctccgaagctgacatctttgtcaccaccaccggtaacaaagacatcatcatggttgaccacatgaggaagatgaagaacaatgctattgtgtgcaacattggtcactttgacaacgagatcgacatgctcggactcgagaccttcccaggtgtgaagcgtatcaccatcaagccccagaccgacaggtgggtgttcccagacaccaagtccggaatcattgtgttggctgagggtcgtctcatgaacttgggttgtgccactggtcacccgagtttcgtgatgtcttgctctttcaccaaccaggtgattgcccagcttgagctttggaacgagaagtcgagcggcaagtacgagaagaaggtgtacgtcctacctaagcatttggatgagaaggttgcagcacttcacttgggaaagcttggagccaagctcaccaagttgacaaaggaccaatctgactacgtcagcattcccattgaaggaccctacaagcctgcccactacaggtactgagagaagaatggagagagcggtttgtttcttcttgtttggtctttgttctgaataaggattcttgttcttttgatggttgtgcttgttcttctttttctgaatttatcttaaaacttaaattagcctttgggaatttgattttgttttgtgttcttcgttgtactctttaaaaattagaaacaaaaaagtttaccggaaaaaaaaaaaa

SEQ ID NO: 6017 - DNA, 860 bp, Brassica juncea
gggaaagggttgtgccgctgccatgaagaccgctggtgctagagttattgtgacggagatcgatcccatctgtgccctacaggctatgatggaaggacttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaatgagatcgacatgcttggattggagacgttcccgggtgtgaagcgtatcaccatcaagccccagacagacaggtgggtgttcccagacaccaagtccggaatcattgtgttggctgagggtcgtctcatgaacttgggttgtgccactggtcacccgagtttcgtcatgtcttgctctttcaccaaccaggtgattgcccagcttgagctttggaacgagaagtcgagcggcaagtacgagaagaaggtgtacgttctacccaagcatttggacgagaaggttgcagcacttcacttgggaaagcttggagctaagctcaccaagttgacaaaggaccaatctgactacgtcagcattcccattgaaggaccatacaagcctgctcactacaggtactgagagaagaagaatggagagatcggtttgtttctagtttggtcttctgatgaagttgaccgattttccttctgaataaggattcttgtcttttgattgttgtgcttgttcttctttttctgaattcatcttgaaactttaattagccttttgctttttgttttttgattttgtgttgtgttcatcgttctactcttttaaaaatagaaacaaaaaggttgga

SEQ ID NO: 6018 - DNA, 1182 bp, Brassica juncea
ggtgctagagtcattgtgaccgagatcgatcccatctgtgccctacaagctatgatggaagggcttcaagttctgaccctggaggatgtcgtctctgaagctgacatctttgtcaccaccaccggtaacaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtcatgtcttgctctttcaccaaccaggtgattgcccagcttgagctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccattgaaggaccttacaagcctgctcactacaggtactgagggaagagtggaagatattggttcgctgatgaagttgaccaaatatccttctgaataattgttattggctttgaaggttgtgcttgtttttctttttcttgaaacttaaattagcttttggttatgagttccctcttgatttgcttttgtgttgtgaccaccgttgtactctttgaacgaaaaatggaagagaggaaactattttccgtacccaaattttagagctttctttctaaaaaaaataggatttcggaataacagagatgagagaacgaacagagtctctggatcctaaattaaataagagcatattccactttactaaaaagggagattaaacgagagaaaactcccctagcaaaaacaaaacaaaaaaagtctcaagaagaatataagttgtattctcaaatcactacacaagcttttcccccattcattccacactttcccttgtttgtaatactctaaacccgtaagaaacttctttctaacagacttaactaacttctccctctctctcatacactctagtcgcacttgatgtttctgtagatcctcccaacaaacagattcgat

SEQ ID NO: 6019 - DNA, 1005 bp, Brassica juncea
gggaaagggttgtgccgctgccatgaagaccgctggtgctagagttattgtgacggagatcgatcccatctgtgccctacaggctatgatggaagggcttcaagttttgacccttgaggatgttgtttccgaagctgacatctttgtcaccaccaccggtaacaaagacatcatcatggttgaccacatgaggaagatgaagaacaatgctattgtttgcaacattggtcactttgacaacgagatcgacatgctcggactcgagaccttccctggtgtgaagcgtatcaccatcaagccccagaccgacaggtgggtcttcccagacaccaagtccggaatcattgttttggctgagggtcgtctcatgaacttgggttgtgccactggtcacccgagtttcgtcatgtcttgctctttcaccaaccaggtgattgcccagcttgagctttggaacgagaagtcgagcggcaagtacgagaagaaggtgtacgttctacccaagcatttggacgagaaggttgcagcacttcacttgggaaagcttggagctaagctcaccaagttgacaaaggaccaatctgactacgtcagcattcccattgaaggaccatacaaacctgctcactacaggtactgagagaagaagaatggagagtgcggtttgtttctagtttggtcttctgatgaagttgaccgattttccttctgaataaggattcttgtcttttgattgttgtgcttgttcttctttttctgaattcatcttgaaactttaattagccttttgttttttgattttgtgttgtgttcatcgttctactcttttaaaaatagaaacaaaaaagttggataattggaaactatttttcgcatcccacatttatagagctttctttctctttcgctttaattttgtttcattgaatgagatgtgaagtatgggttgttgtaattatgggcagtacaatgtttattcaatagacttcgatttcatgagcaaaa

SEQ ID NO: 6020 - DNA, 1362 bp, Brassica juncea
acgctgcaggagtactggtggtgcacggagcgtgctctcgactggggcccaggcggtggtccagatctgatcgttgacgatggtggtgacgccacgcttttgatccacgagggagtgaaggctgaggagatctttgagaagactggtcaggttcctgatcccacttccactgacaaccccgagttccagatcgtgctctccatcatcaaggaaggtctccaggttgatcccaagaagtaccacaagatgaaggagagactcgtcggaggagaccaccaccggtgtcaagaggctttaccagatgcaggaaagtggggccctcttgttcccagccattaacgtcaacgactccgtcaccaagagcaagttcgacaacttgtacggttgccgtcactctctacctgatggtctcatgagggccactgatgtcatgatcgccggaaaggttgcggttatctgtggttatggtgatgtcggaaagggttgtgcagctgccatgaaaaccgctggtgctagagtcattgtgaccgagatcgatcccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctattgtctgcaacattggtcactttgacaacgagattgacatgctcgggctcgagaccttccctggtgttaagcgtatcaccatcaaaccccagaccgacaggtgggtgttcccagacaccaagtccggaatcattgttttggctgagggtcgtctcatgaacttgggttgtgccactggtcacccaagtttcgtcatgtcttgctctttcaccaaccaggtgattgcccagcttgagctttggaatgaaaagtctagcggtaagtacgagaagaaggtgtacgttctacccaagcatttggatgagaaggttgcggcacttcacttgggcaagcttggagctaagctcactaagctgacaaaggaccaatctgactacgtcagcattcccatcgaaggaccatacaagcctgctcactacaggtactgagagctgtttggttctggctgtggtttgtctggaagagtggaagatattggtccgctgatgaagttgaccaaatatccttctgaataaggggtgattggctttgaaggttgtgcttgttgttcttctttttcttgaaacttaaattagcttttggttatgagttccctcttgatttgcttttctgttgtgatcaccgttgtactcttaaactaaaaatggaagagaggaaactattttccgtacccaaa

SEQ ID NO: 6021 - DNA, 834 bp, Raphanus sativus
  misc_feature (819)..(819): n is a, c, g, or t
gccttcaagttctaacccttgaggacgttgtctctgaagctgacatcttctgcaccaccactggaaacaaagacatcatcatggtcgaccacatgaggaagatgaagaacaacgccattgtctgcaacattggtcactttgacaacgaaatcgacatgctcggactcgagactttccctggtgtgaaacgtatcaccatcaagccacagactgataggtgggtgtttccggacaccaagtcaggcatcattgtgctagccgagggtcgtcttatgaacttgggatgtgctactggacacccaagtttcgtgatgtcgtgctcgttcaccaaccaggtgattgcacagcttgagctatggaacgagaagtcgagtgggaagtatgagaagaaggtgtatgttctgcctaagcacttggatgagaaggtagctgcacttcacttgggcaagctcggtgctagactcaccaagctcaccaaggaccagtctgactacgtcagcatacccgttgaaggtccctacaagcctgttcactacaggtactgagaagaaaaaaaggaccaagctttggtggttcttcgtatgtgtggttcgggtttggttggtctggtcgtggaaattatgagatattggtcttcttatgaggttgaccaaatattggtaatgaataaggggttgttgttattggttttgagaggctgtttctttgtttgtttttcgttttctatcttatatcaatcatggttttaacctttttaagttaggtttatttaagcgatgttctgcttaccggttttacttttcgaacaagtgagaaaanaagtatttaaagcta

SEQ ID NO: 6022 - DNA, 961 bp, Raphanus sativus
gagtcattgtgaccgagatcgatcccatctgtgctttacaagctatgatggaaggacttcaggttctgacccttgaggatgtcgtctccgaagccgacatctttgtcaccaccaccggtaacaaagacatcattatggttgaccacatgaggaagatgaagaacaacgccatcgtctgcaacattggtcactttgacaacgagattgacatgcttggtctcgagaccttccctggtgtcaagcgtatcaccatcaagccccagaccgacaggtgggtcttcccagacaccaagtccggaatcattgttctggctgagggtcgtctcatgaacttgggttgtgccactggtcacccgagtttcgtcatgtcttgctctttcaccaaccaggtgatcgcccagcttgagctttggaatgagaagtcgagcggtaagtacgagaagaaggtgtacgttctacccaagcatttggatgagaaggttgcggctcttcacttgggcaagcttggagctaagctcactaagctcacaaaggaccaatctgactacgtcagcattcccattgaaggaccatacaagcctgctcactacaggtactgagaggagagctgtttggttctgcttgtggtttgtgtcgtttatggtgggaagagtggaagatattggtccgctgatgaagttgacctaatatcattctgaataaagggttattggctttgaaggttgttgcttgttgttcttctttttcttcaaacttaatttagcttttggttatgagttccttcttgatttgtgtttttgtgttttgatcgccgctgtactctttaaacgaaaaatggtaaaagaggaaactattttcctcaccaattttagagctttctttatcttttcaccttttattatgttctttgtttcattgaatgtgatgtgaagctctcatttcaaatgtgggcattgctatt

SEQ ID NO: 6023 - DNA, 900 bp, Raphanus sativus
  misc_feature (130)..(130): n is a, c, g, or t
  misc_feature (225)..(225): n is a, c, g, or t
  misc_feature (607)..(607): n is a, c, g, or t
gggttgtgccgctgccatgaagaccgctggtgccagagtcattgtcaccgagatcgatcccatctgtgttttacaagctatgatggaaggacttcaggttcttacccttgaggatgtcgtctctgaagcngacatctttgtcaccaccaccggtaacaaagacatcatcatggttgaccacatgaggaagatgaagaacaacgccatcgtctgcaacattggtcncttcgacaacgagattgacatgcttggtctcgagaccttccctggtgtcaagcgtatcaccatcaagccccagaccgacaggtgggtgttcccagacaccaagtccggaatcattgttctcgctgagggtcgtctcatgaacttgggttgtgccactggtcacccgagtttcgtcatgtcttgctctttcaccaaccaggtcattgcccagcttgagctttggaatgagaagtcgagcggtaagtacgagaagaaggtgtacgttctacccaagcatttggatgagaaggttgcggctcttcacttgggcaagcttggagctaagctcactaagctcacaaaggaccaatctgactacgtcagcattcccattgaaggaccntacaagcctgctcactacaggtactgagaagctgtttggttctggttgtggtttgtgtcgtgtatggtgggaagagtggaagatattggcccgctgatgaagttgaccaaatatcattctgaataaatattggctttgaaggttgttgcttgttgttcttctttttcttgaaacttaaattagcttttggttatgagttccttcttgatttgtttttgtgtttttatcgccgctgtactctttaaaagaaaaatggtgaaagaggaaactattttcctcaccaattttagagc

SEQ ID NO: 6024 - DNA, 867 bp, Raphanus sativus
  misc_feature (14)..(14): n is a, c, g, or t
  misc_feature (90)..(90): n is a, c, g, or t
aggatgtcgtctcngaagcgacatctttgtcaccaccaccggtaacaaagacatcatcatggttgaccacatgaggaagatgaagaacancgccatcgtctgcaacattggtcactttgacaacgagattgacatgcttggtctcgagaccttccctggtgtcaagcgtatcaccatcaagccccagaccgacaggtgggtcttccctgacaccaagtccggaatcattgttctcgctgagggtcgtctcatgaacttgggttgtgccactggtcacccgagtttcgtcatgtcttgctctttcaccaaccaggtgatcgcccagcttgagctttggaatgagaagtcgagcggtaagtacgagaagaaggtgtacgttctacccaagcatttggatgagaaggttgcggcccttcacttgggcaagcttggagctaagctcactaagttgacaaaggaccaatctgactacgtcagcattcccattgaaggaccatacaagcctgctcactacaggtactgagagctctttggttcgtgtcgtttatggtgggaagagtggaagatattggcccgctgatgaagttgaccaaatatcattctgaataaattggcttttgaaggttgttgcttgttgttcttctttctcttgaaacttaatttagcttttggttgtcagttccttctcgatttgtttttgtgttttgatcaccgttgtactctttaaacgaaaaatggtaaaagaggaaactattttcctcaccaattttagagctttctttatcttttcacctttattatgttctttgtttcattgaatgtgatgtgaagctctcatttcaaatgtgggcattgctatttacggta

SEQ ID NO: 6025 - DNA, 1158 bp, Brassica napus
ccgacttccaccgacaatcctgtggtttcagatcgtgtgtcgatcatcaaagatggtcttcaggttgatcccaagaagtaccacaagatgaaggagaggttggttggtgtctctgaggagaccaccactggtgttaagaggctttaccagatgcaggagactggtgctctcttgttccctgccattacgttaatgactccgtcaccaagagcaagtttgacaacttgtatggatgtcgccactctctccctgacggtctcatgagagccactgatgtcatgatcgccggaaaggtcgctgttatctgcggttacggtgatgtcggaaagggttgtgctgcagccatgaaaaccgctggcgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccattgtctgcaacattggtcactttgacaatgaaatcgacatgcaagggcttgagacttaccctggtgtgaaacgcatcaccatcaagccacagactgataggtgggtgttccctgacaccaagtctggcatcattgtgttagccgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggtcgctgcacttcacttgggcaagctaggtgctagactcaccaagctcaccaaggaccaatctgactacgttagcatacccgttgaaggtccctacaagcctgttagctacaggtactgagaagaaaaaaagaggatcaagctatggttcttcgtatggttttatgattttaccatttggttataatccaaatggcaattgtttgagttggttcgggtctggtctggttggggaaatatgagatattggtcttcttatgaagttgatcaaatattggtatcaataaggggttgttgttctttggttttgaggggct

SEQ ID NO: 6026 - DNA, 1006 bp, Brassica napus
gcaggagactggagctctcttgttccctgccattaacgttaatgactccgtcaccaagagcaagtttgacaacttgtatggatgtcgtcactcactccctgacggtctcatgagagccaccgatgtcatgatcgccggaaaggtcgctgttatctgcggttacggtgatgtcggaaagggttgtgctgctgccatgaaaaccgctggtgcacgtgtgatcgtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccatcgtctgcaacattggtcactttgacaatgaaatcgacatgcaagggcttgagacttaccctggtgtgaaacgcatcaccatcaagccacagactgataggtgggtgttccctgacaccaaatcaggaatcattgtgttagccgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggttgctgcacttcacttgggcaagctaggtgctagactcaccaagctcaccaaggaccaatctgactacgttagcatacccgttgaaggtccctacaagcctgttagctacaggtactgagaagaaaaaaaaggatcaagctatggttcttcgtatggttttatgattttaccatttggttatattccaaatgacaattgtttgagttggttcgggtctggtctggttggggaaatatgagatattggtcttcttatgaagttgatcaaatattggtatcaataaggggttgttgttctttggttttgagaggct

SEQ ID NO: 6027 - DNA, 637 bp, Brassica napus
acaaagacatcatcatggttgaccacatgaggaagatgaagaacaacgctatcgtctgcaacattggtcactttgacaacgagattgacatgcaaggacttgagaccttccctggagtgaagcgtatcaccatcaagccccagaccgacaggtgggtgttcccagacaccaagtccggaatcattgttttggccgagggtcgtctcatgaacttgggttgtgccactggtcacccaagtttcgtgatgtcttgctctttcaccaaccaggtgattgcccagcttgagtctttggaacgagaagtcgagcggtaagtacgagaagaaggtgtacgttctacccaagcatttggatgagaaggttgcggcacttcacttgggcaagcttggagctaagctcactaagctgacaaaggaccaatctgactacgtcagcattcccgttgaaggaccttacaagcctgctcactacaggtactgagagctgtttggttctcgttgtggtttgtctggaagagtggaagatattggtccgctgatgaagttgaccaactatccttctgaataaggggttattggctttgaaggttgtgcttgttgttcttcttttctgaaacttaaattaacttttggttatg

SEQ ID NO: 6028 - DNA, 1555 bp, Eutrema parvulum
tccattctcacacagatccgagaaaattttcaaaaatggcgttgcttgtagagaagacgtcgagtggccgtgagtacaaggtcaaggacatgtctcaggccgatttcggtcgtctcgagattgagctcgccgaggtcgaaatgcctggactcgtctcttgcgttaccgaattcggaccttctcagccattgaaaggagctagaatcaccggatctctccacatgacgatccaaaccgctgtccttatcgaaaccctaaccaaacttggcgctgaggtcagatggtgctcctgcaacatcttctccacccaggaccacgccgccgccgcgattgctcgtgattccgccgccgtattcgcctggaaaggagagactctccaggagtactggtggtgcacagagagagctctcgattggggtcctggaggtggtcctgatctgatcgtcgatgacggtggtgacgccacgctcctgatccacgaaggagttaaggctgaggagattttcgcgaagaacggtcaattacccgatccgacttccaccgaaaatcctgagtttcagatcgtgttgtcgatcatcaaagatggtcttcaagttgatcccaagaagtaccacaagatgaaggagagattagtcggtgtttcggaggagacgaccactggtgttaagaggctttaccagatgcaggagactggaactctcttgttccctgctattaacgtcaatgactccgtcaccaagagcaaggtatcgatttatttaacttgtatggatgtcgccactctctccctgacggtctcatgagggccactgatgtaatgatcgccggaaaggtcgctgttatctgcggttatggtgatgtcggaaagggttgtgctgcagccatgaaaaccgctggtgcccgtgtgatcgtgactgagatcgatccaatctgtgcacttcaggctctcatggaaggcctccaagttctaacccttgaggacgtcctctcagaagctgacatctttgttactaccactggaaacaaagacatcatcatggtggaccacatgaggaagatgaagaacaacgccattgtctgcaacattggtcactttgacaatgaaatcgacatgcacggactcgagactttccctggcgtgaaacgcatcaccatcaagccccagaccgataggtgggtgttcccggacaccaagaccggcattattgtcctagctgagggtcgtctgatgaacttgggatgtgccactggacacccgagtttcgtgatgtcgtgctcattcaccaaccaggtgattgcacagcttgagctctggaacgagaagtcgagcgggaagtatgagaagaaggtttatgttttgcctaagcacttggatgagaaggtcgctgcacttcacttgggcaagctcggtgctagactcaccaagctcaccaaggaccaatctgactacgtcagcatacccgttgaaggtccctacaagcctgttcactacaggtactgagaaggaaaaaaggccagagcttttgcttctacgtatggttctatggttaaggcc

SEQ ID NO: 6029 - DNA, 859 bp, Brassica juncea
cgctggtgcccgtgtgatagtgactgagatcgatccgatctgtgcccttcaggctctcatggaaggccttcaagtgctaacactcgaggacgttgtctccgaagctgacatcttctgcaccaccactggaaacaaagacatcatcatggtcgaccacatgaggaagatgaagaacaatgccatcgtctgcaacattggtcactttgacaacgagatcgacatgcaagggcttgagacttaccctggtgtgaaacgcatcaccatcaagccgcagactgataggtgggtgttccctgacaccaagtcaggcatcattgtgctagccgagggtcgtctgatgaacttggggtgtgccactggacacccgagtttcgtgatgtcgtgctcgttcaccaaccaggtgattgcacagctcgagctctggaatgagaagtcaagtgggaagtatgagaagaaggtgtatgttttgcctaaacacttggatgagaaggttgctgcacttcacttgggcaagctaggtgctagactcaccaagctcaccaaggaccaatctgactacgttagcatacccgttgaaggtccctacaagcctgttagctacaggtactgagaagaaaaaaaaggatcaagcgctggttctttgtatggttttatgattagaccatttggttataatccaaatggcaattgtttgagttggttcgggtctggtctggttggggaaatatgagttattggtctgcttatgaagttgatcaaatatttgtatcaataaggggttgttgttctttggttttgagaggctgctttatgttttgttttgtttttccttttcaattttatatatctcaagataaat

SEQ ID NO: 6030 - DNA, 1066 bp, Brassica juncea
tcgccactcactccctgacggtctcatgagagccactgatgtcatgatcgccggaaaggtcgctgtcatctgcggttatggtgatgtcggaaagggttgtgctgcagccatgaaaaccgctggtgcacgtgtgatagtgactgagatcgatccaatctgtgcccttcaggctctcatggaaggccttcaagttctaacccttgaggacgtcgtctctgaagctgacatcttttgcaccaccactggaaacaaagacatcatcatggtcgaccacatgaggaagatgaagaacaacgccatcgtctgcaacattggtcactttgacaatgaaatcgacatgcaagggcttgagacttaccctggtgtgaaacgcatcaccatcaagccacagactgataggtgggtgttccctgacaccaagtctggcatcattgtgttagctgagggtcgtctgatgaacttgggatgtgccactggacacccgagtttcgtgatgtcttgctcgttcaccaaccaggtgattgcacagcttgagctctggaacgagaagtcaagtgggaagtatgagaagaaggtatatgttttgcctaaacacttggatgagaaggtcgctgcacttcacttgggcaagctaggtgctagactcaccaagctcaccaaggaccaatctgactacgttagcatacccgttgaaggtccctacaagcctgttagctacaggtactgagaaggatcaagctatggttcttcgtatggttttatgattttaccatttggttataatccaaatggcaattgtttgagttggttcgggtctggtctggttggggaaatatgagatattggtcttcttatgaagttgatcaaatattggtatcaataaggggttgttgttctttggttttgagaggctgttttatgttttgttttgtttttccttttcaattttatatatctcaagataaattaatttttgtttacactcttgttaggcttatttttaactactaaaaatccttttaaagatatataaaattgaaaaggaaaaacaaaacaaaacataaag

SEQ ID NO: 6031 - DNA, 1005 bp, Brassica juncea
gggagtgaaggctgaggagatctttgagaagacgggtcaggttcctgatccgagttcgactgataatcctgagttccagatcgtgctctcgatcatcaaggaaggtcttcaggttgatcctaagaagtaccacaagatgaaggagagactcgtcggtgtctcggaggagaccaccactggtgtcaagaggctttaccagatgcaggagactggagcccttttgttccctgccattaacgtcaacgactctgtcaccaagagcaagttcgacaacttgtacggttgccgtcactctctacctgatggtctcatgagggccactgatgtcatgatcgccggaaaggttgctgttatctgtggttatggtgatgtcggaaagggttgtgccgctgccatgaaaaccgctggtgccagagtcattgtgacagagatcgatcccatctgtgccctacaagctatgatggaagggcttcaagttctgacccttgaggatgtcgtctctgaagctgacatctttgtcaccaccaccggtaacaaagacatcatcatggttgaccacatgaggaagatgaagaacaacgctattgtctgcaacattggtcactttgacaacgagattgacatgctcgggctcgagacctttcctggtgtgaagcgtatcaccatcaagccccagaccgacaggtgggtgttcccagacaccaagtccggaatcattgttttggctgagggtcgtctcatgaacttgggttgtgccactggtcacccgagtttcgtcatgtcttgctctttcaccaaccaggtgattgcccagcttgagctttggaacgagaagtcgagcggcaagtacgagaagaaggtgtacgttctacccaagcatttggacgagaaggttgcagcacttcacttgggaaagcttggagctaagctcactaagctgacaaaggaccaatctgactacgtcagcattcccattgaaggaccatacaagcctgctcactacag

SEQ ID NO: 6032 - DNA, 557 bp, Brassica nigra
aagatgaagaacacgctattgtctgcaacattggtcactttgacaacgagattgacatgctcgggctcgagacctttcctggtgtgaagcgtatcaccatcaagccccagaccgacaggtgggtgttcccagacaccaagtccggaatcattgttttggctgagggtcgtctcatgaacttgggttgtgccactggtcacccaagtttcgtcatgtcttgctctttcaccaaccaggtgattgcccagcttgagctttggaatgaaaggtctagcggtaagtacgagaagaaggtgtacgttctacccaagcatttggatgagaaggttgcggcacttcacttgggcaagcttggagctaagctcactaagctgacaaaggaccaatctgactacgtcagcattcccatcgaaggaccacacaagcctgctcactacaggtactgagagctgtttggttctggctgtggtttgtgtcgtgtatgcgggggaagagtggaagatattggttcgctgatgaagttgaccaaatatccttctgaataattgttattggct

SEQ ID NO: 6033 - DNA, 1915 bp, Eutrema parvulum
cacgtttgagattgagaacttcacatcacattcaatggaacaaaaagaaacagaataatggcgaaagagaattaaagatttaaaattgggatgcggaaaatagtttccctgtttccattttttttgttttctcatttgtttaaagagtacaacgatgaacacaacacaaaatcaaatcatgagggagaactaataaccaaatgctaattttaagtttcaaagataaatgtagaaaaaaagaagaagaacaagcacaaccttcaaaagccaagaacccttattaagaacaatatttggtcacttcatcagaagaccaatatctcccacaaccagaaccaaaccagctttgttcattcttctctcagtacctgtagtgagcaggcttgtatggtccttcaatgggaatgctgacgtagtcagattggtcctttgacaacttagtgagcttagctccaagcttgcccaagtgaagtgctgcaactttctcatccaaatgcttgggtagaacgtacactttcttctcgtacttaccgcttgacttctcgttccaaagctcaagctgggcaatcacttggttggtgaaagagcacgacatgacgaaacttgggtgaccagtggcacaacccaagttcatgagacgaccctcagccaaaacaatgattccggtcttggtgtctgggaacacccacctgtcggtctggggcttgatggtgatacgcttcacaccagggaaggtctcgagtccgagcatgtcgatttcgttgtcaaagtgaccaatgttgcacacaatggcgttgttcttcatcttcctcatgtggtcaaccatgatgatgtctttgttaccggtggtggtgacaaagatgtcagcttccgaaacgacgtcctcaagggtcagaacttgaagtccttccatcatagcttgtagggcacagatgggatcgatctcggtcacaatgactctggcaccagcggttttcatggcagcggcacaaccctttccgacatcaccgtatccacagataacggcaacctttccggcgatcatgacatcagtagccctcatgagaccatcagggagagagtgacggcaaccgtacaagtttacggaatcaataccttgctcttggtgacggagtcgttgacgttaatggctgggaacaaaagagctccactttcctgcatctggtaaagtctcttgacaccagtggtggtttcctcagaaacaccaacgagtctctccttcatcttgtggtacttcttaggatcaacttgaagaccttccttgatgattgacaacacgatctgaaactcagggttgtcagtggaagtcggatcaggaacctgaccagtcttctcaaagatctcctcagccttaactccctcatggatcaaaagcgtcgcgtcaccaccatcatcaacaatcagatctggaccaccacctggaccccagtcaagagcacgctccgtgcaccaccagtactcctggagcgtctcacctttccaggcgaaaacagcggcggagtcacgagcgattgcggcggcggcgtggtcttgagttgagaagatgttgcaagagcaccatctgacttcggcgccgagtgcggttagggtttcaatgagaacggcggtttggatagtcatgtggagagatccggtgattctagcgcctttgaatggctgagcaggaccaaactcggtacggcaagccatgagtccaggcatctcaacttcggcgagctcgagctcaagacgaccgaaatcggcctgagacatgtccttgaccttgtactcacggccactcgacgtcttctcaacgagcaacgccattttttccggatctgagatttgaaattagggcagagagagagagagatggagagaagtgtgcgaggagaaacgaaagagagtgagagag

SEQ ID NO: 6034 - DNA, 1186 bp, Thellungiella halophila
  misc_feature (369)..(370): n is a, c, g, or t
  misc_feature (1157)..(1157): n is a, c, g, or t
ggcacgaggcattaacgtcaacgactctgtcaccaagagcaagttcgacaacttgtacggatgccgtcactctctacctgatggtctcatgagggcaactgatgtcatgatcgccggaaaggtcgctgttatctgtggatacggtgatgtcggaaagggttgtgccgccgccatgaaaaccgctggtgctcgtgttatcgtgactgagatcgatcccatctgtgcccttcaagctttgatggaaggacttcaagttctgacactcgaggacgtggtctcagaagctgacatctttgtcaccaccaccggtaacaaagacatcatcatggtcgaccacatgaggaagatgaagaacaacgccattgtgtnnaacattggtcactttgacaacgagatcgacatgcttggactcgagacttaccctggtgtgaagcgtatcaccatcaagccccagacagacaggtgggtgttccctgagaccaagaccggaatcattgttttggctgagggtcgtctcatgaacttgggttgtgccactggtcaccctagtttcgtcatgtcttgctctttcaccaaccaggtgattgcccagcttgagctttggaacgagaagtcgagtggtaagtacgagaagaaggtttacgttttgcctaagcatttggatgagaaggttgctgcacttcacttgggcaagcttggagctaggcttactaagttgtcaaaggaccagtctgattacatcagcattcccattgaaggaccatacaagcctgctcactacaggtactgagagagagagattagacaaagcgggtttggttctgcttctggtttgtgtcgggttatggtggaagagtggaagatattggtcttctggtgaagttgatcaattatcgttcttaataagggttcttggcttttgaaggttgtgcttgtttcttcttcttcttcatttttcttgaaaacttaaattagtttttgattatagttctcctcttgattttatttttgtgtgttttgttcaacgttgtactctttaaacaaatcatacagaaaaatgaaaaaggggaaactgttttccgcatctcaatttattgatatctctctctttcgactttattctgtttttttttttttttgcttttttgttccattgnatgtgatgtgaagtgttcaaaaaaaaaaa

SEQ ID NO: 6035 - DNA, 1299 bp, Solanum tuberosum
tgagagggcacttgattggggtccaggtggtggtcctgatctgattgttgatgatggaggtgatgctacactcttgattcatgagggtgttaaggctgaggaggagtttgctaagaatggaacaatcccagatcctacttctactgacaatgtcgagtttcaacttgtgcttactattattaaggagagtttaaagactgatcctttaaggtacactaagatgaaggagagacttgttggtgtttctgaggaaactaccactggtgttaagaggctttaccaaatgcaggctaatggaactttgcttttccctgctattaatgttaatgactctgttaccaagagcaagtttgacaacttgtatggatgccgccactcacttcccgatggtctcatgagggctactgatgttatgattgctggaaaggttgcccttgttgctggttatggagatgtcggcaagggatgtgctgctgccatgaaacaagctggtgcccgtgttattgtgactgagattgacccaatctgtgctctccaggctaccatggaaggcctccaggttcttcctcttgaggatgttgtttctgaggttgatatctttgtgaccaccaccggtaacaaggacatcatcatggttgaccacatgaggaagatgaagaacaatgccattgtctgcaacattggtcactttgacaatgaaatcgacatgcatggtcttgagaccttccctggtgtgaagaggatcacaatcaagcctcaaaccgacagatgggttttcccagacaccaagagtggcatcattgtcttggccgagggtcgtctcatgaacttgggatgtgccactggacaccccagttttgtgatgtcctgctctttcactaaccaagtcattgcccaactcgagttgtggaatgagaggagcagtggcaaatacgagaagaaggtgtatgttttgccaaagcacctcgacgagaaggttgctgcccttcatcttggaaagcttggagccaagcttaccaaacttaccaaggatcaagccgactacattagcataccagttgagggtccttacaagcctgctcactacaggtactgaggaaagacaatttgacagtggaacaatattgtcgcggcatgattattttgctttcaatattttgagtttgtttatgatattagtgttttgattattgttggggatatatttgggaggaagttggcatgttttgctgaaaaaaatggtctcatttgaaagaagaccaaagttttaataatatttgagttatggttggtggtgtg

SEQ ID NO: 6036 - DNA, 847 bp, Papaver somniferum
  misc_feature (4)..(4): n is a, c, g, or t
  misc_feature (52)..(52): n is a, c, g, or t
  misc_feature (61)..(62): n is a, c, g, or t
  misc_feature (831)..(832): n is a, c, g, or t
  misc_feature (835)..(835): n is a, c, g, or t
  misc_feature (841)..(841): n is a, c, g, or t
tgcncttcaagccctcatggaaggtatcccagttcagacccttgaagatgtngtagataannctgatatctttgtcaccaccactgggaacaaagacattatcatgctttctcacatgaggaagatgaagaacaatgccatcgtctgcaacatcggacatttcgataatgagattgatatggctggtcttgagacattccccggtgttcagaggatcacaattaagccccagactgacaggtgggtattccctgacactaaaagtggaatcatcattcttgctgagggtcgtttgatgaacttgggatgtgccactggacaccctagttttgtcatgtcatgctcgttcaccaaccaggtcattgctcagttggaattgtggaatgagagaaagagtggaaagtatgcgaagaaggtttacgttttgcctaagcatcttgatgagaaagttgcagctctccatcttggaaagcttggagctaagctcaccaagctcaccaaggatcagtctgactacatcagtattcctattgaaggaccatacaagccagctcactacaggtactgagaaaagaaggaagggatgcagctcactacaggtactgagaaaagaaggaagggattgatgttggtttctatttggcatgcttggtcttttattttttttgttgtcttgagatcttaggttaaattattttgttaagctagcaatgttcggatctcgagtggagagtgcttgattaagattttggtttcttctttatgaaaaataaggtaggtttgtagtactatagttgttttatgtcttatgttgattattgtgatggatannttntgtttnttttta

SEQ ID NO: 6037 - DNA, 917 bp, Solanum lycopersicum
gaaaatgaaaaacatgatgctttgtttccttgaagcaaattttatagaaacaagaaagcaaatgaatctaacttggtacaatatcatatgacaccaccccaaccataattcaaatattattcaaacacatttaggtcaactttccagcaaaacatcccccaacaaaaataaaaacacactacctaaacaaaataaaagtattaaaaacaaaacaatcatgccgccgtatcgttgttccactgtgagcgtctcttcccctcagtacctgtagtgagcaggcttgtaaggaccctcaactggtacactaatgtagtcagcttgatccttggtgagtttggtaagcttggctccgagctttccaagatgaagggcagcaaccttctcgtcaaggtgctttggcaagacgtacaccttcttctcgtatttgccactgctcctctcattccacaactcgagttgagcaatgacttggttagtgaaagagcaagacatcacaaaactagggtgtccagtggcacatcccaagttcatgagacgaccctcggccaacacaatgatgccactgttggtgtctgggaagacccatctgtcggtttgtggcttgattgtgatcctcttcacaccagggaaggtctcaagaccatgcatgtcgatttcgttgtcaaagtgaccaatgttgcagacaatagcattgttcttcatcttcctcatgtggtcaaccataatgatgtccttgttaccagtggtggtcacaaagatatcaacctcagaaacaacatcctcaagaggaagaacctggaggccttccatggtagcctggagagcacagattgggtcaatctcagtcacaatcacacgggcaccagcttgtttcatggcagcagcacatcccttgccgacatctccataaccagcaa

SEQ ID NO: 6038 - DNA, 915 bp, Ocimum basilicum
tgtacggatgccggcactcgctccccgacggcctcatgagggcgaccgacgtgatgatcgccggaaaggtcggcgttgtcttcggctacggagacgtcggcaaggggtgcgcggccgccctgaagcaagccggggcccgcgtgatcgtgaccgagatcgaccccatctgcgccctgcaagccctcatggagggtttccaggtgctccgcctcgaggacgtggtctcggaggcggacatcttcgtcaccaccaccggcaacaaggacatcatcatggtgagtgacatgcgcaagatgaagaacaacgcgatcgtctgcaacatcggtcacttcgacaacgagatcgacatgcacgggctggagacctacccaggggtgaagcggatcaccatcaagccgcagacggaccggtgggtgttccctgacaccaagtcggggatcatcgtgctggcggagggccggctgatgaacctggggtgtgccacggggcaccccagctttgtcatgtcgtgctccttcaccaaccaggtcatcgcccagctggagctgtggaacgagaggaactccggcaagtacgagaagaaggtgtacgttttgccgaagcacctggacgagaaggtggcggccctccacctaggaaagctgggtgcgaagctcaccaagctttccaaggatcaggccgactacattagcgtcccgatcgagggaccctacaagccggctcactataggtactgagctttgagaggatcaacaatgaaattaaattgggggaaaacacaatatatctatgagcttttttttttttttttttttgaatttgggagcagatttgagaattggaaaataagttggacgatggtttttagctagcgcggtggtttttttttgttcttttatatactcgatgaaatat

SEQ ID NO: 6039 - DNA, 770 bp, Ocimum basilicum
aggacgtggtctccgaggcggacatgttcgtcaccaccaccggtaacaaggacatcatcatggtgagcgacatgcgcaagatgaagaacaacgccatcgtctgcaacatcggtcactttgacaacgagatcgacatgcacgggctggagacctacccaggggtgaagcggatcaccatcaagccgcagacggaccggtgggtgttccctgacaccaagtcggggatcatcgtgctggcggaagggcggctgatgaacctggggtgcgccacggggcaccccagcttcgtcatgtcgtgctccttcaccaaccaggtcatcgcgcagctggagctgtggaaggagaggagctccggcaagtacgagaagaaggtgtacgttttgccgaagcacctggacgagaaggtggcggccctccacctaggaaagctgggtgccaagctcaccaagctttccaaggatcaggccgactacattagcgttccgatcgagggaccctacaagccggctcactataggtactgagctttgagaggatcaacaatgaaattgaattatatctatgagtttctttttttttttgaatttgggagctgatttgatgaattggaaaataagttggacggtggtttttagctagcacggtggttttggtttttttttttttcttttcttttatatactcgatgaaatataaaaaggaaattttttccatttccctcacttgtatactattatgtttatctataatattacgttttgcgttttttc

SEQ ID NO: 6040 - DNA, 1178 bp, Cleome spinosa
tccttcgtccaccgacaaccctgagttccagatcgtgttgcagatcatcaaggacggccttccggtcgatccgaagaagtaccacaagatgaaggagagattggtgggtgtctctgaggagaccaccactggtgtcaagaggctctaccagatgcaggtcaatggaactctcttgttccccgccattaacgttaatgactccgtcaccaagagcaagttcgacaacttgtacggatgccgccactctctccccgatggtctgatgagggcaaccgacgtcatgatcgccggaaaggtcggggttgtctgtggttacggagatgtcggaaagggatgtgctctggccctgaaggctgccggtgcccgtgtcatcgtcaccgagatcgatcccatctgtgccctccaggctctcatggaaggtttccagattctaaccctcgaggacgttgtgtccgaggccgacaccttcgtcaccacgacaggaaacaaggacatcatcatggtcgaccacatgaggaagatgaagaacaacgccatcgtctgcaacatcggtcacttcgacaacgagatcgacatgcacggcctcgagaccttccccggcgtgaaacgcatcacgatcaagcctcaaaccgacaggtgggtcttccccgataccaagaccgggatcatagtccttgcagagggccggctcatgaacctgggctgcgccactggtcacccgagcttcgtgatgtcttgctcgttcaccaaccaggtgatcgcacagctcgagctgtggaaggagaaggcgacaggcaagtacgagaagaaggtgtacgtccttccgaaacacttggacgagaaggtggcggcccttcacctgggcaagctcggggcgaggctgacaaagctcagcaaggaccaatccgattacatcagtgtccccatcgagggtccgtacaagccgcctcattacaggtactgagggagggaacgaggaaagaaaggggtggttaccggaattgaggatggatgttttttctttgattagggtttgtgtgtgtcgaagagggaaactgtatggtctttttactgatgaattaagaccagagtatttgggggtatgaaataaggttttttcttttttttttgggagttcgaaggctgtctctggtctcatgccatccgcatcttcttcc

SEQ ID NO: 6041 - DNA, 763 bp, Nicotiana benthamiana
acattatcatggttgaccacatgaggaagatgaagaacaatgccattgtttgcaacattggtcactttgacaacgaaatcgacatgcttggtctcgagacctaccctggtgtcaagaggatcacaattaagcctcaaaccgacagatgggttttccccgacaccaacagtggcatcattgttttggccgagggtcgtctcatgaacttgggatgtgccacaggacaccccagttttgtgatgtcgtgctcgttcactaaccaagtcattgcccaactcgagttgtggaatgagaagagcagtggcaagtatgagaagaaggtgtacgtcttgccaaaacacctcgacgagaaggttgctgcacttcatcttggaaagctcggagccaagcttaccaaactttcaaaggatcaagctgactacattagcgtaccggttgaaggtccttacaagcctgctcactacaggtactgagcgaagataaatcgatagaggagaacaacattgtcgcggcatgattgttttgcatttaatacttcgatttttgtttaggatactagtattttgaatattgttggtgatatatttgggaggaagtggcatgttttactggaaaagatatggtcttatttgaaagtaagaccaaaatgtgttgaataaggttatggttggtggtgtggtatgatattgtagtaagttagatccatttgctttttggtgtatgattttgtttcgagaaatcaaagcaacacttttccctttca

SEQ ID NO: 6042 - DNA, 1393 bp, Petunia hybrida
actgagagggcacttgactggggtccaggtggtgacctgatttgattgttgatgatggtggtgatgctacacttttgatacatgaaggtgttaaggctgaagaagaatatgctaagactgggaaattacctgatcctagttctaccgataatgctgagtttcagcttgtgcttactattattagagatggattaaagactgatcctttaaagtataccaagatgaaggagagacttgttggtgtttctgaagaaactactactggtgttaagaggttatatcagatgcaggctaatggaactttgcttttccctgctattaatgttaatgactctgtcaccaagagcaagttcgataacttgtatggttgccgccactcactgcctgatggactcatgagggccactgatgttatgattgccggtaaggttgctgttgtcgctggttatggagatgttggcaagggttgtgcttctgccctgaagcaagctggtgcacgtgtgatcgtgactgagattgatccaatctgtgcactccaggctctcatggaaggccttcaagtccttacacttgaggatgttgtctctgatgctgatatctttgtcaccactactggtaacaaggacattatcatggttgaccacatgaggaagatgaagaacaatgccatcgtctgcaacattggtcattttgataacgaaatcgacatgctcggtcttgagaccttcccaggagtaaagagaatcacaatcaagcctcagactgacagatgggtcttccccgacaccaacagtggtatcattgtcttggccgagggtcgtctcatgaacttgggatgtgcaactggacaccctagcttcgtgatgtcctgctctttcactaaccaagtcattgcccagctcgagttgtggaaggagaaaagcaccggcaagtatgagaagaaggtctacgtcttgccaaagcaccttgacgagaaggttgctgcccttcatcttggaaagcttggagcaaggctcactaagcttagcaaggatcaatccgactatattagtgttccagttgagggtccttacaagcctgctcactacaggtactaagagcaggatgagagagactggaaaaacagcgaatttaaggcttttttgttttacttttaatgtttggtttttggttaggacacaagtgttctcttgaaaaattgttggggatactttgggaggtggtatgtttgctgggataagaattggtctcgtctaatggaaggccataatctgttgaataaggttgggatgagaggggtggtgtgctttcgatattatagtagttaagacttttgcttttggttttgtcctttactttgaggaatcacggagctacatgtttgctttatcag

SEQ ID NO: 6043 - DNA, 848 bp, Solanum tuberosum
gctggtgcccgtgtgattgtgactgagattgatccaatctgtgctcttcaggctaccatggaaggactccaggttcttcctcttgaggatgttgtttctgaggttgatatctttgtgaccaccactggtaacaaggacatcatcatggttgaccacatgaggaagatgaagaacaatgccattgtctgcaacattggtcactttgacaatgaaatcgacatgcatggtcttgagaccttccctggtgtgaagaggatcacaatcaagccacaaaccgacagatgggtcttcccagacaccaacagtggcatcattgtcttggccgagggtcgtctcatgaacttgggatgtgccactggacaccccagttttgtgatgtcttgctctttcactaaccaagtcattgcccaactcgagttgtggaatgagaggagcagtggcaaatatgagaagaaggtgtacgtcttgccaaaacacctcgatgagaaggttgctgcccttcatcttggaaagctcggagccaagctcaccaaacttaccaaggatcaagctgactacatcagcgtaccagttgagggtccttacaagcctgttcactacaggtactgagggaagagacactcatggtggaacaacgatatcgcggcatgattgttttgtttttaatactttgattttgtttaggtagtgtgtttttattattgttgggggaagttgggcatgttttgctggaaagttgacctaaatgtgtttgaataatattcgaattatggtgttggggttgtgtcatatgatattgtactaagattcatttacttttttttttctctataaaatttgcttcaagg

SEQ ID NO: 6044 - DNA, 792 bp, Salvia sclarea
ctactagaccttggctgtcactcaacatcttcgtcaccaccactggcaacaaggacatcatcatgctctcccacatgaggaagatgaagaacaacgccatcgtctgcaacattggccacttcgacaacgagatcgacatgcacggcctcgagaccttccccggagtgaagaggatcaccatcaagccccagaccgaccgatgggtgttccctgacaccaagaccggcatcattgtgttggccgagggtcgtctgatgaacttgggatgcgccaccggccaccccagcttcgtcatgtcgtgctcgttcaccaaccaggtcatcgctcagctcgagctctggaacgagaagagcagcggcaagtacgagaagaaggtgtacgtgttgcccaagcacctcgatgagaaggttgctgccctccacttgggtaagctcggcgcgaagctcaccaagctgtccaaggaccaggccgactacatcagcgtcccagtcgagggcccgtacaagcctgctcactacaggtactgagcggagagatggttgtcgaaatgggggaaaacagcacacattgatcagcatcatggttttcttgagctatttgggagtgatttgatgacttgaaaaataagttggaagatgatatttagtcatcacggcggtttgattatttcttttttctgttttccttttgagcgtttgattaaagaaaagatgtagttgccgcagcagatgcattattgcgtttggcatctatatatatatatgcgatgaaatgatatatcattctaatgtt

SEQ ID NO: 6045 - DNA, 851 bp, Solanum lycopersicum
gaaaatgaaaaacatgatgctttgtttccttgaagcaaattttatagaaacaagaaagcaaatgaatctaacttggtacaatatcatatgacaccaccccaaccataattcaaatattattcaaacacatttaggtcaactttccagcaaaacatcccccaacaaaaataaaaacacactacctaaacaaaataaaagtattaaaaacaaaacaatcatgccgccgtatcgttgttccactgtgagcgtctcttcccctcagtacctgtagtgagcaggcttgtaaggaccctcaactggtacactaatgtagtcagcttgatccttggtgagtttggtaagcttggctccgagctttccaagatgaagggcagcaaccttctcgtcaaggtgctttggcaagacgtacaccttcttctcgtatttgccactgctcctctcattccacaactcgagttgagcaatgacttggttagtgaaagagcaagacatcacaaaactagggtgtccagtggcacatcccaagttcatgagacgaccctcggccaacacaatgatgccactgttggtgtctgggaagacccatctgtcggtttgtggcttgattgtgatcctcttcacaccagggaaggtctcaagaccatgcatgtcgatttcgttgtcaaagtgaccaatgttgcagacaatagcattgttcttcatcttcctcatgtggtcaaccataatgatgtccttgttaccagtggtggtcacaaagatatcaacctcagaaacaacatcctcaagaggaagaacctggaggccttccatggtagcctggagagcacagattgggtcaatctcagtcacaa

SEQ ID NO: 6046 - DNA, 873 bp, Brassica napus
taggtcgttgtcgtgcggagtatgtgagtgtggaagggtaggtgtcgctgccatgaagacgctggtgctagagtattgtgacggagatcgatcccaatctgtgccgtaccaggcgtaatgaatgtaagggcgttcaagttttgtacccttcgtaggatgtgtttccgaagctgacaccttgtcacacaccggtacaaagacatcatcatggttgaccacatcaggaagatgaagaacaatgctatgtttgcaacattggtcactttgacaacgagatcgacatgctcggactcgagaccttccctggtgtgaagcgtatcaccatcaagccccaagaccgacaggtgggtggttccccagacaccaagtccggaatcattgttttggctgagggccgtctcatgaacttgggttgtgccactggtcacccgagtttcgtcatgtcttgctctttcaccaaccaggtgattgcccagcttgagctttggaacgagaagtcgagcggcaagtacgagaagaagtgtcgtctaccaagcatttggacgagaaggttgcagctcttcacttgggaaagcttggagctaagctcaccaagttgacaaggaccaatctgactacgtcagcattcccattgaaggaccatacaagcctgctcactacaggtactgagagaagaagaatggagagagtcggtttgtttctagtttggtcttctgatgaagttggccgaattcgtcccttcgtgaaatggaggtattcttgtcttttgatttgttgtgctttgttctttcttttccgattcattcttgaaacttaattgccttttggtatttgattttcgcgtttggtcgtttacattcggttcttaagtac

SEQ ID NO: 6047 - DNA, 1823 bp, Vitis vinifera
agccatgtctttgcttgttgagaagaccagttctggccgggagtacaaggtcaaggacatgtctcaggcggacttcggccgtctggagatcgagcttgcggaggttgagatgccaggcctcatgtcttgcaggactgagttcggaccccagcagccattcaagggtgccaagatcactggctcactccacatgaccatccagactgccgtccttatcgagaccctcaccgcccttggcgccgaggtccgctggtgctcctgcaatatcttctccacccaggaccacgccgccgctgccattgcccgcgacagcgccgccgtcttcgcctggaagggcgagaccctacaggagtactggtggtgcacggagcgggccctcgactggggtcccggtggcggccccgatctcatcgtggacgacggcggcgacgctaccttgttgatccacgagggggtcaaggctgaggaggagtacgccaagagcggcaagttaccggacccctcctccaccgacaatgctgagtttcagatcgttttgaccattattagggacggattgaagacagatccgaagagatatcacaagatgaaggggagattggttggtgtttctgaggagaccaccaccggtgttaagaggctttaccagatgcaagctaacggcactttgcttttccctgctattaatgtcaatgactctgtcaccaagagcaaggtattagttcgacaatttgtatggatgccgccattcactccctgatgggctgatgagagctacggacgtgatgattgccggaaaggttgcagttgtatgcggatacggagatgtgggcaagggctgcgctgctgccctgaagcaagctggagcccgggtgatcgtgacggagatagatccgatctgtgctctgcaggccctgatggagggtatcccggttcaaaccattgaggatgtcgtctctgaagcagacatcttcgtgaccaccaccggtaacaaggacatcatcatggttgaccacatgaggaagatgaagaacaatgcaattgtttgcaacattggccacttcgacaacgagattgacatgttagggctggagacatacccgggtgtgaagagaatcaccatcaagccccaaactgataggtgggtgttccctgataccaattcgggcatcatagtgttggcagaggggcgactcatgaacttgggttgcgccactggccaccccagctttgtgatgtcatgctcgttcaccaaccaggtgattgcacagctggagctgtggaaggagaaggccagtggcaagtatgagaagaaggtgtatgtgttgccaaagcatctcgacgagaaggttgctgcgcttcaccttgggaagcttggggccaagctcaccaagcttagcaaggaccaggctgactacatcagtgtgcccattgagggtccttacaagcctcctcactacaggtactgagagagaagacccacagatatgtggatgggcttgatttgccttcttttacaatctgatttatgttagaattataggtttgatttttgcattttttttttcctgtcatgggggttgtttggggtttgggaagaaaaagaagagagagaaaaaaccgagatcggtgtcttccgttgaagaagatgagcagatgtggggattcaataaggattgtgattgagggctgtgtgtgagagagtattctggttaaaaaccaaaaaagagagaaaaaaatattttatatgtcagttgttttcacttatgcttttcgtttatttcaagatgaaataagtcaattacacaaattacacaaaatta

SEQ ID NO: 6048 - DNA, 928 bp, Cenchrus ciliaris
  misc_feature (917)..(917): n is a, c, g, or t
gatggagggtcttcaggtccttaccttggaggatgtcgtctctgaagctgacatctttgtgaccaccaccggcaacaaggacatcatcatggttgaccacatgaggaagatgaagaacaatgcaatcgtctgcaacattggtcactttgacaatgagattgacatgcacggtcttgagacctaccctggtgtcaagcgcatcaccatcaagcctcagactgaccgctgggtgttccctgagaccaagactggcatcattgtccttgctgagggtcgtctgatgaaccttgggtgcgctactggccaccccagctttgtcatgtcctgctcattcactaaccaggtcattgctcagcttgagctgtggaaggagaagagctctggcaagtatgagaagaaggtgtacgtgctccccaagcaccttgatgagaaggttgctgctctccacttgggcaagcttggtgccaggctcaccaagcttaccaagtctcaggctgactacatcagtgtcccggttgagggtccctacaagcctgctcactaccggtactaggctgcccagcacgacgagaagctcacttggttggccggttgtgttgtgtgcccgtttgaagttcactacaccggctgtccggttaacttttccatggatatcaaatgcgccattggcgtaggagggtcatcgcttgagcctggttgagtggtgagaggagggaagagctgtttgcttttgcagaagaataatggcgagaattggtcgtgggttgaggctgtgtgcgttgccagaaactataatcgtttctgattatcatttgcaagcgatttattctagttatttgtctttcatgaataactttcttcaaaagcatatagtcagatcctgagttttgcttacaaagttacatctagttcgatgngttctccagca

SEQ ID NO: 6049 - DNA, 644 bp, Setaria italica
ccccatctgtgcccttcaggccttgatggagggtcttcaggtccttaccttggaagatgtcgtctctgaagctgacatctttgtgaccaccaccggcaacaaggacatcatcatggttgaccacatgaggaagatgaagaacaacgccattgtctgcaacattggtcactttgacaatgagatcgacatgcacggtcttgagacctaccctggtgtcaagcgcatcaccatcaagccccagactgaccgctgggtcttccccgagaccaagactggcatcattgttcttgctgagggtcgtctgatgaaccttggatgtgccactggccaccccagcttcgtcatgtcctgctcattcaccaaccaggttattgctcagcttgagttgtggaacgagaaggccactggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccttacaagcctgcggcttaccggtactagtgtgtccagcacggctagcggctggcctgagcctgagactgagcaagcggcaccaacgggaactctg

SEQ ID NO: 6050 - DNA, 894 bp, Pseudoroegneria spicata
  misc_feature (285)..(285): n is a, c, g, or t
  misc_feature (728)..(728): n is a, c, g, or t
  misc_feature (887)..(887): n is a, c, g, or t
tgtggttatggtgatgttggcaagggctgtgccgccgcactgaagcaggctggtgcccgtgtgattgtgacagagattgaccccatctgtgcccttcaggccctgatggagggcatccagatcctcaccttggaggatgttgtctcagaggctgacatcttcgtcaccaccaccggaaacaaggacatcatcatggttgaccacatgaggaagatgaagaacaatgccattgtctgcaacattggtcactttgacaacgagatcgacatgaacggccttgagacntaccctggtgtcaagcgcatcaccatcaagccccagactgaccgttgggtcttccccgagaccaagactggcatcattgttcttgccgagggtcgtctgatgaaccttggatgtgccactggccaccccagctttgtcatgtcctgctcattcactaaccaggttattgctcagcttgagttgtggaatgagaaggccaccggcaagtacgagaagaaggtgtacgttctccccaagcaccttgacgagaaggtcgcggcccttcacttgggcaagctcggcgccaagctgaccaagctcaccaagtcccagtctgactacattagcatcccaattgagggtccttacaagcctgcggcttaccggtactaagtgtgtccagcacgactagcggctggcctgagcctgagcctgagcagcggcgccaacgggaactctgccanggcggcctatcaactatcgtgtttcccttccattatcttacatgctgtctcttaggcggaggatttgttattatggttatgttttgagttgagccttgtgagggttgggagaggcggcgtttgcttttgcccagaaataatggcattattattggtttnaaaaaaa

SEQ ID NO: 6051 - DNA, 604 bp, Salvia sclarea
gcacgaggagacgtggtctccgaggccgacatcttcgtcaccaccaccggcaacaaggacatcatcatgctcgaccacatgaggaagatgaagaacaacgccattgtgtgcaacatcggccactttgacaacgagatcgacatgcacggcctcgagaccttccccggagtgaagaggatcaccatcaagccacagacggacaggtgggtgttcccggacaccaagactggcatcatcatcctggccgagggccgtctcatgaacttgggctgtgccaccggccaccccagcttcgtcatgtcgtgctccttcaccaaccaggtcattgcccagctcgagctctggaacgagaagaccagtggcaagtacgagaagaaggtgtatgtgctgcccaagcatctcgatgagaaggtcgcagccctccacctcggtaagcttggggcgaggctcacgaagctctccaaggaccaggccgactacatcagcgtccccgttgagggtccctacaagcctgctcactacaggtactaagctaaaggggaacatggttgttgcaatgtggggtaaaacagtacactttgatcatcagcatcacggtttcttg

SEQ ID NO: 6052 - DNA, 1097 bp, Panicum virgatum
gacaacctgtatggttgccgccactcccttcctgatggtctgatgagggccaccgatgttatgattgctggcaaggttgcggtagtatgcggttatggtgatgttggcaagggctgtgctgctgccctcaagcaggctggtgcccgtgtcatcgtcactgagattgatcccatctgtgcccttcaagccctgatggagggtcttcaggtccttaccttggaggatgtcgtttctgaagctgacatctttgtgaccaccactggcaacaaggacatcatcatggttgaccacatgaggaagatgaagaacaatgcaattgtctgcaacatcggtcactttgacaatgagattgacatgcatggtcttgagacctaccctggtgtgaaacgcatcaccatcaagcctcagacggaccgctgggtgttccctgagaccaagactggcatcattgtccttgctgagggtcgtctgatgaaccttggatgcgctactggtcaccccagctttgtcatgtcctgctcattcactaaccaggtcattgctcagcttgagctgtggaaggagaagagctctggcaagtatgagaagaaggtgtacgtgctccccaagcaccttgatgagaaggttgctgctctccacttgggcaagcttggtgccaagctcaccaagctcaccaagtctcaggctgactacatcagcgtcccgattgagggtccctacaagcccgctcactaccggtactaggctgcccagcacaactagaacaccactttgctggctggctgtgttatgtgcccatacgaagttagccacatcgggttatcttttgaatgctcacatgcgcctttgcctagaaggaatttttatggtcattgcttgagcggtttagtttggttgagtgggggagaggttggaagagctgtttgcttttgcggaagaataatggtgtaattggttgtaggctgaggcggtgtgcgttgccagaaactacatagtttctgattatcatttgcaagcgatttgctcaagttatgtgtctttcatgaataacttgctttcttgaagagcatatttagtctggtcctgaaattttgttt

SEQ ID NO: 6053 - DNA, 1030 bp, Camellia sinensis
tgagagccactgatgttatgattgctggaaaggtcgctgttgtctgtggttatggtgatgtgggcaagggctgtgccgctgcaatgaagcaagctggagcacgtgtgattgttactgagatcgatccaatttgtgcccttcaggctcttatggagggtctccaagttctaaccctcgaagatgtggtctcagaagccgatatctttgtcaccaccactggcaacaaggacaccatcatggttcaccacatgagaaagatgaagaacaacgccattgtctgcaacattggccattttgataatgaaattgacatgcatgggcttgagacatacccgggcgtgaagaggatcacgattaagccccaaacagacaggtgggttttccccgacaccaagtcaggcatcattgtcttggctgaggggcggctcatgaacttgggttgtgctacagggcatcccagctttgtgatgtcatgctctttcactaaccaagtgattgcccagcttgagctgtggaaggagaagagtaccggcaagtatgagaagaaggtgtatgttttgcccaagcaccttgatgagaaggttgcagcacttcaccttggtaagctcggagctaagctcaccattctcaccaaggaccaggctgattacattcgcattccggttgagggtccttacaagcctgctcactacaggtactgaggaaagagagcaaagaacagaacatctgaatggaatggttgtttttgttttcttttatgctttgatttgaattagaatggtagttcttttttctttttctttcttgtttcgttttgtttttttccccttttttatgatgggggttgtgtttggtggtggtgagggttgagaggaaacaaatggattcttccttgtgaagaagaccaaatgggttgaaataaggtttgagacttggttgtgtgggatatgttggagttgctggagtttagggttttactgcattttgttataattttattgtaacaaatatgaaaagtaatatttgcctt

SEQ ID NO: 6054 - DNA, 1467 bp, Nicotiana tabacum
gaagttagatggtgctcttgcaacattttctctacccaggaccacgctgccgccgccatagcgcgtgatagcgctgccgtgttcgcgtggaagggtgagacgttgcaagagtactggtggtgtactgaacgcgcccttgactggggccccggtggtggacccgacttgattgttgatgatggtggtgatgctacacttttgattcatgaaggtgtaaaagctgaagaggaatatgctaaatctggtaaattaccagatccaagttctactgataatgctgagtttcagcttgtgcttactattattagggacgggttgaaaactgatcctttaaaatacactaagatgaaggagagacttgttggtgtttctgaggaaactactactggtgttaagagactttaccaaatgcaggctaatggaactttgcttttccctgctattaatgttaatgactctgttaccaagagcaagtttgataacttgtacggatgccgccactcactgcctgatggtctcatgagggctactgatgttatgattgccggaaaggtagcgcttgttgccggttacggagatgtcggtaagggttgtgctgctgccttgaagcaagctggtgcacgtgtcatcgtgactgagattgatccaatctgtgctctccaagctaccatggaaggtcttcaggtccttacccttgaggatgtcgtttcagatgttgatatcttcgttaccacaaccggtaacaaggacatcatcatggttgaccacatgaggaaaatgaagaacaacgccattgtctgcaacattggtcatttcgacaatgaaatcgacatgctcggtcttgagaccttccctggagtgaagaggatcacaatcaagccccagactgacagatgggtctttcccgacaccaacagcggtatcattgtcttagccgagggtcgtctcatgaacttgggatgcgccactggacaccccagcttcgtgatgtcctgctctttcactaaccaagtcattgctcagctcgagttgtggaaggagaagagcaccggcaagtatgagaagaaggtgtacgtcttgccaaagcaccttgatgagaaggttgctgcccttcatctcggaaagctcggagcaaggctcactaagctttccaaggatcaagctgactacattagtgtaccagttgaaggtccttacaagcctcctcactacaggtactaagcgaagacaaagaagagactgcaaaaacagcacattcttacgccattgattgttatgcttttcatgctttggattttgttaggacaatagtatcttgttcctttaaactatcgttggggatattttggagtgtttggaatgttgtttctggaaaagaattggtctcatatcagatggaagaccaagatgtgttgaataagttttgaggaatggaggtggtgtgctattgatattgtagcagttaga

SEQ ID NO: 6055 - DNA, 1776 bp, Triticum aestivum
agatccaatccaccaaccttctccatggcgctctccgtggagaagacctcgtcgggccgggagtacaaggtcaaggacctctcccaggccgacttcgggcgcctcgagctcgacctcgccgaggtcgagatgcccggcctcatggcctgccgcaccgagttcggtccctcgcagcccttcaaggcgcccggatctccggctccctccacatgaccatccagaccgccgtgctcatcgagaccctcaccgccctcggcgccgaggtccgctggtgctcctgcaacatcttctccacccaggaccacgccgccgccgccatcgcccgcgactccgccgccgtcttcgcctggaagggcgagaccctcgaggagtactggtggtgcaccgagcgctgcctcgactggggcgccggcggcggccccgacctcatcgtcgacgacggcggcgacgccacgctgctcatccacgagggcgtcaaggccgaggaggagttcgagaagtccggcaaggtccccgacccggagtccaccgacaaccccgagttcaagatcgtcctcaccatcatccgcgacgggctcaagaccgacgcccacaagtaccgcaagatgaaggagaggctcgtcggcgtctccgaggagaccaccaccggcgtcaagaggctctaccagatgcaggagtccggcaccctcctcttccccgccatcaacgtcaacgactccgtcaccaagagcaagtttgacaacctttacggttgccgtcactcgctccctgatggtcttatgagggccactgatgttatgatcgccggcaaggtcgccgtggtctgcggttatggtgatgttggcaagggctgtgccgccgcactcaagcaggctggtgcccgtgtgatcgtgacagagattgaccccatctgtgcccttcaggccctgatggagggtatccagatcctcaccttggaggatgttgtctctgaggctgacatctttgtgaccaccaccggaaacaaggacatcatcatggttgaccacatgaggaagatgaagaacaacgccattgtctgcaacattggtcactttgacaatgagatcgatatgaacggccttgagacctaccctggtgtcaagcgcatcaccatcaagccccagactgaccgctgggtcttccccgagaccaagactggcatcattgttcttgctgagggtcgtctgatgaaccttggatgtgccactggccaccccagcttcgtcatgtcctgctcattcaccaaccaggttattgctcagcttgagttgtggaacgagaaggccactggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccgtacaagcctgcggcctaccggtactagtgtgtccagcacgactagcggctggcctgagcctgagtcggagcagcggcaccaacgggaactcttatcaactatcctgtttcccttctattatcttacatgctgtctcttaggcggaggatttgttattatggttatgttttgagccttgtgagggttgggagaggcggcgtttgcttttgcccagaaataatggcattattattggtttaagtgaggtggtgtgcttttccagatactgttttgtctcgtttgttctaccatgtctgaaatcctttgcatgctgttgctcata

SEQ ID NO: 6056 - DNA, 1467 bp, Fagopyrum esculentum
agggacagcgctgctgtcttcgcctggaagggagagaccctacaggagtactggtggtgcactgagagggcattggactggggtcccggtggtggccctgacctcattgtggacgacggaggtgacaccaccctcttgatccacgagggtgtcaaggctgaggaggagtatgccaagaccggcaagctcccagacccaagctctaccgacaatgctgaattcaagattgtcttgacaatcatcaaggatgggttgaaggccgatccccagaagtaccacaagatgaaggacagagttgttggtgtttctgaggaaaccaccactggtgtcaagaggctttaccagatgcaggctaacggatcattgttgttccctgctatcaatgttaacgactctgtcaccaagagcaagtttgacaacttgtacggttgccgtcactctctccctgatggtctcatgagggctactgatgtcatgattgctggaaaggttggtgttgtctgtggttacggagatgtcggaaagggttgtgctgctgccttgaaggctggtggtgcccgtgtaattgtcacagagatcgacccaatctgtgctctccaggctctcatggagggataccaagtcctcaccttggaagacgttgttgccgatgctgacatctttgtgaccaccaccggtaacaaggacatcatcatgctcgagcacatgaagaaaatgaagaacaacgccattgtctgcaacatcggtcacttcgacaatgaaatcgatatgcaaggactcgaaacctaccctggcatcaaaagaatcaccatcaagccacaaaccgacagattcgtcttccccgaaaccaagaatggtgtcatcgtcttggctgaaggccgtctcatgaacttgggttgtgccaccggccaccccagtttcgtcatgtcttgctccttcaccaaccaggtcatcgcccagctcgagctctggaacgagaagtcatccggcaaatacgagaagaaagtctacgtcttgccaaaacacctagatgagaaagttgctgctcttcatctcggaaagctcggtgctagactcaccaagctttcaaaggatcaagccgactacatcagcgttcccgtcgagggcccatacaagccaccacactacaggtactagagggattgcttgttggagttgagatacggagatttttttagggcaatggttgctttcattgcttgcttcaatattgccgtaggcttctagttggtgttttatgtgtttcgagtggtttaggatttggagaacgttaaggtggaatgaagtgtctttctttgaagaccaaagggattgaataaggttcgtgtgtggatgtgttgggtgtgctgtagtgtttttgcttgagcttgcaatcaaaatgaaagaaaatctagggcttttgtttttcatacttttaatgcaaaatcggcaggtaatactttgcct

SEQ ID NO: 6057 - DNA, 786 bp, Linum usitatissimum
gatgaagaacaacgccattgtttgcaacatcggtcactttgacaatgagattgacatgaatggacttgagaccttccctggagtgaagcgcatcaccatcaagccccagaccgacaggtgggtgttcccagacaccaagagcggcatcattgtgttggcagagggacgtctcatgaatttgggatgtgcaactggtcaccctagcttcgtgatgtcctgctcgttcaccaaccaggtgatcgctcagcttgagctctggaacgagagagccagtggcaagtatgagaagaaggtgtacgttctgcccaagcaccttgacgagaaggtggcttcgcttcatcttggaaagcttggagctaggctcaccaagctgtccaaggaccaggctgactacatcagtgttccagttgagggtccttacaagcctgctcagtacaggtactgagcaaccaaagttaaaggggtatggagtggaacaagaaccagatttgcttttggtggtaaatgcggcgatccgttggtttgttttgcatttgtgttaggaagtgtttaggttttgtttttatgtttttggtgttatgggctggctgggaaaggtgagggctttcgggggaatggatgaataagggcatctgggaagttggctgggttgtgtctgatagaattttgtttggtattgttttcgcaaatttggatatttgtgccatgctgcctgaggcgctggctttatcatattattattttctctgggaaaagttatagatgaaaatgaagagttgtttgcct

SEQ ID NO: 6058 - DNA, 1159 bp, Olea europaea
tactgaaagggcacttgattggggcccaggtggaggacccgatctgattgttgatgatggaggagatgctacgctcttgatccacgaagggttcaaggccgaggaggagtatgagaaaactgggaaggtgcccgaccgattcgaccgacatgcggagttccagatcgtgcttacgattatacgagatgggcttaagtcggatccgaagaaatacaccagaatgaaggagaggctcgtcggtgtctccgaggaaactaccactggtgtgaagaggctttaccagatgcaggctaacgggactctgcttttccctgctattaatgtcaatgactctgtcaccaagagcaagtttgataacttgtacggatgccgccattctctccctgatggactgatgagggccactgatgttatgattgctggaaaggttgctgttgtcgctggttatggagatgttggcaagggctgcgctgctgccttgaagcaagccggtgcccgtgtgattgtgactgagattgaccccatttgtgccctccaagctctcatggaaggtctccaggttctaactcttgaggatgttgtctctgaagctgatatcttcgtcaccaccactggtaacaaggacatcattatggtcgaccacatgagaaagatgaaaaacaatgccattgtttgcaacattggtcacttcgacaatgaaattgacatgcatggtctcgagacctaccctggggttaagagaatcaccatcaaaccacaaacagatagatgggtattcccagatacaaattccggtattattgtcttggccgagggtcgtcttatgaacttgggatgtgccaccggacaccctagctttgtgatgtcatgctcttttaccaaccaagtgattgcacaacttgagctctggaacgagaggaaaactggcaagtacgagaagaaggtttatgtcttgcccaagcaccttgatgagaaggttgctgctctccaccttgggaagcttggtgctaagctcactaagctttcaaaggatcaggctgattacattagcattccagtcgagggcccttacaagcctccgcattacaggtactaagggggaaagcatacactgaatcgaaaagacacaaatacacgttgtcttgattgtttcttttac

SEQ ID NO: 6059 - DNA, 1214 bp, Phaseolus coccineus
gcaagatgaagcagcgtcttgttggggtttctgaggagaccaccactggtgtgaagaggctctatcagatgcaggccaatgggactcttttgttccctgctattaatgtcaatgactctgtcaccaagagcaagtttgacaacttgtatgggtgccgtcattctctccctgatggtctgatgagggctactgatgttatgattgcggggaaggtggctgttgtggctggatatggtgatgttgggaagggttgtgctgctgcattgaagcaggctggggctcgtgtgattgtgactgagattgatcccatctgtgccctccaggctctcatggaaggccttcaggttctgaccttggaggatgttgtatctgatgctgatatctttgttaccaccaccggtaacaaggacatcattatggttgaccacatgaggaaaatgaagaacaatgccattgtttgcaacattggtcactttgacaatgagatcgacatgctgggactggagaactaccccggtgtgaagcgcatcaccatcaagccccagactgacaggtgggtgttccctgagaccaacaccggcatcattgtgttggctgagggtcgtttgatgaacttgggatgtgccacaggacaccccagttttgtgatgtcctgctccttcaccaaccaggtgattgcccagcttgagctgtggaatgagaagagcagtgggaagtatgagaagaaggtatatgttttgccgaagcaccttgatgagaaggtggctgcacttcaccttgggaagcttggagctaggctcacgaagcttagcaaggatcaggctgattacatcagtgtggctgttgagggtccatacaagcctactcactacaggtactaaggttgttgtgatgatgatgaatggagagcgaaagcaaaactggttcatggagtggcttgattgtttcattttctttgaattttttgtgctagaacttcacatccatggtagaagaacaattgttttctgaattttgtagaacttatgttggagtgggtgggacgggtacgggtaatgcggcctgttggattctgtggtatgaatccaatttggtctgaaataagggttgtttggtttgggggttgtgtgcattttggtttaactaaatttctgtctctttccaccgtttaatattacatcaaagataatatcatattaaaaaaagttcctaca

SEQ ID NO: 6060 - DNA, 1739 bp, Brachypodium distachyon
gccgcgcctccactcctcgcctagatccaatccccaacaaacttctccccactccagccgccatggcgctctccgtggagaagacctcgtcggggcgggagtacaaggtcaaggacctctcccaggccgacttcggccgcctggagctggagctggctgaggtcgagatgccggggctcatggcctgccgcaccgagttcgggccctcgcagcccttcaagggcgcccgcatctccgggtcgctccacatgaccatccagaccgccgtcctcatcgagaccctcaccgccctcggggccgaggtccgctggtgctcctgcacatcttctccacccaggaccacgccgccgccgccatcgcgcgcgactcggccgccgtcttcgcatggaagggggagacgctcgaggagtactggtggtgcacggagcgatgcctcgactggggcgtcggcggtgggcccgacctcatcgtcgacgacggcggtgacgccacgctgctcatccatgagggtgttaaggccgaggaggagttcgagaagtccggcaagatccccgacccggagtccaccgacaaccccgagttcaagatcgtgctcaccatcatccgtgatgggctcaagaccgacgccaggaagtaccgcaagatgaaggagaggctcgtcggtgtctctgaggagaccaccaccggcgtcaagaggctctaccagatgcaggaatccggcaccctcctcttccctgccatcaacgtcaacgactccgtcaccaagagcaagttcgacaatctgtatggttgccgccactctctccctgatggtcttatgagggctactgatgttatgattgctggcaaggttgccgtggtctgtggttatggtgatgttggcaagggctgtgcttctgcgctcaagcaggctggtgcccgtgtcattgttactgagattgatcccatctgtgcccttcaggccttgatggagggtctccagatcctcaccttggaggatgttgtctcagaggctgacatctttgtgaccaccactggaaacaaggacattatcatggttgaccacatgaggaagatgaagaacaatgccattgtctgcaacattggtcactttgacaatgagattgacatgaacggccttgagacttaccctggtgtcaagcgcatcaccatcaagcctcagacggaccgttgggtcttccctgagaccaactctggcatcattgttcttgctgagggtcggctgatgaaccttgggtgtgctactggccaccccagctttgtcatgtcctgctctttcactaaccaggtcattgctcagcttgagttgtggaaggagaggtccactggcaagtatgagaagaaggtgtatgttcttcccaagcacctcgatgagaaggtggcggcccttcacttgggcaagcttggtgccaagctgaccaagctcaccaagtcccaggctgactacatcagcatcccgattgagggtccctacaagcctgctcactaccggtactagtttgtccagcaaagactagcagctggcttcagccgtggcttcaacatgaactctgccatggcggcttatcaactatcatcctgctttctttctttatattacatgttgtctcttaggtggaggatttgttatgggttatgttttgagcccggtgagggatggagaggaacgatgcgtttgcttttgcccagaaataatggcattattattgatatacagt

SEQ ID NO: 6061 - DNA, 1142 bp, Cynodon dactylon
ccgcaagatgaaggagaggctcgtcggtgtctctgaggagaccaccactggagtcaagaggctctaccagatgcaggagtctggcaccctcctcttccccgccatcaacgtcaatgactccgtcaccaagagcaagtttgacaacctgtatggttgccgccactccctcccagatggtctcatgagggccaccgatgtcatgattgccggcaaggttgctgtcgtctgtggttatggtgatgtcggcaagggctgtgctgctgccctcaacaggctggtgcccgtgtcattgtgactgagatcgaccctatctgtgccctccaggcccttatggagggtctccaggttcttaccttggaggatgttgtctctgaggctgacatctttgtgaccaccactggcaacaaggacatcatcatggtcgaccacatgaggaagatgaagaacaatgccattgtttgcaacatcggtcactttgacaatgagatcgacatgtacggtcttgagacttaccctggtgtgaagcgcatcaccatcaagccccagactgaccgctgggtgttccccgagaccaacactggcatcattgtccttgctgagggtcgtctgatgaaccttggttgtgctaccggccacccaagctttgtcatgtcctgctcattcaccaaccaggtcattgcccagcttgagctgtggaaggagaagagcagtggcaagtatgagaagaaggtgtacgtgctccccaagcacctggatgagaaggttgctgctctccacttgggcaagctcggcgccaggctgaccaagctcaccaagtcccaggctgactacatcagcgttccagtcgagggcccatacaagcctgcccactaccggtactaggctgagcccatcacggctagcggcccgggcacacatttactgggcattatctacccattaaaaatacaactgggtctgcagggatgcacatcataatcttaaggtgggctcagttcattaatgagttgctttagggtgcaatggtatggcttgatcatcttgtaaaaaaaaaaaaaagagagaggatccttaagatgtggcggcacgagacagtggctttggccatcttattagtattcaaataaagcagtttcagtcga

SEQ ID NO: 6062 - DNA, 789 bp, Solanum melongena
tggtcactttgacaacgaaatcgacatgcatggtcttgagaccttccctggtgtgaagaggatcacaatcaagcctcaaaccgacagatgggtcttcccagacaccaacagtggcatcattgtcttggccgagggtcgtctcatgaacttgggatgtgccactggacaccccagttttgtgatgtcctgctctttcactaaccaagtcattgcccagctcgagttgtggaaggaaaagaacagtggcaaatacgagaagaaggtgtatgtcttgccaaagcacctcgacgagaaggttgctgctcttcatcttggaaagcttggagccaagcttaccaaactctccaaggagcaggctgactacattagcgtaccaattgagggtccttacaagcctgctcactacaggtactgagggaagagagactcacagtggaacaaccatatcgcggcatgattgttttgtttttaatactttgattttgtttaggtagtagtgtttttatcaatgtttgtggggggaagttggcatgttttgctgggaagaggatcaaaatgtgtttgaataatatttgagttatggttggggtggtgtgctatgatattgtactaagttagatccatttgccttttttttttctctctataaactctgcttcatggaaacaaagcaaacatgttttcccttttcagttcatcttttgctgcttcaaaattttatcatgttattgcccatctcttttggcaattataaacttcactacagtttcatagagtttaaataatagc

SEQ ID NO: 6063 - DNA, 856 bp, Solanum melongena
caggctaccatggaaggcctccaggttcttcctctcgaggatgttgtttctgaagttgatatctttgtgacgacaactggtaacaaggacatcatcatggttgaccacatgaggaagatgaagaacaatgccattgtctgcaacattggtcactttgacaacgaaatcgacatgcatggtcttgagaccttccctggtgtgaagaggatcacaatcaagcctcaaaccgacagatgggtcttcccagacaccaacagtggcatcattgtcttggccgagggtcgtctcatgaacttgggatgtgccactggacaccctagttttgtgatgtcctgctctttcactaaccaagtcattgcccagctcgagttgtggaaggaaaagaacagtggcaaatacgagaagaaggtgtacgtcttgccaaaacacctcgatgagaaggttgctgcccttcaccttggaaagctcggagccaagcttacgaaacttaccaaggagcaagccgactacatcagcgtaccagttgaaggtccttacaagcctgctcactacaggtactgagggaaagacagtttgacagcggaacaatactgtcgcggcatatgattattttactttgaatactttgagtttgtttaggataatagtgtttttgtttactgttggggatatgtttgggaggatgttggcatgtgttgctggagaaagtggtctcatttggaagaagaccaaaatgtttgttataagatttgagttattggtggtgttgtgcttaagatgctgttataataagctggttccatttgccttttggtgtataattttcgtttctagaattcaaagcaaacatgttttc

SEQ ID NO: 6064 - DNA, 1537 bp, Setaria italica
gtcttcgcgtggaagggggagacgctcgaggagtactggtggtgcaccgagcgatgcctcgactggggtgagggcggcggccccgacctcatcgtcgacgacggcggcgacgccacgctactcatccacgagggcgtcaaggcggaggaggagtacgagaagaccggcaaggtccccgacccggagtccaccgacaacgccgagttcaagatcgtgctcaccatcatccgcgacggcctcaagtccgaccccaagaggtaccgcaagatgaaggagaggctcgtcggcgtctccgaggagaccaccaccggagtcaagaggctctaccagatgcaggagaccggcaccctcctcttccccgccatcaacgtcaacgactccgtcaccaagagcaagttcgacaacctctacggttgccgccactccctccctgatggtttgatgagggccaccgatgttatgatcgctggcaaggtcgcagtggtctgcggttatggtgatgttggcaagggctgtgctgctgccctcaagcaggctggtgcccgtgtcatcgtgactgagatcgaccccatctgtgcccttcaggccttgatggagggtcttcaggtccttaccttggaggatgtcgtctctgaagctgacatctttgtgaccaccaccggcaacaaggacatcatcatggttgaccacatgaggaagatgaagaacaacgccattgtctgcaacattggtcactttgacaatgagatcgacatgcacggtcttgagacctaccctggtgtcaagcgcatcaccatcaagccccagacagaccgctgggtgttccctgagaccaacactggcatcattgtcctcgctgagggtcgtctgatgaaccttgggtgcgctactggccaccccagctttgtcatgtcctgctcattcactaaccaggtcattgctcagcttgaactgtggaaggagaagagctctggcaagtatgagaagaaggtgtatgtgcttccgaagcaccttgatgagaaggttgccgctctccatttgggcaagcttggtgccaagctcaccaagctctcgaagtctcagtctgactacatcagcgtcccaatcgagggtccctacaagcccgctcactaccggtactaggctgcccagcatggcaggaagctcattcggccagccggttgtgtggtgtgcccgtacgaagacgctgatgtgccgttgcttaggaggaattattatggtcatcgcttgagcctggttgagtagtggggagaggagggaagagatgtttgcttttgcggaagaataatggcgtaattggtcgttggttgaggtggcgcgcgttgccagaaacagtttctgattatcaattgcaagcgatttgctctggttatgtgtttttcatgaataacttgctttcttcgaagcatattttagttggatcctgagttttgcttacgtttgttttgtagagttgtgtccagcaatttcgttgggccttctcagctcagtgtcttttgtgtctccttatgccgtt

SEQ ID NO: 6065 - DNA, 674 bp, Lolium multiflorum
gacatcatcatggtcgaccacatgaggaagatgaagaacaatgccattgtctgcaacattggccacttcgacaacgagattgacatgaacggccttgagacctaccccggcgtcaagcgcatcaccatcaagccccaaaccgaccgctgggtgttccctgagaccaagactggcatcattgtcctcgccgagggtcgcctgatgaaccttgggtgcgccactggccaccccagctttgtcatgtcctgctcgttcactaaccaggttattgcccagcttgagctgtggaacgagaggaagtctggcaagtacgagaagaaggtgtacgttctccccaagcacctcgacgagaaggtcgcggccctccacctgggcaagcttggtgccaagctgaccaagctcaccaagtcccagtctgactacatcagcatcccggtcgagggtccttacaagcccgctgcctacaggtactagagagggtgtccagtacagacttgtggctggccactgtgaaccctgctgcatcgaattatcaactatcctattttttttgcattatcttacattctgtcttaggcggaggatttgttacgttttgtgccctgtgagggttgtaagaggaggcgtttgtttttgctgagaataatggcattattaatggtggtttaagtgca

SEQ ID NO: 6066 - DNA, 955 bp, Eragrostis curvula
  misc_feature (850)..(850): n is a, c, g, or t
  misc_feature (927)..(929): n is a, c, g, or t
  misc_feature (934)..(934): n is a, c, g, or t
  misc_feature (936)..(936): n is a, c, g, or t
  misc_feature (947)..(947): n is a, c, g, or t
tttggccaccccgtttatgcaggcacccttcctctttccccgccatcaacgtcaacgactccgtcaccaagagcaagtttgacaacctttacggttgccgccactccctccctgatggtctgatgagggccaccgatgttatgattgccggcaaggttgccgttgtctgcggttatggtggtgttggcaagggctgtgctgctgccctcaagcaggctggtgcccgtgtcatcgtgactgagatcggccccatctgtgcccttcaggccctgatggagggtctccaggttcttaccttggaggatgttgtctctgaggctgacatctttgtgaccaccaccggcaacaaggacatcatcatggttgaccacatgaggaagatgaagaacaacgccattgtttgcaacattggtcactttgacaatgagattgacatgctcggtcttgaaacctaccctggtgtcaagcgcatcaccatcaagccccagactgaccgctgggtgttccctgagaccaacactggcatcattgtccttgctgagggtcgtctgatgaacctgggttgtgctactggccaccccagctttgtcatgtcctgctcattcaccaaccaggtcattgctcagcttgagctgtggaaggagaagagcagtggcaagtacgagaagaaggtgtacgtcctccccaagcacctggatgagaaggttgctgctctccacttgggcaagcttggtgccaggctgaccaagctcagcaagtcccaggctgactacatcagcgtcccgatcgagggcccatacaagcccgctcactaccggtactaggctgcccagcatgacttgcggctggnccaatcagttgtgccgtggaggctgctgctgtgcgggctcatcatctatcttttgcattgtcatcctatacgttatnnnttaanangaggatttgtnatggatgt

SEQ ID NO: 6067 - DNA, 1880 bp, Tropaeolum majus
gttcgctccactttcttcgatctcagaaccctaatattactccaatccctcagttccatttctgagagattgttatattggattctttaattttctttaacatttcttagcaatggctttgattgtagagaaaaccaccagtggccgtgagtacaaggtgaaggacatgtctcaggctgacttcggtcgcctcgagatcgagcttgctgaggttgagatgcccggactcatttcttgcagaactgaattcggtccatcacagccttttaaaggtgctagaattccacatgaccatccaaaccgctgttctgatcgagactctgactgctcttggagctgaggttcgttggtgctcatgcaacatcttttccacccaggaccatgccgcggctgcaattgctagggattcggctgctgtgtttgcctggaagggggagactcttcaggagtactggtggtgcacagagcgcgcactcgactggggtccagatggtggtcccgatcttatcgttgacgatggtggtgatgctactctcttgatccacgagggtgtgaaggctgaggagatctatgagaaaaccggagtgcttcccgatccggcttccactgacaacgccgagttccaaatcgttttgactatcatcagggacggtcttaagactgactctaagaggtaccgcaagatgaaggacaggttggttggtgtgtccgaggagactaccactggagttaagaggctataccagatggaggctagcggcagtcttttgttccctgctatcaatgtcaacgactctgttaccaagagcaagtttgataacttgtacgggtgccgtcactctctccctgatggtttgatgagggcaactgatgtcatgattgccggaaaggttgctgttgttgctggatacggagatgttggcaagggatgtgctgctgccatgaagcaagcaggagctcgcgttatcgtatcagaaatcgatcccatttgtgctcttcaggcactcatggaaggtctccaagtcctccccctagaggatgttgtctcagaggcagacatctttgtcaccaccaccggtaacaaggacatcatcatggttgaccacatgaggaagatgaagaacaatgccattgtttgcaacattggtcatttcgataacgaaatcgacatgctcggattagaaactttccccggtgtgaagcgtatcaccatcaagccccaaaccgacaggtgggtcttccccgacaccaactctggcatcattgtgttggctgagggtcgtctcatgaacttgggttgtgccaccggtcatcctagtttcgtcatgtcctgctctttcacaaatcaagttatcgcccagctggagctctggaacgagaaagcttccggcaaatatgagaagaaagtgtacgtgttgcccaaacaccttgatgagaaggttgctgccctccatttgagcaagcttggagctaagctcactaagcttaccaaggaccaagctgattacattatggtaccagttgagggaccatacaagccagcacactacaggtactgagagatgcacaatatcattgtttacatttggatggatcggataatcttctttttttacaattggagtgatttgtagtagcgaaatgtagaacttttattgtttctaggagtttgtgggggtgtatggaaggaagtttggagggggaaatgtgttgtctcttggtctctcttcttgactgagacaccaaatgggtttgaataacgtgaaggctcgatcaatggctgtgtgtgaatgaagtaaaactgatgctgttagttttgctgcatttaatcatctgtttttctaatgaaatatgtaaaacaccgaaaagagaaaaaaaaa

SEQ ID NO: 6068 - DNA, 1517 bp, Saccharum officinarum
tgctcctgcaacatcttctccacgcaggaccacgccgccgccgccatcgctcgcgactcggccgccgtgttcgcctggaagggggagaccctcgaggagtactggtggtgcaccgagcgctgcctcgactggggcgagggcggcggccccgacctcatcgtcgacgacggaggcgacgccacgctgctcatccacgagggtgtcaaggccgaggaggagtacgagaagaccggtaagatccccgacccggagtcaaccgacaacgctgagttcaagatcgtgctcaccatcatccgcgacgggctcaaggctgaccccaagaagtaccgcaagatgaaggagaggcttgtcggcgtctctgaggagaccaccaccggagtcaagaggctctaccagatgcaggagaccggcgccctcctcttccctgccattaacgtcaacgactccgtcaccaagagcaagtttgacaacctgtatggctgccgccactccctccctgatggtctgatgagggccacagatgttatgattgctggcaaggttgccgtggtctgtggatatggtgatgtcggcaagggctgtgctgctgcgcttaagcaggctggtgcccgtgtcattgtgactgagatcgaccccatctgtgccctccaggctctgatggagggtcttcaggtccttaccttggaggatgttgtctctgaggctgacatcttcgtgaccaccaccggcaacaaggatatcatcatggttgaccacatgaggaagatgaagaacaatgccattgtctgcaacattggccactttgacaatgaaattgatatgctcggtcttgagacctaccctggtgtcaagcgcatcaccatcaagccccagactgaccgctgggtgttccctgagacaaacactggcatcattgtccttgctgagggtcgcctaatgaaccttggatgcgctactggccatcctagttttgtcatgtcttgctcattcactaaccaggtcattgcccagcttgagctgtggaaggagaagagctctggcaagtatgagaagaaggtgtatgtgctccccaagcaccttgatgagaaggttgctgctctccacttgggcaagcttggtgccaagctgacgaagctcaccaagtcccaggctgactacatcagtgtgccgatcgagggtccctacaagcctgcccactaccggtactaggcagcgcagcacgacttgcagctcactccgccggttgtgtgctatgaagtttgctacaccggcctgtcagttatcttttgcatgcatatgcattgtcatatatgcagctgcgcaggaggatttgttatgattatcgcttgagctgaggggggaagcgaggagctgtttgctttggctgatgaataatggtgttattggctgggatgaggcgatgcgcgttgccagatacagttttgtcttgttgactctacttatctgattatcatttgtaagcgatttgctcaagttatgtgtcatttatgaataac

SEQ ID NO: 6069 - DNA, 1009 bp, Triticum aestivum
ctttacggttgccgtcactcgctccctgatggtcttatgagggccactaatgttatgatcgccggcaaggttgccgttgtctgcggttatggtgatgtgggaaagggctgtgcggccgcactcaagcaggctggtgcccattttatcattacagaaattgaccccatctgtacacatcagggcctgatggagggcatccagatcctcaccttggaggatgttgtctctgaagctgatatctttgtaaccaccaccggaaacaaggacatcatcatggttgaccacatgaggaagatgaagaacaacgccattgtctgcaacatcggtcactttgacaacgaaattgacatgaacgggcttgagacctaacctggtgtcaagcgcatcaacatcaagccccagactgaccgctgggtcttcccgaagaccaagaccggcatcattgttcttgctgagggtcgtctgatgaaccttggatgtgccactggccaccccaactttgtcatgtcctgctcattcactaaccaggttattgctcagcttgagttgtggaacgagaaggccaccggcaagtacgagaagaaggtgtacgttctccccaagcacctcgacgagaaggtcgcggccctccacttgggcaagctcggcgccaggctgaccaagctcaccaagtcccagtctgactacattagcatcccagttgagggtccgtacaagcctgcggcctaccggtactagtgtgtccagcacggctagcggctggcctgagcctgagtcggagcagcggcaccaacgggaactctatcaactatcctgtttcccttctattatcttacatgctgtctcttaggcggaggatttgttattatggttatgttttgagccttgtgagggttgggagaggcggcgtttgcttttgcccagaaataatggcattattattggtttaagtgaggtggtgtgcttttccagatacagttttgtctcgtttgttctaccatgtctgaaa

SEQ ID NO: 6070 - DNA, 435 bp, Cirsium arvense
tgccatcgtctgcaacatcggtcacttcgacaacgaaatcgacatgcttggacttgaaacctaccccggtgttcaaagaatcaccatcaaaccccaaaccgacaggtgggtcttccccgaaaccaagactggcatcattgtttttggccgagggtcgtctcatgaacttgggttgtgccactggtcaccctagtttcgtgatgtcgtgctcgttcaccaaccaagtgattgctcaactcgaactgtggaacgagaagagcaccgggaagtacaagaaggaggtgtacgtgttgccaaagcatcttgacgagaaggttgccgctcttcatcttggaaagcttggagctaagttgaccaagttgaccaaggaccaggctgactacatcagcgtaccagttgagggtccatacaagcctgctcactacaggtactgag

SEQ ID NO: 6071 - DNA, 883 bp, Cucurbita pepo
aacttgtatggatgccgacactctctccctgatggtttgatgagagctaccgatgtcatgattgccggtaaggttgctgttgtgtgcggttatggagatgttggaaagggttgtgcttctgctctcaagcaagctggagcccgtgtgatcgtgaccgagatcgatccaatttgtgccctccaggctctcatggaaggacttcccgtcctcacattggaagatgtcctctctgaggctgatatcttcgtcaccaccaccggtaacaaggatatcatcatggtcgaccacatgaggaaaatgaagaacaatgccatcgtctgcaacatcggtcactttgacaacgagatcgacatgctcggtcttgagagctaccctggtgtgaagcgtatcaccatcaagcctcaaaccgacaggtgggtcttccccgaaaccaactccggcatcatcgtgttggccgagggtagactcatgaacttgggttgtgccactggacaccctagcttcgttatgtcctgctcatttacaaaccaagtcattgcacagctcgagctctggaacgagaggacatccgggaagtacgagaagaaggtttacgtgttgccgaagcacctcgacgagaaggtggccgcacttcacctgggtaaactaggtgctaggctgaccaagctcagcaaggaccaagctgactacatcaacgtgccagttgagggtccatacaagcctgctcactacaggtactgagaggagaatgctggttttacaagtaggggtttattgaattgtgtttggggttagtggtgtgaaggggaaagggtctgtgtgttgaagagagacccattgtatggggctgaataaggatagatttggctgtgtgaaaaatatc

SEQ ID NO: 6072 - DNA, 644 bp, Euphorbia peplus
ggctgtgctgctgctttgaagcaagctggatctcgcgtgattgtgaccgagattgatcccatttgtgcccttcaggctcttatggaaggtttccaagttttgacccttgaagatgttgtctctgaggctgacatctttgttaccaccactggtaacaaggatatcatcatggttaaccacatgaggaagatgaagaacaatgccattgtttgcaacattggtcacttcgacaatgaaattgacatgcatggtcttgagaccttccctggcgtgaagcgcatcaccatcaagccacaaaccgacaggtgggtgttcccagacaccaactcaggcatcattgtgttggctgagggacgtctcatgaatttgggttgtgccaccggtcaccccagctttgtgatgtcctgctctttcaccaaccaggtgattgcacagctcgagttgtggaaggagaaggcaagtggcaaatacgagaagaaggtctatgttttgccaaagcaccttgatgagaaggttgcggctcttcaccttggaaagcttggagccaagctcaccaagctctccaaggagcaggctgactacatcagtgttccagtcgagggtccttataagcctgctcattataggtactgaagcaggagaaa

SEQ ID NO: 6073 - DNA, 650 bp, Platanus occidentalis
acaaggacatcatcatggtcgatcacatgaggaagatgaagaacaatgcaatcgtctgcaacatcgggcacttcgacaatgagatcgatatgctgggattagagactttccccggcgtgatgcggatcacaatcaagccccaaacggacaggtgggtcttccctgataccaagtccggcgtcattgtcttggccgaggggcggcttatgaacctgggatgcgccactggccaccccagctttgtgatgtcgtgctctttcacgaaccaggtgattgctcagcttgagctgtggaaggagaagagcaccggcaagtatgagaagaaggtgtatgtgcttcccaagcaccttgatgagaaggtagctgcacttcatcttggaaagctaggggctaagcttaccaagcttacggctgatcaggctgactacattagcgtccctgtggagggtccatacaagcctgctcagtataggtactgattgatcattgatgagagaggggaatactcaaatagccatgaataattcttttctattggtagtttgtagttttgatatttacagtgatgggtgttgagaaggagaagagggggaattggtctctgttggaatgtaaacagggaagaccatgggttttgaataagattgaaa

SEQ ID NO: 6074 - DNA, 682 bp, Scabiosa columbaria
agagctactgatgtcatgattgccggaaaggttgctgttgtctgtggatatggagatgtaggcaagggttgtgcctcagcaatgaagcaagctggagcccgtgttatagtaacagagatcgatcccatctgtgccctccaagccctaatggaaggatttcaagtgctaaccctagaagatgctgtttctgaggctgacatttttgtgactaccactggcaacaaggacatcatcatggttaatcacatgaggaagatgaagaacaatgctattgtttgtaacattggacattttgataatgagatcgacatgatgggtcttgagacctatccaggtgtgaagaggatcactatcaagccacaaactgacaggtgggttttccctgatactaagaccgggatcttggttcttgctgagggtaggttgatgaaccttgggtgtgccactggtcaccctagctttgtgatgtcgtgctcgtttacaaaccaagtgattgctcagctcgagctttggaatgagagaacttctggaaagtatgagaagaaggtttatgtcttgcctaagcatcttgatgagaaggttgctgcccttcatctcggaaagcttggggccaagctcaccaagctcactaaggatcaatccgactatatcagtataccaattgagggcccatacaagcctg

SEQ ID NO: 6075 - DNA, 759 bp, Thalictrum flavum
aattgatcccatatgtgctcttcaagctctaatggaaggtttccaagttttgcctcttgaggatgttgtttcggatgcagatatctttgttaccaccacaggtaacaaggacattatcatggttgatcacatgaggaagatgaagaacaatgccattgtttgcaacattggtcactttgacaatgaaattgatatgcaaggattggaaactttccccggtgtgaagaggattactattaagcctcagacagataggtgggtgttcccagataccaagtctggtgtcattattttggctgaaggcaggctcatgaacttgggatgtgcaactggtcatcctagctttgtcatgtcttgctcattcactaaccaggtgattgctcagcttgagctatggaatgagagaaacagcggaaagtacgagaagaaggtttatgttttgcccaaacatcttgatgagaaggttgctcagcttcatcttggaaagcttggagctaagctcaccaagcttacacctgaccaatctgaatacattagcatccctgtggagggtccatacaagcctgctcactacaggtattgagaggtttgagatcgactgattgcaggagtggagggattttgttaggctagtaattttgtattacagtggtggtggggagagggagggttttgggtctatgctggaattctagcagtgagactcttttgggttttgaataagtttgttgggttgtgtttgtatataacgttgtgtaa

SEQ ID NO: 6076 - DNA, 1364 bp, Amaranthus tuberculatus
ggtcctggtggtggtcccgacctcatcgtcgatgatggtggtgacgctaccttgttgatccatgagggagtcaaggctgaggaagaatttgagaagactggcaaggtgcccgaccctagctcaaccgacaatgttgagttccagcttgtcttgggtttgatccgtgacagcttgaaggttgaccctaagaggtaccacaagatgaaggagagattggttggtgtctccgaggagaccactaccggtgttaagaggctttaccaaatgcaggctaatggcactttgctcttccctgctatcaatgttaacgactctgtcaccaagagcaagtttgacaacttgtatggatgccgccactccctcccagatggtttgatgagagccactgatgtcatgattgccggaaaggttggtgttgtgtgtggatacggagatgttggtaagggttgtgctcttgcattgaaggctgctggagctcgtgtgattgtgactgagattgatccaatctgtgctctccaagctcttatggaaggtttccaggtcttgaccttggaagatgttgtctctgaggctgatatctttgtcaccaccaccggtaacaaggacatcatcatggtcgaccacatgaagaagatgaagaacaacgccattgtttgcaacatcggtcactttgacaatgaaatcgacatggcaggtcttgaaaactacccaggaatcaagagggttactatcaagccccaaactgaccgatttgtcttccccgagaccaagaccggaatcattgtgttggctgagggtcgtctcatgaacctgggatgtgcaactggtcaccctagctttgtcatgtcttgctcattcaccaaccaagtcattgctcagcttgagttgtggaatgagaaagcatccggcaaatatgagaagaaggtgtacgtgttgcccaagcaccttgacgagaaggttgctgctcttcaccttggcaagctcggtgccaagctcaccaagctctctaaggaccaagctgactacatcagtgtcccagtcgaaggtccatacaagccagctcactacaggtattagagcaggaacatgaagattgtggcctgtcggacatttcgagaggaaagcggacaatgttccttgcatcataattttcccttaggatcttagtttatgtttttcattccttgttgggcgagttggacggacaaacatcaaagtgggttttgaattacatgtctgaataaggcgatgtttaatgtttagatttaatgtttgtagtcgctcagccggacttgttgctggtatctagcattatggctagtctggttataatttttctgtcaatgaataggaatgagtgttgt

SEQ ID NO: 6077 - DNA, 1219 bp, Ocimum basilicum
tcacgagggtgtgaaggcagaggaggagtacgagaagtcggggacgttgccggatccaagctccaccgataatgcggagtttcagatagtgctgactttgatcagagatgggttgaaggcagatccgagcaagtacaggaagatgaaggagagattggttggtgtttctgaggagactactactggtgtgaagaggttgtatcagatgcaggctaatggcactctgcttttccctgcaatcaatgtcaatgattctgtcaccaagagcaagtttgataacttgtacggctgccgccactcacttcccgatggacttatgagggccaccgatgtgatgattgccggaaaggtcggagttgtgtgtggttatggagatgtcgggaagggctgcgctgttgcactaaaacaagcaggtgctcgtgtgatcgtgactgagatcgatcccatctgcgctcttcaggccctcatggaaggcttccaagttctaacccttgaggacgttcttgctgatgctgacatcttcgtcaccaccaccggcaacaaggacatcatcatggtggaccacatgaggaagatgaagaacaacgccatcgtctgcaacattggtcactttgacaatgagatcgacatgcagggcctcgagacctaccctggcgtgaagaggatcaccatcaagccgcagaccgatcggtgggttttcccagaaaccaacacaggaatcattgtgttggctgagggccgtttgatgaacttgggatgtgcaacggggcaccctagctttgtcatgtcgtgctccttcaccaaccaggtcatcgcccagcttgagctctggaaggagaggagcagtggcaagtatgagaagaaggtgtacgtgttgcctaagcatcttgatgagaaggtggctgctcttcaccttggaaagctcggggccaagctcactaagcttacgaaggatcaggctgactacattagcgtaccggttgagggtccttacaagcctcctcactacaggtactaagaggcaaaccaagtattattgattcttcccagagagagttgtttgtttgcagttataactgcattgagtttgtagttttgatgtttgggttttcgggattgtgtacttttgttggggaagaatgtatggctaaggcaagatctatgtgaaacggctagttagccttttgtttgagttttcatttactattaatggaagctt

SEQ ID NO: 6078 - DNA, 888 bp, Gossypium hirsutum
agctgattatcacaagatctaaacacctgtctcacatgctgcatgttgtcaagggaaagtgcaatttgaagtgcactcgcgaattcctcaaacttaagatatattgtgtatgcaatatccaaaactaacatgtcatctggtccattgcaacattggtcacttgacaatgaaatcgatatgcccggtcttgagacctatcctggtgttaaacgcatcaccattaagcctcaaaccgataggtgggtcttccctgaaaccaaaactggcatcattgtgttggctgaaggacgtctgatgaacttgggatgtgccactggacacccaagttttgtcatgtcctgctcgttcactaaccaggtgattgcccagctcgagctatggaaggagaaggcaactggaaaatatgagaagaaggtttacgtattgccaaagcacctcgacgagaaagttgctgcacttcacctcggcaagctcggagctaagctcactaagctcactaaagatcaagctgattacattagtgtgcctgttgaaggtccttacaagcctcctcattacaggtactgagggggacagttaatgagtttttatcgagaaagaaaaagcatccggatggtttgattgtttcttgtttactgaaatttcatgatggttaggtttttgttttatttttagagttctttttgtgtttgggtgatgggaagtgtctggggatgggaaaatgatgtgggatttggtctcttcttgtttgaagatgaccaaatggtttgaaataaaagtgttttgagggatgtgtggaagaatatatagtatttgccataatgcagtcttgttttgctgcattgctttttttaaagcaatttcattttatatacttcaataccaaca

SEQ ID NO: 6079 - DNA, 2099 bp, Gossypium hirsutum
ttttcatcattgtgctggacattggaaccctggaggtggagttttgccacagtcgatgaggacctgaagaagctatggggattataatattgatattcaaaagtttggccttgatcgtagtacagagacaaatggcggcgtctaaatccaacagcccttgtagtacagggcagcaagtgtctttggcgctgctacctatgccgatgtgtactaagccacccaacacgtccacacatgcacctagcttgagagtgtctatggggcatgtttgttgtgccggaggtggtggtggaggacacggtgtttccggtgaaggtggcttcacgataggaggcgttggtggcttcacaataggtggtgatggtggtggtagaatcggcggtgttggtgggttcactattggtggactggggtggactggtggctttggaggcagtattggtggtgatatgaccggcggtattggatagtaaggtggcttgggtgtatatggcggaggcttcacaaccggcggtgttggtggattcactattggtggactggggtagactggtggctttggaggcagtgttggtggtgatatgactggcttgtagaaccgagttcggccctgcccaacctttcaaaggagccaaaattactggttctcttcacatgaccatccaaaccgccgttcttattgaaacccttaccgccctcggagctgaagtccgttggtgctcttgcaacattttctctacccaagaccacgctgccgctgccatcgctcgtgactccgccgctgttttcgcttggaaaggggagaccctccaggaatactggtggtgtactgagagagcccttgattggggtcctactggtggacctgatctgatcgtcgatgatggtggtgatgctactttgttgatccacgaaggtgttaaagctgaggaagtttatgagaaaactggtcaactcccagatccggcttcgactgataacgctgagtttcagattgttttaaccattatcagagatgggttgaaagcagatcccaagaagtatagaaggatgaaggagagattggtaggtgtttctgaagaaactacaactggagttaagaggctttatcagatgcaggccaacggtaccttgttgttccctgccattaatgtcaatgactctgttactaagagcaagttcgataacttgtatggatgccgtcactcacttcccgatggtttgatgagagctactgatgtgatgattgccggcaaggtcgccgttgtctgtggttatggtgatgttggaaagggttgtgctgctgccttgaagcaagccggtgctcgtgtcattgttactgagattgatcccatctgtgcccttcaggctcttatggaaggacttcaggttttgaccctagaagacgttgtctccgaggctgatatcttcgtcaccacaaccggtaacaaggacatcatcatggttgatcacatgaggaagatgaagaacaatgccattgtttgcaacattggtcactttgacaatgaaatcgatatgctcggtcttgagacctatcctggtgttaaacgcatcaccattaagcctcaaaccgataggtgggtcttccctgaaaccaaaactggcatcattgtgttggctgaaggacgtctgatgaacttgggatgtgccactggacacccaagttttgtcatgtcctgctcgttcactaaccaggtgattgcccagctcgagctatggaaggagaaggcaactggaaaatatgagaagaaggtttacgtattgccaaagcacctcgacgagaaagttgctgcacttcacctcggcaagctcggagctaagctcactaagctcactaaagatcaagctgattacattagtgtgacctgttgaaggtccttacaagcctcctcattacaggtactgagggggacagttaatgagtttttatcgagaaagaaaaagacatccggatggttgattgtttcttgttttactgaaatttcatgatggttaggttttttgtttttattttttagtagttctttttttgttgtttgggttgatggaaagtgtctgggatgggaaaatgatgtggg

SEQ ID NO: 6080 - DNA, 721 bp, Solanum melongena
ttaccacaaccggtaacaaggacatcgtcatggttgaccacatgaggaagatgaagaacaatgccattgtctgcaacattggccactttgacaatgaaatcgacatgcatggccttgagaccttccctggagtgaagagaatcacaatcaagccccaaactgacagatgggtcttccccgacaccaaaagtggcatcattgtcttagctgagggccgtctcatgaacttgggatgcgccactggacaccccagttttgtcatgtcatgttctttcactaaccaagtcattgctcagcttgagttgtggaaggagaagggaagtggcaagtatgagaagaaggtgtacgtcttgccaaagcacctcgatgagaaggttgctgcccttcatctcggacagctcggagccaagcttactaagctctccaaggaccaagctgattacattggtgtaccagttgagggtccttacaagcctgctcactacaggtactgaggaaagacacagcgcgaccaaacaaaatcgtatggcatgatgtcttctcttttaatactttgattctttttctgttggggaatgttttagaaatgaaatggtctcatttgaaagaagaccaaaaatgtgttgaaaaaaagttttagcatggatgtggtgtgatagtgatataatagctactagattccatttgggtttgatttatgattttgctcgaagatattgaa

SEQ ID NO: 6081 - DNA, 1348 bp, Eucalyptus grandis
  misc_feature (539)..(539): n is a, c, g, or t
cgaggagatcttcgccaagaccggcaagctccccgacccggcctccaccgacaacgccgagttccagctcgtgctcaccatcatcagggacggcctgaagaccgaccctcagaggtaccacaagatgaaggacaggctcgtcggcgtctcggaggagaccaccactggcgtgaagaggttgtaccagatgcaggccaacgggactctcttgttccctgccatcaacgtcaatgactctgtcaccaagagcaagtttgataacttgtatgggtgccgccactctctccccgacggtctgatgagggccaccgatgtcatgatcgctggtaaagttgctgtggtctgtggatacggagatgtgggcaagggctgcgctgctgccctcaagcaggctggtgctcgcgtcattgtgactgagatcgatcccatctgtgctctccaagctctcatggaaggcctccaggtcctacccctccaggatgttgtctctgaggctgacatctttgtcaccaccactggcaacaaggacatcatcatgntccacgacatgaagaagatgaagaacaatgccatcgtctgcaacatcggtcactttgataacgagattgacatgcacggcctggagaacttccccggtgtgaagcgcatcaccatcaagccccaaaccgacaggtgggtcttccctgacaccaagtcaggcatcattgtcttggcggagggacgcctcatgaacttgggttgcgccaccggccaccctagcttcgtcatgtcctgctccttcacgaaccaggtgattgcccagcttgagctgtggaaggagaagtcctctggcaagtataagaaggaggtctatgtcttgcccaagcacctggatgagaaggtggctgctcttcacctcggcaagctcggtgctaagctcaccaagctcagcaaggagcaagccgactacattagcgtccccgttgagggtccctacaagcctcctcactacaggtactaggcgggttcacatgaagattttacggacggcttccccatttctttctcaatttgatttctctcggtagaatggtgggatttttgttattcgggaagtatggttggatgtttttcggggcgaggaaggtgagctgataaatcgatgagactatgagagggtctatgaataaagtttgcaaggcctgtagaatagcatgttgttagtgctgcaattcaaccttgctgcacatgttttaccatatatctcgaagctgaaaggctgacttctttttcttttatattttctggggcgtctgtggacgagatgaaagaatatatgatccaatccgattgatcctgctttgtttcc

SEQ ID NO: 6082 - DNA, 1379 bp, Leymus cinereus x Leymus triticoides
ccgagcgctgcctcgactggggcgtcggcgggggccccgacctcatcgtcgacgacggtggtgacgccacgctgctcatccacgagggcgtcaaggccgaggaggagttcgagaagtccggcaaggtccccgacccggagtccaccgacaaccccgagttcaagatcgtcctcaccatcatccgcgacgggctcaagaccgacgccaacaagtaccgcaagatgaaggagaggctcgtcggtgtctccgaggagacaaccaccggcgtcaagaggctctaccagatgcaggagtccggcaccctcctcttccccgccatcaacgtcaacgactccgtcaccaagagcaagtttgacaacctctacggttgccgccactcgctccctgatggtcttatgagggccactgatgttatgatcgccggcaaggttgccgtggtctgcggttatggtgatgttggcaagggctgtgccgccgcactcaagcaggctggtgcccgtgtgatcgtgacagagattgatcccatctgtgcccttcaggccctgatggagggtatccagatcctcaccttggaggatgttgtctccgaggctgacatctttgtgaccaccactggtaacaaggacatcatcatggttgaccacatgaggaagatgaagaacaacgccattgtctgcaacattggtcactttgacaacgagattgacatgaacggccttgagacctaccctggtgtcaagcgcatcacaatcaagccccagactgaccgttgggtcttccctgagaccaacactggcatcattgttcttgctgagggtcgtctgatgaaccttggatgtgccactggccaccccagctttgtcatgtcctgctcattcactaaccaggttattgctcagcttgagttgtggaacgagaaggccactggcaagtacgagaagaaggtgtacgtcctccccaagcacctcgacgagaaggtcgccgccctccacttgggcaagcttggtgccaagctcaccaagctcaccaagtctcagtctgactacattagcatcccagttgagggtccttacaagcctgcggcttaccggtactagagtgtccagcacgactagcggctggcctgagcctgagcctgagcagcggcaccaacgggaactctgccacggcgacctatcaactatcctgtttcccttccattatcttacatgctgtctcttaggcggaagatttgttattatggttatgttttgagccttgtgagggttgggagaggcggcgtttgcttttgcccagaaataatggcattattattggtttaagtgaggtggtgttcttctccggatgcggttttgtctcgtttgttctaccatgtctga

SEQ ID NO: 6083 - DNA, 1487 bp, Pennisetum glaucum
ccatcatccgcgacgggctcaaggccgaccccaagaagtaccgcaagatgaaggacaggctcgtcggcgtctccgaggagaccaccaccggagtcaagaggctctaccagatgcaggagaccggcaccctcctcttccctgccatcaacgtcaatgactctgtcaccaagagcaagtttgacaacctgtatggttgccgccactccctccctgatggtttgatgagggccaccgatgttatgatcgccggcaaggttgcagtggtctgcggttatggtgatgtcggcaagggctgtgctgctgccctcaagcaggccggtgcccgtgtcatcgtgactgagattgaccccatctgtgcccttcaggccctgatggagggtcttcaggtccttaccttggaggatgtcgtctctgaagctgacatctttgtgaccaccaccggcaacaaggacatcatcatggttgaccacatgaggaagatgaagaacaacgccattgtctgcaacatcggtcactttgacaatgagatcgacatgcacggtcttgagacctaccctggtgttaagcgcatcaccatcaagccccagaccgaccgctgggtgttccctgagacaaacactggcatcattgtcctcgctgagggtcgtctgatgaaccttgggtgcgctactggccaccccagctttgtaatgtcctgctcattcactaaccaggtcatcgctcaacttgagctgtggaaggagaagagctctggcaagtatgagaagaaggtgtacgtgctccctaagcaccttgatgagaaggttgctgctctccatttgggcaagcttggtgccaagcttacaaagctctccaagtctcaggctgactacatcagcgtcccaattgagggtccctacaagcccgctcactaccggtactaggctgcccagcatgacaaggtcatttggccagccggttgtgtggtctgcccgtacgaagacgctcatgtgtcgtgcttaataggaattgagcctggttgagtaggggggagaggatgggaagagatgtttgcttttgctgaacaataaaggtgtgtaattggtcgtgggggcttgtcaggtggtgtgtgtcgccagaaacagtttctgattaccattttgcaagtgatgattttatctagttttgtgtttccatgaataacttgctttcttgaaagcatattttagtctgatcctgggttttggttacgcctggtttgtactttgtagtgttgtgcccagcaacttcgttgggccttcgcttcgcagttcagtatcttttgtgtctccttatgctgctctggaaatgcatcgatttacgtcagttttgctagagttttctaatggtgtatgtgctgctctggttcagtgtcgccttggaatgcttcagcttgcctgaacatgaatgtttcgtttccgggaaattctgtagctcagttgcaaagtatttcatggtttatagttctg

SEQ ID NO: 6084 - DNA, 1882 bp, Pennisetum glaucum
cccagatccaatccgcgagctctctccctcccgctgccctgccatggcgctctccgtggagaagacctcgtcggggcgggagtacaaggtgaaggacctgtcccaggccgacttcggccgcctcgagatcgagctggcggaggtcgagatgcccgggctcatgtcgtgccgcaccgagttcggcccgtccaagcccttcgccggcgccaggatctcgggctccctccacatgaccatccagaccgccgtcctcatcgagaccctcaccgcggtccgctggtgctcctgcaacatcttctccacgcaggaccacgccgccgccgccatcgcgcgggactcggccgccgtcttcgcctggaagggggagaccctctgcaccgagcgctgcctcgactggggcgagggcgggggccccgacctcatcgtcgacgacggaggcgacgccacgctcctcatccacgagggcgtcaaggccgaggaggagtacgagaagaacggcaccgtccccgacccggagtccaccgacaacgccgagttcaagatcgtgctcaccatcatccgcgacgggctcaaggcccaccccaacaagtaccgcaagatgaaggacaggctcgtcggcgtctccgaggagaccaccaccggagtcaagaggctctaccagatgcaggagaccggcaccctcctcttccccgccatcaacgtcaatgactctgtcaccaagagcaagtttgacaacctgtatggttgccgccatttgatgagggccaccgatgttatgatcgccggcaaggttgcagtggtctgcggttatggtgatgtcggcaagggctgtgctgctgccctcaagcaggctggtgcccgtgtcatcgtgactgagattgaccccatctgtgcccttcaggccctgatggagggtcttcaggtccttaccttggaggatgttgtctctgaagctgacatctttgtgaccaccaccggcaacaaggacatcatcatggttgaccacatgaggaagatgaagaacaacgccattgtctgcaacattggtcactttgacaatgagattgacatgcacggtcttgagacctacccaagcgcatcaccatcaagccccagaccgaccgctgggtgttccctgagacaaacactggcatcattgtcctcgctgagggtcgtctgatgaaccttgggtgcgctactggccaccccagctttgtaatgtcctgctcattcactaaccaggtcattgctcaacttgagctatggaaggagaagagctctggcaagtatgagaagaaggtgtacgtactccctaagcaccttgatgagaaggttgctgctctccatttgggcaagcttggtgccaagcttacaaagctctctaagtctcaggctgactacatcagcgtcccaattgagggtccctacaagcccgctcactaccggtactaggctacccaggctgcccagcatgacaaggtcatttggccagccggttgtgtggtctgcccgtacgaagacgctcatgtgtcgtgcttaataggaattgagcctggttgagtagggggggaagaggatgggaagagatgtttgcttttgctgaacaataatggtgtgtaattggtcgtgggggcttgtaaggtggtgtgtgtcgccagaaacagtttctgattaccattttgcaagtgattttatctagttttgtgtttccatgaataacttgctttcttgaaagcatattttagtctgatcctgggttttggttacgtctggcttgtactttgtagtgttgtgcccagcaatttcgttgggccttcgcttcgcagttcagtatcttttgtgtctccttgtgctgctctggaaatgcatcgatgtacgtcaa

SEQ ID NO: 6085 - DNA, 952 bp, Pennisetum glaucum
ccgccaccctcctcttccctgccatcaacgtcaatgactctgtcaccaagagcaagtttgacaacctgtatggttgccgccactccctccctgatggtttgatgagggccaccgatgttatgatcgccggcaaggttgcagtggtctgcggttatggtgatgtcggcaagggctgtgctgctgccctcaagcaggccggtgcccgtgtcatcgtgactgagattgaccccatctgtgcccttcaggccctgatggagggtcttcaggtccttaccttggaggatgtcgtctctgaagctgacatctttgtgaccaccaccggcaacaaggacatcatcatggttgaccacatgaggaagatgaagaacaacgccattgtctgcaacatcggtcactttgacaatgagatcgacatgcacggtcttgagacctaccctggtgttaagcgcatcaccatcaagccccagaccgaccgctgggtgttccctgagacaaacactggcatcattgtcctcgctgagggtcgtctgatgaaccttgggtgcgctactggccaccccagctttgtaatgtcctgctcattcactaaccaggtcattgctcaacttgagctatggaaggagaagagctctggcaagtatgagaagaaggtgtacgtactccctaagcaccttgatgagaaggttgctgctctccatttgggcaagcttggtgccaagcttacaaagctctctaagtctcaggctgactacatcagcgtcccaattgagggtccctacaagcccgctcactaccggtactaggctgcccagcatgacaaggtcatttggccagccggttgtgtggtctgcccgtacgaagacgctcatgtgtcgtgcttaatgagtagggggggaagaggatgggaagagatgtttgcttttgctgaacaataatggtgtgtaattggtcg

SEQ ID NO: 6086 - DNA, 1609 bp, Quercus alba
gacttcggcccttcacagcccttcaagggagccagaatcaccggctatctccacatgaccagccaaaccgcagtcctcatcaagaccctgacggccctcggcgccgaggtccgcaacatcttctcgacccaggaccacgccgccgccgccgtgttcgcctggaaaggggagaccctccaggagtactggtggtgcaccgagcgtgctctcgactggggtcccggtggtgggcccgatctcatagtcgacgacggtggtgacgccactctgctcatccacgagggcgttaaggccgaggagttgtttgagaagaatgggactattccggacccagcttccaccgacaatgccgagttccagattgttctgaccattatcagagatgggttgaagacagatcccaagaggtaccacaagatgaagcaaagattggttggtgtgtctgaagagacaaccactggagttaagaggctttaccagatgcaggccaatggtaccctcttgttccctgctattaacgttaacgactccgtcaccaagagcaagtttgataacttgtatggatgccgccactccctccccgatggtttgatgagggctactgatgtcatgattgccggaaaggttgctgttgttgctggatatggtgatgttggcaagggctgtgctgctgccttgaagcaagctggtgcccgtgtgattgtgactgagattgatccaatttgtgctcttcaggctcttatggaaggcctgcaagttctaacccttgaggatgttgtatctgaggctgatatctttgtgaccaccaccggtaacaaggacatcatcatggttgaccacatgaggaagatgaagaacaatgccattgtttgcaacattggtcactttgacaatgagattgacatgctcggacttgagaactatccaggtgtgaagcgcatcaccatcaaaccccaaacagacaggtgggtcttccctgatacaaactcaggcatcattgtgttggccgagggtcggctcatgaacttgggttgtgccacagggcacccaagtttcgtgatgtcttgctcattcacaaaccaggtgattgcacagcttgagctgtggaaggagaggactacagggaagtatgagaagaaggtctatgtcttgccaaagcaccttgatgagaaggttgctgcacttcacctaggtaaacttggggctaggctcaccaagctcagcaaggaccaggctgactacattagtgttcctgtggagggtccatacaagcctgctcactacaggtactgagaagagtcaagaaaacaaggcatatcgagaaaaccaagatatttgatatttggtccggcttgatggtttcttttacaaacttatgacttttattaggatgttaggttttgaagttttttttggtaggggcttttgtgtttggtggtggatgttatggaggaaagaaattggttggtctctgttgaaagaagaccaattggggtttcaataagggttggatggggctgtgtgggaaaatatattattgactaatgctgtttgagtttttgttgcatttgttattaaaacctaaaaaaaggactgctatttccttaaa

SEQ ID NO: 6087 - DNA, 882 bp, Avena sativa
ctgcgccgccgcgctcaagcaggccggtgcccgtgtcatcgtgacagagatcgaccccatctgcgccctgcaggccttgatggagggcatccagatcctcaccctggaggacgtcgtctctgatgccgacatctttgtgaccaccacaggaaacaaggacatcatcatggtggaccacatgaggaagatgaagaacaacgccattgtctgcaacatcggtcactttgacaacgagatcgacatgaacggccttgagacctaccctggtgtcaagcgcatcaccatcaagccccagaccgaccgctgggtcttccctgagaccaagactggcatcattgtcctcgctgagggtcgcctgatgaaccttgggtgcgccactggccaccccagcttcgtcatgtcctgctcgttcaccaaccaggtcattgctcagcttgagttgtggaacgagaggaagtctggcaagtacgagaagaaggtgtacgtccttcccaagcacctcgacgagaaggtcgcggcgctccacctgggcaagctcggcgccaagctgaccaagctcaccaagtcccagtctgagtacatcagcatccccgtcgagggtccttacaagcctgccgcctaccggtactagagaggatggtgtatgtccagcacggctagcggctgaaagattgagaaaggagcagcaacttgtctctgcggcatggatttgttgaaccactgtatcttctattttgcatcatcttgcatgaatgctgtgtctctcttaggtggaggatgatttgttatgttttgagtctgggatgggttggtggaggaagcgtttatttttgctgaggaataataatggcattgttgatggtctagttttgtggttggtaa

SEQ ID NO: 6088 - DNA, 1068 bp, Elaeis guineensis
tcaccaagagcaagttcgacaatctatatggatgccggcactctctccctgatggcttgatgagggccactgatgtgatgattgctggcaaggtcgccgtggtctgtggttatggtgatgtgggcaagggttgtgcttctgcgttgaacaggctggagcccgggtgatcatcacagagattgaccccatctgtgctctccaggccctgatggagggcatccctgttatcactttggaggatgtggtctctgaggctgacatatttgtgactacaactggtaacaaggatatcatcatggttgaccacatgaggaagatgaagaataatgcaattgtctgcaacataggccacttcgacaatgagattgacatgcatggtctggagaactacccaggcgtcaagcgcatcaccatcaagccccaaactgatcgctgggtattccctgacaccaactccggtatcattgtgcttgccgaggggcgtctgatgaaccttggttgtgccactggccaccccagctttgtcatgtcctgttccttcaccaaccaggtgattgctcagttggaactgtggaaggaaagggcaagcggcaagtatgagaagaaggtgtatgtgctgcccaagcatctggatgagaaggtggcagccctccacctgggcaagctgggagccaagctaaccaagctcacaccatcccaggccgagtacatcagcattccaattgagggtccctacaagcctgctcactacaggtactaggaagtatgtgacagatgacaggcagcaacaacagctgcaaaccacaattcatcaagatgatttgagggattgcgagggcttttttcttcattattgttattgttatctcccatctccttcctgggttattagttaggattctaatttggttgcgtttgaattcaatggttaggaatgccgaagtcatgttttgataggaataatgaggttgtgagtggtggtgtaatggccagatatatttttatcgttggccgtctttcttaatcacaatttgcaggaagcattgctgcgtcttccttttatccatc

SEQ ID NO: 6089 - DNA, 878 bp, Secale cereale
  misc_feature (638)..(638): n is a, c, g, or t
  misc_feature (649)..(649): n is a, c, g, or t
  misc_feature (665)..(665): n is a, c, g, or t
  misc_feature (667)..(667): n is a, c, g, or t
  misc_feature (676)..(676): n is a, c, g, or t
  misc_feature (690)..(690): n is a, c, g, or t
  misc_feature (713)..(714): n is a, c, g, or t
  misc_feature (716)..(717): n is a, c, g, or t
  misc_feature (732)..(732): n is a, c, g, or t
  misc_feature (742)..(742): n is a, c, g, or t
  misc_feature (745)..(745): n is a, c, g, or t
  misc_feature (748)..(748): n is a, c, g, or t
  misc_feature (753)..(753): n is a, c, g, or t
  misc_feature (756)..(756): n is a, c, g, or t
  misc_feature (758)..(758): n is a, c, g, or t
  misc_feature (761)..(762): n is a, c, g, or t
  misc_feature (769)..(769): n is a, c, g, or t
  misc_feature (777)..(777): n is a, c, g, or t
  misc_feature (785)..(785): n is a, c, g, or t
  misc_feature (789)..(789): n is a, c, g, or t
  misc_feature (803)..(803): n is a, c, g, or t
  misc_feature (818)..(818): n is a, c, g, or t
  misc_feature (828)..(828): n is a, c, g, or t
  misc_feature (841)..(841): n is a, c, g, or t
  misc_feature (844)..(845): n is a, c, g, or t
  misc_feature (847)..(848): n is a, c, g, or t
  misc_feature (857)..(857): n is a, c, g, or t
  misc_feature (866)..(866): n is a, c, g, or t
ttatgagggccactgatgttatgatcgccggcaaggttgctgtggtctgcggttatggtgatgttggcaagggctgtgctgccgcactcaagcaggctgtgcccgcgtgatcgtgacagagattgaccccatctgtgctcttcaggccctgatggagggcattcagatcctcaccttggaggatgttgtctcttatgccgacatcttcgtgaccaccacaggaaacaaggacatcatcatggttgaccacatgaggaagatgaagaacaatgccattgtctgcaacattggtcactttgacaacgagatcgacatgaacggcctcgagacctaccctggtgtcaagcgcatcaccatcaagccccagactgaccgctgggtcttccccgagaccaagactggcatcattgttcttgctgagggccgtctgatgaaccttggctgtgccactggccaccccagttttgtcatgtcctgctcattcactaaccaggtcatcgctcagcttgagttgtggaaggagaaggccagcggcaagtacgagaagaaggtgtatgtgctccccaagcaccttgacgagaaggtggcggccctccacctgggcaagctcggtgccaggctgaccaagctcaccaagncccagtctgantacattagcatcccantngagggtccntacaacctgcggcntaccggtactagtgtgtccagcnngnntagcggctggcctgngcctgagccngancantggcnccnanggnnacctatnaactatcntgtttccnttcnattatcttacatgntgtctcttaggcggnggattttttnatggttatgtttnganncnngtgagggtngggagaggnggcgtttgcttt

SEQ ID NO: 6090 - DNA, 1265 bp, Panicum virgatum
gcaagtttgacaacctgtacggttgccgccactccctccctgatggtttgatgagggccactgatgttatgattgccggcaaggttgcagtggtctgcggttatggtgatgttggcaagggctgtgctgctgccctcaagcaggctggtgcccgtgtcatcgtgactgagatcgaccccatctgtgcccttcaggccctgatggagggtcttcaggtccttgccttggaggatgtcatttctgaagctgacatctttgtgaccaccactggtaacaaggacatcatcatggttgaccacatgaggaagatgaagaacaacgcaattgtctgcaacattggtcactttgacaatgagatcgacatgcacggtcttgagacctaccctggtgtcaagcggatcaccatcaagccccagactgatcgctgggtgttccctgagaccaacactggcatcattgtcctcgctgagggtcgtctgatgaaccttgggtgcgctactggccaccccagctttgtcatgtcctgctcattcactaaccaggtcattgctcagcttgagctgtggaaggagcggagctctggcaagtatgagaagaaggtgtatgtgctccccaagcaccttgatgagaaggttgccgccctccacttgggcaagcttggtgccaagctcaccaagctcaccaagtctcaggctgactacatcagtgtcccgatcgagggtccctacaagcccgcgcactaccggtactaggttgcccaggacgactagaagctcactcggctggccggttatattgtgtgcccttacgaagttcactacaccggctggtcaattatcatatgcgctgttgcgctggaggatttgttatgatcattgcttgagcctggttgagtggggagaggagggaagagctgtttgcttttgcggaagaacaatggcctaattggttgtagggtgtggcagtgtgcgttgccagaactatacagtttctgattatcatttgcaagcgatttgctctagttatgtgtctttcatgaataacatgctttcttaaagagcacatttagtctgattctgagttttgtttatgtctggttgattgagttgtgcccagcaagcttgttgggccttctcagttgtcttctattgtttctctgtattttggttcatgcccgttttacgaattatgatagaatgtggatggatcatatgagaattgctggtgtttttgaatggagtatatgctgcagttcgttcagtgtc

SEQ ID NO: 6091 - DNA, 864 bp, Juglans hindsii x Juglans regia
  misc_feature (332)..(332): n is a, c, g, or t
  misc_feature (761)..(761): n is a, c, g, or t
  misc_feature (769)..(769): n is a, c, g, or t
catcatggtgagtgacatgaagaagatgaagaacaatgccattgtctgtaacattggccactttgacaatgagattgacatgcttgggctcgagaactacccgggcgtgaagcgcatcaccatcaagcctcaaacagacaggtgggtattccccgagaccaactcaggcatcattgttttggccgagggtcggctcatgaacttgggttgtgccacagggcaccctagttttgtgatgtcctgttccttcacaaaccaggtgattgcccagctggagttgtggaaggagaagacaagtggaaaatacgagaagaaggtatatgtgttgcctnagcaccttgatgagaaggttgctgcgcttcaccttggcaagcttggggccaagctcaccaaactcagcaaggaccaggctgattacattagcgtgcccattgagggaccttacaagcctgctcactacaggtattgagagattcaagaaagtgagaaaaatatataatatttggatatttgaacggctttgagtgtttgtggtaggatgctagagttgattttgggagggtttgtgtttgttggtggaatggtatgggaggaaattgacgggtctcctttgaatgaagaccaggttgggtttttgaatgaataaatatggatgggaccaagtgggaggtgtattgtaacggctgcactcttgagttttgctgcatttcttatcatttcattactataaatggggaaaaaagagctaccactatttccanggacaacngtcttgctttgtgactttctcgtatcatatttctccaaaatattattcaattttggtatgagaaatgttggtatataaaataactagttattttg

SEQ ID NO: 6092 - DNA, 787 bp, Thellungiella halophila
cgagactttccctggtgtgaaacgcatcaccattaagccgcagaccgacaggtgggtgttcccggacaccaagacaggcatcattgtgttagccgaaggtcgtctgatgaacttgggatgtgccactggacacccgagtttcgtgatgtcgtgctcgttcacaaaccaggtgattgcacagcttgagctatggaacgagaagtcgagcgggaagtatgagaagaaggtgtatgttttgcctaagcacttggacgagaaagtggctgcacttcacttgggcaagctcggtgctagactcaccaagcttaccaaggaccaatctgactatgtcagcatacccattgaaggtccctacaagcctgttcactacaggtactgagaagaagaagcaaagcagaaaaaaaagaggccaaagctttggttttatggttaaaggccgtttattggctatgctataatcctaatggcatttaattatttgagttggttcgggtctggtttggttgggaaaatttgaggtgattggtcttctgattaggttgatcaaatattggtatgaataaggggttgttgttcttggttttgagaggcttctttttgttttttttttttttgtttttgttttttttatttatatattatctcaagataaattagtttttgttttacactgtttgttaggcttatttatgcgatgttctgtttaccggtttacttttcagaacacaagtgagaaaacaagatacgtaaagttattttggcaatattagtggaaaatcttgtctcc

SEQ ID NO: 6093 - DNA, 688 bp, Nicotiana benthamiana
  misc_feature (15)..(15): n is a, c, g, or t
  misc_feature (191)..(191): n is a, c, g, or t
  misc_feature (200)..(200): n is a, c, g, or t
  misc_feature (651)..(651): n is a, c, g, or t
  misc_feature (660)..(662): n is a, c, g, or t
tcaagctccaaacgnacagatgggttttccccgacaccaacagcggtatcattgtcttggccgagggtcgtctcatgaacttgggatgtgccacgggacaccccagcttcgtgatgtcatgctcttttactaatcaagttattgcccagctcgagttgtggaaggagaatagccccggcaagtatgagaanaaggtgtangtcttgccaaagcacctcgacgagaaggttgctgcccttcatcttggaaagctcggagcaaggctcactaagctttccaaggatcaagctgactacattagtgtaccagttgaaggtccttacaagcctcctcattacaggtattaagcgaagacaaaaagagactgcaaaaacagcacattcttactgctttgattgttatgctttggattttgttaggacaatagtatcttgttcgtttgaactatcgttggggatattttgggatgtttggaatgttgtcgctggaaaagaattggtatatatatatatatatatatatatatatatatatatatatatatatatatatggatcgggtggcacgccgccatgggtatgtgtggtcatataatctgatgtgttgaataagtttttgaggaatggaggtggtgtgctattgatagtgtancagttaaannntttctgcttttggtttatccttctta

SEQ ID NO: 6094 - DNA, 1237 bp, Cirsium arvense
tcatgagggagttaaggctgaggaggagtttgagaagaccggtaaagttccagatccgacttccaccgataaccctgagttccagatcgtgttgtcgatcattaaggaagggctacaggttgaccctaagaagtaccacaagatgaaggataggttgttggtgtgtctgaggagactaccactggtgttaagaggctttaccagatgcaagccaatggtactctgcttttccctgccattaatgtcaatgactctgttaccaagagcaagtttgacaacttgtacgggtgccgtcactcactcccgatggtttgatgagagccaccgatgtcatgatcgccggaaaggttgcagtcgtctgcggttacggagatgtcggaaagggttgtgctgccgccatgaagcaagccggagctcgtgttatcgtcacagaaatcgaccccatctgtgcccttcaagccaccatggaaggtctccaagtcctacccttggaagacgtcgtttcagaagccgatatcttcgtcaccaccaccggtaacaaagacatcatcatggtcagcgacatgaagaagatgaagaacaacgccatcgtctgcaacattggtcatttcgacaacgagatcgacatgctcggactcgaaacctatccaggtgtgaagcgaatcaccatcaaaccacaaaccgacaggtgggtgttccctgaaaccaagaccggaatcatcatcttagccgaaggtcggctcatgaacttgggttgtgccactggccaccctagtttcgtgatgtcgtgctcgtttaccaaccaggtgatagctcagcttgagctatggaatgagaagagcagtgggaagtataagaaggaagtgtatgtgttgccaaagcatcttgatgagaaagtggctgcacttcatcttgagaagcttggagccaagctgaccaagctgaccaaggatcaagccgactacatcagtgtaccagttgagggaccatacaagccagctcattacaggtactaagctaagctaagccaagctgtgtgattttgagggggaatttgaagaggggttgggttatgtgatgattattgatacagtttgattattatgtgatgttagatttggtgaatttttatggggttgtgtgttgggtgggagagaaagtgaatggtgtttttctttgttgaaggctgccattgaataagggttgtgtgaaagggttgtgtaaacaccatctgtag

SEQ ID NO: 6095 - DNA, 694 bp, Linum usitatissimum
cgggaaacaaggacctgatcatggtgaaccacatgaggaagatgaagaacaatgcaatcgtgtgcaacatcggacactttgacaacgaaatcgacatgcacgggctggagaccttccccggggtgaagcgcatcaccatcaagccccagacagacaggtgggtgttcccggacaccaagactgggatcattgtgttggccgaggggcgtctgatgaatctgggatgtgcgacgggccacccgagctttgtgatgtcatgctcgttcacgaaccaggtgattgcgcagctggagctgtggaaggagaagacgagtgggaagtacgagaagaaggtgtatgttttgcctaagcatctcgacgagaaggttgctgctcttccccttaggaagcttggagctaggcttactaagctgtccaaggatcaagctgactatatcagcgtccctgttgagggtccgtacaagcctgctcactccaggtattgagggaacggacagccaaccaaagattaagaagaaggttgcatttcggaacagcaactgcatacaaataaaattgtaatcatctgtgggatacatttttacttcttactgttacttcgagtcaagagctctgatatgatataattttttaaagatttgtgatgaactagtttgttttttttatagatgcaatccaatgcatttgaaattca

SEQ ID NO: 6096 - DNA, 1056 bp, Fraxinus spp
gctatcaatgtcaatgactctgtcaccaagagcaagtttgataacttgtatggatgccgccactcacttcccgatgggctaatgagagcactgatgtgatgattgctgggaaggttgctgttgtatgcggttatggtgatgttggcaagggctgtgctgctgccttgaagcaagctggtgctcgtgtgattgtgactgagatcgatccaatctgtgctcttcaggccctcatggaaggactccaagttctaacactcgaggatgtagtctccgaggccgatatctttgtcaccacaactggtaacaaggacatcatcatggttgatcacatgaaaaagatgaagaacaatgccatcgtttgcaacattggtcacttcgacaatgaaatcgatatgcagggtctggagacctaccctggggttaagagaatcaccattaagcctcaaacagacagatgggttttcccagaaacaaactcaggcattattgtcttggcggagggccgtctaatgaacttgggttgtgccacaggacaccccagctttgtcatgtcatgctctttcactaatcaagtcattgcccaacttgagctgtggaaggaaaagagcaccgggaagtacaagaaggaggtctacgtcttgcccaagcaccttgatgagaaggttgccgctcttcaccttggtaagctaggtgctaagctcaccaagctttccaaggatcaagctgactatattagtgtaccaattgagggtccttacaagcctcttcactacaggtactaagggaaggcattgattataaaccagaatacttgaatttcgaggttgtttttcattaattgctcttattactgtactgggtttgtagttgtgagtttttgtttcggtggaagaaatggtctctcgggaataagttttgagtaagaggtttgtgtgagagactacaatggagttattgtgttcctttttcagttgttttttgcaagaaatgaaaatgcatatgtttgctgcatttcattagtaattttgaattatatgggaatggaagtttagacca

SEQ ID NO: 6097 - DNA, 1135 bp, Olea europaea
ttgactatcattagagatggactgaagtcagatccaaagaagtataccagaatgaaggagagacttgttggtgtttctgaagagaccaccactggtgtgaagaggctgtaccagatgcaggctaatggaacactgctcttccctgctatcaatgtcaatgattctgtcaccaagagcaagtttgataacttgtatggatgccgccactcgcttcccgatgggctaatgagagccactgatgtgatgattgctggaaaggttgctgttgtgtgcggttatggtgatgttggcaagggctgtgctgctgccttgaagcaagctggtgctcgtgtcattgtgactgagattgatccaatctgtgctcttcaggccctcatggaaggactccaagttctaacccttgaggacgtagtctctgaggctgatatctttgtcaccaccactggtaacaaggacatcatcatggttgatcacatgaaaaagatgaagaacaacgccatcgtttgcaacattggtcactttgacaatgaaatcgatatgcagggtctagagacctaccccggggttaagagagtcaccatcaagcctcaaacggacagatgggttttcccagaaacaaactcaggcattattgtcttggccgagggtcgtctaatgaacttgggttgtgccacaggacatcctagctttgtcatgtcatgctctttcactaatcaagttattgcccaactcgagctgtggaaggagaagagcaccgggaagtacaagaaggaggtttatgtcttgcccaagcaccttgacgagaaggttgccgcacttcaccttggaaaacttggtgctaagctcactaagctttccaaggatcaggctgactacattagtgtaccaattgagggtccttacaagcctccacattacaggtactgagggaagtcagagttataaaccaaccatatacatgaagaatgtggtcattgtttttcattattgtattaggttttgtagctgtgagttttttgttttggtggaagaaatggtctcttttgaagactaaggtgttggaaataagttttgcaattttactgtgagacgacaatgaagttgttgccatggaggaacttgttttcagttttcg

SEQ ID NO: 6098 - DNA, 940 bp, Thalictrum flavum
ttgatcccatttgtgctcttcaagctctaatggaaggtttccaagttttgcctcttgaggatgttgtttcggatgcagatatctttgttaccaccacaggtaacaaagacattattatggttgatcacatgaggaagatgaagaataatgccattgtttgcaacattggtcacttcgacaatgaaattgatatgcatggattggaaactttccccggtgtgaagaggattactattaagcctcagacagataggtgggtgttcccagataccaagtctggtgtcattattttggctgaaggcaggctcatgaacttgggatgtgcaaccggtcatcctagctttgtcatgtcttgctcattcactaaccaggtgattgcccagcttgagctatggaatgagagaaacagcggaaagtatgagaagaaggtttatgtgttgcccaaacatcttgatgagaaggttgctcagcttcatcttggaaagcttggagccaagctcaccaagcttacacctgaacagtctgaatacattagcatccctgtggagggtccatacaagcctgctcactacaggtattgagaggtttgagatctattgattgcaggagtggagggattttgttaggctagtaattttgttttacagtggtggtggggagagggaggggttttgggtctacgttggaattctagcagtaagactcttttgggttttgaataagtttgtgttgggttgtgttggaatataacattgtgatgaatgcagtggttaattggctgcatcattttaatattatgagtaagacttgccttttatttaccattttgctaaggttactgcccagtaacgcttactgcctttcactgttaaattaaattacacctactactccctccgtcccagtttgtttgtccactttgtaaaaatacaaagtttaa

SEQ ID NO: 6099 - DNA, 1175 bp, Citrullus lanatus
ctcttcctgatccttcttctactgataatgctgagtttcagatcgtgttgacgattatcagagatggattgaaatctgaccctaagaggtatcacaagatgaaggagagattggttggtgtttctgaagagactaccactggtgttaagaggctttaccagatgcagtctagtggaaccttgttgttccctgccattaatgtcaatgactctgtcactaagagcaagtttgacaacttgtatggatgccgtcactctctccctgatggtttgatgagagctactgatgtcatgattgccggtaaggtcgcggttgtgtgcggttatggagatgttggaaagggttgtgctgctgccctcaagcaagctggagctcgtgtgatcgtgactgagatcgatccaatttgtgcccttcaggctcttatggaaggccttcaagtcctcacccttgaagatgtcgtctcggaggctgatatcttcgtcaccaccaccggtaacaaggatatcatcatggttgatcacatgaggaagatgaagaacaatgccattgtttgcaacattggtcactttgacaatgagattgacatgcttggtcttgagaattaccccggtgtgaagcgtatcaccatcaagcctcaaacagacaggtgggtcttccctgaaaccaacactggcatcatcgtgttggcagaggggcgactcatgaacttaggttgtgccactggacaccctagctttgtgatgtcctgctcattcacaaaccaagtgattgcacagctcgagctatggaacgagaaggcatccgggaagtatgagaagaaggtctacgtgttgccaaagcaccttgacgagaaggtagccgcccttcaccttggcaaacttggggctaagctgacgaagctgagcaaggaccaagctgactacatcaatgtgccagttgagggtccatacaagcctgctcactacaggtactgagggggaagtgtggaggcttgattttcacaatttttgaagtgttttggggttggtggtttgaaggggaaaagggtctgtatgttgaagaaagacccattgtatgggatgaataaggaaggttagatttggctgtgtgtgaaaaacattactggtttttgtttgttgttttatttttttgctgaatctgtgtcatcgttttta

SEQ ID NO: 6100 - DNA, 998 bp, Fagus grandifolia
tactgatgtcatgattgcgaaggttgccgtgtcgctggatatggtgatgtgggaaagggttgtgctgctgccttgaaacaagctggagcccgtgtcatcgtgactgagattgatccaatttgtgctcttcaggcccttatggaaggcctccaagttctaacccttgaggatgctgtcgctgatgctgacatcttcgtcaccaccaccggtaacaaggacatcatcatggttgatcacatgaggaagatgaagaacaatgccattatttgcaacattggtcattttgacaatgagattgacatgcttggccttgagaactatcccggcattaagcgtatcaccatcaagccccaaacagacaggtgggtgttccccgatacaaactcaggcatcattgtgttggctgagggtcggctcatgaacttgggttgtgccacagggcaccctagtttcgtgatgtcttgctcattcaccaaccaggtgattgcacagctcgagctgtggaaggagagggcaaccggaaagtatgagaagaaggtctatgttttgcctaagcaccttgatgagaaggttgcagcacttcaccttcccaagcttggggctaggctcaccaagctttccaaggaccaggctgactacattagcgtgcctgtggagggtccttacaagcctgctcactacaggtactgagaagtgtcaaggaaacaagagatattgagaaactataatattttatatttggacccggcgtgatggtttatttttcaattttatgacttttattaggatggtaggttttgaattttttttaggggctgtgtttggtggtggaaagtagggatgaaagaaattgattggtctcttgaaagaagaccaattagggtttgttgaatgaataagggttggatggggctgtgtgggattattttattataacaactgaagtttgtagttttgttgtctttttgttatcatcaaattaaaaaaaaggaaaaaag

SEQ ID NO: 6101 - DNA, 1242 bp, Centaurea maculosa
  misc_feature (269)..(269): n is a, c, g, or t
  misc_feature (336)..(336): n is a, c, g, or t
  misc_feature (416)..(416): n is a, c, g, or t
  misc_feature (530)..(530): n is a, c, g, or t
  misc_feature (1025)..(1025): n is a, c, g, or t
  misc_feature (1084)..(1084): n is a, c, g, or t
  misc_feature (1091)..(1091): n is a, c, g, or t
  misc_feature (1104)..(1104): n is a, c, g, or t
  misc_feature (1111)..(1111): n is a, c, g, or t
  misc_feature (1121)..(1121): n is a, c, g, or t
  misc_feature (1123)..(1123): n is a, c, g, or t
  misc_feature (1127)..(1128): n is a, c, g, or t
  misc_feature (1132)..(1132): n is a, c, g, or t
  misc_feature (1145)..(1145): n is a, c, g, or t
  misc_feature (1148)..(1149): n is a, c, g, or t
  misc_feature (1153)..(1153): n is a, c, g, or t
acggagcgacgccacgctcctcatccacgagggagtcaaggccgaggaggagtttgagaagaccgggaaggtacccgacccgacctccaccgataaccccgagttccagatcgtgctttcgatcatcaaggaagggctttcggttgaccctaagaagtaccacagatgaggagaggttggttggtgtttctgaggagaccaccactggtgtgaagaggctttaccagatgcaggctaatggcactctgcttttccctgccattaatgtnaatgactctgtcaccaagagcaagttcgacaacttgtacggatgccgtcactcactccccgatggtntgatgagagccaccgatgtcatgatcgccggaaaggtcgccgtcgtctgcggttacggagatgtcggaaagggttgtgcngccgccatgaagcaagccggagcccgtgtgatcgtcaccgagatcgaccccatctgcgccctccaggccaccatggaaggcctccaggtcctccccttggaagacgtcgtctcngaggccgacatcttcgtcaccaccaccggtaacaaggacatcatcatggtcagcgacatgaagaagatgaagaacaacgccatcgtctgcaacatcggtcacttcgacaacgagatcgacatgctcggcctcgagacctacccgggcgtgaagaggatcaccatcaagccccagaccgaccgatgggtgttccccgagaccaagaccggcatcatcgtgttggccgagggtcgtttgatgaacttgggatgcgccacgggacaccccagcttcgtgatgtcgtgctcgttcaccaaccaggtgatcgcccagctcgagctctggaacgagaggaccagcggcaagtacaagaaggaggtgtatgtgttgccaaagcatctcgatgagaaggtggctgcacttcatcttggaaagctcggagccaagctgaccaagctgaccaaggatcaagccgactacatcagcgtgccggtcgaggggccatacaagccagcncactacaggtactgagctgtggttttggggcatttgagaggatttatgtgttgtttttnacagaanaatattgtagatngtggtgntgatgggttngnttgnncaanatgatgcttcttntgnngcangatagctgactgaaagtagtgtaacgcctcgtatgtccagctatcagttgcctgacattgctgatcagcatcagagtagaatttttctg

SEQ ID NO: 6102 - DNA, 885 bp, Cichorium intybus
taggccgggcaggaaggcctccagtcctaaccctagaagacgtcctctccgaggccgatatcttcgtcaccaccaccggaaacaaagacatcataatgctccaccacatgaagaagatgaaaaacaacgccatcgtctgcaacatcggccacttcgacaacgaaatcgacatgctcggcctcgaaacttatcaaggtatcaaacgaatcacaatcaaaccccaaactgaccgatgggtcttcccggaaaccaaatctgggatcatagttttagctgaaggtagactaatgaacttgggatgtgcaactgggcatccaagttttgttatgtcttgttcattcacaaaccaagtaatcgcacagcttgaattatggaatgaaaagggaactgggaaatacaagaaggaagtttatgttttgcctaaacatcttgatgagaaagtggcggcgcttcatcttggaaagcttggagctaagcttactaaacttagtaaggatcaagctgattatattagtgttcccattgatggtccgtacaagcctgctcattacaggtattgatgatttaaagggaaaatatgaagaagttgtgtgtttgagtttttatataaagatatgagtttggttgtgaagagagaaagttggtggaaaaagacgtctgaataaggaaaggttggggatggaggttgtgtgaaagtgtagctttgttggattatagattgttttttacactttacttgaatgagaatattaatacttcgcatttattaacaaacaattttttaataaagggggtttttttaccaaatttttttcttccccaaaaaaattttttttttttaaaaaaaccgccccccccgccccctttaattttttattctgaaaa

SEQ ID NO: 6103 - DNA, 1425 bp, Gossypium hirsutum
cttggtggtgttacatgtgccatccacaccagtgtaggggtagtccggtttcgctatcgatcccgccattgtttataacccactcgaaagcatagtccatgtatcctccttcacacccatagttgctggtatcacaatctacaagttcttgttctgaaaggctaattaggtctccagtaactaaggcattgattccttccatggctccggttgatgagaatgcccaacaagtatacaaggatgaaggagagattagttggtgtttctgaggaaactacaaccggtgttaagaggctttatcagatgcaggccaatggaaccttgttgttccctgctattaatgtcaatgactctgtcaccaagagcaagttcgataacttgtatggatgccgtcactctcttcccgatgggttgatgagagctaccgatgtcatgattgctggtaaggtcgctgttgtctgtggttatggtgatgtcggcaagggttgtgctgctgccttgaagcaagccggtgctcgcgtcattgtcaccgagatcgatcccatctgtgcccttcaggctctcatggaaggacttcaagttttgacccttgaggatgttgtctccgaggctgatatctttgtcaccaccactggtaacaaggacatcatcatggttaaccacatgaggaagatgaagaacaatgccattgtttgcaacatcggtcacttcgacaatgaaattgacatgctcggtctcgagaattatcctggtgtcaagcgcattaccatcaagcctcaaaccgataggtgggtcttccctgaaaccaacaccggcatcattgtgttggctgaaggacgtctcatgaacttgggttgtgctactggccaccctagctttgtcatgtcatgctctttcaccaaccaggtgatcgcccagctcgagctgtggaaggagaaggcaaccggcaagtacgagaagaaggtgtacgtttgcctaagcaccttgatgagaaggtggctgctcttcaccttggaaagcttggggctaacctcaccaagctcaccaaggatcaggctgactacattagcgtccccattgagggtccttacaagcctcctcactacaggtactgaggagagaatacgagagagagagagggagagagttggactagaaaaaggaaccatacaacgggatggtttgattgtttgttttactaaaatttattgatgatttgtggttagatggttagattttgattttgataggagtttgcgtgtgggatggatggtaagttttggtggaaaagaatgaggtctctgcttgaagaagaccaaatggggtctgaataaggtgatggggattgtgtgggagatgatatttcgccattggtgcagtccagttttgctgcatctggttttcaattaattaatcaaaaaaaag

SEQ ID NO: 6104 - DNA, 780 bp, Cyamopsis tetragonoloba
tttgttaccaccactggcaacaaggacatcatcatggttgaccacatgaggaagatgaagaacaatgccattgtctgcaacattggtcactttgacaatgaaatcgatatgcaaggtcttgagaactaccctggtgtcaagcgcatcaccatcaagcctcaaaccgacagatgggttttccccgagaccaactctggcatcattgtcttggccgagggtcgtttgatgaacttgggttgtgccaccggacaccccagtttcgtgatgtcttgctcattcaccaaccaggtcatcgctcagctcgagttgtggaaggagaagagtaccggcaagtatgagaagaaggtgtatgtcttgccgaagcaccttgatgagaaggtggctgcacttcaccttggaaaacttggagctaagctcaccaagcttagcaaatcacaggctgattacatcagtgttcctgttgagggtccatacaagcctgcacactacaggtactgagatgatcaaggaggtgatgaggatgaaattgagggaaaagaaaagaaagtgtttgatgaatcggctttgattgtttcgttttcctttttggatttttgttgttagaactttcagattggtaggttaattttagtagaatttctgttcaagtgggtgggactggggaagagcaaggtaacctattggtttctgtgatgagaccaaatgggtttgaataattctggttttgttttgaggctgtgtggtttctagctataatttgtgtttctatccaactatatc

SEQ ID NO: 6105 - DNA, 1100 bp, Taraxacum officinale
cggggaagagagatggtcggagtatcagaggaaaccaccaccggcgtcaagcggctctaccagatgcaagctaacggctccctactcttccccgccattaacgtcaatgattccgtcaccaagagcaagttcgataacttgtacggctgccgtcactcactccccgacggtctaatgagagccaccgacgtaatgatcgccggaaaggtcgcggtcgtctgcggttacggagacgtcggaaaaggttgcgcctccgccatgaaacaagccggcgctcgcgtcatcgtccagaaatcgatcccatctgcgcactccaagctctcatggaaggtctccaagtcctaaccctcgaagacgtactctccgaagccgacatcttcgtcaccaccaccggaaacaaagacataatcatggtcgaccacatgaagaagatgaaaacaacgccatcgtctgcaacatcggccacttcgacaacgaaatcgacatgctcggcctcgaaacatacccaggagtcaaaagaatcacgatcaaaccccaaactgacaggtgggtgttcccggagacaaaaactgggatcataatcctggcggaggggagattgatgaacttgggttgcgcgactgggcatcctagtttcgtaatgtcgtgttcgtttaccaatcaagtgattgcccagcttgaattgtggaaagagaagggaactgggaaatataagaaggaggtttatgttttgcctaagcatctcgatgagaaagtggcggcccttcatcttggaaagcttggagctaggcttactaaacttagtaaggatcagtctgattatattagtatccctgttgaaggtccgtacaagcctgttcattataggtattgattggattgaatcattgaagaagaagaagtgtggttggttttttatggttgttggtgggggcgaatgtggttggtggatgttggaaaagaccatgtatgggtctgaataaggaaggacaggggatgaggttgtgtaaaagtgtagttttgttgctttatactttttttttggttgcttacttgttttacactattacttaatgaaggtatcaatacgtttacttgct

SEQ ID NO: 6106 - DNA, 674 bp, Ipomoea nil
tcaccaccaccggcaacaaggacatcatcatggtaaaccacatgcgcaaaatgaaaaacaacgccatcgtctgcaacatcggccacttcgacaacgaaatcgacatgcaaggcctcgaatcctacccgggcgtgaagcgcatcaccatcaagccccagaccgacagattcgtcttccccgacacaaaaaccggcatcatcatcctcgccgaggggcggctcatgaacttaggatgcgccaccggacatcctagtttcgtgatgtcgtgttccttcacgaaccaggtgattgcccagctggagctctgcaaggagaagagctccgggaagtatgagaagaaggtttacatcttgcccaaacaccttgatgagaaagttgcggccttgcatcttgggaagcttggggctaggctcactaagcttacaccagaacagtctgcttatattagtattcctgttgaggggccttacaagcctgctcactacaggtattaattcaacggcagagtggatatagtatatggttttgtgggcattttggatggaatattttgaagggcaagtctttggcatagaaggcttgttcccttatattgaataaggttgagttggagggtttgttttaggggctgcagtagtagtttagattctttcttttctgttagtttatgcatt

SEQ ID NO: 6107 - DNA, 1103 bp, Parthenium argentatum
ggagagattggttggtgtgtctgaggagactaccactggtgttaagaggttgtaccagatgcaagctaatggtactctgctgtttcctgctattaatgtcaacgactctgttactaagagcaagtttgacaacttgtacggctgccgtcactctctccctgatggtttgatgagagccaccgatgtcatgattgccggaaaggttgccgttgtctgtggttacggagatgtcggtaagggttgtgctgctgccatgaaacaagctggcgcacgtgtcatcgtgacagaaatcgaccccatctgtgctctccaggccaccatggaaggactccaagtccttaccttggacgacgtagtttcagaagctgacatcttcgtcaccacaaccggtaacaaagacatcatcatggtttctgacatgaagaagatgaagaacaacgccatcgtctgcaacattggtcacttcgacaatgaaatcgacatgcttggacttgaaacttaccctggtgtccaaagaatcaccatcaaaccccaaaccgacaggtgggtcttccctgaaaccaagagcggcatcattgttttggctgagggtcgtctcatgaacttgggttgtgccactggtcaccccagtttcgtgatgtcttgctcgttcaccaaccaagtgattgcccaactcgaactatggaacgagaagaacaccgggaagtacaagaaggaggtgtatgtgttgccaaagcatcttgatgagaaggttgctgctcttcatcttggaaagcttggagccaagttgaccaagttgaccaaggaccaggctgactacatcagtgtaccagttgagggcccatccaagcctgctcactacaggtactgagcgtgtcggttttgggtggaagttgttgcgttctttataagatacaattcgagtatgtgttagactttagttttgtttgttattttgatcggggtgttggcgaggaagaaaccgattggtcgtttcttgatgagacggctgtttatgtcggtttgaataagggttgcatgtgaaggttgtgtggactctattgtagctgttattttggtttagaggttttacttgctttggc

SEQ ID NO: 6108 - DNA, 784 bp, Ambrosia trifida
gtttgataacttgtacggatgccgccactcgctccctgacggtttaatgagagccaccgatgtcatgatcgctggaaaggtagcagtggtctgtggttatggagatgtggaaagggttgtgctgctgcaatgaaacaagctggtgcgcgtgtcatcgttacagaaatcgaccccatctgcgcccttcaggctctcatggaaggtcttcaagtcctaaccttagaagatgtactatccgaagccgatatcttcgtgaccaccaccggtaacaaggatatcatcatggttgaccacatgaagaaaatgaagaacaatgcaatcatctgcaacatcggtcacttcgacaatgagatcgacatgcttggtttggaaacataccctggagtcaagcgaatcaccatcaagccccaaaccgaccgatgggtgttccctgaaaccaagagtggtgtcattgtgttggccgagggtcggctcatgaacttgggctgtgccactggtcaccaagttttgtgatgtcgtgctcgttcactaaccaagtgattgcgcagctcgagctgtggaacgagaaggggaaggggaagtacaagaatgaagtgtatgtgttacccaagcaccttgatgagaaagtggctgcacttcatcttggtaagcttggagccaggctcactaagctaaccaaggaccaggccgactacactagcgtgcctgttgaaggtccatacaagcctgctcactacaggtattgagcaatggggttcaggggaacattgtgtgcttgttttca

SEQ ID NO: 6109 - DNA, 794 bp, Cirsium arvense
cgtaacagaaatcgaccccatctgtgcccttcaggccaccatggaaggtctccaagtcctccccttggaagacgtcgtctctgaggccgatatcttcgtcaccaccaccggaacaaggacatcatcatggtcagcgacatgaagaagatgaagaacaacgccattgtctgcaacatcggtcacttcgacaacgagatcgacatgctcggcctcgagacctaccccggagtgaagaggatcaccatcaagccccagaccgaccgctgggtgttccccgagaccaagaccggcatcatcgtgttggccgagggtcgtttgatgaacttgggatgcgccacgggacaccccagcttcgtgatgtcgtgctcgttcaccaaccaggtgatcgctcagctcgagctgtggaacgagaggaccaccggcaagtacaagaaggaggtgtatgtgttgccaaagcatcttgatgagaaggttgctgcacttcatcttggaaagctcggagccaagctgaccaagctgaccaaggatcaagccgactacatcagtgtgccggtcgaggggccatacaagcctgctcattacaggtactgagctgtgatttttgggggcaatttgaagaggggttatgtggttgttttttaattgaaagatacaatatgtgtttagatttgggtgtgttggttttgatggggttgtgtttggtgggaaagtaagtgaatggtgttttctttgttgaaaggccattgaataagggttgagtgtgaaaggggttgtgtaccatcaatgtagttagg

SEQ ID NO: 6110 - DNA, 1339 bp, Flaveria ramosissima
tgggcccgatctgatcgtcgacgacggtggcgatgcgacgctgttgattcatgaaggtgtgaaggcggaggaggagtttgagaagacggggaagctgccggatccgtcgtcgacggataacgcggagtttcagatcgtgttgtcgattattaaggaggggttgcagagtgatcccaagaagtatcataagatgaaggagagattggttggtgtgtcggaggagaccaccactggtgttaagaggctgtatcagatgcaggccaatgggactctgttgttccctgctattaacgtcaatgactctgttactaagagcaagtttgataacctgtacggttgccgtcactctctccctgatggtttgatgagagctactgatgtcatgatcgctggaaaggttgcagtggtctgcggttatggtgatgtcggaaagggttgtgctgctgcaatgaaacaagctggtgcacgtgtgatcgttacagaaatcgaccccatctgcgcgcttcaggccaccatggaaggactccaagttcttaccttggatgatgtggtttcagaggccgatatcttcgttaccaccactggcaacaaggacatcatcatggtttccgacatgaagaagatgaaaaacaacgcgatcgtgtgcaacattggtcatttcgacaatgaaatcgacatgcttggacttgaaacctacccaggtgtcaagagaatcaccatcaagccccaaaccgacaggtgggtcttcccagaaaccaacactggcatcattgtgttggccgagggtcggctcatgaacctggggtgtgctactggacaccccagtttcgtgatgtcgtgctctttcactaaccaagtgatcgcccaacttgagctttggaaagaaaagaacagcgggaagtacaagaaggaagtgtatgtgttgccaaaacatctcgatgagaaggtggctgcacttcatctcggaaagcttggagccaagttgaccaagttgaccaaggaccaggctgattacatcagtgtgccggttgagggtccatacaagcctgctcactacaggtactagacgggtcgggttttttggtgagttcgaagagagcttgatgtgattgttgctttctttataagatacaatgagtatatgttagggttttgttttgtttgttatgttgatcgggggtgttggcgtgtaagaaaccgactggtcatatctttatgagatgatcgttgatgtcggtttgaataagggttgtgtgaaggttgtgtaaacgctattgtagttgttttttgggttagaggtttaatttgctatgcgttttgcttgttagttcatcaacaa

SEQ ID NO: 6111 - DNA, 1111 bp, Flaveria ramosissima
ggtgttaagaggctgtatcagatgcaggccaatgggactctgttgtccctgctattaacgttaatgactctgttactaagagcaagtttgataacctgtacggttgccgtcactctctccctgatggtttgatgagagctactgatgtcatgatcgctggaaaggttgcagtggtctgcggttatggtgatgttggaaagggttgtgctgccgcaatgaaacaagctggtgcacgcgtgatcgttacagaaatcgaccccatctgcgctcttcaggccaccatggaaggactccaagttcttaccttggatgatgtggtttcagaggctgatatcttcgttaccaccaccggcaacaaggacatcatcatggtttccgacatgaagaagatgaaaaacaacgcgatcgtgtgcaacattggtcattttgacaatgaaatcgacatgcttggacttgaaacctacccaggtgtcaagagaatcaccatcaagccccaaaccgacaggtgggtcttcccagaaaccaacactggcatcattgtgttggctgagggtcggctcatgaacctggggtgtgctactggacacccaagtttcgtgatgtcgtgctctttcactaaccaagtgatcgcccaacttgagctatggaaagaaaagaacagcgggaagtacaagaaggaagtgtacgtgttgccaaaacatctcgatgagaaggtggctgcacttcatctaggaaagcttggagccaagttgaccaagttgaccaaggaccaggccgattacatcagtgtgccggttgagggtccatacaagcctgctcactacaggtactagacgggttgggttttttggtgagttcgaagagagcttgatgtgattgttgctttctttataagatacgatgagtatgtgttagggtttagttttgtttgttatgttgatcggggtgttggcgtggaaaaaaccgctggtcgaatcttgatgagacgaccgatgatatcggtttgaataagggttttgagaaggttgtgtaaacgccattgtagttgttttttgggcaagatgttttgtttgctatgtgttttgcttgttagttcatcaggaaactaatg

SEQ ID NO: 6112 - DNA, 1618 bp, Flaveria ramosissima
tcgagctagccgaggtcgagatgcctgggctcatgtcatgccggaccgacgttcggcccctctcagccgttcaaaggcgccagaatcaccggctcgctccacatgacgatccaaaccggcgtcctgatcgaaaccctaaccgctttaggcgctgaggtgagatggtgctcgtgcaacatcttctccactcaggaccacgcggcggcggcgatcgcacgtgactccgccgcggtgttcgcgtggaagggggagacgttgcaggagtactggtggtgtacggagcgggcgttggattggggccccggtggtgggcccgatctgatcgtggacgacggtggcgatgcgacgctgttgattcatgaaggtgtgaaggcggaggaggagtttgagaagacggggaagctgccggatccgtcgtcgacggataacgctgagtttcagatcgtgttgtcgattattaaggaggggttgcagagtgatcccaagaagtatcataagatgaaggagagattggttggtgtgtcggaggagaccaccactggtgttaagaggctgtatcagatgcaggccaatgggactctgttgttccctgctattaacgtcaatgactctgttactaagagcaagtttgataacctgtacggttgccgtcactctctccctgatggtttgatgagagctactgatgtcatgatcgctggaaaggttgcagtggtctgcggttatggtgatgtcggaaagggttgtgctgccgcaatgaaacaagctggtgcacgtgtgatcgttacagaaatcgaccccatctgcgcgcttcaggccaccatggaaggactccaagttcttaccttggatgatgtagttcagaggccgatatcttcgttaccaccactggcaacaaggacatcatcatggtttccgacatgaagaagatgaaaaacaacgccatcgtgtgcaacattggtcatttcgacaacgaaatcgacatgcttggtcttgaaacctacccaggtgtcaagagaatcaccatcaagccccaaaccgacaggtgggtcttcccagaaaccaacactggcatcattgtgttggccgagggtcggctcatgaacctggggtgtgctactggacaccccagtttcgtgatgtcgtgctctttcactaaccaagtgatcgcccaacttgagctttggaaagaaaagaacagcgggaagtacaagaaggaagtgtatgtgttgccaaaacatctcgatgagaaggttgctgcacttcatctcggaaagcttggagccaagttgaccaagttgaccaaggaccaggctgattacatcagtgtgccggttgagggtccatacaagcctgctcactacaggtactagacgggtcgggttttttggcgagtttgaagagagggtgatgtgattgttgcttactttataagatacaatgagtatgtgttagggttttagttttgtttgttatgttgatcggggtgttggcgaggaaaaaaccgatgagacgaccgttgatgtcggtttgaataagggtgtgtgaaggttgtgtaaacgccagttgttttttgggcaagaggttttatttgctgtgtgttttgcttgttaatatt

SEQ ID NO: 6113 - DNA, 1187 bp, Flaveria ramosissima
tgcgacgctgttgattcatgaaggtgtgaaggcggaggaggagtttgagaagacggggaagctgccggatccgtcgtcgacggataacgctgagtttcagatcgtgttgtcgattattaaggaggggttgcagagtgatcccaagaagtatcatagatgaaggagagattggttggtggtgtcggaggagaccaccactggtgttaagaggctgtatcagatgcaggcgaatggaactctgttgttccctgctattaacgtaatgactctgttactaagagcaagtttgataacctgtacggttgccgtcactctctccctgatggtttgatgagagctactgatgtcatgatcgccggaaaggttgcagtggtctgcggttatggtgatgtcggaaagggttgtgctgctgcaatgaacaagctggtgcacgtgtgatcgtacagaaatcgaccccatctgtgcgcttcaggccaccatggaaggactccaagttcttaccttggatgatgtagtttcagaggccgatatcttcgttaccaccactggcaacaaggacatcatcatggtttccgacatgaagaagatgaaaaacaacgcgattgtgtgcaacattggtcatttcgacaatgaaatcgacatgcttggtcttgaaacctacccaggtgtcaagagaatcaccatcaagccccaaaccgacaggtgggtcttcccagaaccaacactggcatcattgtgttggccgagggtcggctcatgaacctggggtgtgctactggacaccccagtttcgtgatgtcgtgctctttcactaaccaagtgatcgcccaacttgagctttggaaagaaaagaacagcgggaagtacaagaaggaagtgtatgtgttgccaaaacatctcgacgagaaggtggctgcacttcatctcggaaagcttggagccaagttgacaaagttgaccaaggaccaggccgattacatcagtgtgccggttgagggtccatacaagcctgctcactacaggtactagacgggtcgggtttttggtgagtttgaagagagggtgatgtgattgttgctttctttataagatacaatgagtatgtgttagggtttagttttatttgttatgtcgtagtcggggtgttggcgaggaaaaaccgactggtcgtatcttgatgagacgac

SEQ ID NO: 6114 - DNA, 546 bp, Phalaenopsis aphrodite
ctcgccttgaggacgttgtgtccgaggctgacatttcgtcaccaccaccggcaacaaggacatcatcatggttgaccacatgaggaagatgaagaacaatgccatcgtctgcaacattggccactttgacaacgagattgatatgctcggactcgaatcattccccggtgtcaaacgcatcaccattaagccgcagacggatcggtgggtcttccctgacacaaatagcggcatcctcgtgctggcggagggccgtctgatgaacctcggatgcgccacgggtcaccccagctttgtcatgtcgtgctcttttacgaaccaggtaattgctcagctggagctgtggaaggagagggcgtcggggaagtatgagaagaaggtgtatgtgttgccgaagcacttggacgagaaggttgcggcgcttcatttgggcaagcttggggccaagctcaccaagcttactccttcgcaggctgattacatcagcgttccggtcgagggtccctacaaaccagccccattacaggtattagagaattttaatgt

SEQ ID NO: 6115 - DNA, 1241 bp, Sarracenia psittacina
tgtatcagatgcaagccaacgggaccttgcttttcccggcaatcaatgtcaatgactccgtcaccaagagcaagtttgataacttgtatggatgccgccattcactccctgatggtctgatgagagccactgatgttatgattgctggcaaggttgcagttgtttgtggttatggtgatgttggcaagggctgtgcagccgccatgaagcaagcaggagcccgtgtgatcgtaaccgagatcgatccaatctgtgcccttcaggctctaatggaaggcctccaagtcctacccctcgaggatgtcgtctcagaagccgatatctttgtcaccacaaccggtaacaaggacatcatcatggtggaccacatgaagaagatgaagaacaatgccattgtgtgcaacattggccatttcgacaacgaaattgacatgatcgggctcgagacttacccaggcgtgaagagaatcacgatcaaaccgcaaaccgacaggtgggtcttccccgaaaccaactcgggcatcattgtcttggccgagggtcggctcatgaacttgggctgcgctacaggccacccgagctttgtgatgtcttgctctttcaccaaccaagtgattgctcaacttgagctttggaaggagaagaaaacaggcaaatatgagaagaaagtgtatgttttgcccaagcaccttgatgagaaagtcgcatcacttcaccttgggaagcttggagctaagctcaccaagctcaccaaggaacaggcagattacattagtgtccctgtggagggtccttacaagcctgcccactacaggtattgaggagaaagagaagggagatttctgaaatcaaaatttatgaaccgcatggttgtttgctttttcatccctttgctttgaagtagaacggtagtttgttttccccccttcaatttttatgatgggattgtgttgggtttttttggtggttgaaaacttgaaaggaaagaaatgtattcttccatgcgaagaataccaaatgggctgaataaggacatattaggtggtgtgggtcatgtgggaccgtcgaagttggtgcaggttaggttgtctgcattttgattattattatgattgtattaacaaatatacaagttttttttttattggtgtgatgggtttggcccttactcctctattggtgtcagataaaatgatacttagttatttaggcgtggggtgcgcaatcattgatggatagat

SEQ ID NO: 6116 - DNA, 1260 bp, Malus domestica
tcttccaccgataaccaggagttccagctggttctgaccatcatcagagatggcttgaagaccgaccccaagaggtaccacaagatgaaggacaggttggtcggagtttcggaggagaccacaaccggcgtcaagaggttgtatcagatgcaggctagcggcgctctgttgttccctgccattaatgtcaatgattctgttacaaaaagcaagtttgacaacttgtacggatgccgtcactctctccctgatggtttgatgagggccacggatgtcatgattgccggaaaggtttccgttgtctgtggatacggagatgttggaaagggttgtgctgctgccctcaagcaagcaggatctcgtgtgattgtgactgagatcgatccaatttgtgccctccaggctcttatggaaggccttcaggttcttcctcttgaggatgttgtctctgaggctgatatctttgttaccaccaccggtaacaaggacatcatcatggttgaccacatgaggaagatgaagaacaatgccattgtttgcaacattggtcactttgacaatgagattgacatgcacggtcttgagacataccccggagtgaagcgcatcaccattaagcctcaaactgacaggtgggtcttcccagagaccaacactggcatcattgtgttggctgagggccgtctcatgaacttgggatgtgccactggacaccccagctttgtgatgtcctgctctttcaccaaccaagtgattgctcagcttgagttgtggaacgaaaggaagtctggcaagtacgagaagaaggtgtatgtcttgcctaagcaccttgacgagaaggttgctgcccttcatcttggaaagcttggagctaagctcaccaagctcagcaaggaacaagctgactacatcagtgtgccggtcgagggtccatataagccagctcactacaggtactgaagagggattgtcaatgagacaagaaatgaggaaaaaaacaattatatctggacgaagagttgttttttaatttttgatttttattttttacattctgatgaaatgttgtagaatttctaggtttttaaattttagtaggagtgtgttggcgggttttggagggtatgtgatgaaggaaagggatgatttgggtctaagtggaagaccttggggtttgaataagggaatgggatggggttgtgtgtgatgacatctgctgcaacatcacttgtgtgctgcgtctgcttgtcatttttacca

SEQ ID NO: 6117 - DNA, 892 bp, Ocimum basilicum
gggctactgatgtgatgattgccggaaaggtgggagttgtgtgtggttatggagatgttggcaagggttgtgccgcagcctgaaacaagccggtgctcgtgtgatcgtcaccgagatcgatcccatctgtgctctccaagccctcatggaaggcttccaagtgctgaccctggaggacgttctttctgaggccgatatctttgtcaccaccaccggcaacaaggacatcatcatggtcgaccacatgaagaagatgaagaacaatgccatcgtcaacattggccactttgacaacgagattgacatgctgggtcttgagacctaccccggtgtgaaaaggatcaccatcaagccacagactgaccgatgggtgttcccagagacgaatagcggaataatcgtgttggcagaaggtcggctgatgaacttggggtgtgcgacggggcacccgagctttgtgatgtcgtgctcgttcacgaaccaagtgatagcgcagctggagctgtggaaggagaggaagagtgggaaatacaagaaggaggtgtacgtgttgccgaagcacctggatgagaaggtggcagcactgcacctgggaaagctgggggccaagctcactaagctcaccaaggatcaggctgattacatcagtgttccggtggagggaccttacaagcctcttcactacagatactgatcacaacaaacaacctctttctgctatttgccattgcgcaagcttcctactttttgagttttcttgccatcttggaactcccattttaataactaaaaatatcttttcttttgcatctctcctcacacaaacacaacagccatttcaattttagatggcttttggactaatcagacaatttgcaacgcatcattgggt

SEQ ID NO: 6118 - DNA, 1177 bp, Trifolium pratense
cttttgttccctgctatcaatgtcaatgactctgttaccaagagcaagtttgacaacttgtatggttgccgtcactcactccccgatggactgatgagagctactgatgtcatgattgccggtaaggttgctgttgtttgtggttacggagatgttggcaagggttgtgctgctgccttgaaacagggtggtgctcgtgtggtcgtgactgagatcgatccaatctgtgcactacaagctctcatggaaggtcttcaagttctaactcttgcagatgttgtctccgaggctgacattttcgttaccacaaccggtaacaaagacattatcatggtcagtgacatgaagaaaatgaagaacaacgccattgtctgcaacattggtcactttgacaacgaaatcgacatgcatggccttgagacataccctggtgtgaagcgcatcacaattaagccacaaaccgacagatgggttttccccgaaaccaactctggcattattgtcttggccgaaggtcgtttgatgaacttgggatgtgctactggacaccccagtttcgtcatgtcatgctccttcaccaaccaagtcattgctcagattgagttgtggaaagagaagacttccggcaaatatgaaaagaaggtctatgttttgcctaagcacctcgatgagaaggttgccgctcttcatcttggccagctcggagctaagcttaccaagctttcaaaagatcaggcagattacatcagcgtgcctgtcgagggtccatacaagcctgctcactacaggtactgaagtgatcaagggattgttgagggaaagaataaagatgattctatccgtattgtgttgcattccattttggaatatttttggtttctcattacaatttttagatttgtggtacattgggaattcttttggattattatcctagaatctcaattccattgggttaagggtaagagcaaaaaacctattggtttctgtcaattgagaccaattgggtttgaataatgctttggttgcggctgtgtgggttatgattgattattagagtataataacgtgtttccgtcgtctatctttgacaaagaaacaggttaggaaaatgcagaaaaaaaatgtacttcactgttttaagctcgatttgttttaatttatatttttttttttt

SEQ ID NO: 6119 - DNA, 1105 bp, Curcuma longa
cgcctcgtgccgaattctgcacgaggggaaacgaccactggtgttaagcggctgtaccagatgcaggccagcggcgccttgctcttccctgcgatcaacgtgaatgactctgtcacaaagagcaagttcgacaatctgtatgggtgccgccattctctccctgatgggctcatgagggctaccgacgttatgatcgccggcaaggttctgtggtctgtggctacagagatgtcggcaagggttgcgcctctgctttgaagcaggcaggtgcccgggtcatcgttaccgagatcgaccccatctgtgctctccaggctctgatggagggcatccctgttctcaccttggaggatgttgtttcggaggctgatatcttcgtcaccaccaccggaaataaagacatcatcatggtggatcacatgaagaagatgaagaacaatgccattgtatgcaacattggccacttcgacaatgagatcgacatgcacgggcttgagacttacccaggcgtcaagcgcatcaccatcaaaccccaaacagaccgctgggtgttccctgagacaaattccggcatcatcgttctcgcggaggggcgtcttatgaaccttggttgtgccactggccatcccagcttcgtcatgtcctgctcgttcaccaatcaggtgattgcgcagcttgagttgtggaaggaaaggagcagcggaaagtatgagaagaaagtgtacgtgctacctaagcatcttgatgagaaggtggcggctctgcacctgggtaagctaggagccaagcttaccaagctcacaccagctcaggccgcgtacatcagcatccccgttgaaggcccttacaaacctgctcactacaggtaataatatgccctaccgacatgagacagtcgtggccggagatgttactgatgtctgaatttctcctgcttgatttaccttttagctttttatttcgctatttcccattttgaattggttgagaaatgatctgggcaagcttcgtatcggagtggttgagaagagatggtccttctgttgtgtgtccgtgctgcccgtcctgaaacggttcggaataatgcgatttccaatattttgtc

SEQ ID NO: 6120 - DNA, 1443 bp, Gerbera hybrid cultivar
agagttgtatcagatgcaagctaatggtaccttgcttttccctgccattaatgtcaacgactctgtcaccaagagcaagtttgacaacttgtacggatgccgccactcactccccgacggtttgatgagagccaccgatgtcatgatcgccggaaaggtcgccgttgtttgtggttatggagatgtcggaaagggttgtgccgctgccatgaaacaagccggagccagagtcatcgtcacagaaatcgacccgatctgtgcccttcaagccaccatggaaggtctccaagtcctaaccctagaagatgtagtctcagaagccgacatcttcgtcaccaccacaggcaacaaagacatcatcatggtcgaccacatgaggaagatgaagaacaacgctattgtctgcaacattggccatttcgacaacgaaatcgacatgctaggacttgaaacctaccctggtgtcaagagaatcaccattaaaccccaaaccgacaggtgggtcttccccgaaaccaaaaccggcatcattatcttagccgagggtcggctcatgaacctgggatgtgccactggccacccaagtttcgtcatgtcttgttctttcaccaaccaagtgatcgcccagcttgagctatggaaagaaaaatcatctgggaagtacaagaaggaagtgtatgtgttgcctaagcatcttgatgagaaggttgctgcacttcatcttggaaagcttggagctaagttgaccaagctcagcaaggaccaggccgactacattagtgtaccagtggagggtccttacaagcccgctcactacaggtactaaatatgttgttttggggaattcgaatgtggggttttgtgatttggggatttatatgaatacattttgatcatgtgttttagggttagttttgtgtttctgaattttgtggtggtgtttggtgggggataatgtgagtggtttttgttggaaggccattgatgcggggtttgaataagggttgtgtgtggaggttgtgtaatgattgtagtttttttggctagaagttttaattgttgccttttgtttcttaattcacgaggaaatcaagggaaaaaggcattttagaccagctatttgcattgttaaatgttatgagttgtattgtatactttttagagtgcaaaaagagaacattgatcaatcgtcgtaaccattgggcctcaaattgcaaggcttggattgctgtgattgttaaactcttgcttatgtgagatagaatggccgggtccgggtttatttgggcttcttatccttcggctgaggtttaaatgaatgatttacatgggctttttctggttttgggctttttaggcgtggtcctgaatggggttcaggtcttaggctttttgcttctctgatgttggaaactgaaatattattttgacgaattcaacatg

SEQ ID NO: 6121 - DNA, 857 bp, Zingiber officinale
  misc_feature (338)..(338): n is a, c, g, or t
gcaggcaggtgccggggtcatcgttaccgagatcgaccccatctgtgctctccaggctctgatggagggcatccctgttctcaccttggaggatgttgtttcggaggctgatatcttcgtcaccaccaccggaaataaagacatcatcatggtggatcacatgaagaagatgaagaacaatgccattgtatgcaacattggccacttcgacaatgagatcgacatgcacgggcttgagacttacccaggcgtcaagcgcatcaccatcaaaccccaaacagaccgctgggtgttccctgagacaaattccggcatcatcgttctcgcggaggggcgtnttatgaaccttggttgtgccactggccatcccagcttcgtcatgtcctgctcgttcaccaatcaggtgattgcgcagcttgagttgtggaaggaaaggagcagcggaaagtatgagaagaaagtgtacgtgctacctaagcatcttgatgagaaggtggcggctctgcacctgggtaagctaggagccaagcttaccaagctcacaccagctcaggccgcgtacatcagcatccccgttgaaggcccttacaaacctgctcactacaggtactaatatgccctaccgacatgagacagtcgtggccggagatgttactgatgtctgaatttctcctgcttgatttaccttttagctttttatttcgctatttcccattttgaattggttgagaaatgatctgggcaagcttcgtatcggagtggttgagaagtgatggtccttttgttgtgtgtccgtgctgcccgtcctgagacttttcggaataatgcgatttccaatattttgtctcttgttcctt

SEQ ID NO: 6122 - DNA, 532 bp, Heritiera littoralis
tttgcaacattggacactttgacaatgaaattgacattcaaggtcttgagaactatccccgtgtcaagcgcatcaccatcaagcctcaaacagataggtgggttttccctgaaaccaacatcggcatcattgtgttggctgaggggcgtctcatgaacttgggctgtgccactggccaccctagcttcgtcatgtcctgctcattcacaaaccaggtgatcgcccagctcgagctgtggaaggagaaggcgaccggcaagtatgagaagaaggtgtatgttttgcccaagcaccttgatgagaaggttgctgctcttcaccttggcaagcttggagctaggctaaccaagctcagcaaggctcaagcagattacattagtgtgcccgttgagggtccttacaagcctcctcactacaggtactgaggagagaatgacagagtttcgagaaaagcaatacatccggatggctgattgttctttttacttcaacttatggatgatttgtggttagattgttaggatttgatttt

SEQ ID NO: 6123 - DNA, 697 bp, Glycyrrhiza uralensis
ctacttgatcccatttgtgcccttcaggccctcatggaaggtttccaggttctgaccctggaggatgttgtctctgaggccgatatctttgttaccaccaccggtaacaaggacatcatcatggttgaccacatgaggaagatgaagaacaatgccattgtttgcaacattggtcactttgacaatgagattgacattcttggccttgagacctaccctggcgtgaagcgcatcaccatcaagccacaaactgacagatgggtcttccctgagaccaacaccggcatcattgtcttggccgagggtcgtttgatgaacttggggtgtgccacggggcaccccagttttgtgatgtcctgctccttcaccaaccaggtcattgctcagcttgagttgtggaaggagaagagtagtggcaagtatgagaagaaggtgtacgttttgcctaagcaccttgatgagaaggtggctgcacttcaccttggcaagcttggagctaagctcaccaagctttcccaatcccaggctgattacatcagtgtgccagttgagggtccatacaagcctgctcactacaggtactgagatgatcaagaaggtgatatgaggagattgagggaaatgaaaaaactgtttcaagaatcggctggcttgattgtttcatttgcctttttggatttttgtcattaggctcttc

SEQ ID NO: 6124 - DNA, 1297 bp, Carica papaya
cgagaccctcaccgctctcggtgccgaggtccgttggtgctcctgcaacatcttctccactcaggaccacgccgctgccgcaatcgctagggattccgccgctgtcttcgcatggaagggtgagactctgcaggagtactggtggtgcaccgagcgcgctctcgactggggtccatccggtggccctgatcttattgttgacgatggtggtgatgccactctcttgatccacgagggtgtgaaggctgaggagatcttcgagaagaccggtcagttgcccgatccaaactctaccgataatgccgagttccagatcgtgctcactatcattaaggacagcctcaagactgatcccaagaggtaccacaagatgaaggaaagattggttggtgtctctgaggagactaccaccggagttaagcgactctaccagatgcaggctaatggaactctgttgttcccagccatcaatgtcaatgactcagtcactaagagcaagtttgataacttgtacggatgccgccactctctccctgacggtctgatgagggcaactgatgtcatgattgctggaaaggttgctgttgtttgcggttatggtgatgttggcaagggctgtgccgcagctttgaagcaggctggtgccagagtcattgttactgagattgatcccatttgcgctctccaggctctgatggagggtctccaagttttaaccctggaagatgttgtctccgaggccgacatctttgtcaccaccactggtaacaaggacattataatggttagccacatgaagaagatgaagaacaatgccattgtctgcaacattggtcactttgacaatgaaattgatatgcacggacttgaaacctatccgggtgtcaagcgcatcaccatcaagccccaaactgacagatgggttttcccggaaaccaacactggcatcattgtgttggctgagggtcggctcatgaacttgggttgtgccaccggacaccctagctttgtgatgtcctgctcattcacaaaccaggtgattgcccagctggagctctggaaggagaaggcaactggcaagtacgagaagaaggtgtacgttctgcccaagcaccttgatgagaaggttgctgctcttcatctagggaagcttggagccaagctgacgaagctcagcaaggaccaagctgactacatcagcgtgccagttgagggtccatacaagcctgctcactacaggtactgagggcgagagaaggtgctatattttgagagagagacaaaaaaaaaaaaaagg

SEQ ID NO: 6125 - DNA, 1131 bp, Arachis hypogaea
gaggttgtaccagatgcaggccaatggaactctcttgttccctgccatcaatgtcaatgactctgtcaccaagagcaagtttgacaacttgtatgggtgccgccactccctccccgatggtctcatgagggctactgatgtcatgattgccggaaaggttgccgttgttgccggttacggagatgtcggcaagggttgtgttgctgctttgaagcaggccggtgctcgcgtcattgtgactgagatcgatccaatttgcgccctacaggctctcatggaaggtcttcaggtcttgacccttgaggatgttgtctctgaggctgatatcttcgtcaccaccaccggtaacaaggacatcatcatggttgaccacatgaggaagatgaagaacaatgccattgtctgcaacattggacactttgacaatgagatcgacatgcacggtcttgagacatatcctggcgtgaagcgcatcaccatcaagccccaaaccgatagatgggtgttccccgagaccaacaccggcatcattgtgttggctgagggtcgtttgatgaacttgggttgtgccacgggacacccaagtttcgtgatgtcttgctcattcaccaaccaggtcattgcacagcttgagttgtggacggagaagagcagtggcaaatatgagaagaaggtgtatgttttgcccaagcacctcgatgagaaggtggccgcactccaccttggcaagcttggagccaagctcaccaagctttcccaatcacaagctgattacatcagtgttccagtggagggtccatacaagcctcctcattacaggtactaaggaagaagatcaagatttgttgagagaagaaaaggagaaaaacaatgttttgtggatcgaatttgattgtttcattttgcattttggggactttcattattacacattttggatttgtggttagatgagtggtagtcttctaattctagtagggtttcttgtgttgtttcggaggggagggttaagggggaagggtagaatctccattgctttctctggaaagagaacaaatgggtttggttttgaataaggctgtgggttgggggttgtgttcattcttctttagtagctcatatatccgtgtt

SEQ ID NO: 6126 - DNA, 992 bp, Cajanus cajan
cgacgtgatgattgccggaaaggttgccgtgtgtgcggctatggagatgttggcaagggttgtgctgccgccatgaagcaggctggggctcgtgtcattgtcactgagatcgatcccatttgtgcccttcaggctctcatggaaggtcttcaggttctcaccctcgaggaaactctctccgtcgccgacatcttcgtcaccaccaccggtaacaaggacatcatcatgctcaaccacatgaagcaaatgaagaacaacgccattgtctgcaacattggccacttcgacaacgaaatcgacatgctgggcctggagacccaccctggtgtgaagcgcatcactatcaagcctcaaaccgatcgatgggtcttccctgagaccaaaacagggatcattgtgctggcggaggggcgtttgatgaacttggggtgtgccacaggccaccccagctttgtcatgtcctgctccttcaccaaccaggtcattgctcagcttgaactgtggaaggagaagggttctggcaagtatgagaacaaggtctatgttttgcccaaacaccttgatgagaaagtcgcttctctccaccttggcaagcttggagctaacctcaccaagcttaccaaagagcaggcagattacatcagtgtgcctgtcgagggtccatacaagcctgctcattacagatattaattcatcccatcacattccccgagaataaagaaaatatattctatcgctatcactatcacttcccctcattcttacacttttcttctcttactttttccatatttctgctagaataggaccttcttttattcttttcataggatcacaattccattaggttaagagcaaaattacccatggctcctctaatctatcaaatgagaccagacccaatgggttcgaataaggctttggctttggctacttctgtggttttgatttagcagctattatattttccatctctttttcttaaaatccgc

SEQ ID NO: 6127 - DNA, 484 bp, Podocarpus macrophillus
gagatcgatatgctgggattagagactttccccggcgtgatgcggatcacaatcaagccccaaacggacaggtgggtcttccctgataccaagtccggcgtcattgtcttggccgagggcggcttatgaacctgggatgcgccactggccaccccagctttgtgatgtcgtgctctttcacgaaccaggtgattgcccagcttgagctgtggaaggagaagagcaccggcaagtatgagaagaaggtgtatgtgcttcccaagcaccttgatgagaaggtagctgcacttcatcttggaaagctaggggctaagcttaccaagcttacggctgatcaggctgactacattagcgtccctgtggatggtccatacaagcctgctcagtataggtactgattgatcattgatgagagaggggaatactcaaatagccatgaataattcttttcatggagtttgtagttttgatatttacagtggtg

SEQ ID NO: 6128 - DNA, 1427 bp, Senecio madagascariensis
actgagtttaggtctcttgattggggtccagatggtggacctgatctcattgttgatgatggtggagatgctacccttttgatccatgaaggagttaaagctgaggaggagtttgagaagacggggaaattgcctgatcctacttctactgataacgcggagtttcaaatcgtattgtcgattattaaggaaggtttgtcaattgaccccaaaaagtaccacaaaatgaaaactagacttgttggtgtttccgaggaaaccacaactggtgttaagagattataccaaatgcaagctaacggtaccttgttgttccctgctattaatgttaacgattctgttaccaagagcaagtttgataacttgtacggatgccgtcactcgctccctgatggtttgatgagagctactgatgttatgattgctggaaaggttgcggttgtgtgtggatacggagatgttggaaagggttgtgcttctgccatgaagcaagctggtgcccgtgttattgttacagaaattgatcccatctgtgcccttcaggctaccatggaaggtctccaagtcttgactttggaagatgttgtccggccgaggtctgatatcttcgttaccactaccggtaacaaagatattatcatggtttctgacatgaagaagatgaagaacaatgctattgtttgcaacattggtcactttgacaatgaaattgatatgcttggtcttgagacttaccctggtgtgaagaggatcaccattaagccccaaaccgataggtgggtgttccccgagaccaagagtggtgttatcatcttggctgagggtaggctcatgaacttgggatgtgctactggtcatcctagtttcgtcatgtcttgctctttcactaaccaagtgattgctcaactcgagttgtggaacgagaagggaaccggaaagtacaagaaggaggtgtatgtgttgcctaagcaccttgacgagaaagttgctttacttcatctcggaaagacctggagctaagctcactaagctcacaaaggaccagtctgattacctcagtatccctattgaaggtccttacaagcccgttgcatacaggtactgatcaaagaggatattttccgcgaatgttgaagagcccatgtgattgttcttttcaatttgcaagtttgcttgtgtactaagactatcaagtttttattttgattttttgttggggtttggtggttggtttggggattcaaataaggaggctatggttagaaggttggtgtgagttttgttggactagcggttttatgccatttacttgtatgcggatattttaaagtggaaaagagtgtttttacactttcagagtgtgctccaaatctggttctaaaatggtcagatcggttagcagttctaattggaatcgcgaaggcagt

SEQ ID NO: 6129 - DNA, 1069 bp, Tamarix hispida
  misc_feature (49)..(49): n is a, c, g, or t
  misc_feature (832)..(832): n is a, c, g, or t
  misc_feature (839)..(839): n is a, c, g, or t
  misc_feature (841)..(841): n is a, c, g, or t
  misc_feature (845)..(845): n is a, c, g, or t
  misc_feature (851)..(851): n is a, c, g, or t
ggggacaacttgtatggatgccgccactctctccctgatggtttgatgngagccactgatgtcatgattgctggcaaggttggtgttgtctgtggatacggagatgttggcaagggctgtgcttttgccttgaaggctgcgggtgcacgtgtgattgtgactgagatcgaccctatctgtgctctccaagctctcatggaaggtttccaagtcctcacattggaagatgtggttgctgaggctgacatctttgttaccaccactggtaacaaggacatcatcatggtcgacgacatgaggaagatgaagaacaacgccattgtctgcaacatcggtcactttgacaacgagatcgatatgcttggcctcgagagctaccctggtgttaagaggatcaccatcaagccccagacagacagatttgtatttcccgacaccaagaggggagtcatcattttggccgagggtcgtctcatgaacttgggttgtgccactggtcaccctagctttgtcatgtcttgctcgttcaccaaccaatgtatcgcacaactcgagctctggaaggagaagaactctggcaagtacgagaagaaggtgtatgtcttgcctaagcacctcgatgagaaggttgccgcacttcaccttggcaagcttggtgccaagctcactaagctcagcaaggaccaggccgactacattagtgttcctattgagggtccttacaagcctgctcactacaggtattagagagagagggatgagacggagtcgactatgccacagccggatccttttgatcgcccaccgtctacagcttaatatgctgtaaggnattcagntntttncttttntcttatattgtctggtttttgttgggttttccggtatggggaaaggtggatggaaaaatgatagtcttgtacgaagacttaatttgaggttggataaggttggcttgtgttattattgctgcagctttttgggtgcatatgtttagattcttaattcttggcgaaaagaaaaacaaaagaaggttttccttgttcctttaataaagtccggtctttta

SEQ ID NO: 6130 - DNA, 1476 bp, Tragopogon dubius
agatggtgttcatgcaacattttttccactcaggatcacgccgccgctgccattgctccgtgattccgctgctgtgttcgcctgggaagggggagactctgcaggagtactggtggtgtacggaacgagctcttgattggggtcctggcggtggacctgatctaatcgtcgacgatggaggtgatgctacgcttttgatccatgaaggagtgaaagctgaagaggagtttgcgaagaccgggaattgcctgatccgagctccaccgacaaccctgaattccagatcgtgttgtcgattatcaaagaagggttacagattgacccgaagaagtaccacaagatgaatgaacggttggtcggtgtatcggaggagaccacaaccggcgttaagaggttgtaccagatgcaggccaatggtacattgctcttccctgcaatcaatgtcaatgattccgtcaccaagagcaagtttgataacttgtacggctgccgccactccctcccggacggattaatgagagccaccgacgtcatgatcgccggaaaggtcgcagtagtctgcggttacggagacgtcggaaagggatgtgccgcagccatgaaacaagcaggcgccagagtcataataacagaaatcgaccccatctgcgcccttcaagctctaatggaaggtctccaagtcctaacactagaagacaccctctcagaagccgacatcatcatcaccaccacaggtaacaaagacataatcatggtcgaccacatgaagaagatgaagaacaacgccatcgtctgcaacatcggccatttcgacaacgaaatcgacatgctaggtctcgaaacatacccaggtgtgaaaagaatcacaatcaaaccccaaactgacagatgggtgttcccagaaaccaaaagtgggatcattgtgctagcagaagggaggctgatgaacttgggttgtgctacagggcaccctagtttcgtaatgtcttgttcgtttactaaccaggtgattgcgcagcttgagctatggaaggagaaaggaagtgggaagtataagaaggaagtttatgttttgccgaagcatcttgatgagaaggtggctgcacttcatctgggtaaacttggagctaagctcacgaagctgagcaaggatcaggctgattacattagtgttccggttgaaggtccatacaaacctgcaaattacaggtactgagcttactacattcatggctattaatggagatataaatcatgtggggatcatataatatatatagtatatcgtttgatttcggtggcggttggtggttggtggcggttggagagaattgattattttcttgggggtttaaataagggtagagtatgtaggtggtgttaacattatttttttaccggcaaaatgaaaggggaaaaggaagttatagaaatattgtatttgtcaaaatcaatataaaaagagtaatatattgg

SEQ ID NO: 6131 - DNA, 626 bp, Triticum aestivum
cacatgagaagatgaagaaaaccccaatgttgacaaattgtcaattgacaaataaatcaaaatgaacggccttaaaacctaacctgggtcaagcgaattaccataaagccccagactgaccgttgggttttccccgagaccaagaatggaatcattgttcttgctgagggtcgtctgatgaaccttggatgtgccactggccaccccaactttgtcaagtcctgctcattcaccaaccaggttattgctcagcttgagttgtggaacgagaaggccagtggcaagtatgagaagaaggtgtacgttctccccaagcaccttgacgagaaggtcgcggccctccaattgggcaagctcggcgccaggctgaccaagctcaccaagtcccagtctgaataaattagcatcccaattgagggtccttacaaacctgcggcttaccggtaaaaaagtgtccagcaagaataacggctggcctgagcctgaatcggaaaaacggcaccaacgggaaatctatcaaatatcctgtttcccttctaatatctaaaaagctgtctcttaggcggaggaattgttaataaggttaagttttgaaccttgtgaaggttgggaaaggcggcgtttgc

SEQ ID NO: 6132 - DNA, 1298 bp, Flaveria ramosissima
atcaccggatcactgcacatgacgattcaaaccggtgtgttgatcgaaaccctaactgcattgggcgctgaagtgagatggtgctcgtgcaacatcttctcgacgcaggaccacgctgcggcggcgatcgcacgtgactccgccgcggtgttcgcgtggaagggagaaacgctgcaggagtactggtggtgtacggaacgagcgcttgattggggccctggtggtggaccggatctgattgttgatgatggtggtgatgcgacgttgttgattcatgaaggtgtgaaggctgaagaggagtttgagaagagtgggaagctgccggatccgaactcgactgataacgctgagtttcagatcgtgttgtcgattattaaggaggggttgcagagtgacccgaagaagtgtcacaggatgaaggataggttggttggtgtgtcggaggagactaccactggtgttaagaggttgtatcagatgcaagctaatggaaccttgctgttccctgcgattaacgttaatgactccgttactaagagcaagtttgacaacttgtatgggtgccgccactcactcccagacggactgatgagagccactgatgttatgattgccggaaaggttgcagtagtctgcggttatggtgatgtcggcaagggttgtgccgccgccatgaaacaagccggtgcacgtgtcatagtgacagaaatcgaccccatttgtgcccttcaagctctcatggaaggcctccaagtcctaaccctagaagacgttctctcagaagctgacatctttgtcaccaccacaggcaacaaagacattatcatggttgaccacatgaaaaagatgaaaaacaacgccatcgtctgcaacatcggccatttcgacaatgaaatcgacatgcttggtttggaaacatacccaggcgttaagagaatcaccatcaaaccccaaaccgacaggtgggtattcccagaaaccaacactggcatcattgtgctagccgaaggtcggctcatgaacttgggttgcgccactggtcaccctagtttcgtgatgtcgtgctcgttcacaaaccaagtgatcgcgcagctcgagctgtggaaagagaagtcatcagggaagtacaagaaggaagtatatgtgttgccgaagcatcttgatgagaaagtggctgcacttcatcttggaaagcttggagccaagctgactaagcttagccaggaccaagctgactacatcagtgtgccagttgagggtccatacaagcctgctcactataggtactgagtatgttt

SEQ ID NO: 6133 - DNA, 1124 bp, Flaveria ramosissima
gggccctggtggtggaccggatctgattgttgacgatggtggtgatgcgacgttgttgattcatgaaggtgtgaaggctgaagaggagtttgagaagagtgggaagctgccggatccgaactcgactgataacgctgagtttcagatcgtgttgtcgattattaaggaggggttgcagagtgacccgaagaagtatcacaggatgaaggataggttggttggtgtgtcggaggagactaccactggtgttaagaggttgtatcagatgcaagctaatggaaccttgctgttccctgcgattaacgttaatgactccgttactaagagcaagtttgacaacttgtatgggtgccgccactcactcccagacggactgatgagagctactgatgttatgattgccggaaaggttgcagtagtctgcggttatggtgatgtcggcaagggttgtgccgccgcgatgaaacaagccggtgctcgtgtcatagtgacagaaatcgaccccatttgtgcccttcaagcactcatggaaggcctccaagtcctaaccctagaagacgttctctccgaagctgacatctttgtcaccaccacaggcaacaaagacattatcatggttgaccacatgaaaaaaatgaaaaacaacgccatcgtctgcaacatcggccatttcgacaatgaaatcgacatgcttggtttggaaacatacccaggcgttaagagaatcaccatcaagccccaaaccgacaggtgggtattcccagaaaccaacactggcatcatcgtgttagccgaaggtcggctcatgaacttgggctgcgccactggtcaccctagtttcgtgatgtcgtgctcgttcacaaaccaagtgatcgcacagctcgagctgtggaaagagaagtcatcagggaagtacaagaaggaagtttatgtgttgcctaagcatcttgatgagaaagtggctgcacttcatcttggaaagcttggagccaagctgactaagcttagccaggaccaagctgactacatcagtgtgccagttgagggtccatacaagcctgctcactataggtactgagtatgtttcaaagatgaattgcttcatatgcctattgattattatg

SEQ ID NO: 6134 - DNA, 1310 bp, Flaveria ramosissima
gattggggccccggtggtggacccgatctgatcgtcgacgacggtggcgatgcgacgctgctgattcatgaaggtgtgaaggcggaggaggagtttgcgaagacggggaagctgcccgatccggcgtccaccgataacgcggagtttcagatcgtgttgtcgatcattaaggagggtttgcagagtgatccgaagaagtatcataagatgaaggagagattggttggtgtctcggaggagaccaccactggtgttaagaggctgtatcagatgcaagcgaatgggactctgttgttccctgctattaacgtcaatgactctgttactaagagcaagtttgacaatctgtatggttgtcgtcactctctccctgatggtttgatgagagccactgatgtcatgatcgccggaaaggttgccgtggtctgtggttatggtgatgtcggaaagggttgtgctgctgcgatgaaacaagctggtgcgcgtgtgatcgttacagaaatcgaccccatctgcgcacttcaggccaccatggaaggactccaagttcttactttggatgatgtagtttcagaagctgatatcttcgtcaccaccaccggcaacaaagacatcatcatggtttccgacatgaagaagatgaaaaacaacgcgatcgtgtgcaacattggtcattttgataatgaaatcgacatgcttggacttgaaacctacccgggtgtcaagagaatcaccatcaagccccaaaccgacaggtgggtcttcccagaaaccaacactggcatcattgtgttagccgagggtcggctcatgaacctagggtgtgctactggacaccccagtttcgtgatgtcgtgctcgttcactaaccaagtgatcgcccagcttgagctctggaaggaaaagaacaccggcaagtacaagaaggaagtgtatgtgttgccgaagcatcttgatgagaaggtggctgcacttcatcttggaaagcttggagccaaattgaccaagttgaccaaggaccaggctgattacatcagtgtgccggttgagggcccatacaagcctgctcactacaggtactagacgggtcggttttttgggcgaatttgcagagggggtgatgtgattgttgctttctttataagatacgagtatgtgttagggttttgttttgtttgttacgttgattgggatgttggcgaggaagaaaccgaggggtcgtttcatgatgagtcgatgtcggtttgaataaggattgcgtgtgaaggttgtgtaactcttatggtagttgttttttggttagtaggttt

SEQ ID NO: 6135 - DNA, 1015 bp, Flaveria ramosissima
ttgtcgattattaaggaggggttgcagagtgacccgaagaagtatcatagaatgaaggataggttggttggtgtgtcggaggagactaccactggtgttaagaggttgtatcagatgcaagctaacggtaccttgttgttccccgcgattaacgttaatgactccgttactaagagcaagtttgacaacttgtatgggtgccgccactcactcccagatggactgatgagagccactgatgttatgattgccggaaaggttgcagtagtctgcggttatggtgatgtcggcaagggttgtgccgccgccatgaaacaagccggtgcacgtgtcatagtgacagaaatcgaccccatttgtgcccttcaagctctcatggaaggcctccaagtcctaaccctagaagacgttctctccgaagccgacatctttgtcaccaccacaggcaacaaagacattatcatggttgaccacatgaaaaagatgaaaaacaacgccatcgtctgcaacatcggccatttcgacaatgaaatcgacatgcttggtttggaaacatacccaggcgttaagagaatcaccatcaaaccccaaaccgacaggtgggtattcccagaaaccaacactggcatcattgtgctagccgagggtcggctcatgaacttgggttgcgccactggtcaccctagttttgtgatgtcgtgctcgttcacaaaccaagtgatcgcgcagctcgagctgtggaaagagaagtcatcagggaagtacaagaaggaagtttatgtgttgccgaagcatcttgatgagaaagtggctgcacttcatcttggaaagcttggagccaagctgactaagcttagccaggaccaagctgactacatcagtgtgccagttgagggtccatacaagcctgctcactataggtactgagtatgtttcaaacatgagttgctttatatgcctattgattattatggtgtttggtggttgagttcttgaaagatcatcatcatgtgtg

SEQ ID NO: 6136 - DNA, 862 bp, Fraxinus spp
gctatcaatgtcaatgactctgtcaccaagagcaagtttgataacttgtatggatgccgccactcatccctgatggctaatgagagcaccgatgtgatgattgctggaagttgccgttgtatgtggttatggtgatgttggcaagggctcgtgcctgctgccttgaagcaagctggtgctcgtgtgatcgtgactgagattgatccaatctgtgctcttcaggccctcatggaaggactccaaattctaaccctcgaggacgtagtctctgaagctgatatctttgtcaccaccaccggtaacaaggacatcatcatggttgatcacatgaaaaagatgaagaacaatgccatcgtttgcaacattggtcactttgacaatgaaatcgacatgcagggtcttgagacctaccctggggttaagagaatcaccattaagcctcaaacagacagatgggttttcccagaaacaaaaacaggcatcattgtcttggcggagggtcgtctaatgaacttgggttgtgccacaggacaccctagctttgtcatgtcatgctctttcactaatcaagttattgcccaacttgagctgtggaaggaaaagagcaccgggaagtacaagaaggaggtttatgtcttgcccaagcaccttgacgagaaggttgccgcacttcaccttggaaaacttggtgctaagctcactaagctttccaaggatcaggccgactacattagcgtagcaattgagggtccttacaaacctccaaattacaggtactgaggaaggcagaaagtgaattggttataaaccaaccatatacttgaagaatgtggtgattgtttttcattattgtattatttct

SEQ ID NO: 6137 - DNA, 1104 bp, Phalaenopsis aphrodite
ggcggaggcccggatctcattgtcgacgacggcggtgatgcgacacttcttatccatgagggagttaaggctgaggaggagtacgagaagaacgggaaaattccagatccggcttctacggacaacgcggagttccagatcgtgcttgggctcatcagggatagcttaagcgtcgatccgaagaaatatcggaggatgaaggagaggctcgttggcgtctctgaggagacgaccaccggagtgaagaggttgtaccagatgcagtacagtgggacccttcttttccctgccatcaacgtcaatgactcagttaccaagagcaagtttgataacctatatggttgccgtcactctctccccgatggcctaatgagagccaccgatgtcatgatcgccggcaaggtagctgttgtttgcggctacggagatgtaggcaagggttgtgccgcggcactcaagactgccggtgctcgtgtcatcgtcactgagatcgacccaatatgtgcccttcaggccctcatggaaggcctccctgtcctccgccttgaggacgtcgtgtccgaggctgacattttcgtcaccaccaccggcaacaaggacatcataatggttgacacatgaggaagatgaagaacaatagccatcgtctgcaacattggccacttcgacaacgagattgatatgctcggactcgaatcattccccggtgtcaaacgtatcaccattaagccgcagacggatcggtgggtccttccctgactcaaatagtggcatcctcgtgctggcggagggccgtctgatgaatctcggatgtgccacgggtcaccccagctttgtcatgtcgtgctcttttacgtaaccaggtaattgctcagctggagctgtggaaggagagggcgtcgggaaagtatgagaagaaggtgtatgtgttgccgaagcacctggatgagaaggttgcagcacttcatttaggcaagcttggggccaagctcaccaagcttactccttcgcaggctgattacatcagcgttccggtcgagggtccctacaaaccagcccattacaggtattagagaattttaatgtgaggaaactgaatctgtt

SEQ ID NO: 6138 - DNA, 1067 bp, Scabiosa columbaria
gaggctttaccaaatgcaggctaatggaactcttttgttccctgcaatcaatgttaacgactccgttaccaagagcaagtttgataacttgtacgggtgccgccactcgctccctgatggtctcatgagagctactgatgttatgattgccggtaaagttgctgttgtctgtggatatggtgatgtcggcaagggttgtgcctctgcaatgaaacaagctggtgcacgagtcattgtgaccgaaattgatccaatttgcgccctacaagccctaatggaaggaattccagtcctcacattggaagacgttgtctctgaagctgacatcttcgtcaccaccactggtaacaaagacatcataatggttgaccatatgaggaagatgaagaacaacgctattgtatgcaacattggtcatttcgacaatgaaatcgatatgctcggtcttgagacttatcctggtgtaaagagaatcacaatcaagccacaaaccgaccgttggatcttcccagagactggcaccgggatattggtcttagccgagggacggttgatgaacttgggttgtgccaccggtcaccctagctttgtgatgtcttgctctttcactaaccaggtgattgctcagcttgaactgtggaacgagagggctagtggaaagtatgaaaagaaagtttacgttttgcctaagcatctcgatgagaaggtggctgcacttcatcttgggaagcttggagctaagctcactaagctatctcctgagcaatctgcttatatcagtattccaattgaagggccttacaaaccaccacactacaggtactaaggttttgaggagggggagaaagcgcggataatgtgttcaagtttatgggtctgtatggcctttatgttatctttgggttttgttattttaaactaatgttaatgttgtaggtcttgttgtttcctttcgttggatggtagttacggttgttttaaggtttcattgattgttgggagtgggttatgagtttgcaatttgttgtggctcaagccagattcttttcctttaatgaatatcagcc

SEQ ID NO: 6139 - DNA, 469 bp, Artemisia annua
gctatcgtctgcaacattggtcacttcgacaatgaaatcgacatgcttggacttgagaactacccaggtgtcaaaagaatcaccatcaaaccccaaaccgacaggtgggtattcccagaaaccaagaccggcatcatcatcttggccgagggtcgtctcatgaacttgggctgtgccactggtcaccccagtttcgtgatgtcgtgctcgttcaccaaccaagtgattgcccagctcgagctatggaacgagaggaacagcggaaagtacaagaaggaagtgtatgtgttgccaaaacatcttgatgagaaggttgctgcactccatcttggaaagcttggagctaagttgaccaagttgagcaaggaccaagctgactacatcagtgtaccagtcgagggaccatacaagcctcttcactacaggtattgagcggcgttggcttttggtgatatgatttggatgttgg

SEQ ID NO: 6140 - DNA, 1239 bp, Persea americana
gactctgtcaccaagagcaagtttgataacctgtatggatgccgccactccctccctgatggtctgatgagggccactgatattatgatcgcgggcaaggttgcagttgtttgtggatatggagatgttggaaagggctgcgcatctgccctcaagcaggctggtgctcgtgtgattgtgacagagattgaccccatctgcgccctccaggcactgatggaaggcatcccagtactcacccttgaggatgttgttgccgaagctgacatttttgtgacaacaactgggaacaaggacattatcatggtagatcacatgaggaagatgaagaacaatgccattgtctgcaacattggccattttgacaatgagattgacatgcatggactggagactttcccgggtgttaagcgcattaccatcaagccgcagaccgaccgatgggtcttcccaggcaccaacagtgggatcattgttcttgcagagggtcggcttatgaaccttgggtgcgcaactgggcaccccagttttgtcatgtcctgctccttcaccaatcaggtgattgctcagctggagttgtggaatgagagggcaacaggcaagtatgagaagaaggtatatgtgctgccaaaacatttggatgagaaggttgcagcactccacctgggcaagcttggggctaatttaaccaagctcacgccagcacaggcagagtacatcagcgttccggtggaaggtccttacaagcctgctcactataggtactgaaggaaaggcgaaagaaacggtgataacgagtgagaaagtggtcatcacctgtaagagcttgaggaggagtttagctcatgtaggtagcattgtgcttggagcattttgagcagtacttggactccaacttggagtgtgccttggagcattttgagtacatttagtggagtccaacttggaagatgctgtggaagatgaattgatagatttttcttatctttttttaatatttttagttttaatattatttttcttatcttgggttattacccattattggtagacttatagttccttgcattcaacactcttacagttccttgttagtgaaagtgttattgtgggcttcctttgatgtgttgtggattaataagcattgcttcaatatgtgaaagggttcagagtaatgcaactgaggtgtttggcatgtgagtggactaattgactaaatcattcacatataaatttatt

SEQ ID NO: 6141 - DNA, 793 bp, Guizotia abyssinica
atacggaggtgtccaagagggttgtgctgccgcaatgaaacatgctggtgcacgtgtcatcgttacagaaatcgaccccatctgcgccctccatgccaccatggaaggactccaagtccttactcttgaagacgtagtctccgaagctgacatcttcgtcaccaccaccggaaacaaagacatcatcatggtttccgacatgaaaaagatgaagaacaacgccattgtctgcaacatcggtcacttcgacaatgaaatcgacatgcttggacttgaaacataccctggtgttcaaagaatcaccatcaaaccccaaaccgacaggtgggtattccccgaaaccaagaccggaatcattgttctagctgagggtcggctcatgaacctggggtgtgccactggtcaccccagtttcgtcatgtcgtgctctttcactaaccaagtgatcgcccagctcgagctctggaaagaaaaggacaccgggaaatacaagaaggaagtgtatgtgttgccaaagcatcttgatgagaaggtggctgctcttcatcttggaaagcttggagccaagctgaccaagttgtcaaaggaccaggctgactacatcagtgtgccggttgagggtccatacaagcctgctcactacaggtactaaacagatagggtttttggcggatttgaagagagggtgatgcgattgttgctttctttatatgatacaagtcgagtatgtgttagattttggctttgtttgttgctttggtcgggggtgttggcgaagaagaaccgactggct

SEQ ID NO: 6142 - DNA, 744 bp, Liriodendron tulipifera
  misc_feature (486)..(486): n is a, c, g, or t
  misc_feature (506)..(506): n is a, c, g, or t
  misc_feature (509)..(509): n is a, c, g, or t
caccgatatcatgatcgccggcaaggtcgctgtagtatgtgggtacggagatgtcggcaagggctgtgctgctgccctcaagcaggctggtgcccgtgtgatcgtgaccgagatcgaccccatctgtgctctccaggccctgatggaaggcatccctgttttgactcttgaggacgtggtctcagagactgatatctttgtgacgacgaccggtaacaaggacatcatcatggtggaccacatgaagaagatgaagaacaatgccatcgtgtgcaacattgggcactttgataacgagattgacatgctggggctggagtcatacccaggtgtcaagcgcatcaccatcaagccacagacggaccggtgggtcttccctgaaaccaattccggcatcattgtccttgctgagggccgtctcatgaaccttgggtgtgccactggccaccccagctttgtcatgtcctgctccttcaccaaccaggngatagcacagctggagctgnggnaggagagatcatcgggcaagtatgaaaagaaggtctacgtgctgccgaagcacctcgatgagaaggtggcggcactccaccttggcaagcttggagctaagctaaccaagctttctcaggaccaggccgactacatcagcgtccctgtcgagggcccttacaagcctcctcactacaggtactgaagcaacaaaacagagagagagagagagagagagagagagagagagagaga

SEQ ID NO: 6143 - DNA, 1312 bp, Medicago truncatula
aaccgccttaggtgctgaagtccgttggtgttcctgcaacattttctcaactcaagaccacgccgccgccgccatcgctcgtgacagcgccgccgttttcgcctggaagggtgagactcttcaagagtactggtggtgtactgaacgtgctcttgactggggtccaggtggtggtcctgatttgattgttgatgatggtggtgatgctactttgttgatccatgaaggtgttaaggctgaagagctttatgagaaaactggtgaggttcctgatccaagttctactgataacgctgagtttcagcttgtgcttactatcattagagatgggttgaagactgatcctaagaggtatcgtaagatgaaggatagacttgttggtgtttctgaagagactactactggtgttaagaggctttatcagatgcaagctagtggaactcttttgttccctgctattaatgtcaatgacttcttgatgatgttgtctcttatgctgacatctttgttaccaccaccggtaacaaggacatcatcatggttgatgacatgaggaaaatgaaaaacaatgccattgtttgcaacattggtcactttgacaatgaaattgatatgtctggacttgagaactaccctggtgtgaagcgcgtcaccatcaagcctcaaaccgacaggtgggttttccccgagaccaacaccggcatcattgtcttggccgagggtcgtttgatgaacttgggttgtgctactggacaccctagttttgtgatgtcctgctccttcaccaaccaggtcattgctcagcttgagttgtggaatgagaggaaatctggaaagtatgagaagaaggtttacgttttgcctaaacatcttgatgagaaggtcgcggcacttcatcttggcaagcttggagctaaactcaccaagctttcccaatcacaggctgattacatcagtgtgccagttgagggtccatacaagcctgctcactacaggtactgagagatgatcaaggtggtgattagaggtcgagggaaaaaggaaatgtgttttatgaaatggattgatttttcattttcattttccttgtttgattttttggaattagactttttcagaattgtggtagagtaggtttttgtaatgttaacagtgggtggggaatggtaagaggaaggcaacctactggtttcttgaatgagaccaaatgggtttgaataatgccttgtttggggattgtgtgtcaattatgctgaatttgagtttctgtagacctttaatgtttgaaaaaatgagaaaattattttcttgc

SEQ ID NO: 6144 - DNA, 1179 bp, Nuphar advena
taccacaagatgaaggacacgctcgtcggcgtctcagaggagaccaccacaggcgtcaagaggctctaccagatgcagaccaacggcacgctcctgttcccggccatcaacgtcaacgattccgtcacaaagagcaagtttgacaacttgtatgggtgcagacactcactggcctgatgggctgatgagggctactgatgtgatgattgctggcaaggttgcagtggtctgtggttatggtgatgttggcaagggctgtgctgctgccttgaaacaggcaggtgctcgcgtcattgtgacagagattgaccccatctgtgctctccaggcactcatggagggtcttcaagtactcacccttgaggatgttgttgctgaggctgacatctttgtcaccaccaccggcaacaaggacatcatcatggtgaagcacatgaagcagatgaagaacaacgccatcgtatgcaacatcggccacttcgacaatgaaattgatatgctcggattggaaacatacccaggcatcaagcgcatcacaatcaagccccagacggatcgctgggttttcccggagactaacaggggcatcattgtcctggctgagggtcgtctgatgaaccttggctgtgctactgggcaccccagctttgtcatgtcctgttccttcactaaccaggtgattgctcagctggagttgtggaaggagaagggcactgggaaatacgagaagaaggtctatgtgttgcccaaacacctagatgagaaggtcgctgctctgcatttaggcaagcttggtgcccatctaaccaagctcacccctgaacaggctgattacatcaatattcctgtggaaggtccctacaagccaccacactacaggtactaggtaaccaagaaggagttgctgcttatctttatgccttccgactgcaagtttttcgcattcctttttggtttcttttttttttccgggtttctttagtggttttttgtgggctatggtggagttctttctttgtttcttttggatgttgccgagggactgttccaatgagaatgtagagaggatggtttagttgttgctgtagttgtgcaacattgaaatcatcattgggggactacgagatgtctaatgatgtaataccattgtcattcaccagtattaatgtttgtcatctt

SEQ ID NO: 6145 - DNA, 1229 bp, Ananas comosus
ctcatcagggacgggctcaaggtggatccgagcaagtaccggaagatgaaggagcgcctcgtcggcgtgtcggaggagacgaccaccggggtgaagaggctctaccagatgcaggcgagcgggaccctgctgttccccgccatcaacgtcaatgattccgtcaccaagagcaagttcgacaacctctatgggtgccgccactctcttcctgatggcctgatgagggcgaccgacgtgatgatcgccgggaaggctgctgtggtctgcggctatggtgatgttggcaagggctgtgctgctgccttgaagcaggctggggcccgtgtgatcgtcactgagattgaccccatatgcgccctccaagccctgatggagggcatccctgtgctcactttggaggatgtcgtctccacggctgatatcttcgtcaccaccacgggcaacaaggacatcatcatggtggaccacatgaagcagatgaagaataatgctattgtttgcaatattgggcacttcgataatgagatcgatatgcacgggttggagacctacccaggtgttaagcgcatcaccatcaagccacagactgatcggtgggttttccccgagaccaattctgggattattgttcttgctgaggggcggctcatgaaccttgggtgtgcaacaggtcaccccagcttcgtcatgtcctgctccttcactaaccaggtgattgctcagctggagctgtggaaggagagaaagagcggcaagtatgaaaagaaggtgtatgtccttccgaagcatctcgacgagaaggtcgcggccctccacctgggcaagcttggtgccaagctaaccaagctctccccgtcccaggccgagtacatcagcgtcccaatcgagggcccctacaagccccctcactacaggtactaaaccctaatattatgcccaagagaggaggtatacttatcgaaaactgcggcatcaacttgttcatcactccctctttttcccttttaattattgttattgttatgcctttaggataagtgttgttctgcatgtttttgtgtttcaatggcgaggagatgagttatcagtattcagtttggaaggaataatgagtgtgggttgtgactgtaaggagggggtgttttatggccagatacttttttgtgtctttggcgctcgctccttttcctattattttgcaatgcaatcaattgatctccgatttaatc

SEQ ID NO: 6146 - DNA, 904 bp, Salvia sclarea
cacgaggcctcgtgccgaattcggcacgagggatgtgatgattgccggaaaggtcggcgtggtgtgtggttacggagatgtgggaaagggctgtgccgctgcgttgaaacaggccggtgctcgtgtgattgtgactgagatcgatcccatctgcgctctccaagccctcatggaagggttccaagtcctaaccctcgaggatgcagtctccgacggtgacatcttcgtcaccaccaccggcaacaaggacatcatcatgctcgaccacatgaggaagatgaagaacaacgccatcgtctgcaacatcggccactttgacaatgagatcgacgtgcagggcctggagaccttcccgggtgtgaagagggtcaccatcaagccacagacggacagatggatcttcccggacaccaagaacgggatcatcctcctggctgaggggcggctgatgaacttggggtgcgccacggggcaccctagctttgtcatgtcatgctccttcaccaaccaggtgatcgcgcagcttgagctgtggaatgagaggaagtcgggcaagtacgagaagaaggtgtacgtgctgcccaagcaccttgacgagaaggtggctgccctccacctcgcgaagctaggggcgaagctcacgaagctcagcaaggagcaggcggactacattagcgtgccggttgagggaccttacaagcctctacactacaggtactaagggaaaagaagcagcatctgagaaaaaagaagggcctagtgatcattgttgtttctgattgtgtgttagctttctagtttctaagtttttgtttgaggtgtttgttgccgcagcagttaccatttaccatgttgggttgggtttgcaactattggccaaaataacttcaggatgttctctcct

SEQ ID NO: 6147 - DNA, 1682 bp, Saccharum officinarum
tcgttcgcctgcagccaccggcccggatttccgggttgagccacgcgttcgctcccctccgtccgttccattcctgcttgctcgcagtcccagatccatttcgcgacttctccctccgccgctgccatggcgctctctgtggagaagacctcgtctgggcgggagtacaaggtcaaggacctctcgcaggcggacttcggccgcctcgagatcgagctggccgaggtcgagatgcccggtctcatggcgtgccgcgccgagtttggcccgtccaagcccttcgccggcgctaggatctcggggtcgctccacatgaccatccagaccgccgtcctcatcgagaccctcaccgcgctcggcgccgaggtccgctggtgctcctgcaacatcttctccacgcaggaccacgccgccgccgccatcgctcgcgactcggccgccgtgttcgcctggaagggggagaccctcgaggagtactggtggtgcaccgagcgctgcctcgactggggcgagggcggcggccccgacctcatcgtcgacgacggaggcgacgccacgctgctcatccacgagggtgtcaaggccgaggaggagtacgagaagaccggtaagatccccgacccggagtcaaccgacaacgctgagttcaagatcgtgctcaccatcatccgcgacgggctcaaggctgaccccaagaagtaccgcaagatgaaggagaggcttgtcggcgtctctgaggagaccaccaccggagtcaagaggctctaccagatgcaggagaccggcgccctcctcttccctgccattaacgtcaacgactccgtcaccaagagcaagtttgacaacctgtatggctgccgccactccctccctgatggtctgatgagggccacagatgttatgattgctgggcagggtgccgtggtctgtggatatggtgatgttggcaagggctgtgctccactttgaccaatgaaattgaaaggctcggtcctgagacccaaccctggtgttcaagggcatcaccatcaaagccccagactgacggctggctgttccttgagacaaacacgggcatcatggtccttgctgagggtcgcctaatgaaccttggatgcgctactggccatcctagttttgtcatgtcttgctcattcactaaccaggtcattgcccagcttgagctgtggaaggagaagagctctggcaagtatgagaagaaggtgtatgtgctccccaagcaccttgatgagaaggttgctgctctccacttgggcaagcttggtgccaagctgacgaagctcaccaagtcccaggctgactacatcagtgtgccgatcgagggtccctacaagcctgcccactaccggtactaggcagcgcagcacgacttgcagctcactccgccggttgtgtgctatgaagtttgctacaccggcctgtcagttatcttttgcatgcatatgcattgtcatatatgcagctgcgcaggaggatttgttatgattatcgcttgagctgaggggggaagcgaggagctgtttgctttggctgatgaataatggtgttattggctgggatgaggcgatgcgcgttgccagatacagttttgtcttgttgactctacttatctgattatcatttgtaagcgatttgctcaagttatgtgtcatttatgaata

SEQ ID NO: 6148 - DNA, 562 bp, Flaveria ramosissima
ccccaaaccgacaggtgggtcttcccagaaaccaacactggcatcattgtgttggccgagggtcggctcatgaacctggggtgtgctactggacaccccagtttcgtgatgtcgtgctctttcactaaccaagtgatcgcccaacttgagctttggaaagaaaagaactccgggaagtacaagaaggaagtgtatgtgttgcccaaacatctcgatgagaaggttgctgcacttcatctcggaaagcttggagccaagttgaccaagttgaccaaggaccaggctgattacatcagtgtgccggttgagggtccatacaagcctgctcactacaggtactagacgggtcgggtttttgggcgactttgcagagagggtgatgtgttgttgctttctttataagatacaatgagtatgtgttaggttttgttttgtttgttacgttaatcgggggtgttggcgtgtaagaaaccgactggtcatatctttatgagatgaccgttgatgtcggtttgaataagggttgtgtgaaggttgtgtaaacgccattgtagttgttttt

SEQ ID NO: 6149 - DNA, 661 bp, Fagopyrum esculentum
tgctattgtctgcaacatcggtcactttgacaatgaaattgacatgcttggactcgagagttacccaggtgtccagagaatcaccatcaagccacaaaccgacaggtttgtcttcccagacaccaagaagggggtcattgtcttagctgaaggccgtctcatgaacttgggttgtgccaccggccaccctagcttcgtgatgtcttgctcattcaccaaccaggtgattgctcagcttgagttgtggaaggagaaggcaactgggaaatacaagaaggaggtgtatgtgttgcccaaacatcttgatgagaaggttgcggctctccaccttggaaagcttggtgctaggctcaccaagctgtccaaggatcaggctgattacattagcgtggctgttgagggtccatacaagccacctcactacaggtactagagagagaagctggggatatttttccattgatcattcatggattactaaaatatgctgtaggtgcctagttgctttgatgttgttttggattttgagaagtttggatggaatgaaatgtttagtctctgttgaagactaatgggttgggattgttgtgtgttgtagttgttacaggcttgcaccctgtagttctctgctgctgcatctgttttgagctcaatccacaga

SEQ ID NO: 6150 - DNA, 1289 bp, Fagopyrum esculentum
cccggtggtggccctgacctgattgtggacgatggtggtgatgcaccctcttgattcacgagggtgttaaggccgaggaggagtatgccaagtctggcaagatcccagacccaagctccaccgataatgctgagttccagcttgttctgactattatcagggatgggttgacggctgaccccttgaagtaccacaagatgaaggataggttggtcggtgtttctgaggaaaccaccacaggtgtcaagaggctctaccagatgcaggctaacgggaccttgttgttccctgctatcaatgttaatgactctgtcaccaagagcaagtttgataacttgtacggatgccgccactctctccctgatggtctgatgagggccactgatgtcatgattgctggcaaggtcggtgttgtctgtggtttcggagatgtcggaaagggctgtgctgctgccttgaaagctgccggagcccgtgtgatcgtgactgagatcgatccaatctgtgctctccaggccctcatggagggataccaagttctcaccttggaagacgtggttgctgatgccgacatctttgtcaccaccaccggtaacaaggacattatcatgcttgaccacatgaggaagatgaagaacaatgctatcgtctgcaacatcggtcactttgacaatgaaatcgacatgcttggactcgagaactacccaggtgtccagagaatcaccatcaagccacaaaccgacaggtttgtcttcccagacaccaagaggggcgtcattgtcttagctgagggtcgtctcatgaacttgggttgtgccaccggacaccctagctttgtgatgtcttgctcgttcaccaaccaggtgattgctcagcttgagctgtggaaggagaaggcaaccggcaaatacaagaaggaagtgtatgtcttgcccaaacatctcgatgagaaggttgcagctcttcacctcggaaagcttggtgctaggctcaccaagctctccaaggaccaggctgattacattagcgtggccgttgagggtccatacaagccacctcactacaggtactagagagaagccggagatattttttccattgatcattcatggattactaaaatatgctgtaggtgcctagttttctttgatgtttctgtgtgggtttggattttgaaaagtttggatggaatgaaatgaaatgttgaagaccagtgggataggatcataggatggttttgttgtgtgttgtagttgttacaggcttgcagcctgtaattctctgcttct

SEQ ID NO: 6151 - DNA, 1385 bp, Amaranthus tuberculatus
ggtcctggtggtggtcccgacctcatcgtcgatgatggcggtgacgctaccttgttgatccacgagggagtcaaggctgaggaggagtatgagaagaccggtaaggttcccgaccctacctccacagataatgtcgagttccagcttgtcttgggtttgatccgcgacagcttgaaggtcgacccaaagaggtaccacaagatgaaggaaagattggttggtgtctccgaggagaccaccaccggtgttaagaggctttaccagatgcaggctaatggcaccttgcttttccctgccatcaatgttaatgactctgtcaccaagagcaagtttgacaacttgtatggatgccgccactccctcccagatggtttgatgagagccactgatgtcatgattgctggaaaggtcggtgttgtttgtgggtatggagatgtcggaaagggttgtgctcttgccttgaaggctgctggtgctcgtgtgattgtgactgagattgacccaatctgtgctcttcaagctcttatggaaggtttccaagtcttgaccttggaagacgttgtctccgaggctgacattttcgtcaccaccaccggtaacaaggacatcatcatggttgaccacatgaagaagatgaagaacaacgccattgtttgcaacattggtcactttgacaatgaaatcgacatggcaggtcttgagaactacccaggagtcaagaggatcaccatcaagcctcaaacagaccgatttgtcttccctgagaccaacactggaatcattgtcttggctgagggtcgtctcatgaacttgggttgtgcaaccggtcaccctagctttgtcatgtcttgctcattcaccaaccaagtcattgctcaactcgagttgtggaatgagaaagcatccggaaaatataaaaaggaggtatatgtcttgcctaagcacctcgatgagaaggttactgcccttcaccttggcaagctaggtgctaagctcaccaagctctctaaagatcaagccgactacatcagtgtgccagttgagggtccatacaagccagctcactacaggtattagagcaggaacgtgaagattgtggcttatcggacattctgagaggaaagggacccctgttccaaatatcataattttcgcctagggtgttagttcatgttttttcttcgttgttgggtgggtcagaaagattggaaggacaaacaaagtatcaatgtgttttgaattatgtccgaatggggcttgaataaggcaatgtttaaatgtttaggctttgtttttgtaatcgcttgcccgacttgcttgctgttgtttagcattgtagttggtcttgctatagtttttctgttaatgaagagaatgagttgtca

SEQ ID NO: 6152 - DNA, 779 bp, Cryptomeria japonica
tcacttcgataatgaaattgacatgcatggacttgaaacctaccctggtgtcaagaaggtaaccatcaagcctcagactgaccggtgggtgttccctgaaaccaacagcggcatcattgtccttgcagagggacgtctcatgaacttgggttgtgctaccggccacccaagttttgtcatgtcatgttccttcacaaatcaggttatcgctcagctggagctttggaatgagaggaaaacagggaagtatgagaagaaggtttatgtgctccccaagcatttagatgagaaggtggctgctctgcacttgcccaagctgggtgccaaactaacaaaactttccccagatcaggctgcctacatcaatgtgcctatcgagggtccttacaagcctgtccactaccgatactgagcaaagcatgtctttgacatgactaattagtgcagggcagctgttttgagaatatgcttaggaagcgaagactattcttggcttctttattgctttccttatacctctaataaaagcaagaggtctattctactgcaggcaaatctgctctttactacggcatacctcatattaaacaagaggtctgatgtgtttcaggtgtatctgctagtttacttaaacagcaccttcaatttctactttccagttatgtcatagaatagaagagttccgattttagaatctgtatgcatgacttgttcatcgtttgggctgcgaaggccgaaatctttaatggaacacagaaattcaaaataatctatgtgtc

SEQ ID NO: 6153 - DNA, 892 bp, Cynara scolymus
  misc_feature (142)..(142): n is a, c, g, or t
gtcattgtcacagaaatcgaccccatctgtgcccttcaggccaccatggaaggtctccaagtccgaaccttggaagacgtcgtctcagaagccgatatcttcgtcaccaccaccggcaacaaaggcatcatcatggtcgcgncatgaggagatgaagaaaacgccatcgtctgcaacattggacatttcgacaacgaaatcgacatgcttggactcgaaacctaccctggtgtgaagcgcatcaccatcaaaccccaaaccgacaggtgggtgttccccgaaaccaacacgggcatcatcatcttggctgagggtcggctgatgaacttgggttgtgccaccggccaccccagcttcgtgatgtcatgctcattcaccaaccaagtgattgcccagcttgagctatggaaggagaagagcagtgggaagtacgggaaggaagtgtatgtgttgcccaaacatcttgatgagaaggtagctgcccttcatcttgaaaagcttggagccaagctgaccaagctgagcaaggatcaagccgactatatcagtgtgccagtcgagggtccatacaagccagctcattacaggtactaagctgtgattttgggggcaatctgaagagggttatatgtgattgctttatgcctacaagatacaatttgattatgtgttgttagctttggtgatttttatggggttgtgttggtgggaaagtaagtgaatggtgtttctttgttgaaaggccattgaataagggtttttgagtgtgaaagggttgtgtaacaccacttgtagtagggtttttttggggttatttataggtttttgcttgcagtcttttgtcacttgaattcatgaggaaatcaaagaaaaggagaagacttttttctac

SEQ ID NO: 6154 - DNA, 1358 bp, Cajanus cajan
gggggggcgccgaggtccgctggtgctcctgcaacatcttctccacgcaggaccacgccgccgccgccatcgcccgcgacagcgccgccgtcttcgcctggaagggggagacccctccaggagtactggtggtgcaccgagcgcgccctcgactgggggccccggcggcggccccgacctcatcgtggacgacggcggcgacgccacgctcctcatccacgagggctcagggccaggagctctacgagaaaaccgggcagttgcctgaccctgcttccaccgacaacgctgagttccagatcgtcctcaccatcatcagggacggcttgaagaccgacccctcccgctaccgcaagatgaagaaccgtctcgtcggggtttccgaggaaaccaccaccggcgttaagaggctctaccagatgcaggccaatggcactcttctcttccccgctattaacgtcaacgactctgtcaccaagagcaagtttgacaacttgtatgggtgccgtcactctctccctgatgggttgatgagggctacggatgtgatgattgccgggaaggtggctgttgtgtgtggttatggtgatgttggcaagggttgtgctgctgcaatgaagcaggctggtgctcgtgtcatcgtgactgagattgatcccatttgtgcccttcaggcactcatggagggccttcaggttttgaccttggaggatgttgtgtctgaggctgatatcttcgtcaccaccaccggtaacaaggacatcatcatggttgaccacatgaggaagatgaagaacaatgccattgtctgcaacattggtcactttgacaatgagattgacatgcttgggctggagaactaccctggtgtgaagcgcatcaccatcaagccccagactgacagatgggtcttccctgagaccaacaccggcatcattatcttggccgagggtcgtttgatgaacttgggttgtgccactggacaccccagttttgtgatgtcatgctccttcaccaaccaggtcattgctcagcttgagttgtggaaagagaaggatagtggcaagtatgagaagaaggtttatgttttgcccaagcaccttgatgagaaggtggctgcacttcaccttggcaagcttggagccaagctcaccaagcttagccaatcccaagctgattacatcagtgtgcctgttgagggtccatacaagcctgctcactacaggtactaagattgagatcaagatcaccgatggagagttgggggggggggggaggaaaatggttttatgaaacggcttgattgtttgatttactttttgggaattttggtgttagacatgtggtagaagaaatgt

SEQ ID NO: 6155 - DNA, 932 bp, Pisum sativum
cgtaaaatgaaggagagacttgttggtgtttcggaagagactacaactggtgttaagaggctttatcagatgcaagccagtggaactcttttgttccctgctattaatgtcaatgactctgtcaccaagagcaagtttgacaacttgtatggatgccgtcactctcttccagatggtttgatgagggctactgatgttatgattgctgggaaagtgggtgttgtctgtggatacggagatgttggaaagggttgtgctgttgccttgaagcaagctggagctcgtgtgattgtgactgaaattgatccaatctgtgcccttcaggctctcatggaaggattccaggttctgactcttgacgatgttgtctcttatgctgatatctttgttaccaccactggtaacaaggacatcatcatggttggtgacatgaagaaaatgaagaacaatgccattgtttgtaacattggtcactttgacaatgaaattgatatgtctggtgttgagaactaccctggtgtgaagcgtatcaccatcaagcctcaaaccgacaggtgggttttccctgagaccaacactggcatcattatcttggcggagggtcgtttgatgaacttgggatgtgccactggacaccctagttttgtgatgtcctgctctttcaccaaccaggtcattgctcaactagagttgtggaatgagaggaaatctggaaagtatgaaaagaaggtttacgttttgcctaagcatcttgatgagaaggtggctgcacttcaccttggcaagcttggagccaaactcaccaagcttacccaatcacaggctgattacatcagtgtgccagttgagggtccttacaagccagctgcctacaggtactgaaaggtgatcaaggtggtgatgagattgagggacaagaaaattgattttat

SEQ ID NO: 6156 - DNA, 1751 bp, Phalaenopsis aphrodite
taatgttgtttaataattagttatgtagttaattttatgttttaatcaatattttaaatcatatagaagtgttatcaatattagattaaattactaacttaaacacagttagcatatagttgtcctgaccaatttctaattaatttagttaatttgattaattatttccctcagttttattttattccttgagtagttatttttattatagtttttaatgagtaattatgtaatattgtctccaattagcctatttaactttgatttaatacttatgactaattacttgtagttaattaatttacgttagcctttgcttcattaatatatgactaattaatttaatttattattataatcattttaaaattcaaacttgctataatttggcaaaaaataaaatgagaaatttacgatttggtttcgtttatgaaaaatgtgtacttcggttttaaaaatttagtaatagtagtatttcttatgcatattaaagattagagtgttacgcatataaatgaaaaagttttcgtgttatctactaaaacaagaattgtgtcccctgtatctaaatgagcaaaaaattgcaaaagtaaaaggactctatcttgcatctcttttttaacatatcctaattttttattgttttgttcatcttaaaacagtttgataacctatatggttgccgtcactctctccccgatggcctaatgagagccaccgatgtcatgatcgccggcaaggtagctgttgttgcggctacggagatgtaggcaagggttgtgccgcggcactcaagactgctggtgctcgtgtcatcgtcactgagatcgacccaatatgtgcccttcaggccctcatggaaggcctccctgtccctccgccttgaggacgtcgtgtccgaggctgacattttcgtcaccaccaccggcaacaaggacatcataatggttgaccacatgaggaagatgaagaacaatgccatcgtctgcaacattggccacttcgacaacgagattgatatgctcggactcgaatcattccccggtgtcaaacgtatcaccattaagccgcagacggatcggtgggtcttccctgactcaaatagtggcatcctcgtgctggcggagggccgtctgatgaatctcggatgtgccacgggtcaccccagctttgtcatgtcgtgctcttttacgaaccaggtaattgctcagctggagctgtggaaggagagggcgtcggaaagtatgagaagaaggtgtatgtgttgccgaagcacctggatgagaaggttgcagcacttcatttaggcaagcttgggccaagctcaccaagcttactccttcgcaggctgattacatcagcgttccggtcgagggtccctacaaaccagcccattacaggtattagagaattttaatgtgaggaaactgaatctgttggaacttctgttccattggattcaaaggaggaatcaacttcatacttatctttatcaagttatgctctatttatcctttaaacatggttaatgttgtgttgattgaagggggtgagtgtgattctgagaggaataatgaggtttgtgggttgtggcggaggcggtgtatcgtccctgagtatattcgggagactttttttgttttgtgtagcctttttctatatggggcttttggaggaaatttaatgaacttgtttgcaagatgctagttttgtttgaggtgggcattgtagtgtatcttcgacaccgactg

SEQ ID NO: 6157 - DNA, 842 bp, Musa acuminata
ggctcgggtcatcataactgagattgaccccatctgtgctcttcaggcactgatggaaggcctccctgtcctcactctagaggatgttgtttctgaggctgatatatttgtgacgaccaccgggaacaaggacattatcatggttgatcacatgaagaagatgaagaacaacgccattgtctgcaacattggccacttcgacaatgagattgatatgcaggggctggagacctacccgggcatcaagcgcatcaccatcaagccccagactgatcgctgggttttcccagagactagcactggcatcatagttctcgccgaggggcgtcttatgaaccttggttgtgccactgggcatcccagctttgtcatgtcctgctccttcaccaaccaggtgatagcacagctggagttgtggaaggagaggaaaaccgggaagtacgagaagaaagtctacgttctacccaagcatttggatgagaaagtcgcagcccttcacctcggcaagctgggagccaagctcaccaagctcactccgtcgcaagcgagtacattagcgtcccagtcgagggcccctacaagcctgttcactacaggtattaggatggcgcttatccaagagattatgacaaagcagtggcagtatcaatggtcgtgtttattttgcttggttatcttccttcttcctcgtattgctggtttccccgagtatgtgtttgatccgaatgttgtttaaggcatgcttacgaataattagggtaggaaagatgttgtaatggccaaatgagttattatctttggctcttttccattattaattgcatggatgatacgttttatct

SEQ ID NO: 6158 - DNA, 655 bp, Ipomoea batatas
cggcttacggccggggggagggctgtgctgcagctttgaagcaggctggtgcacgtgtgatcgtgactgagattgatccgatctgtgctctccaggccctcatggagggtctccaggttcttaccctcgaggatgttgtctctgatgctgatatccttgtgaccaccactggtaacaaggacatcatcatggttagccacatgaagaagatgaagaacaacgccatcgtttgcaacattggccactttgacaatgaaatcgacatgcaagggctcgagacgtaccctggcgtgaagaggatcaccatcaagcctcagacagacagatttgtgttccccgagaccaacaccggcatcattgttttggccgagggccgtctcatgaacttgggttgtgccaccggacaccctagcttcgtgatgtcctgctcctttaccaaccaaatcattgcccagcttgagctgtggaaggagaagagcaccggcaagtacgagaagaaggtttacgtcttgccaaagcacctcgatgagaaggttgctgcccttcatctcgggaagctcggtgccaggctcactaaacttagccccgaacaagctgcttacattagtgttccagttgagggtccttacaagcctcctcactacaggtactaagc

SEQ ID NO: 6159 - DNA, 578 bp, Arachis hypogaea
cgtgaagcgcatcacgataaagcctcagaactgacaggtgggtgttcccggagacgaactccggcatcatcgtgttggccgaagggcgtctgatgaaccttgggtgcgcaacagggcaccaagtttcgtgatgtcgtgttctttcacaaaccaagtgattgctcagcttgaactttggaaggagaaggggacaggcaagtatgagaagaaggtttatgttttgcccaaacaccttgatgagaaggttgcttctcttcatcttggaaagcttggcgctaaactcacaaggcttagcaaagatcaagctgattacattagtgtgcctgttgggggtccctataagcctgctcattataggtactaataacatgtcattatcatgatgattatgatgatattcatgtcaacaagtgccaaggactagattattatttcattcttttgtgtttttttggtagtggtagtttgttggatttttgttagggtgtgtttcatttggaatcttggaaagaacaagtgtagtggaaaatctatcaaatggatttgaataaggatttatcgttgggttttctgtttag

SEQ ID NO: 6160 - DNA, 953 bp, Brassica napus
actctcttacctgactagtgtcatcagggccgactgatgtcatggatcgccggaaacgggttaggtcgttgttacgtcgtcggagtatggtgatcgtggaaagggttaggtgccgcgtgccatgaagaccgctggtgctagagttattgtgacggagatcgatcccatctgtgccctacaggctatgatggaagggcttcaagttttgacccttgaggatgttgtttccgaagctgacatctttgtcaccaccaccggtaacaaaagacatcatcatggttgaccacatgaggaagatgaagaacaacgctatcgtccgcaacattggtcactttgacaacgagattgacatagcaaggacttgagaccttccctggagtgaagcgtatcaccatcaagccccagaccgacaggtgggcgttcccagacaccaagtccggaatcattgtttttggccgagggtcgtctcatgaacttgggttgtgccactggtcacccgagtttcgtcatgtcttgccctttcaccaaccaggtgattgctcagcttgagctttggaacgagaagtcgagcggcaagtacgagaagaaggtgtacgttctacctaagcatttggacgagaaggttgcagcacttcactgggaaagctggagctagctcaccaagttgcaaaggaccaatctgactacgtcaggcattcccactttcgtaagggacccattaccaagccctagtctcactacaggttactgagagtaagaaatggagagagcggtttatttctagtttggtcttctgatgaagttgaccgaatatccttctgtaataaggattcttgtctttttgattgttgtgcttgttctttttttttctgaatttatcttgaaacttaaattagcctttggttatttgattttgtgttgtgttcattgttctactctttaaaaatagaaac

SEQ ID NO: 6161 - DNA, 1226 bp, Phalaenopsis aphrodite
aaccgccctcggtgccgaggtacgctggtgctcctgcaacatttttctccacccaggaccatgctgctgccgcaatcgcccgtgattccgccgccgtttttgcttggaagggagagaccctttcagggagttactggtggtgcacggagcgctgcctagaatgggcgccggcggaggcccggatctcattgtcgacgacggcggtgatgcgacacttcttatccatgagggagttaaggctgaggaggagtacgagaagaacgggaaaattccagatccggcttctacggacaacgcggagttccagatcgtgcttgggctcatcagggatagcttaagcgtcgatccgaagaagtatcggaggatgaaggagaggctcgttggcgtctctgaggagacgaccaccggagtgaagaggttgtaccagatgcagtacagtgggacccttcttttccctgccatcaacgtcaatgactcagttaccaagagcaagtttgataacctatatggttgccgtcactctctccctgatggcctaatgagagccactgatgtcatgatcgccggcaaggtagctgttgtttgcggctacggagatgtaggcaagggttgtgccgcggcactcaagactgccggtgctcgtgtcatcgtcactgagatcgacccaatatgcgcccttcaggccctcatggaaggcctccccgttctccgccttgaggacgttgtgtccgaggctgacattttcgtcaccaccaccggcaacaaggacatcatcatggttgaccacatgaggaagatgaagaacaatgccatcgtctgcaacatcggccacttcgacaacgagattgatatgctcggactcgaatcattccccggtgtcaaacgcatcaccattaagccgcagacggatcggtgggtcttccctgacacaaatagcggcatcctcgtgctggcggagggccgtttgatgaatctcggatgtgccacgggtcaccccagctttgtcatgtcgtgctcttttacgaaccaggtgattgctcagctggaactgtggaaggagagggcgtcggggaagtatgagaagaaggtgtatgtgttgccgaagcacctggatgagaaggttgcggcgcttcatttgggcaagcttggggccaagctcaccaagctcactccttcgcaggctgattacatcagtgttccggtcgagggtccctacaaaccagccc

SEQ ID NO: 6162 - DNA, 698 bp, Primula obconica
aacaatgctattgtctgcaacattggtcatttcgataacgagatcgacatgcttgggcttgagacttacccgggtgtcaagagggtcacgatcaagcctcagaccgacaggtgggtcttccccgagactaacactggtatcattatcttggccgagggtaggctcatgaacttgggttgtgccactggacaccccagctttgtgatgtcttgctcgttcaccaaccaggtcatcgcccagctcgagctctggaaagagaaagatacaggcaagtacaaaaaagaggtgtatgtattgcctaagcatcttgatgagaaggttgcggctcttcaccttgagaagctcggggctaagcttaccaagctcagcaaggatcaagctgattacattagtgtccctgttgaaggtccttacaagcctgctcactataggtactgaggggcataatagaccagggataaagtcttggttgttgaggaactcggtgattgttttcgataacaactttatttctttagtgtttttttttgtcatgaattatttgtttgggtgacagaggtttgagaggaaagaaatggtcactttctttgtgaaaagaaggccaagtgtggtaaaaataaaagggttgtaagaggctgtgtggttttcgatgttgcaagtttagggtgttactgcattttattgtgacttttatttac

SEQ ID NO: 6163 - DNA, 899 bp, Pisum sativum
cgagcggccgcccgggccggtacgtaaaatgaaggagagacttgttggtgtttcggaagagactacaactggtgttaagaggctttatcagatgcaagccagtggaactcttttgttccctgctattaatgtcaatgactctgtcaccaagagcaagtttgacaacttgtatggatgccgtcactctcttccagatggtttgatgagggctactgatgttatgattgctgggaaagtgggtgttgtctgtggatacggagatgttggaaagggttgtgctgttgccttgaagcaagctggagctcgtgtgattgtgactgaaattgatccaatctgtgcccttcaggctctcatggaaggattccaggttctgactcttgacgatgttgtctcttatgctgatatctttgttaccaccactggtaacaaggacatcatcatggttggtgacatgaagaaaatgaagaacaatgccattgtttgtaacattggtcactttgacaatgaaattgatatgtctggtgttgagaactaccctggtgtgaagcgtatcaccatcaagcctcaaaccgacaggtgggttttccctgagaccaacactggcatcattatcttggcggagggtcgtttgatgaacttgggatgtgccactggacaccctagttttgtgatgtcctgctctttcaccaaccaggtcattgctcaactagagttgtggaatgagaggaaatcaggaaagtatgaaaagaaggtttacgttttgcctaagcatcttgatgcgaaggtggctgcacttcaccttggcaagcttggagccaaactcaccaagcttacccaatcacaggctgattacatcagtgtgccagttgagggtccttacaagccagctgcctacaggt

SEQ ID NO: 6164 - DNA, 583 bp, Solanum tuberosum
gagaccttccctggtgtgaagaggatcacaatcaagcctcaaaccgacagatgggttttcccagacaccaacagtggcatcattgtcttggccgagggtcgtctcatgaacttgggatgtgccactggacaccccagttttgtgatgtcctgctctttcactaaccaagtcattgcccaactcgagttgtggaatgagaggagcagtggcaaatacgagaagaaggtgtatgttttgccaaagcacctcgacgagaaggttgctgcccttcatcttggaaagcttggagccaagcttaccaaacttaccaaggatcaagccgactacattagcgtaccagttgagggtccttacaagcctgctcactacaggtactgagggaagacaatttgacagaggaacaatattgtcgcggcatgattattttgcgttgaatactttgagtttgtttaggataatgatgttttgattattgttggggatatatttgggaaggaagttggcatgttttactgaaaaaaatggtctcatttgaaagaagaccaaaatgtttaataatatttgagttatggttggtggtgtg

SEQ ID NO: 6165 - DNA, 888 bp, Flaveria ramosissima
agtgatccgaagaagtatcataagatgaaggagagattggttggtgtgtcggaggagaccaccactggtgttaagaggttgtatcagatgcaagcgaatgggactctcttgttccctgctattaacgtcaatgactctgttactaagagcaagtttgataatctatacgggtgccgtcactctctccctgatggtttgatgagagccactgatgtcatgatcgccggaaaggttgcagtggtctgtggttatggtgatgtcggaaagggttgtgctgctgcgatgaaacaagctggtgctcgtgtcatcgttacagaaattgaccccatctgcgcgcttcaggccaccatggaaggactccaagttcttactttggatgatgtggtttcagaggccgatatcttcgtcaccaccactggcaacaaagacatcatcatggtttcggacatgaaaaagatgaaaaacaatgccatcgtgtgcaacattggtcattttgataatgaaatcgacatgcttggacttgaaacctacccgggtgttaagagaatcaccatcaagccccaaaccgacaggtgggtcttccctgaaaccaacactggcatcattgtgttggccgagggtcggctcatgaaccttgggtgtgctactggacaccccagttttgtgatgtcgtgctctttcactaaccaagtgatcgcccaaatcgagctttggaaagagaagaacaccgggaagtacaagaaggaagtgtatgtgttgccgaaacatcttgatgagaaggtggctgcacttcatcttggaaagcttggagccaagttgaccaagttgaccaaggaccaggctgattacatcagtgtgccggttgagggtccatacaagcctgctcac

SEQ ID NO: 6166 - DNA, 1063 bp, Zingiber officinale
gtcggcgtctcggaggaaacaactactggtgtcaagcgactgtaccagatgcaagacagcggctccctcctcttccccgccatcaacgttaatgactccgtcacaaagagcaagttcgacaatctgtatgggtgccgccactctcttcctgatgggcttatgagggctaccgacgttatgatcgccggcaaggttggcgtggtctgtggttatggagatgtcggcaagggttgcgccgctgctctgaagcaggcaggtgcccgtgtcatcgtcaccgagatcgaccctatctgcgctctccaggccctgatggagggcatccctgttctccccctggaggatgttgtcgccgaggccgacatcttcgtcaccaccaccggaaacaaagacatcatcatggtggatcacatgaagaagatgaagaacaatgccatcgtatgcaacattggccacttcgacaacgagatcgacatgcacgggctcgagacctacccaggcgtcaagcgcatcaccatcaagccccaaaccgatcgctgggtcttccccgagacgaactccggcatcattgttctcgcagagggccgtctcatgaaccttggctgtgccactggccatcccagcttcgtcatgtcctgctccttcaccaaccaggtgattgcccagcttgagttgtggaaggaaaggaaaagcggaaagtatgatcggaaagtgtacgtgctgcctaagcatctggacgagaaggttgcggctctgcacctgggtaagctgggagccaagctcaccaagctcacaccagagcaggcagagtacatccatgtcgccgttgaaggcccttacaagcctgctcactacaggtactagtgtgccatttcggcctgagatggtaccggaatcgccaaggcagcagcagtctttgccagggatcggagtgacgctgaaattatcttgcttgatttaccttctacctttctgtttttgctatttccgatggagttctatttcattttgaattggatgaggaatgctttggccaagcttcggaactgaataattcttcaagcga

SEQ ID NO: 6167 - DNA, 1641 bp, Zea mays
gtcggtccacctcgggctatgccttgttcctcggggacaacctcgtctcctgtttgtccaagcgccagctggtcgtctcccgctccagagccgaggccgagtatcgcgtcatgggcaacgacgtggttgaggcgacctggctccgccaacttctttaagagctccacagtccgctgaccacgagcaccctagttctctgtgacaacgtcagcgcagtctacctctccacctaccccgtccaacaccagtgcacgaagcatgtcgagatcgataactctctctctcactgccattaatgtcaacgactccgtcaccaagagcaagtttgacaacttgtatggttgccgccactccctccctgatggtctgatgagggccacagacgttatgattgctggcaaggttgccgtggtctgtggatatggtgatgttggcaagggctgtgctgctgcactcaagcaggctggtgcccgtatcatcattactgagatcgaccccatctgtgccctcctggctctgatggagggtcttcaggtccttaccttagaggatgttgtctctgaggctgacatctttgttaccaccaccggcaacaaggatatcatcatggttgaccacatgaggaagatgaagaacaatgccattgtctgcaacattggccattttgacaatgaaattgatatgctcggtcttgagacctaccctggtgtcaagcgcatcaccatcaagccccagattgaccgctgggtgttccctgagaccaacactggcatcattatccttgcagagggccgtctgatgaaccttgggtgtgctactggccatcctagctttgtcatgtcctgctcattcactaaccaggtccttgcccagcttgagctgtggaaggagaagaactctggcaagtatgagaagaaggtatatgtgctccccaagcaccttgatgagaaggttaatgctctccacttgggcaagcatggtgccaagctcaccaagctcaccaagtcccaggctgactacatcagggtgccgatcgaaggtccctacaagcttgctcactaccggtactaggcagcccagcacgacaggcagcttattcggtcggtactgtgctatgaagcttgctacaccggcctgccagttagtcttttgcatgcatatatgcattatcatatagacagtcgcgcgatgttgtcgcttgagacgagggggaagcgagaagggtaggaactgcttgcttttgctgaagaataatgtgtaattggctgggacctgggatgagatgatgttcgttgccacatacagttttccctttgttgactgactctacttgtatgattattgtttgtaaactatttgcttatgtgtcatttacgaaaaacttcttttatgaagagcatagttatggtttaactttcggagtatatatatattaaaaataatctaaaatcccaataaaatgtatatataaggtgaatatatagatttgtgataatttacagatgtgaactttctttagttcaatttagaatcttttaggattgtttttttaatttgtaccattcaattttttcttcatatttttatcatttaaaattttaatatatatccatcataggattttgctctagatttctagaa

SEQ ID NO: 6168 - DNA, 677 bp, Parthenium argentatum
tggttgaccacatgaagaaaatgaaaaacaatgcaattgtttgcaacatcggacattttgacaatgaaatcgacatgcttggtttagaaacatatccgggtgtgaaaagaatcaccatcaaaccacaaaccgaccgatgggtgtttcctgaaaccaacagtgggatcattgttttagctgagggtcggctcatgaatttgggttgcgccacgggtcatccaagctttgttatgtcatgttcgtttattaatcaagtgatcgcccagctcgagctgtggaaagaaaagtcgagcgggaagtacaagaaggaagtttatgtgttgcctaaacatcttgatgagaaagtggctgcacttcatcttggaaagcttggagccaagctgattaagtttagccaggagcaagctgattacatcagtgtgccagttgagggtccatacaagcctgctcagtacaggtattgatcatggatcaagaaaactgttggtttggttgttggtagttgggaaggtggttggagagaattgattggttttttgaatgactatccatccatacatatatgatggtttgaataagggtggtgtatgcaggtggtgtaaaacataaagttattatttttgtgggttttgttttatgttccaatgacaaaattaaatgggataaagatctttttt

SEQ ID NO: 6169 - DNA, 595 bp, Cucumis melo
actttccctgacgtgaagcgcatcacgatcaagcctcaaactgataggtgggtgttccccgatactaactcaggcatcatcgtgcttgccgaggggcggctaatgaacttgggatgtgccaccggccaccctagctttgtgatgtcctgctcattcacaaaccaagtgattgcacagcttgagctttggaatgagaggaaaactggaaaatatgagaaaaaagtgtatgttttgcccaaacatcttgatgaaaaagttgctgctcttcatcttggcaagcttggagctaagctcactaagcttagtaaggatcaagctgactatatcagtgtccccattgaaggtccttacaagcctgctcattacaggtattgaacggacccagtgagaccatcgatatcggttggaacgatcagaagggtttgttgtttttcttgtcttttttatatagaattatttcgtcatatagagttctaggtttcgttccattcaaattcgacttaggacaaagattaagttcttttgcctaaaaatcaaatgaactgaataaggttggatttgagttgtgtggttacttccttgcagtttgttttgg

SEQ ID NO: 6170 - DNA, 739 bp, Ipomoea nil
cccccggcaacaaggacgtcatcatggttagccacatgaagaagatggaagaacaacgccattgtttgcaacattgggcacttcgacaatgaaattgacatgcacgggcttgagacataccctggtgtaaagagaaccaccatcaaacctcagaccgacagatttgtgttcccggataccaagaatggcatcattgttttgggcgaggggcgtcttatgaacttgggttgtggctccagacatcctagtttcgtgatgtcttgctccttcaccaaccaagtgattgcccagctggagctgtggaaggagaagagcagtgggaagtacgatgagaagaaggtttacgtgttgccaaagcacctggatgagaaggttgctgcccttcatattgggaagctgggtgccaagctcactaaacttagccctgaccaagctgcttacattagtgttccagttgagggtccttacaagcctccgaactacaggtactaaacagaagcctcgagagttgttataagcaacatggaacctggtcaaaacacataataccgtgaatacaatacaaggtcattaaatcttaatgtgtgactgcatgcagtatttgaaagtaacttgtgaatacaaaataatgtaatcaattacatatatattaatattctatgttgtagtatataaattgtaaacatttggacttggatccacagaataatttgtgaagcctcgatgatcaagaagagaa

SEQ ID NO: 6171 - DNA, 1363 bp, Primula obconica
accgcggttcttatcgagacgcttacggcgctcggggccgaggtgcggtggtgctcttgtaacatcttctccacgcaggaccatgcggcggcggcgatagcgagggactcggcggcggtgtttgcgtggaaaggggagacgctggcggagtactggtggtgtacggaacgggcgttggattggggggagggcggtggccccgatctcatcgttgatgatggaggtgatgcgactctgttgatccacgagggagtgaaggcagaggaggagtttgagaagaacgggacagtgccagacccaacctccactgacaatgctgagttccagatcgtgctttcaataatcaaagaaggccttaagacggaccccaaaaggtaccacaagatgaagaccagattggtcggagtgtcggaggagaccactacgggtgttaagaggctctaccagatgcagttgaatggcactcttctcttccctgctatcaatgttaatgactcagtcaccaagagcaagtttgacaacctgtatggttgccgccactctctccccgacggcctgatgagagccaccgacgtcatgattgctgggaaggtagccgttgtctgcggctacggagatgtcggaaagggctgtgctgccgccctaaagcaggccggtgctcgtgtgatcgttacagagattgacccaatctgcgcccttcaggctaccatggaaggccttcaggtcctaacccttgaagatgttgtctcccaggctgatatttttgtcaccaccaccggaaacaaggacatcatcatggtctcagacatgaggaagatgaagaacaacgccatcgtctgcaacattggacatttcgataacgagattgacatgctcggcctcgagacgtaccctggcgtgaagaggatcacgatcaagccccagaccgacaggtggttgttcccagagaccaacaccggtatcataatcttggccgagggtaggctaatgaacttgggctgtgccactggtcaccctagctttgtgatgtcgtgctcgttcaccaaccaggtgattgcccagctcgagctctggaaagagaaagatacaggaaagtacaagaaggaggtgtatgtattgcccaagcacctcgatgagaaggtcgcagctcttcaccttgagaagctcggggctaaactaaccaagctcagcaaggaccaggctgattacatcagcgtccctgtcgagggcccttacaagccagctgcttataggtattaagaggagcgttgaggatgatgttcggctgattgaattaagttttgtttatttatttaataccctttttggggaattgatgtgtgtttgggggagaagagagggg

SEQ ID NO: 6172 - DNA, 619 bp, Zingiber officinale
  misc_feature (53)..(53): n is a, c, g, or t
  misc_feature (56)..(56): n is a, c, g, or t
  misc_feature (218)..(218): n is a, c, g, or t
  misc_feature (372)..(372): n is a, c, g, or t
  misc_feature (411)..(411): n is a, c, g, or t
  misc_feature (613)..(613): n is a, c, g, or t
tggagacttacccgggcgtcagcgcatcaccatcaagccccagaccgatcgcnggntgttccctgatacaaacaccggcatcatagtgcttgccgaggggcgtcttatgaaccttggttgtgccacaggccaccccagcttcgtaatgtcctgctccttcaccaaccaggtgatagcacagctcgagttgtggaaggagaaaatgacagggaagtacnagaagaaagtttatgtgctacctaagcatctggatgagaaagtggcagctcttcaccttggcaagttgggagccaagctcaccaaactcactccatcacaagctgagtacatcagtgttccggtggggggaccttacaagcctgctcactacangtattaggatgctaatgctggatattagaagaaacaganaaaactgggagtgtccaggggatccacggaatgaatttgtttgtttagcttgcttattgtttggtttgcaatttttgctgagttacctaacgatattggttcgttttgaatttctcgatgtaattgccagggaagcaattgtctctggctccacttaattagttgcaagacaaaaacctcgtgccgaattcggcacgaggcntcgtgc

SEQ ID NO: 6173 - DNA, 530 bp, Nicotiana tabacum
accgctgggtatttcctgaaaccggaactggcattattgtccttgctgaaggccgtttgatgaatcttggttgtgcaactgggcatcctagctttgtgatgtcttgctctttcacaaatcaggtgattgctcaacttgagctttggaatgaaagggcaacaggcaaatatgagaagaaggtctatgttctgccaaaacaccttgatgaaaaggttgcagcccttcaccttggaaagcttggagctaagttaaccaagttgacacctgagcaagctgcttatgttagtgttccaaccgagggtccatacaagccaccacattataggtactaaggattgcagatattgcattaagtctctttaagcacatttttcggggttatattacattgtttctgcctatgtactagcttacaaattcggtgtttatggctagttagtattctaattgttggaattcggaatttctgtgtatcctttagtgtttcaaatagttgaatagattgagtttaatactagactatttggata

SEQ ID NO: 6174 - DNA, 647 bp, Cryptomeria japonica
  misc_feature (46)..(46): n is a, c, g, or t
  misc_feature (68)..(68): n is a, c, g, or t
  misc_feature (341)..(341): n is a, c, g, or t
  misc_feature (388)..(388): n is a, c, g, or t
  misc_feature (474)..(474): n is a, c, g, or t
agataactatcaagcctcaaacagacagatgggtgttccctgaaancaatagtggtatcattgtcctngcagaggggcgtctcatgaacttgggttgtgccactggacacccaagttttgtcatgtcttgctcattcacaaaccaagttattgcacagttggagctttggaatgagaggaaaacaggaaagtatgagaagaaggtatatgtgttgcccaagcatctagatgagaaggtggctgctctacatttgcccaagttgggtgccaaacttacaaagctttctccaaagcaggctgcatacattaatgttcctattgagggtccttacaaacccctncactacagatactgagctaagcatgattttctcatgacttgtttgtnaaggctgttttgattatagcaattcgagcacaaaacagttttggcatcttcattattttccgtaataagtgatagattacttaatntgaatgatgttgaattgtgagctgaagcggaataagaatccatgggctaaaccaaggatttgaagaaatgaaaagaaaatgttcgttggtttcacattctatttgtatctggattttatgctgagcaattttattatgtaaaagctattttcgtatcaagttgagttaacgcg

SEQ ID NO: 6175 - DNA, 1262 bp, Zamia vazquezii
  misc_feature (359)..(359): n is a, c, g, or t
  misc_feature (380)..(380): n is a, c, g, or t
  misc_feature (382)..(382): n is a, c, g, or t
  misc_feature (385)..(385): n is a, c, g, or t
  misc_feature (391)..(391): n is a, c, g, or t
  misc_feature (487)..(487): n is a, c, g, or t
  misc_feature (493)..(493): n is a, c, g, or t
  misc_feature (876)..(876): n is a, c, g, or t
  misc_feature (996)..(996): n is a, c, g, or t
  misc_feature (1092)..(1092): n is a, c, g, or t
tcagaggctgtatcagatgcaggccaacggctcattgctgttccctgccatcaatgtcaatgactctgtcaccaagagcaagtttgataacttgtatggatgcaggcattctctgccagatggtttgatgacagccacagatgtgatgattgctggtaaggttggggttgtatgtgggtacggagatgtgggcaagggttgtgctgcacccctcaaggccgctggagctagggtcattgttacagaggttgatccgatctgtgcactccaagcactcatggaaggcatccctgtactaagattggaggatgtgttgagcactgcaaatatctttgtgacttgtactggcaacaaggacnttatcatggtggatcacatgngnaanatgaanaacaatgctattgtttgcaatatcggacattttgacaatgaaattgacatgcagggcctggaaacctaccctggagtcaagagaataaccattaanccacanacagatcgttgggtattccctgagaccaacacaggcatcattgttctggcagagggccgactcatgaacttgggatgtgctactggccatccaagttttgtcatgtcctgctccttcacaaaccaggtgattgcccagcttgagctctggaatgagaggaaatctgggaagtacaagaaggaggtgtatgtgctccccaaacatctggatgagaaggtggctgccctgcacttggacaagctgggtgctaagctcaccaagcttactccggaccaggcagcatacatcaatgtgccggttgagggtcccttcaagcctgctcgctaccgatattgaggggtgtatttttgctgctttgagttttgggctcggtagaggatttntttgtttggtgggcggcagaactcgccatttttgtgccatttcccttcaacggcacttcaataagaggattgttagggtttgatcgagctgccaacattcattatagcagcaactttttntgtttaatttgttagtgttggtaaggtatattatgaaaaaaggtcgaactagaactaatatcagtgtcgcctcattcttcatgttatgctattgtntgatggtagaactggtagtgttcatttgagtctttcacatgaatcggacagtttttaactagcgtcggaggggtttttttaattagaatggttcataactaaagggggttgtcgcttatagtgttttgaaaattttgcaaattgttcatttagtggttattttttatttc

SEQ ID NO: 6176 - DNA, 372 bp, Flaveria ramosissima
cataccctgatgtccaaagaatcacaatcaaaccccaaaccgacagatgggtcttccccgaaaccaagactggcatcattgtgctagccgagggtcgcctcatgaacctgggttgtgccacgggtcaccctagtttcgtgatgtcatgctcattcaccaaccaagtgatcgcgcaacttgagctatggaaagagaagaacacagggaagtacaagaaggaagtgtatgtgttgccaaagcatcttgatgagaaggttgcagcacttcatcttggaaagcttggagctaagttgaccaagttgaccaaagaccaagctgactacatcagtgtaccagttgagggtccttacaagcctgctcattacaggtact

SEQ ID NO: 6177 - DNA, 1252 bp, Pinus taeda
agaatgccgggtccctgctgtttcctgctatcaatgttaagtgactctgttacaaagagcaagtttgacaacttgtatggatgtaggcactctctgccagacggtcttatgagagccacagatgtcatgattgctggtaagtgggttggagatgttggcaagggttgtgctgcagctttgaaagtcgctggagctagggtcattgttacagagattgatcctatctgtgccctgcaagctcttatggaaggccttcctgtccttaccctgtaggatgtagttagcactgctgatatctttgtgacaaccactggcaacaaggacatcatcatggtagatcacatgcggaaaatgaagaataatgccattgtttgcaacatcggtcactttgacaacgagattgatatgcaaggccttgaaactttcccaggcgttaagaagattaccatcaagcctcagactgacaggtgggtgttccctgacaccaacagtggcatcattgttcttgcagagggacgtctgatgaacttgggttgtgcaactggccacccaagttttgtcatagtacttagactacctttaacaaaaccaaggtacaattgctcagttagagctctggaatgagaagaaatcagggaagtatgagaagaaggtctatgtgctgcctaagcatctagatgagaaggtggctgctctgcacttgcccaagttgggtgccaagctaacaaagcttactcctgatcaggcagagtatatcaatgtgcctattgaggggccttacaagcctgctcagtaccgatactgaaaagatctgacgtttgggatggcttgttggacgagtagcaaaggtccttgctgtttgcaaataaaagaaactgtaggatttatttttggcagctctgttgttttaagggaccttacaagcctcctgactacatactgaagagatgacattttgggtgagacctgctcggcgagtatcaagttacaatgctcctcgacataataaaagagactacgacctactactttgtcggcatctccattgtttgggtagaattataataaaattttgctatcgcttgtatgggtggctgctgaatttcttgcagcatcacatcaagcatctcgttttaatatgggtggctgctgaatttcttgcagcatcacatcaagcatctcgttttaatactactggtatatggtttaatagtttattagagttcgtatgggaatttctgccaatgtggca

SEQ ID NO: 6178 - DNA, 545 bp, Utricularia gibba
cgaagacccttacggaaagtcaagaggaagtcaccactgaaaccccaacgactgacagactttgtcttcccttcgagaccaactccggccgaatcatcatcctggctgaaggccgtttgatgaacttgggttgtgccacaggacaccccagcttcgtcatgtcatgctccttcacaaaccaagtcattgctcagctcgagctctggaacgagagaagcagcggcaagtacgagaagaaggtgacgttttgccaaagcaactcgacgagaaagtggctgccctccaccttggaaagctcggtgctaagctcaccaagctctccaaggagcaagctgactacatcagcgtccctgttgagggtccctacaagcccgcccactacaggtattgagagattttagtacacgtgccagagcaagactggagatcgcattgctattggtgtattttgtcttaaataagtgtctgagaccgtcatcatatcttcctgcttttgtgttgctgattcctttctgtagttgaacaatcccagtttttattgctat

SEQ ID NO: 6179 - DNA, 504 bp, Solanum tuberosum
caacagtggcatcattgtcttggctgaaggtcgcctcatgaacttgggatgtgccacaggacaccccagttttgtgatgtcctgctctttcactaaccaagtcattgcccaactcgagttgtggaatgagaggaccagtggtaaatacgagaagaaggtgtacgtcttgccaaagcacctagacgagaaggttgctgccctacatcttggaaagctcggagctaagcttaccaaactcaccaaggatcaagctgactacatcagcgtaccagttgaaggtccttacaagcctgctcactacaggtactgagggaagagacactcatggtggaacaacgatatcgcggcacgattgttttgtttttaatactttgattttgtttaggtagtctgtttttattattgttgggggaagttggcatggtttgctggaaagttgacctaaatgtgtttgaatatattcgattatggtgtggggttgtgtcatatgatattgtactaaga

SEQ ID NO: 6180 - DNA, 452 bp, Utricularia gibba
cctggagtcaagcgcaccaccatcaagccacagactgacagatagggtgttccctaagactggcaatggcatcattgtccttgctgagggacgtctcatgaacttgggctgcgccactggtcaccctagcttcgtcatgtcctgctccttcaccaaccaggtgattgcccagcttgaactctggaacgagcgtgccagcggcaagtacaagaaggaggtgtacgtgctgcccaagcacttggacgagaaggttgctcttctgcacttggagaagctgggagccactttgaccaagttgaagccagaccaggccagctacatcaacgtgcctgtggagggaccctacaagcctgctctctacagatactagggattgaaatgtgcctaaaattggctgaatgttgacaagggcttcgtttttttgtccgttctggatcgttgtgggcttgagg

SEQ ID NO: 6181 - DNA, 933 bp, Citrus sinensis
tgaggatgtcgtctccgatgctgacatctttgttaccaccaccggtaacaaggacatcatcatggttgaccatatgaagaagatgaagaacaatgcaattgtttgcaacattggtcactttgataatgaaattgatatactcggtcttgagacctacccgggtgttaagcgcattaccatcaagccccaaattgataggtgggtcttccccgagaccaactcaggcatcatcgtgttggctgagggacgtctcatgaacttgggatgtgccactggacaccccagctttgtgatgtcctgttccttcacgaaccaggtgattgcccagcttgagttttggaaggagaagagcaccggcaagtacgagaagaaggtgtatgttctgcccaagcacctcgatgagaaggttgttgtttttcaccttggaaaacttggagttaagctccccaggctcaccaaggagcaggctgactacatcagtgtgtccgccgatggtccttacaagccttttcactacaggtattaagtggaagaagaagaagaagaagaggaagaagaagaagaagagtgaatgttttgagggaaagaaacaaaatatttggccggcttgattgttttcaatgctgatctgtagtaggatgttaggtttaaatttcgtagtagtgtgtgtttgggtggtgggaaagttgattgaagaccatttgggatttgaataaggttttggatggggccgtgttggattattttgtatttgatgcagttttaagttttgcttgctttgctgttgttatccttattgtttactgatgaatgattaaaaaaaaagaaaaatcttttttccagtttcttatctatatcaaaaatcattatgaaaaaaaaaaaaaaaaaaaaaaaaaaaaaaaaaaaaaaaaaaaaaaaaaaaaaaaaaaaaaa

SEQ ID NO: 6182 - DNA, 680 bp, Phaseolus coccineus
ctgggactggagaactaccccggtgtgaagcgcatcaccatcaagccccagactgacaggtgggtgttccctgagaccaacaccggcatcattgtgttggctgagggtcgtttgatgaacttgggatgtgccacaggacaccccagttttgtgatgtcctgctccttcactaaccaggtgattgcccagcttgagctgtggaatgagaagagcagtgggaagtatgagaagaaggtatatgttttgccgaagcaccttgatgagaaggtggctgcacttcaccttgggaagcttggagctaggctcacgaagcttagcaaggatcaggctgattacatcagtgtggctgttgagggtccatacaagcctactcactacaggtactaaggttgttgtgatgatgatgaatggagagcgaaagcaaaactggtttatggagcggcttgattgtttcattttctttggattttttgtgctagaacttcacatccatgctagaagaacaattgttttctgaattttgtagaacttatgtttgagtggtgggacggatacgggtaatgcggcctgttggattctgtggtatgaatccaatttggtctgaaataagggttgtttggtttgggggttgtgtgcattttggtttaactaaatttctgtctctttccaccgtttaatgg

SEQ ID NO: 6183 - DNA, 665 bp, Fraxinus spp
tggtctcgagacctaccctggtgttaagaggatcaccatcaagccacaaacagatagatgggtattcccagatacaaattccggtattattgtcttggctgagggtcgtctcatgaacttgggatgtgccactggacaccctagctttgtgatgtcatgctcttttaccaaccaagtgattgcacaacttgagctctggaacgagaggaaaactggcaagtacgagaagaaggtttatgtcttgcccaagcacctcgatgagaaggttgctgctctccaccttgggaaacttggtgctaagctcactaagctttcaaaggatcaggctgattacattagcgttccagttgagggtccttacaagcctcctcattacaggtactaagtggaaagcagacactgatttccaggacacatacatttgtcgctgtgattgtttatttttcaaaattgtgttttcacgttagattgtagttttcttgggggagttttgggagttggtatgtttggaaagaaatggtctctatctaaagaccaaaatatgttaaaataaggttttgatcaagggctgtgtgatatggaaatttagttaattaggtcttattgcttttggttaacatttgtttacaagaaaatgaaaagaatatgtttacagcttttaaaat

SEQ ID NO: 6184 - DNA, 326 bp, Petunia hybrida
ttcccaggagtaaagagaatcacaatcaagcctcagactgacagatgggtcttccccgacaccaacagtggtatcattgtcttggccgagggtcgtctcatgaacttgggatgtgcaactggacaccctagcttcgtgatgtcctgctctttcactaaccaagtcattgcccagctcgagttgtggaaggagaaaagcaccggcaagtatgagaagaaggtctacgtcttgccaaagcacctcgacgagaaggtcgctgcccttcaccttggaaagctcggagccaagcttaccaagctctccaaggatcaagctgactacattag

SEQ ID NO: 6185 - DNA, 3327 bp, Gossypium hirsutum
atgggggccctcatcttccttcaaccctaaacttaaagagtccagtatctgctctctgcctctgcattgcatcactctgctatttttgattttcagctttcgatcctactgctcgttacttattacgtcgtatcatctcatcttttctctctctgtttactttggtgagaagcagatatttgttttaaagctatccgtttagcggaaatagataacgttatcgccgctattttccgttacaccgcctattgagatctttatagcggcggacggtgccgatattgcaaaatagcgacccgcggcatcgatatttgaaacactgccaatacgatggcagttaaaaagcggaaagagagagccgttggcggtgaatccggaaacagcaagaagttcaaaaagtattccaactccaaaggaccgatgaagaaaaacaagaacgatacgagaaagaaggggaaaggtcctcgcttgccttctgcgctacgaacggagcttgatcgcctggaccctaaaatagcttccgatagtgatgacggtatcgatttagatgttggaaacgatgtttatgagtatgaggaagaagttccacaagaagagtcccggaagaaccgccgtttcgatcctgtcgagaactatgagtatgagctacctgaggattttgaggatgagaatgtaccatcagatgacgacgacgatgatggtgactttggtgttggtgggaacaagggtagtctaaatgatgatgttgatgcgagtgatggggatgaagaggaagatgatgaaaggcacttgaggatgttgcaaggggtcactggaatgtcaactgatgcctttggaggcaagaagaagaggaatagtgtggttatatccgaggcacatcctgagtcagaatacaaccctactcgtgatgttcttgagggtgacagccacattacacttcaagatcttttggatcctattcaaggaaaagcggggtatagcaaacttagaaaaagagtgcaacacatggacagaaagtctacatctgttcaagctccattgccgaaggtagatagagagaaattggagaggatggcagtttatgaacattcaaagaaagatattactaagtgggagcatctggtcaaaaggaatagagaagctcctactgtttttttggtggagatgtagacttggggttttcaactgtaggggcaatagcttctgaatttgagcctagaactgagtttgagaagaaaattgcttctttggtttatgatgacaaagttatggaagctcacaaagcagatggttccaaacttctggagttaaataagatatctgaggaagattatatgaagcaccgggatcatgttgctaaaatgcgcagcctgcttttccgccatgaaatgaagcagaagcgcataaaaaagatcaagtccaaaacctatcatcgtttaaagaataaggataaactgaaagtggaatctgcagaaatgctgatggatccagaggcagccaaagagcaggctaggaagcaagagttcaaacgagctgaggagcgaatgactttgaagcacaaaaataagtcaaagtgggcaaggcgtatcttagaacgaggtttgaatgcccaggatgaaggtactcgagcagctatggctgaacagcttcaccaacatgctcttttgacaagaaaaattaacactgttaaagacagtagtagtagcagtgatagtagtagtgatgatgatgatgaggtttcaaacgaggatagggcatctgagttgctagaaaaagcaaaagagaaaacgctgaaagtattagaagacgatgaagaattgcctaattctggagttctttccttacctttcatggttcgtggaatgaagaaaagaaggaagaaacaattgaagaagctaagcttgctcttcaagagtatgagcaattggagggtacaaatgatgcagaaaattcaaaaccagccactgcaagtggtagaagggtctttggcagggctaataatgaagttccagattctaacaagaagaccaaaactgataataagatgaaaatggataattattatggtaatagtgatagtgaagacgatttgaaagccaaagagaatgttaacattgagggcggcaaaagaaatgatgttgagaaggatgttggccctaattatgatcgtaaagaagtagctgatgtttccatattcaagaattttgatgacaatggagaccctggttcaaaaacgacatatgaagttgctatttttgcttccgactcgcggagaaagatgaaaagtgagaatggaattgataaaaatgcgaaaaagttgcaacaagtgaaggaagctattgtgcatgataaagacatggaggagggagaagaggatagtgattcggagagcaaacaaatggtggatgggattttgtcctcggcccccaaggaatcatatgaactcccttctcagtctgaactcattcgacatgcttttgctggggactatgtggaagaagaatttgaaaaggataagcaggaaatcctgaatgaggaaaaccctgaaccggataaacctgttttgctccctggttggggccaatggactcatgtacagcaaaaaaaaggtttgccttggtggatgcttaaggaacacgaagactctaagcggaagagggaagaaagtcttaagaaaaggaaggatgcacagctcaagcatgtcattatatccgaaaaggtggataaaaaagctgagaaattgcagacaaaatctttgccctacccgttcacatccaaggaactttttgaacaaagtatgcgaatgcctattggatcagaatctaacccggagacagcaatcagaagtcttaatcgaccagaagtggtgaagaaacctggggtaattataaaaccaataaagtttgtggagatgcatcatcacgaaaaatccgaggataacaaacggagtgggcagaaacagaagaaaaataaaagcaaaggtgccagtggcaagaacaagaaacagagcaactaaatctcataaattttggctgaaattaggtgtagaaaattttggctgtaccatcttgtttagtggtgtaaggaagcaaaacaaactgcttttccaggcaaaggtaattgagaaaggcggtcacagttttaaaattgtctattgctgttgcgaggtgagccggcaatggttaaacagccgccgtacgttcctacacttttggaggcaattttacgatgcgagtttatatttatataagttatattttgctattagtttattcaatttgatcttagtttttgtattctaaaattttgaaatatcaattttgattc

SEQ ID NO: 6186 - DNA, 5852 bp, Theobroma cacao
ggcttgatctaatgcttttgcctgctttatctattcaactaagtaccctcttggtgatggactttaatcgatgaagcctatgcatttgtatggagactcagttcacccgcaccgtttcgagaaagggtcgggtttagcctccaaattcctaaatcctagtaaaccccttcgctctcactgagcagccacaatttatttgcggccaccaccaccactaccacaagctctgcttagcgatggcagaaaagaagcggaaagagagggccggaggcggcgaatccagaacgaacaaaaagttcaaaaagcattcaaactccaaaggcctaaccaagaaaagcaaggataaatccaatatgagaaggaagagaacaggtcctcgcttgccttctgcgctgcgaacggagctcgaccgcctgaacgctagaatttcatccaacagcgatgacgagatcaattcggatgtggaaaaggatgtttatgagtacgaggaagaagtgccccaagaagagtcccggaagaaccgccgcttcgaccctgtcgagaactatgaatacgagcttcctgaggattttgaggatgaaaatgtgtcatcggatgatgatgatgatgacaatgacgacgactttgatgttggtggaaatgaggggaatctgattgaagatcttgatgatagtgatggggttgaagaggaagatgatggaaggcacttgaggatgttgcaaggaatcactggaatgtcaaatgatgcctttgaaggcaagaaaaagaaaaataatgtggttatatctgaggcacatcctgagtcagaatacaatcctactcgtgatgttctggagggtgatggccacattacagttcaagatcttttggagcctattcaaggaaaacctggatatagcaaacttagaaaaagagtgcaatacatggacagaaagtcaacatctattcaagctccgcttccaaaggcagatagagagaagttggagaggatggcagtgtatgaacattcaaagaaagatattactaagtgggaacacttggtcaaaaggaatagagaagctcctactattttttttggtgaagatgtagacttggggttttcaactgtaggggcaatagcttctgaatttgagcctagaactgagtttgagaagaaaattgcttctttggtttatgatgacaaagttattgaagctcacaaagcagatggttccaagcttctggaactaaataagatatctgcagaagattacatgaagcaccgaaatcacattgctaaaatgcgcagccttcttttccatcatgaaatgaagagaaaacgcgtaaaaaagatcaagtccaaaacctatcatcgtttaaaaaataaggacaaacttaaagcagcttctgcagaaatgctgatggatcctgaggcagccaaagagcaggctaggaagcaagagttcaaacgggctgaggagcgaatgactttgaagcacaaaaataagtcaaagtgggcaaggcgtattttagagcgtggtttgaatgcccaggatgaaggtactcgagcagctatggctgaacagcttcaccatcatgctcttttgacaagaaaaataaacactgtgaaggacagtagtagtagcagcagtgatagcagtagtgatgaggatgatgagggttcagaccaggatagggcatcagagttgctagaaaaagcaaaagagaagacattgaaagtattagaagacgatgaggaagtgcctaactctggagtgctttctttacctttcatggttcgtggaatgaagaaaagaaaggaagaagctattgaagaagctaagcttgctcttcaggagtacgagcaattagaggggacagttggtgctgtaaatttaaaaccagccactgcaagtggtagaagggtctttggcatggctaataatgaagcttcagaatctaacaataagatcaaaactgataataagaagatgaaaatggataattattatggtaatagtgatagtgaagatgatttggaagccaaagagaatcttaacattacgggtggcagaaaaaatgatgttgagaaggatgctggccctaattgtgttcataaagaagctgctgatgttcgtcaggattctgtattcaagaattttgatgacattgttagagacccaggcccaaaaacaacatatgaagttgctatttttacctcagactcgtggagaaagatgaaaagtgagaatggagtggatgcaaatgtcaaaaagtcacaagaaatcaaggaacctattgtgcagaatcaagacttgaaggagggagaagaggaaagtgattcagatagcgaagaacaaatggtggatgggattttgtccacaggccccaaagactcatatgaacttccttctcaatcggagctcattcgacatgcttttgctggggatgatgtggaagaagaatttgagaaggataaacaggagatcttgaatgatgaaaatcctgaacctgataaacctgttttgctccctggttggggccagtggactcatatacagcaaaaaaaaggtttgccttcgtggatgcttaaagaacatgacgatgcaaagcggaagagggaagaaactcttaagaaaaggaaggatgcacatctcaaacatgtcatcatctctgagaagttggataaaaaggctgagaaattgcaaacaaaaactttgccatatcctttcacatccaaggaacgttttgaacagagtgtgcgcatgcccattgggtctgaatttaacccagagacagcaatcagagctcttaatcggccagatgtaagttattcaatcttttcaaaattaatagtcctcaaaacctcatattttcctttggggggggtgggggtgcttgtaagaggaaaaatgctgcacgagctcttactagctcttgttggttacaccggagatctcataatcgacgagcgagaacaccataaatctcttggccttcacttatctcccgacgcccccatctccgaccagcgctccttcaagcttgcttccgatatttccttcatcgactccagcgaaagggatcttatcgagaggctaattacattggggttttattaccgagagctcgatcgcttcgccacaaaatcccggaatttaagctggataaggtccgctgatgtttctcctttggagagagccgctgggttgtccaaacctaagaccgagaagccaagcgtttatcgcagagccattgctaatgggctggtggaaatactctctgtctataggtctgctgttcttcaaatcgagcagaaattattgtcggaaaccatgcccattttggcaactgtcactcagggcctcaataagttctttgttattttgccacctttgtacgagcttattctagagatcgagcgtgatgatatacgtggaggacagcttcttaaccttttacacaaacgctgccactgtggggtgcctgaattgcaggcctgcattcaaaggcttctttggcatggtcatcaagtgttgtataaccaacttgcatcatggatggtttatgggattcttcaagaccagcatggagaatttttcattagaaggcaggaagatagagatgtcgactatggctcatctatctcggatatgtccgaaaagttggcacgcttgtcaactgatgattcatctttaacggattggcacttgggctttcatattttcctggatatgctccctgagtacatccctatgcatgttgcagagtcgattctttttgctggtaaagccgtcagggttctccgaaacccaagccctgcctttcaatttcaggatgctctgcgtaatcagcagataaaaaaaggctctcaaaaggttcaaggatcttctgggcgtgttcccttccataaggagcctttcctggatataaaaatgattggagaagaattgcttccacaatctgaggctgataagattgaaactatgcttcaagatctaaaggaatcatcagaatttcacaaaaggtcatttgaatgctcagttgactctatccgggctgttgcagctagtcatctttggcagcttgtggttgtacgtgccgacttgaatggtcacctgaaggctctaaaagactattttcttttggcgaaaggagactttttccagtgctttcttgaggagagccggcacttaatgcgcctgccacctcgccagtcaactgctgaagctgatcttatggttccatttcagctggcagccataaagaccattagtgaggaagacaaatacttttctctagtatctttgcggatgccttcatttgggatcacagtcaaatcctctcaagtagatttaccaaatacaaaaacatatactgatggaagttcaggtgctgtactgtcaagtacttcttcagagacatcacttgatggttgggatggtattgcccttgaatattctgttgattggcccttacagctgttctttacccaagaagtgctctccaagtaccgtagaattttccagtacctgctgaggctcaaacgaacacaaatggaattggagaaatcctgggcatctgtcatgcatcaggatcacacagattttgccaaacaccgcaatgaccggatgaactgctcaatatctcagccacggcggcagcgttgtagaccaatgtggcatgttagagagcatatggcatttttaatcagaaatcttcaattttatatccaggttgatgtgatagaatctcaatggaatgttttgcaatctcacattcaagattctcatgatttcactgaacttgtgggtttccatcaagagtatttatcggctttaatttctcagtccttcttggacattggctctgtgtcaaggatattggacagcatcatgacggtttgcctgcagttctgctggaatattgagaaccaagaaagcagtcaaaacacatctgaactagaacgtataaccgaggaatttaacaagaaatcaaactcgttatataccatattgcgcagtagcaggcttgctgggagtcagcgagctccatttctgagacgtttccttttgcgaatgaattttaattccttctttgaggcaactgcaaggggtgtgctgaatgttgtcagaccacgcccatcgcttcctgttttaaatcagcgatagcatttgattatatgaaatttctgaagtagcttgtctgattcttatttgagtgttcctcgtggtgctgctgtctcctttcatgtttgtttgtgggaggatggtgctttactacctagactgaggggcatgcttgttttcagctttatgaatgcccattaaccatctcaaatcagttactagtgcataagttatctgacttggagtttgctgcttgctccttgttgacctttgagtaaccatctctgggaagttagatgtcattgtgggaagcgggctcgagggtgcagtttattctcagcggtaagcaagcccttgggcagataagccactgcttgctaggtaactggagtttacgagacctgtgcttggctttgactggctacccttttgtgataaggtggtgcattgacggttggtttcattctttttctttttttttttgtgggagtgagatttttagttttatttatttatttttgtgtaaatgcaatgtatatgggttgtagactatatattatgtaatgtaatataatataagtgcataaattttcttaagattaatggctatcaagcttgtttttgcatttctaaaagtggaaggagttatactgtacatgatcttgcacgctcctagctcacttgtataatatttggagtcgatattctccttattccttaatgttataaaggtggcagtctaca

SEQ ID NO: 6187 - DNA, 2579 bp, Humulus lupulus
ctaactactgtcctctaactctatctctcactctccaagggcatgggcatggcggccacgatgacagggtcagcttcttcttcttcttcactcaagaatttcaccttcaatgcctctcaaagaatgcctgccacgcttctttctccacagagctttctgggtcttcgttctcgaccctcatcttctttaacttcctcttctctttcccatttctttgggaatgctcgtctcagctcaaaatctgttaagctcactggttcaaatcagcaaacccgaagaagaaacctatctgttttctccatggccgctgatgctccagcggacaagcgtgctgtgccattgaatgattatcgaaatatcggaattatggctcatatagatgcaggaaagaccacaaccacggaaagggttctgttctatacaggaagaaattataaaataggggaagtacacgagggaacagctactatggattggatggagcaggaacaagaaagagggattaccataacttcagctgcaacaaccacattttggaacaagcacagaattaacataatcgatactcctggtcacgttgacttcactcttgaagtggagcgagccctcagggtattggatggtgcaatatgcttgtttgacagtgttgctggtgtggaaccgcaatctgaaactgtgtggaggcaagctgacaaatatggtgtacccaggatttgctttgttaataagatggatcgtatgggggcaaatttttttagaaccagagacatgattgtcacaaatttgggtgccaaaccactggtgattcagattccggttggtgctgaagataaatttaagggtgttgttgatcttgtgaggatgaaagccataatttggtctggggaagagttgggtgcaaagtttgagtatgtggacattccagaagatcttcaggagctggctcaagaatacaggtctcagatgattgagaacatagtcgaactagatgatagtgctatggaaagctacctagaaggagaagagccagatgaagaaaccataaagaagttaattagaaagggaaccattggtggtagtttgtgccggttttatgtggctcagcctttaagaataagggtgttcaaccattgcttgatgctgttgtagattatttgccttcgccactcgacgtgcctcctatgaagggtactgatccagataaccctgaaataataatagagaggtctgccaatgatgatgaaccattttctggactagctttcaagatcatgactgatccatttgtgggcacccttacatttgtaagaatctatgctgggaagctttctgcagggtcgtatgtgatgaacgcaaacaagggaaagaaagagaggattggtagacttctagagatgcacgctaacagccgagaggatgttaaagtagctttggcaggtgatattgttgcccttgcaggtctaaaagataccattactggtgagacattatgtgatcctgaaaatcctattgtgctcgaaaggatggacttccctgatcctgtcattaaggtggtaattgaacctaagactaaagctgatattgataaaatggctactggtttgattaagcttgcgcaagaagatccttcatttcatttctcaagggatgaagagattaaccagacagtcattgaagggatgggagaattgcatctcgagattattgttgatcggttaaagagagaattcaaggtagaagctaatgttggagcgccccaagtgaactacagagaaagcatttctaaggtatcagaagtgaagtacgtacacaaaaagcagtctggtgggcaaggtcagtttgccgatatcactgttcggtttgaacctatggaggcaggcagtggatatgagttcaagagcgaaatcaagggtggtgcagttccaaaagaatacattccaggagtaatgaaaggtttagaggagtgcatgaacaacggtgtgctagcaggctttcccgttgttgatgttcgtgctgcactagtagatggttcttaccacgatgtagactctagtgtattggcgttccagcttgcagccagaggagcttttcgggaagggatgagaaaagctggccctaagatgcttgaaccaatcatgaaagttgaggttgtcacacctgaagaacatctgggagatgttattggtgatctcaactctaggagaggacagatcaacagcttcggcgacaaacctggtggtctcaaggtggttgatgcactggttcctctagcagagatgtttcaatatgttagtacactcaggggaatgacaaaagggcgtgcttcctacaccatgcagttagccaagttcgatgttgtgcctcaacacatccaaaatgagcttgctgctgccaaggagcaagaagttgctgcttgatttttttatttttttttcattttctcatgtttggcaaataataatagttaacaattttattttggcaaatcatagtttttttccatgttcatattttgtatcaggaagtctcatgtcagcttcaacaagagaacacaagatgtattataggaacttcatatt

SEQ ID NO: 6188 - DNA, 2303 bp, Cajanus cajan
ctgatgatgcaaagcgaagtattccattgaaggattatcgcaacattggcatcatggctcacatagatgctggaaagactaccacaactgaaagaattttgtactatactggaaggaactacaaaattggtgaggtgcacgagggaaccgcaaccatggattggatggaacaagagcaagaaagagggattaccattacttctgctgcaaccactacattttggaacaagcaccggatcaacattattgatactcctggtcatgtcgacttcaccttggaagtggagcgggctcttaggggtgttggatggagctatttgcttgtttgacagtgttgctggtgtagagccacaatcagaaactgtgtggaggcaggctgataagtacggggtcccgcgaatttgtttgtcaataaaatggaccggcttggagctaacttttatcgaacaagagatatgataataacgaatttgggtgctaagccacttgtaattcagttgccaattggtgcagaagatagctttaagggtgttgtagaccttgttaggatgaaagctatagtttggtctggagaagagcttggtgccaagtttgatattgtagatattccagaagatgttctagagcaggctcaagagtaccgttcccagatgatagaaaccatagttgagttcgatgaccaggctatggagaactatctagaaggaattgaaccggatgaagaaactgtaaagaaattaattaggaagggaaccatatcagccagttttgtgccagtgatgtgtggctcagccttcaaaaacaagggagtccaaccgttgcttgatgccgtagtggattatctaccatcaccacttgacttgccagcaatgaagggaagtgaccctgaaaaccctgaagcgaccttagagagggtagcaagtgatgaagaaccatttgctggactagcttttaagatcatgagtgatccatttgtaggctcccttacatttgtcagggtatatgctggaaagctaactgctgggtcttatgtactcaatgcaaacaaagggaaaaaggagagaattggtagactcttagaaatgcatgcaaacagcagagaggatgttaaagtagctttagcaggtgatattattgctcttgcaggtctgaaagatactatcactggtgaaacgttatgtgacccagataatccaatcatgctcgagcggatggacttccctgatcctgttattaaggttgcaattgaacccaagactaaagctgatgttgacaagatggcaactggtttaatcaagcttgcacaggaagacccttctttccacttctcccgtgatgaagagattaaccagacagtgattgaaggaatgggagaattgcatcttgagatcattgttgatcggcttaaaagagaatttaaggtggaagctaatgttggtgccccccaagtgaactacagggaaagtatttccaaaaccgcagaagtgaagtatgtgcacaagaaacaatcaggtggacaaggtcagtttgcagatatcactgtacggtttgaacctatggacccaggtagtggatatgagttcaagagtgaaatcaaaggaggtgctgtaccaaaagaatacattcctggggtaatgaaaggattggaagagtgtatgagcaatggtgtgcttgctggttttccggttgttgatgtacgagcagtacttacagatggttcttaccacgatgtagattcaagtgtgttggctttccagttggcagcaagaggagcttttagggaaggaataagaaaagctggaccaaggatgcttgagcctataatgaaggttgaagttgttactcctgaagaacatcttggtgatgtaattggtgatctcaactctagaagaggtcagatcaacagttttggcgacaaaccgggtggccttaaggtggttgattccctggtacctcttgctgagatgttccagtacgtcagcacactaagagggatgacaaagggccgtgcatcctacacaatgcaattagccatgtttgatgtggtgcctcagcacattcagaaccaacttgcctcaaaagagcaagaagttgctgcttaatgtatttgcttggtctcctaacaagaaacttttcctttgatagttgtattatgtcctttgtcaaatagttgggtttgttttggtattttttattgtaattttccttgtaccaatacaaggttagccaacataaattttcagaagaaaaataggaaacgatttttcttcccatgttggagtcaatgaactgttatgatttat

SEQ ID NO: 6189 - DNA, 2317 bp, Cleome gynandra
ttttgggtagtcttcgtattggattgggctcgtcgaacgtgtcccgccatggacgtaactccaggaggagacggttctctgttttcgccatggctgatgaggtaaaacggactgtaccactcgtagattatcgtaatatcgggattatggctcacattgatgcgggaaaaacgacaacgacagagcgaattttgtattacacgggaagaaactacaaaatcggagaagtacacgaaggaacagcgactatggattggatggaacaagaacaagaaagaggaattaccataacttcagctgcaactacaacttattggaacaaacatcgaattaatatcattgatactcctggccacgttgattttacgcttgaagtcgaacgtgctttaagggtacttgacggtgctatatgtttgttcgatagtgttgcaggcgttgagccacaatcggagacggtttggagacaagctgataaatatggggttccgaggatttgctttgttaataaaatggatcgtcttggggcgaattttttcaggacgagggatatgatcgttacgaatttaggtgctaagccattagtgattcaaataccaattggttctgaagataatttcaagggtgttgttgatcttgttaggatgaaagctattgtttggtcgggagaagagttgggtgcgaagtttgcgtattcggatattcctgaagatcttcgagatttggctgaggattatcgagctcagatgatcgaaatgattgtcgagttagatgatgaagctatggagaactatttagaaggagttgaacccgaggaggaaacgattaagaaattgattagaaagggaacgatttcgagcatttttgttccggtaatgtgtggttcggcttttaagaacaagggagtgcaaccgttacttgacgcggtggtagattatttgccttcgccaattgatttaccatcgatgaaagggtcggatcctgaaaacccagaagctacaattgaacgaaaagcggacgatgatgaaccgttttctggtttagcattcaagattatgagtgatcctttcgtgggttcgcttacgtttgtgagaatttactcgggaaaactttcagctggttcgtacgttttgaatgctaacaaaggaaagaaagaacgaatcggacgattattggaaatgcacgcgaatagccgagaagatgtaaaggtagctttgacaggtgatattgtagctcttgcaggacttaaagatacaatcaccggagaaactctttctgatccagagagtcccgttgttctcgaaaggatggacttcccggatcctgtaatcaaggttgcgattgaaccaaaaacgaaagccgatatcgataaaatggctacgggtttgatcaaacttgctcaagaagacccgtcgttccatttctcacgggacgaagagattaaccaaactgttattgaaggaatgggagaattgcatcttgagattatcgtcgataggctcaagagagaatttaaggtcgaggccaacgtgggtgcgccacaagtgaattaccgtgagagtatatcgaaaatcgcggaagtgaaatacgtacacaagaaacaatctggtggacaagggcaatttgcggatattacaatccgattcgagccgttggaagcaggaagtgggtatgaattcaagagcgaaatcaaaggaggagcggttccaaaagagtacattcccggtgtaatgaaaggactcgaggaatgtatgagcaacggtgtactcgctggcttccctgtggttgacgtccgtgccgttttagtcgatggttcataccacgacgtggactcaagcgttctcgcgttccaactcgcggcaagaggtgcgttccgcgaagggataaaaaaagactagtccaagaatgttagaacctatcatgaaagtagaagtcgttacacccgaagaacatctcggagatgtcatcggagatttaaattcaagaagaggtcaaatcaatagctttggtgacaaacccggtggtcttaaggtggtggatgctttggttccgttggcggaaatgtttcaatacgtaagtacgttacgagggatgacgaaaggacgggcttcgtatacaatgcaactcgcgaaatttgacgttgttcctcaacatattcagaatcaactcgcgtcgaaagatcaagaagttgctgcttaggttttattgtctgaattggacattgtgagacatgaagatgttgtcttcacctccaatggtgtaatagaatcaattcatgtaatcaaaatctatatctatttgaacaaaagtgaattaaagg

SEQ ID NO: 6190 - DNA, 2140 bp, Flaveria ramosissima
gcccacatagatgctggaaaaactaccacaacagagcgtgtactttactacactggtagaaactacaagattggtgaggtacacgagggtacggccacaatggactggatggaacaagagcaggagagagggatcaccataacttcggctgcaaccaccacattctggaacaatcaccgcatcaacatcattgatacacctggccacgtggacttcacacttgaggtggaacgtgcccttagggttcttgatggtgccatttgcttgttcgatagtgttgctggtgttgaaccacagtcggaaacagtgtggagacaagcagataagtatggggtgcctagaatttgttttgttaacaaaatggaccggcttggtgctaacttttttagaacacgtgacatgattgttacaaatttgggtgctaaaccacttgtgctccaactcccgattggggcagaagatgttttcaaaggggttatagatcttgttaggatgaaggccatagtgtggtctggtgaagaattaggtgccaaattttcatatgaagatattccttctgaccttcaagaattatctgaagagtatcgcgcattgatgctcgagaccattgttgaattagatgacgaggttatggaagggtaccttgaaggggtggagcccgacgaacaaaccgttaagaagttaattagaaagggaaccataggaggtagttttgtaccagttttatgtgggtctgctttcaagaacaaaggggttcaaccattgctcgatgctgttgttgactatttaccctctccacttgacttgccacctatgaagggtaccgacccagagaacccagaaatcgaatttgatcgggttgcaagtgatgatgctccttttgctgggttagctttcaagatcatgaatgacccgtttgtcggatcacttacttttgtaaggatatatgctgggaagcttgctgctggatcttatgtgatgaatgcaaataaaggaaagaaagaaagaattggaagattacttgaaatgcatgcgaatagcagagaagatgttaaagtagcattagctggtgatattgttgctcttgcagggttaaaagataccattactggagaaacattatgtgatcctgagaagcctattgtgcttgagcgaatggatttccctgatccagttattaaagttgctatcgagcctaagaccaaagcagatgtcgataaaatggcaaatggattaatcaagcttgcccaagaagatccgtctttccacttctcacgtgatgaagaaattaaccaaacagttattgaagggatgggagaattgcatcttgagattatcgttgataggctcaagagggaattcaaggtggaggcgaatgtaggtgcaccacaagtaaactaccgtgaaagcatatccaaggtgtctgaggtgaagtacgtccacaagaaacagtcaggtggtcaaggacagtttgcagatatcaccgtacggtttgagccattagaggcaggtagtggatacgagttcaagagtgaaatcaagggtggtgctgtcccaagagaatacatccctggtgtgatgaaagggttagaagagtcaatgaccaatggagtacttgcaggcttccctgttgttgaccttcgtgcagtattgactgatgggtcctaccatgacgttgactctagtgtactcgccttccagctggcagccagaggagctttccgtgaaggagttaggaaagcaggacccaagattctggaacccattatgagagttgaagttgtgacacctgaagaacatttgggagatgttattggtgatcttaattccagaagaggacagattaatagctttggtgacaagcctggtggcctcaaggtggtggattcccttgtgccgcttgcagaaatgttccagtatgtgagtactctaagaggaatgacaaaaggtcgagcatcctacactatgcaactagcgaaattcgatgtggtacctcaacacattcagaaccagctttctgctgcaaaggaagaagcagttgcaacttaatatttctttcactgattctatttaatgtttgtattttttgttctttctacttttttatgttttataggacataagaaaatcctcctaattt

SEQ ID NO: 6191 - DNA, 2134 bp, Ambrosia trifida
gtgaaacgtgaggttccgttgaaggactaccgcaacattgggattatggctcacatagacgctgggaaaactacgacaacggagcgtgtgctttactacactggtagaaactataaaatcggtgaggtgcatgagggtaccgctacaatggactggatggagcaagagcaggagagagggatcactataacttcagctgcaaccaccacgttctggaacaaacaccggattaatattattgatactcctggccatgtggacttcacacttgaggtggagcgagcccttagagttcttgacggtgctatttgcttgtttgatagtgttgctggggtcgagccgcagtcggagacggtgtggagacaagcggataagtatggggtgccaaggatttgttttgttaataaaatggaccggcttggtgctaactttttaggacacgggatatgatagttacaaatttgggtgctaaaccgcttgtgctccaactcccaattggggcagaagatgtttttaaaggtgttatagatcttgttaggatgaaggccatagtttggtctggtgaagaattaggtgctaaatttgcatatgaagatattcccgctgaccttcaagagttagctgaagaatatcgcgctttaatgctcgagaccattgttgaattagatgacgaggttatggaagggtatcttgaaggggttgagcctgatgaagcaaccgtcaagaggttagttaggaagggaaccattgggggtagttttgtaccggttttatgtgggtcggctttcaagaacaaaggtgttcaaccattgcttgatgctgttgttgactatttaccctctccacttgacctgccacccatgatgggtactgaccctgagaacccagaaattgaaattgaacgggttgcaagtgatgatgaagcgttttctgggttagctttcaagatcatgaacgacccgtttgtcgggtcacttacatttgtaaggatatactctgggaaactcgctgctggatcttatgtaataaatgcaaataaaggaaagaaggaaagaattgggagattacttgaaatgcacgcgaacagcagagaagatgttaaggtagcattagcaggtgatattgttgctcttgcaggcttgaaagataccattaccggagaaacactatctgatcctgagaagcctattgttcttgaaagaatggatttccctgatcccgttatcaaagttgccattgagcctaagaccaaggcagacgttgataaaatggcaaatggattaatcaagcttgcacaagaagatccgtctttccacttctcacgcgatgaagaaattaaccaaacggttatcgaaggaatgggagaattgcatcttgagattattgttgataggctcaagagggaattcaaggtggaagcaaatgtaggtgcgccccaagttaactaccgcgaaagcatttccaggatggcagaggtgaagtatgtccacaagaaacaatcaggtggtcaaggacagtttgcagatataaccgtacggttcgagccattagaggcaggtagtggatacgagttcaagagtgagatcaagggtggtgcggtcccaagagaatacatccctggtgtaatgaaagggttagaagagtcgatgtctaacggagtactcgctggcttccctgttgttgacctccgtgcagtgttgactgatgggtcctaccatgatgttgactctagtgtactagccttccagctggcagctagaggagctttccgtgaaggagttaggaaagcggctcccaagattttggaacccattatgagagttgaagttgtgacacctgaagaacatttgggtgatgttattggtgatcttaattccagaagaggacagattaatagctttggtgacaagcctggtggcctcaaggtggtggattcgcttgtgccgctagcagaaatgttccagtatgtgagtacgttaagaggaatgacaaaaggtcgagcttcttacactatgcaactagcgaaattcgacgtggtacctcaacacattcagaaccagctttctgctgccaaagaagaagcagttacagcttaatctctcttcctgtaattctattttatgtttgtaatttt

SEQ ID NO: 6192 - DNA, 2642 bp, Vinca minor
cactctgcaacaacttcaatggcggcggcggggtctcctcatcctcaagaaggcctttccttatttactctctcaatcgaagcggccgttctaaatacacaagtagaagtagagttcgctctctcacttccggatttctcggaaatattcatcttaattctactactactgctcctaagctctcttccaatttgaggaaattcaacagcttcactgtttttgccatggccgctgatgaaggaaagagaacagtaccactgaaagactatcgcaatattggaattatggctcacatagatgcaggaaagaccaccacaactgagcgagttttgtattatacgggtagaaactacaaaattggcgaggtgcacgagggaacagctacaatggactggatggagcaagaacaggagaggggtattaccattacttctgctgccactactacattttgggacaatcatcggattaacataattgatactcctggacacgtcgactttacacttgaggtggagcgtgcactcagggttttggatggtgcgatatgtttatttgacagtgttgcgggtgtggaacctcagtctgaaactgtttggagacaagctgataaatatggagtccccaggatatgctttgttaacaaaatggatcgtcttggagcaaatttcttccgaacaagagacatgatagtgacaaacttgggtgctaaaccacttgtccttcaaatcccaattggtgcagaggacaatttccaaggagtcattgatattgtcaggatgaaagctatagtttggtcaggggaagaattgggtgcaaagttttcctatgaagacattccagctgatcttcaagaactggctgaagattatcgagcacagatgattgagactgttgttgagttggatgatgaagttatggagaattacctcgagggaaacgagcctgatgaggaaacaattaagaaactaattaggaagggaacaatttcaaacagttttgttccagttttatgtgggtcagcattcaagaataagggggttcaaccacttcttgatgcagtggtggattacttgccttctcctcttgacgtgcctgcaataacggggactgaccccgagaacccagaagtgacagttgaaaagccacccagtgatgatgaaccttttgctggattagctttcaagattatgagcgatccttttgtaggatctctaacatttgttagggtttattcagggaagctcgctgcaggatcttatgtgctgaatgcaaacaaaggaaagaaagagagaattggtagacttttggaaatgcacgctaatagcagagaggatgtcaaagtagccttaaccggtgatattgttgctcttgctggtttgaaagatacagttacaggagaaacattgtgcgatcctggcactcccatagtgctcgaacgaatggattttccagatcctgttattaaggtggcaattgaacccaagacaaaggctgatattgacaagatggcgaatggtttgattaagctcgcgcaggaagatccatctttccacttctctagagatgaagagaccaaccaaactgtaattgaaggaatgggagaattgcaccttgaaattatagttgacaggctcaagagagagtataaggtagaagctaatgttggtgcaccacaagtaaactacagagaaagcatttctaaagttgcggaagtcaaatacgtccacaagaaacagtccggtggttcagggcagtttgctgatatcactgtaaggtttgaacccttggaggcaggtactggatatgagtttaagagtgagataaagggaggagcagttctgaaagagtacattccaggtgtcatgaaaggtttggaagaaagcatgcctaatggtgtgctggcaggctttcccatggttgatgttcgtgctgtattaactgatggctcgtaccatgatgttgattcaagtgtcttggctttccaactggccgcaagaggagcttttagagagggtattagaaaagcgggtcccagaatgctagaacccataatgaaggtcgaagttgtcacccctgaagaacatttaggagatgtgatcggtgatctcaactctaggagagggcagatcaacaactttggagataaacctggtggtctcaaggttgtggatgcattggttccactggcagagatgttccaatatgtgagcaccctaagaggaatgacgaaaggtcgggcttcctatacgatgcaattagccaaattcgacgttgtcccacaacacatccagaaccagctttccgcaaaggaagaagctgttgcttcttaactttggttaagactttatttataagcaccaaggaagaggattccttggtaagttgtccactccaccatgccaggattctaaatacactttttttgtccagatgacagtatatgcataaatttttggatagtaaggaatggagaaaatggattctaaaatgtattcatgtgaatgattttacgtaattctttctttagttcatgtatctgaccataatcttttgggactaatgcttttaattgtttttgttgatgattacagtaaacataaattaatagaaagttgtaaaaccttccaactgtgtttagg

SEQ ID NO: 6193 - DNA, 2487 bp, Amorphophallus konjac
tcgccatggctggtgatgacatgaaaaggcaagtgccactgaaagattatcggaatattgggatcatggcacacatagatgcagggaagactaccactacggagcgcattctctattacacaggaaggaactataaaattggagaggtgcatgagggaactgctaccatggactggatggaacaagagcaagaaagaggcattacaataacatcagctgcaacaaccacattttggaaaaaccacaggattaacattattgacactcctggtcatgttgatttcacacttgaagttgagcgtgctctcagggtacttgacggtgctatatgtttgtttgatagtgttgctggagtagaaccacagtctgaaactgtgtggagacaagctgataaatatggagtcccaagaatatgctttgtcaacaagatggatcgtcttggagccaactttttcagaacaagggacatgataatcacaaacttgggtgctaaaccactcgtgcttcaattgccagttggtgctgaagatagtttcaaaggagtaattgaccttctgaaaatgaaagctgtgatctggtcgggagaagaattgggtgcgaagttttcatatgaagatataccggttgatcttcaagatttggctcaagaatacagaatgcagatgatagagactgttgtggagttggatgacaaagcaatggaagaatatctagaaggagtagaacccgatgaggaaactcttaagaaactaattaggaagggaaccatatcaagcagttttgttccagttttttgtggctcagcatttaagaacaaaggtgtgcaaccattgctggatgctgttgtggattatttgccatctccacttgatttgccaccaatgaagggcactgaccctgagaacccagacttgataattgaaagagcagcaagtgatgatgaaccatttgccggacttgctttcaagattatgagtgatccttttgtgggatcacttacatttgtgagagtgtatgccggcaagctagttgctggttcttatgttctcaatgcaaacaaagagaagaaagagaggataggaaggctactggagatgcatgctaatagtagagaggacatcaaagcagctctaacaggtgacatagtcgctcttgctggtcttaaagatacaatcacaggtgaaacattatgtgatccagagaaacctgttgtacttgaacggatggattttcctgatcctgttatcaaggttgcaatagaacccaagactaaagctgatgttgacaagatggctcttggactgattaagcttgctcaagaagacccatccttccacttctcaagggacgatgaagccaaccagactgttatagaaggcatgggagagctgcaccttgaaatcattgttgatcgattgaagagagaattcaaggttgaagcaaatgttggtgcacctcaggttaactaccgtgaaagcatctcaagaacaaccgaagtgaagtatgttaaaaaaaaacagtctggtggacagggtcaatttgcagatattactgtgaggtttgagcccatggaggcaggaagtggctatgaattcaagagtgaaataaagggtggggcggtgccaaaggaatatataccaggagttatgaaggggctggaagaatgcatgagcaatggtgtcctggcaggatatcctgttgttgatgttcgggcggcattggttgatggctcctatcacgacgttgattccagtgtattggcattccaactggctgctagaggggctttccgggagggtatgagaaaggctgctcctaggatgcttgaacctgttatgaaagttgaagtcgttactcccgaggagcacttgggtgatgtgattggtgatctcaactcaagaagaggtcagatcaacagctttggtgataagcctggtggtcttaaggttgtcgatgctttggtaccattggccgaaatgttccagtatgtgagtacactccggggtatgacaaaaggccgtgcctcttacacaatgcaattagccaagttcgatgttgttccacaacacatccagacccagctctcatctaaggcagaggcagttgctgcttaaacctgcagtcatttatccggcagtgccttgggagaagcagcggtttggacggccacgttaattctttgtagatcatgaactggggatgacgaatttgtatgaaccttctactatttattacaggggaaactttttgcatcaaattgcgtttcgcccccttgactcaaatctggtacaggccagattacgaccatctcttacggattgcaaagtagcgacattctgatcaaagtggcttcatcggaaaaatgttattctccatattccagtaagggtacataatatggttagaaatgatgatccagttgccgttgcggaaaacatttttgcccctgtcgattactttcatctggaaattgtctcatgaaacaac

SEQ ID NO: 6194 - DNA, 2186 bp, Trigonella foenum-graecum
atcattgatactcctggtcatgttgacttcaccttagaagtggagcgtgctcttagggtgttggatggagctatatgcttgtttgacagtgttgctggtgtggagccacaatcagaaaccgtgtggaggcaagctgacagatatggagtcccgcgaatttgttttgtcaataaaatggaccgccttggagcaaattttttccgaacaagagacatgatagtgacaaatttaggtgctaagccacttgtacttcagctcccaattggtgcagaagattccttcaagggagttattgatcttgttaggatgaaagctatagtttggggtggagaagagcttggtgccaagtttgcttatgaagatatacctgcagatctcctcgagcaggctcaagattacaggtcacagctgatagaaaccatagttgagttagatgacgagactatggagaactacctagaaggagttgaaccagatgaagaaactataaaaaattaattaggaagggatccatagcagccacttttgtgccagtgttgtgtggatcagctttcaaaaacaagggagtccaaccgttgttagatgccgtagtggattatctaccatcaccacttgacgtaccaccaatgaagggaactgaccctgaaaacccagaagcaacaatagagagggtagctagtgatgatgaaccattttctggactagcttttaagatcatgagtgattcatttgtaggatcccttacgtttgtcagagtgtattctggaaagctaaccgcagggtcttatgtactcaattcaaacaaaggcaaaaaggagagaattggtagacttctagaaatgcatgcaaacagcagagaagatgttaaagtagctttaacaggggatattgttgctcttgctggtttgaaagatacaataacaggtgaaacattgtgtgaccccgaggatccagtcgtgcttgagcggatggacttccctgatcctgttattaagattgcaattgagcccaaaactaaagctgacattgacaagatggcagctggtttagtcaagcttgcacaggaagacccttctttccacttctcccgtgatgaagagataaaccagacagtgattgaaggaatgggagagttgcatcttgaaatcattgttgaccgtctcaaaagagaatataaggtagaagctaatgttggtgctccccaagtaaactacagggaaagcatttccaaaatcacggaaacgaggtatgtgcacaagaaacaatcaggtggacaaggccagtttgcagatataaccgtacggtttgaacccatggagccaggtagtggatatgaattcaagagtgaaatcaaaggaggagcagttccaaaagaatacattccgggggtggttaaaggattggaagagtgcatgagcaatggtgttctggctggatttccagttgttgatgtacgtgcagtacttgtagatggtacttaccatgatgtggattcaagtgtgttggctttccagttggctgcaagaggagctttccgggaaggaataagaaaagccggaccaaaaatgcttgaacctataatgaaagttgaagttgttactcctgaagaacatttaggagatgtaattggtgatctcaactcaagaagaggccaaatcaacagttttggtgacaaaccaggtggactcaaggtggttgattcattagtacctcttgctgagatgtttcagtatgtcagtacactcagagggatgacaaagggtcgagcatcctactcaatgcaattagccatgtttgatgtggtacctcaacacattcagaaccaacttgctacaaaagtgcaagaagtttctgcttaatgtatttccttggtgccctaaccaggaggattatcttccatttgatacttgtattatgttcattgttctatagttgttttattttttggggggtatttttcattgcaatttttcttgtactaatacaaggttagccaaaaaaaaaggaaacactcagaagaaaaaaggaaacacgatttttcttccttgaactgttactggacaaattttggtgtatatttttgtttttgtttttgggagaaagtaagtcatttaagcttggattttgcagaaccacatcttaagaacccatagttatttacacatctatagtgatgttcattctga

SEQ ID NO: 6195 - DNA, 2568 bp, Artemisia annua
aagcagtggtataacgcagtactccaacggggctcttcacattccaagtgtgagactcttaaaaaaaacccaatggcggcagaagctgttgccatgtcatcactctgtaacttctccggcaacaatggtgctggtgggtcatctaccaggcccccggtccgacggtttcttctttctccgggtaactctctacggagatgtcagtataataacaggagtatgacgtcatccttttttgggacacaagggttgatgaggaatagtagtaaaacgttgggtggtgtttgggaagaggaatttgtctgttgttgccatggctgctggccctgaagatgggaagcgtgaggttccattagaggactaccgtaacatcggtatcatggctcacattgacgccggaaaaaccaccacaaccgaacgtgtcctatactacaccggtagaaactacaaaattggtgaagtacacgaaggtaccgccaccatggactggatggagcaagaacaagaaagaggaatcaccattacatcagcagcaaccacaacattctggaacaagcaccgaatcaacatcatcgatacacccggtcacgtggacttcacacttgaagtagaacgtgcccttagggttcttgatggtgctatttgcttgttcgatagtgttgctggcgttgaacctcagtctgaaacagtgtggagacaagctgataaatacggtgtcccacgtatttgttttgttaataagatggaccgtttgggtgctaatttctttagaacacgtgatatgattattacaaatttgggtgctaaaccacttgtgcttcaacttccaattggagcagaggacgtctttaaaggggttatagatctcgttaggatgaaagcgattgtttggggtggtgaagagttgggagcaaagttttcatatgaagatattcctgctgatcttcaaaaattatctgaagaatatcgggctacaatgcttgaaaatatagtagaactagatgatgaagtgatggaagcgtatcttgaaggtgttgaacccgacgaagcaacggttaagaagttaattagaaagggtactattggaggtagttttgtgcccgttttatgtgggtctgcttttaaaaacaaaggtgttcagcctctgctcgatgcggttgttgactacttaccttcaccccttgatgtgccacctatgattggtactgatcccgataaccctgaaattgaaattccaagggttgcaagtgacgatgaaccgtttgctggactagctttcaagatcatgaacgacccatttgtggggtcacttacttttgtaagaatatatgctggaaagcttgctgctggatcttatgtagttaattcaaacaaggggaagaaagaaagaattgggaggttacttgaaatgcacgcgaatagtagagaagatgttaaagtagcgttgacaggtgatattgtggctcttgcgggtttgaaagatacaattactggtgaaacgttatgtgaccctgacaagccaattgttcttgaaagaatggatttccctgatcctgttattaaagttgctattgaacccaaaactaaagctgatgttgataagatggctaatggtttgattaagctggcacaagaagatccttctttccatttttcacgagatgaagaaataaaccagacggttattgaaggaatgggtgaattgcatcttgagattattgttgataggctcaagagggaatttaaggtagaagcaaatgttggtgcaccacaagtaaactaccgtgaaagtatatcacgtgtgtctgaagtaaaatacgtccacaaaaaacaatccggtggtcaaggtcaatttgcagatattaccgtccggttcgagcctttagaggcaggcagtggatacgagttcaagagtgagatcaagggaggagcagtcccaagagaatacattcctggtgttatgaaagggttagaagagtccatgtcaaatggtgtactcgcaggcttccctgttgttgacgttcgtgcagtattaacagatggtaactaccatgatgttgactctagtgtcttagctttccagctggcggctagaggtgctttccgtgaaggtgttaggaaagcgggtcctaagattttggaacccattatgagagtcgaagttgtgacacctgaagaacatttgggtgatgttatcggtgatctcaattccagaagaggacagattaatagctttggtgacaagcccggtggtctcaaggtggtggattcactagtgccactagcagaaatgttccagtacgtgagtacgctgagagggatgacaaaaggtcgagcatcgtacactatgcaactagcgaagttcgatgtggtacctacacacatccagaaccagcttgctgctggcaaagaagaagctgtcgcagcttgatcttttgtctaattgcgctgtttaatatttgtaattttcactccacatgtcatattaggacaatacaaaagcctccaatttttcatcatacattataccgagccacgtgtttattttatccaattcataaatttgtg

SEQ ID NO: 6196 - DNA, 2543 bp, Guizotia abyssinica
aattacagataactttgtggcgccactctttcaatggcggcagaagctgttactgccgcttctctctgcaacttctccggcagcaatgttgcttcttcaagcaggctgccgcgccgccgctaccttctgtctccctccctcagccgtcacaatctccaccagcaacgtagccttacgtcctccttcatcggaacgcaacgtatcgctccaggcaaatcaaattctcactttcagaagaggaatctctcggttttcgctatggctgctgctgaagacggaaaacgtgaggttccattgaaggactaccgcaacattggcattatggcgcatatagacgctggaaagactaccacaacagaacgtgtactttactacactggtagaaactacaaaattggtgaggtacatgagggcaccgccacaatggactggatggaacaagaacaggaaaggggaatcaccataacttcagctgcaaccaccacattctggaacaaacaccgcatcaacatcattgatacacctgggcacgtggacttcacacttgaggtggagcgtgcccttagggttcttgatggtgccatttgcttgtttgatagtgttgctggtgttgagccacagtcagaaacggtgtggagacaagcagataagtatggggtgccaagaatctgttttgttaacaaaatggaccggcttggtgctaacttttttagaacgcgtgacatgataattacaaatttgggtgctaaaccacttgtgctccaactcccgattggggccgaagatgtttttaaaggggttatagatcttgttaggatgaaagccatagtttggtctggtgaagaattaggtgccaaattttcatatgaagatattccttctgatcttcaagaattatctgaagaatatcgagcattaatgctcgagaccattgttgatttagatgacgaggttatggaagcgtatcttgaaggcgttgagcccgatgaagaaaccgttaagagattagttaggaagggaaccataggaggtagttttgtaccagttttatgtgggtcagctttcaagaacaaaggggttcaaccgctgcttgatgctgttgttgactatttaccctctccacttgacttgccacctatgaagggtaccgacccagagaacccagaaattgaaattgaaaggattgcaagcgatgatgaaccgttctctgggttagctttcaagatcatgaacgacccgtttgtcgggtcacttacatttgtaaggatatatgctgggaagcctgctgctggatcttatgtaatgaacgcaaataaaggaaagaaagaattgggagattacttgaaatgcatgcaaatagcagagaagatgtcaaagtagcattagctggtgatattgttgctcttgcagggttaaaagataccattactggggaaaccttatgtgatcccgacaagcccattgtgcttgagagaatggatttccctgatccagttattaaagtcgccattgagcctaagaccaaagcagatgttgataaaatggcaaatggattaatcaagcttgcacaagaagatccgtctttccacttctcacgtgatgaagaaattaaccaaacggttattgaagggatgggagaattgcatcttgagattatcgttgataggctcaagagggagttcaaggttgaagcaaatgtaggcgcaccacaagtaaactaccgtgaaagcatttccagggtgtcagaggtgaagtatgtccacaagaaacagtcaggtggtcaaggacagtttgcagatataaccgtacggtttgagccattagaggcaggtagtggatacgagttcaagagcgagatcaagggtggtgccgtcccaagagaatacatcccaggtgtaatgaaagggttagaagagtcgatgactaacggtgtagttgcagactttcctgttgttgaccttcgtgcagtgttgactgatgggtcctaccatgatgttgactctagtgtactagccttccagctggcagctagaggagctttccgcgaaggagttaggaaagcggcacccaagattttggaacccattatgagagtagaagttgtgacacctgaagaacatttgggagatgttattggtgatcttaattccagaagaggacagattaatagctttggtgacaagcctggtggcctcaaggtggtggattcccttgtgccgctagcggaaatgtttcagtatgtgagtactttaagaggaatgacaaaaggccgggcatcttacactatgcaactagcaaaattcgacgtcgtacctacacacattcagaaccagctttctgctgccgaagaagaatcagttgcagcataatctttcttcctgtaactctatttaatgtttgtaatttttcacttctcatgttttataggaccatattaaaatcaattttccatcgacagatatacgaagcaacatgtttgtttatttatccattcataagttttggcttattttgctcgaaaaaaagaaaaaaggccgcctcgg

SEQ ID NO: 6197 - DNA, 2351 bp, Solanum tuberosum
ctaccaccttctggaacaagcatcgtatcaacattattgatactcctggtcacgtggacttcactcttgaagtggagcgtgcccttagggttttagatggtgccatatgcttgtttgacagtgttgctggtgtggaacctcaatcagaaactgtttggagacaagctgataagtatggagtcccaaggatatgtttcgtaaataagatggatcgtcttggagctaatttcttccgaacaagagacatgatagtaacaaacttgggtgctaaaccacttgtaattcagattccaattggtgcagaggatacattcaaaggattagttgatcttgtgatgatgaaagctattgtttggtccggagaagaattaggggcaaagttttcctatgaggacattcctgctgatcttcaagagctagctgaggagtatagggcactgatgattgagaccgtagttgaattggatgatgatgttatggagaaataccttgagggggttgaacctgatgaggcaaccattaaacagttgatcaggaagggaactatctctggcaattttgtccctgtattatgtggctcagctttcaagaacaagggggttcagccgcttctcgatgcagttgtggattatttgccttctccagttgacgtgccacccatgaatggaaccgaccctgacaacccagaagtgatcattgagagggccccaagtgatgatgaaccatttactggtttggcatttaagatcatgaatgacccttttgtcgggtctctcacatttgtcagggtatattcaggaaagcttactgcaggatcatatgtattgaatgcaaacaaaggcaggaaagagagaattggcagacttctggaaatgcatgctaacagcagagaggatgtaaagacagcgttaactggtgatattgttgctcttgctggattgaaagatacaattacaggagagacattgtctgatcccgagaagcctgttgtgcttgagcgcatggatttcccagatcctgttataaaggttgcaattgaacctaagaccaaagcagacattgataagatggcgcaaggcttaataaaactggctcaagaggatccgtctttccatttttcacgtgatgaggagattaaccagacagttatcgagggaatgggagaattacatcttgagatcattgtagatcgactgaaaagggaatttaaggtggaagctaatgttggagctccacaagtaaactaccgtgagagcatttccaggaatgcagaagtgaaatacgtgcacaagaagcagtctggtggttcaggacagtttgctgatatcacagtaaggtttgaacccatggaagcaggcggtggatatgaattcaagagtgaaatcaagggaggtgcagtgccaaaagaatatattccaggtgttatgaagggattagaagaatgcatgagtaacggggtactggcaggctttcccgttgttgatgttcgtgctgtgctagtagatggctcttaccatgatgtggattcaagtgttttggcattccagctggctgctcggggagcttttagggaagggatgagaaaagctagtccacaattgctagaacccataatgaaggttgaagtagtaacaccagaagaacatctaggagatgtgattggtgaccttaattcaaggaggggtcagatcaacagctttggagacaaaccgggaggtctcaaggtggtggatgctttagttccattagcagagatgttcaattacgttagtaccttgcgagggatgacaaagggtcgtgcatcttacgttatgcaattagccaaatttgacgttgtccctcaacacattcaaaaccagcttgccaaaaaggaggaagcagcagccgcttagtcagtcatcttccagattttggatccacgaacttgaaaataggtatttttactcgacaaagatgttaaggcttgcacaacattctttttgtacgtactagcatgaaacaccgatggagaatagctgatatttagttatacgtctgagttttttcagccatttgtgtatgtcgttgaatttataagctgagactccgaagggacagaagaaagaaaggactaaatgtgtatacatgcatttaagatatctctgcatccaaagaagcatcaatattttagggcaagattgagtgtgtcctgattttgggattatttttcttactatagaagaacaaatatatgctttgtaacaatttgatgctctttattgagatcttaggtgtaacatctgacggtttgagttgtttatttcacatttgttttatgttgcaattctatttataatattgaggtccaaact

SEQ ID NO: 6198 - DNA, 2187 bp, Brassica napus
caaaataacggcgaacggttactaccgaaggacgacagacgtacaataggactggatggagcaagagcaagaaagaggaatcaccatcacttcagctgcaaccaccacgttctgggacaagcacaggatcaacatcatcgatacgcctggacacgtggatttcactctcgaagtcgaacgtgctctgagagttctcgacggagctatatgcttgttcgacagtgttgctggcgttgagcctcagtccgagactgtgtggagacaagctgataaatacggtgtgcctaggatctgctttgtgaacaagatggaccgtcttggagctaactttttcaggactagggacatgattgtgactaatctcggtgctaagcccttggtgcttcagataccaatcggtgctgaagattcttttaaaggtgtggttgatctcgtgaggatgaaggctatagtttggtctggagaagagcttggtgccaagtttaattacgaggatattccagcggatcttgaagagttggctcaagagtatagggctgcgatgatggagctgattgttgatttggatgatgaggttatggagaattatttagaaggagttgagcctgacgaggccacggtgaagagattggttaggaaaggaaccatcacagggaagtttgtgcctattctctgtggctcagcgtttaagaacaaaggtgtgcagccgttgcttgatgctgtggttgactatcttccttctccagttgaagttccgccgatgaacggaacagatcctgagaacccggaagttaccattgtccggaaaccagatgatgaggagcctttcgctgggttagcgttcaagatcatgagtgatccttttgttggctctcttacgtttgtgagagtctactcagggaagctcacagctggctcttacgtgctgaacgctaacaaaggaaagaaggagagaatcggaagacttttggagatgcacgcaaacagcagagaagatgttaaagtagcattaacgggtgacattgtggctctcgctggtctcaaagatacaatcactggcgaaacgttgagtgatccggaaagccctgttgtcctcgaacgtatggacttccctgatcccgtcatcaaggtggcgatcgagccgaaaaccaaagcggacattgataaaatggctacgggactgatcaagctcgctcaagaagacccttctttccatttttcacgcgatgaggagatgaaccaaaccgtcattgaaggaatgggagagcttcatcttgagatcatcgtcgacaggcttaaaagagagttcaaggtcgaggctaacgttggagcgccgcaagtgaactaccgtgagagtatctccaaagtagctgaagtgaagtacacgcacaagaagcaatcaggtggacaaggacagtttgctgatattacagtcaggttcgagccgttagaagcaggatcagggtacgagttcaagagcgagatcaaaggaggagctgtgccaagagagtatattccaggtgtgatgaaagggcttgaggagtgtatgagctccggtgtgcttgcgggttttccggtggttgatgtccgtgcttgtctagttgatggttcttaccatgatgtggactcgagcgtgttagctttccagctagctgcgagaggagctttccgtgaagggatgaggaaagcaggtccgaggatgcttgaacctattatgagagttgaagttgttacgccagaagaacatcttggtgatgtcattggtgatcttaactctaggagaggtcagatcaacagcttcggagacaaacccggtggtctcaaggtggtagattctctggttccgttagcagagatgtttcagtatgtgagtacattgagggggatgacaaaaggtcgtgcttcttacataatgcaattggctaagttcgatgttgttcctcagcatattcagaaccagctttcctccaaggatcaagaagttgctgcttaagtcggacagattatgttttcatgttcagaaacttcactgaaatgtgttatcttgataatgtttaatcatttctatagttttgtttggttttgatgaagagaacaaatatatttaactctttttgtgtggatgtcaaaacaagtacgggaatgtagataacactttgaatgattcaagttcgatgcattcaactg

SEQ ID NO: 6199 - DNA, 4264 bp, Brassica napus
tacctttctcggtcttcctcctcgcgcttctctttctcatcttctcggtaaagctcgtattgggcttggctcttcaaagctagtacaccgaaagaaacaattctctgtcttcgccgccgccgaaggagaggggaagcgcgccgtgccgcttaaagactacagaaacattggcatcatggctcacatagacgctggaaagactacaacaacggagaggattctctactacacaggaagaaactacaagatcggcgaagtccacgaaggaacagccacaatggattggatggagcaagagcaagagagaggaatcaccattacctcagctgcaaccaccacgttctgggacaagcacaggatcaacatcatcgatactcccggacacgtggatttcactcttgaagtcgaacgtgctctgagagttctcgacggagctatatgcttgttcgacagtgttgctggcgttgagcctcagtccgagactgtgtggagacaagctgataaatacggtgtgcctaggatctgctttgtgaacaagatggaccgtcttggagctaactttttcaggactagggacatgattgtgactaatctcggtgctaagcccttggtgcttcagatacctattggtgctgaagattcgtttaaaggtgtggttgatctcgtgaggatgaaggctatagtttggtctggagaagagcttggtgccaagtttaattacgaggatattccagctgatcttgaagagttggctcaagagtatagggcggcgatgatggagctgattgttgatttggatgatgaggtcatggagaattatttagaaggagttgagcctgacgaggccacggtgaagagattggtgaggaaaggaaccatcactgggaagtttgtgcctattctctgtggctcagcctttaagaacaaaggtgtgcagccgttgcttgatgctgtggttgactatcttccttctccagttgaagttccgccgatgaacggaacagatcctgagaacccggaagttaccattgtccggaaaccagatgatgaggagcctttcgctgggttagcgttcaagatcatgagtgatccttttgttggctctcttacgtttgtgagagtctactcagggaagctcacagctggctcttacgtgctgaacgctaacaaaggaaagaaggagagaatcggaagacttttggagatgcacgcaaacagcagagaagatgttaaagtagcattaacgggtgacattgtggctctcgctggtctcaaagatacaatcactggcgaaacgttgagtgatccggaaagccctgttgtcctcgaacgtatggacttccctgatcccgtcatcaaggtggcgatcgagccgaaaaccaaagcggacattgataaaatggctacgggactgatcaagctcgctcaagaagacccttctttccatttttcacgcgatgaggagatgaaccaaaccgtcattgaaggaatgggagagcttcatcttgagatcatcgtcgacaggcttaaaagagagttcaaggtcgaggctaacgttggagcgccgcaagtgaactaccgtgagagtatctccaaagtagctgaagtgaagtacacgcacaagaagcaatcaggtggacaaggacagtttgctgatattacagtcaggttcgagccgttagaagcaggatcagggtacgagttcaagagcgagatcaaaggaggagctgtgccaagagagtatattccaggtgtgatgaaagggcttgaggagtgtatgagctccggtgtgcttgcgggttttccggtggttgatgtccgtgcttgtctagttgatggttcttaccatgatgtggactcgagcgtgttagctttccagctagctgcgagaggagctttccgtgaagggatgaggaaagcaggtccgaggatgcttgaacctattatgagagttgaagttgttacgccagaagaacatcttggtgatgtcattggtgatcttaactctaggagaggtcagatcaacagcttcggagacaaacccggtggtctcaaggtggtagattctctggttccgttagcagagatgtttcagtatgtgagtacattgagggggatgacaaaaggtcgtgcttcttacataatgcaattggctaagttcgatgttgttcctcagcatattcagaaccagctttcctccaaggatcaagaagttgctgcttaagtcggacagattatgttttcatgttcagaaacttcactgaaatgtgttatcttgataatgtttaatcatttctatagttttgtttggttttgatgaagagaacaaatatatttaactctttttgtgtggatgtcaaaacaagtacgggaatgtagataacactttgaatgattcaagttcgatgcattcaactgagacaaagagaacaagatttaatcacgacaaggttcacgtcacaatcgatataggaaaagacgaaagttataacagaaaaatgggaacaatcgattttggatttgagttacaaaaagtaaaaacactgcgtttaagtttatttcatctggacgattcctgagctgattagcttttggattttgttcatgatcatcgggttctgcatgtgtttttgtgctgctgctggattctcctggagatcagacagaacctgtctcattacgggatctgtgagaatgttctggatctcagggtcttgcattcccttagcctgtctttctttcaactcctctggagtaaggtcaccacggtttgccttgttgatctgttgcacacatcttctaacaccgtctaggagctcctgattgttaggatcatgtttgagaccctcctggtatgtttccattgcattgtcatactccttcatgaagaattggactgcaccttttctgctgtatccctttgagaatgttggatcgagctcaatgcacttctccgcatccttcaatccttcgggcattgcccccagttttgtgtaacatgcagctcggttgctgtatgctctcgggtcttttggattccttttgatcgcttcagtgtagtgtctcacagcatcaggatacttctgctccttgaagaactgattacctttctcacgctcctcatcaccaatagctggatcaaaatactcttgctgctccaactctttcttagctctctctgcctcattcagcctcttcaacgtgtctgggttacggtgctccgtaagtgctttctggtaagtctcaatcacaggttcatagtcttttgagactttagccatcttccccagagctgttcctttcctggtcaaagctttagctaccatcttgtaatctgacctaagctctctacccctttcaacagccttatcacagtccttgatgcactcatcatactttcccatctcgagatgaacagcagcacggttagtgataaaagagatatcttcatcatcaatctccatagccgtggagtaatgcttgatagcagtttcaaagtccttcttcttatacgcagcgttccccatctctttctccttcaaagccttctccctcctctccttcttctccttctcctccgcaacctccggctcaggctcaggctccggctcacgcttcttctcaaccacaggctcattcacaaccatctcatcctcctcctgagccccctcagcttcatcaccagtctgagtcctgaactgaacattcaacaaaaccccaagagactgcatcaccctctggtccttcaagtagagattaagactgctcgggttcctctggatctcctgcatcatgttgacgaaatcaggctgcttcaagaaccccctcgtcgacggatccgccgtcagcttggcccacatctcgggccccttgaacgcatccccgaacggattcggcggaggagcggcgcgtgacctcgacgcgtcagctaagcccgacttcaacgcctcgttgctcggatcgatctcgagccccttggagtacgcctccacggcctcctcgtggtggttcagacccaggtgagcggcgccgaggcggctgtagcccttggcccagtccggtttgagctcgacggtcttcttggcgtcggagagagcttcctcgtagtggtggagggaggcgtgggcggcggagcggttggagaagaggacgtggttggttggagcgaggttgatcgcgtcggtgaagtgggtgacggcggaggcgaagtcgccggaggagaaagcggcgttgcctttggctttagcttcgtcggccatggttg

SEQ ID NO: 6200 - DNA, 2814 bp, Solanum phureja
cagagtcagtgacaagaatgtcatctgctgcttcttcactctgtaactttaatgggtctcaaagacccgtacccgtttccaaccgggtcgcttcttctcggaggaatcgatgtgttaaactacagtcacttgcttctgcttccatgtctgaattctttggaagctcacgagtgttctctgttaatggttctaaaagcttaggattatctcagaaaacaagaaagaatggattttctgttattgctatggctgcagctgaagaggagaagagaacagttcctttgaaggactatcgcaatataggaattatggctcatatagatgcggggaagacaactacaacggaacgtgtcctttactatactggcagaaactataaaattggtgaagtgcatgagggaactgccacaatggactggatggagcaagagcaagagagggggattacaattacttctgctgctactaccaccttctggaacaagcatcgtatcaacattattgatactcctggtcacgtggacttcactcttgaagtggagcgtgcccttagggttttagatggtgccatatgcttgtttgacagtgttgctggtgtggaacctcaatcagaaactgtttggagacaagctgataagtatggagtcccaaggatatgtttcgtaaataagatggatcgtcttggagctaatttcttccgaacaagagacatgatagtaacaaacttgggtgctaaaccacttgtaattcagattccaattggtgcagaggatacattcaaaggattagttgatcttgtgatgatgaaagctattgtttggtccggagaagaattaggggcaaagttttcctatgaggacattcctgctgatcttcaagagctagctgaggaatatagggcactgatgattgagaccgtagttgaattggatgatgatgttatggagaaatacctggaaggagttgaacctgatgatgcaaccatcaaacagttgatcaggaagggaactatctctggcaattttgtccctgtattgtgtggctctgctttcaagaacaagggggttcagccacttctcgatgcagttgtggattatttgccttctccagttgacgtgccacccatgaatggaaccgaccctgacaaccccgaagtgatcattgagagggccccaagtgatgatgaaccatttactggtttggcatttaagatcatgaatgacccttttgtcgggtctctcacatttgtcagggtatattcaggaaagcttactgcaggatcatatgtattgaatgcaaacaaaggcaggaaagagagaattggcagacttctggaaatgcatgctaacagcagagaggatgtaaagacagcgttaactggtgatattgttgctcttgctggattgaaagatacaattacaggagagacattgtctgatcccgagaagcctgttgtgcttgagcgcatggatttcccagatcctgttataaaggttgcaattgaacctaagaccaaagcagacattgataagatggcgcaaggcttaataaaactggctcaagaggatccgtctttccatttttcacgtgatgaggaggttaaccagacagttatcgagggaatgggagaattacatcttgagatcattgtagatcgactgaaaagggaatttaaggtggaagctaatgttggagctccacaagtaaactaccgcgagagcatttccaggaacgcagaagtgaaatacgtgcacaagaagcagtctggtggttcaggacagtttgctgatatcacagtaaggtttgaacctatggaagcaggcggtggatatgaattcaagagtgaaatcaagggaggtgcagtgccaaaagaatatattccaggtgttatgaagggattagaagaatgcatgagtaacggggtactggcaggctttcccgttgttgatgttcgtgctgtgctagtagatggctcttaccatgatgtggattcaagtgttttggcattccagctggctgctcggggagcttttagggaagggatgagaaaagctagtccacaattgctagaacccataatgaaggttgaagtagtaacaccagaagaacatctaggagatgtgattggtgaccttaattcaaggagaggtcaaatcaacagctttggagacaaaccgggaggtctcaaggtggtggatgctttagttccattagcagagatgttcaattacgttagtaccttgcgaggaatgacaaagggtcgtgcatcttacgttatgcaattagccaaatttgacgttgtccctcaacacattcaaaaccagcttgccaagaaggaggaagcagcagctgcttagtctgtcatcttccagattttggatccacaaacttgaaaataggtatttttactcgacgaagatgttaaggcttgcacaacattctttttgtacgtaccagcatgaaacaccgatggagaatagctgatctttagttatacgtctgagttttttcagccatttgtgtatgtcgttgaatttataagctgagactccgaagggacggaagaaagaaaggactaaatgtgtatacatgcatttaagatatctctgcatccaaagaagcatcaatattttagggcaagattgagtgtatcctgattttgggattatctttcttactatagaaacaaatatatgctttgtaacaatttgatgctctttattgagatcttaggtgtaacatctgacggtttgagttgtttatttcacatttgttttatgttgcaattctatttataatattgaggtccaaact

SEQ ID NO: 6201 - DNA, 1748 bp, Flaveria ramosissima
acagacggaacagtgcggaggactaagacagataagtatggggtggcctagaattgtttgttacaaaataggacggctggtgctactttttagtaacacgtgacatgattgttacaaattgggtgctaaaccacttgtgctccaactcccgattgggggagaagatgttttcaaggggttatcgatcttgttaggatgaaggccatagtgtggtctggtgaagaattaggtgccaaatttcatatgaagatattcctctgaccttcaagaattgtctgaagagtatcgagcattgatgctcgagacaattgttgaattagatgacgaggttatggaagggtaccttgaaggggtggagcctgacgaacagaccgttaagaagttaattagaaagggaaccataggaggtagttttgtaccggttttatgtgggtctgctttcaagaacaaaggggttcaaccattgctcgatgctgttattgactatttaccctctccacttgacttgccacctatgaagggtaccgacccagagaacccagaaatcgaaattgatcgggttgcaagtgatgatgctccttttgctgggttagctttcaagatcatgaatgacccgtttgtcggatcacttacttttgtaaggatatatgctgggaagcttgctgctggatcttatgtgatgaatgcaaataaaggaaagaaagaaagaattggaagattacttgaaatgcatgcgaatagcagagaagatgttaaagtagcattagctggtgatattgttgctcttgcagggttaaaggataccattactggagaaacattatgtgatcctgagaagcccattgtgcttgagcgaatggatttccccgatccagttattaaagttgctattgagcctaagaccaaagcagatgttgataaaatggcaaatgggttaatcaagcttgcccaagaagatccgtctttccattctcacgtgatgaagaaattaaccaaacggttattgaagggatgggagaattgcatcttgagattatcgttgacaggctcaagagggaattcaaggtggaggcgaatgtaggtgcaccacaagtaaactaccgtgaaagcatatccaaggtgtctgaggtgaagtacgtccacaagaaacagtcaggtggtcaaggacagtttgcagatatcaccgtacggtttgagccattagaggcaggtagtggatacgagttcaagagtgaaatcaagggtggtgctgtcccaagagaatacatccctggtgtgatgaaagggttagaagagtcaatgaccaatggagtacttgcaggcttccctgttgttgaccttcgtgcagtattgactgatgggtcctaccatgacgttgactctagtgtactcgccttccagctggcagccagaggagctttccgtgaaggagttaggaaagcaggacccaagattctggaacccattatgagagttgaagttgtgacacctgaagaacatttgggagatgttattggtgatcttaattccagaagaggacagattaatagctttggtgacaagcctggtggcctcaaggtggtggattcccttgtgccgctagccgaaatgttccagtatgtgagtactttaagaggaatgacaaaaggtcgagcatcctacactatgcaactagcgaaattcgatgtggtacctcaacacattcagaaccagcttctgctgcaaaggaagaagcagttgcaacttaa

SEQ ID NO: 6202 - DNA, 2615 bp, Mimulus guttatus
atatggcggcagcatcagaatcgattatgaaaatattacccaactcttcttcagccctctgcaacttaaatggctcttcccgtaggcctctgccgcccgtctctcaatccacgcgccgccgtaggtgtaacccttcttccagagttcgtgccctttcttcttcgtttcttggcaccgtccgcctcagctccgccgccgccaagctctcgactttgcagcagagaaggaacttgtctgtatttgccatggctgctgcccctgttgaggaaaaaagaacggtcccactaagagactaccgtaacatcggaatcatggcccacatagacgcgggcaaaaccaccacaacagagcgtatcctctactacacgggccgcaactacaagatcggagaggtccacgagggcaccgccacaatggactggatggagcaagagcaagagcgagggatcaccataacttccgctgcgaccaccacattctggaacaagcaccgcatcaacatcatcgacacaccaggccacgtggacttcacgctcgaggtcgagcgggccctacgtgtcctcgacggcgccatctgtctcttcgacagcgtcgccggagtcgagccccagtcggagacagtctggcggcaggccgataaatacggggttccccgtatatgcttcgtcaacaaaatggaccgcttgggagcaaatttcttccgcacaatagacatgattgtaagtaacctcggagccaaacccttagtcctccaaatacccgtcggagccgaagacacctttaagggcgtaatcgacattgtaagaatgcaagcaattatttggtccggcgaagaattgggcgcgaagttctcctacgaggaaatacccgaagatcttcaagatatggctcaagagtatcgcgcccaaatgatcgaaaacatagttgagctcgatgacgaggcgatggaggggtacctagaagggctcgagccagatgaagaaactatcaagaagctaattcggaaagggactattgggggatctttcgttccggttttgtgtgggtccgcttttaaaaataaaggtgtgcagccattattggattccgtggtggactatttgccttctcccgaggaggtgccgccaatgaaaggaaccgaccccgacgacccggaattgataattgaacgaggggcgaacgacagcgagccctttgctggattggctttcaagattatgagcgacccttttgtgggctcactcactttcgttagggtttacgcgggaaagctcgaggcgggttcttatgtgctcaactcgaataaaggaaaaaaagagagaattggtagacttcttgaaatgcacgcgaatagtagagaggatgtcaaggttgccctaacgggggatattattgcgcttgctggtctgaaagatactgttaccggcgagactttgtgcgatccggaaaaaccgattgttcttgaaagaatggatttcccggaccctgttattaaggttgcgattgaacctaagacgaaagcggatatcgataagatggcggttgggttgattaaacttgcgcaagaggatccttctttccatttttcgagagatgaagagattaatcagacggttattgaaggcatgggagagttgcatcttgagattatcgttgatcggcttaaaagggaatataaggtggaagcaaacgtgggagcgccacaagtcaactaccgggagagcatatcaaagataacagaagtcaaatacgtccacaagaagcaatcgggcgggtcgggtcagttcgctgacatcaccgtacgattcgagccgttggaagctggcagcgggtacgagttcaagagcgagatcaagggtggagctgtgcccagggagtacattccaggtgtcgtcaagggattggaggagagcatgagcaacggtgttttggccggataccctgtcgttgatgttcgtgctgtattggtcgatgggtcataccacgatgttgactccagcgtcttggcgttccagctggcggccagaggggcgtttagggaaggtattaggaaggcgggcccacgcatgctcgagcctattatgaaggtggaggttgttacgcccgaagaccatttgggtgatgtcattggtgacctcaactcgaggagagggcaaatcgagaattttggagataaacctggtggcttgaaggtggtggatgctttggtgccgctagcggagatgtttcagtatgtgagtacattaagaggaatgacgaaagggcgagcttcgtatacgatgcagttggctaaatttgacgttgtgcctcagcatattcagaaccagctcgctacgaaagaggaggctgttactgcctgatcttgattcctagtactaaacaaaaagtataaatacaattcactattgcaaagattgatgttcttttcgtttataatttaatttttttctttttttttttttttttttttttgttcgggggaacgatgagcagattttttgcacatagaacaattgaatggtgaaggtatagaagagacagcttcagttgtctgcttttttatcggtggacttgccaaatgagtttttgactatataaagctgagtttaattgaa

SEQ ID NO: 6203 - DNA, 1896 bp, Ambrosia trifida
gatagtgttgctggggttgagccgcagtcggagacggtgtggagacaagcggataagtatggggtgccaaggattgttttgttaataaaatggaccggcttggtgctaacttttttggtacacgggatatgatagttacaaatttgggtgctaaaccgcttgtgctccaactcccaattggggcagaagatgttttaaaggtgttatagatcttgttaggatgaaggccatagtttggtctggtgaagaattaggtgctaaatttgcatatgaagatattcccgctgaccttcaagagttagctgaagaatatcgcgctttaatgctcgagaccattgttgaattagatgacgaggttatggaagggtatcttgaaggggtcgagcctgatgaagcaaccgttaagaggttagttaggaagggaaccattgggggtagttttgtaccggttttatgtgggtcggctttcaagaacaaaggtgttcaaccattgcttgatgctgttgttgactatttaccctctccacttgacctgccacctatgatgggtaccgaccctgagaacccagaaattgaaattgaacgggttgcaagtgatgatgaagcgttttctgggttagctttcaagatcatgaacgacccgtttgtcgggtcacttacatttgtaaggatatactctgggaaactcgctgctggatcttatgtaataaatgcaaaataaaggaaagaaggaaagaattgtgagattacttgaaatgcacgcgaacagcagagaagatgttaaggtagcatttagcaggtgatattgttgctcttgcaggctttgaaaagataccatttaccggagaaactactatctgatcctgagaagcctattgttcttgaaagaatggatttccctgatcccgttatcaaagttgccattgagcctaagaccaaggcagacgttgataaaatggcaaatggattaatcaagcttgcacaagaagatccgtctttccacttctcacgcgatgaagaaattaaccaaacggttatcgaagggatgggagaattgcatcttgagattattgttgataggctcaagagggaattcaaggtggaagcaaatgtaggtgcgccccaagttaactaccgtgaaagcatttccaggatggcagaggtgaagtacgtccacaagaaacaatcaggtggtcaaggacagtttgcagacataaccgtacggttcgagccattggaggctggtagtggatacgagttcaagagtgagatcaagggtggtgcggtcccaagagaatacatccctggtgtaatgaaagggttagaagagtcgatgtctaatggagtacttgctggcttccctgttgttgacctccgtgcagtattgaccgatgggtcttaccatgatgttgactctagtgtactagccttccagctggcagctagaggagctttccgtgaaggagctagggaagcggcacccaagattttggaacccattatgagagttgagttgtgacacctgaagaacattaggagatgttattggtgatcttaattccagaagaggacagattaatagctttggtgacaagcctggtggcctcaaggtggtggattcgcttgtgccgctagcagaaatgttccagtatgtgagtacgttaagaggaatgacaaaaggtcgagcttcttacactatgcaactagcgaaattcgacgtggtacctcaacacattcagaaccagctttcagctgccaaagaagaagcagttacagcttaatctctcttcctgtaattctattttatgtttgtaatttttcacttatgttctataggacaatatgaaatgcctccaatttccatcaacagatatacgaagctacatgtttatttat

SEQ ID NO: 6204 - DNA, 2682 bp, Plantago ovata
gcctcacattctatcccaaatactcttcttcttctactactacttatctacacttccccaatccaagcaagcaggtttcacacacacacattcagtgcgtgtaaacctctgcttagcaatggcggcaccagctgctgctgctgaatccttaatcaaaatgtcaacaaacgcctcttcctccctctgcaactttaacggttcttccaggaggcctcttcccgttgtttctcagtctactcgacgccgtaccaagcgcaattcttccgccagggttcaggctctctcctctcctttctttgggagcttcaggctaacttctaccgccggctcaactttacagcacaaacagcaaacaaggaatttctctgtccttgctatgtcggccgatgagagagcggtgcctttgaaagactaccgtaacattggaattatggcacatatagatgcgggaaagaccaccacgactgagcgtgtcctgttctacaccggccgaaactacaaaattggtgaagtccatgaaggaactgccacaatggactggatggagcaagaacaggaaagaggaatcaccattacatccgctgcaactacgactttctggaacaagcaccgaattaacataattgacaccccaggccacgtcgacttcacactagaagtggagcgtgccctcagggttttagatggtgcaatatgcctgttcgatagtgttgctggtgttgaacctcagtctgaaaccgtttggagacaggcagataaatatggtgtgcccagaatatgctttgtgaacaaaatggatcgtcttggagcaaatttctaccgaacaagagatatgatcatcagtaatttaggtgcaaagcctttggtgcttcaactcccaatcggtgctgaggatactttcaagggagttgttgatcttgtgcgaatgaaagcaattgtttggtccggggaacaattaggtgcaaaattctcgtacgaggaaattccagctgatctacaagacttagctgaagagtatcgggcccagttgattgagaccgttgttgaagtggatgatgcagcaatggagaactaccttgagggaattgagcccgatgaggaaacaatgaagaagttagttaggcaaggaacaatcgggggcaactttgttcccgttttatgtggctcagcttttaagaataaaggtgttcagccacttcttgatgctgtagttgattatttaccctctccccttgacgtgccagcaatgaaaggaactgatcccgatgatccggagctgataattgaaagaaagcccagtgatgatgagccgtttgcaggattggcgtttaagatcatgaacgatcctttcgtgggttctttgacatttgtgcgtgtctatgctggaaagctagctgctggatcatatgttgtaaatgcaaacaaagggaagaaggagaggattggtaggctattggaaatgcatgccaacagcagagaagacattaaagcagcattaactggtgatattattgctattgcgggcctgaaagatacaataacaggagaaacattgagtgatcctgatcaacccattgttcttgagcggatggatttcccagatcctgtcattaaggttgctattgaacctaagacaaaggctgatattgataagatggctattggcttgatcaagcttgctcaagaagatccatctttccacttttcacgagatgaagagatcaaccagactgttattgaaggaatgggtgaattgcaccttgaaattattgtggataggctcaagagggaatttaaggtggaagccaatgttggagcaccccaagtcaactatcgtgagagcatttccaaggtcaccgaagtgaagtatgttcacaagaagcaatctggtggttccggtcagtttgctgacatcacagtcaggttcgagcccctggaagctggtactgggtatgagttcaagagtgagattaagggaggtgcagtgccaagagaatacatacctggtgtgatgaaaggattggaagaaagcatgagcaatggtgtacttggtggctatcctgtggttgatgtgcgtgcagtattagtggatggttcttatcacgatgttgattcgagtgtgttggcgttccaactggcagccagaggagcatttagggaagggatcaggagagctgggccccagatgctcgaacccatcatgagggttgaagttgtcacccctgaggagcatttgggagatgtaattggtgatttgaactcaaggagaggacagatcaacaacttcggtgacaaacctggtggattgaaggtggttgacgccctggttcctcttgctgagatgttccagtatgtaagtaatcttcgaggaatgactaaaggccgtgcttcatacacaatgcagttggccaaatttgatgtggttcctcagcatatccagaaccagctagccaaagaagatgctgtaactgcttgatgtggtttcatttttccacacttgatatatgagataccatagcaaagttgattttgttttaattttttttttgggttatggaaaccgcagataaagataaattaagaaaaccagcagtgtggtaggttggttgactgctttgtgtgagaccttgcaactggattttgtttagggaaggcattaattgtttataaattccattttac

SEQ ID NO: 6205 - DNA, 2469 bp, Tragopogon dubius
attaccagaaaattctagtggcggagaaacatggcggcagaaactgtagccgcggcgtcactctgcaacttctccgttaacaatggccgtacctcaagcaggccgctccgtcgtttccttctctcccccgccacctccctccgtcgccgtagtcttacgtcctcgtttttcggaacccaacgcctcacaacaaacatatcgacttctcacttccaaaagaggaacctttcggtgttcgccatggccgctgctccagaagagggaaagcgtgaggttccattagaggactaccgcaacatcggcatcatggctcacatagacgccggaaaaaccaccacaacagaacgcgtcctttactacacaggaagaaactacaaaatcggcgaagtacacgaaggtacagccacaatggactggatggaacaagaacaagaacgaggaatcaccataacatcagcagccaccaccacattctggaacaaacatcgcatcaacatcattgacactcccggccacgtcgacttcacactcgaagtcgaacgcgcactccgagtcctcgacggcgccatttgtttattcgacagcgtcgcaggcgtcgaaccccaatccgaaaccgtctggcgacaagcggacaaatacggcgtgccaagaatctgcttcgtcaacaaaatggaccgcctcggcgcaaactttttccgaacacgcgacatgatcgtaacaaatctcggcgcgaaaccgcttgtgcttcaactcccgatcggagcggaagaagtcttcaaaggggttatcgatcttgtcaaaatgaaagcgatagtttggtccggcgaagaattaggcgctaaattttcatacgaagaaatcccgtcagatcttcaagaattatcggaagaataccgtgcgcttatggttgaaacgattgttgatttagacgatgaagtcatggaagcgtatctagaaggggttgaaccagatgagcccacaatcaagagattagttagaaaaggtacaatcggaggtaatttcgtccccgttttatgtgggtccgctttcaaaaacaaaggggttcaacctttactcgatgcggttgtcgactatctaccctcccccctcgaccgtaccccccatgataggaaccgaccccgaaaacccggaaattgaaatcgaacggcgcgcgagtgacaacgaacccttcgcggggctcgcttttaaaatcatgaacgacccttttgtggggtcgcttacatttgtaagaatctacgcgggtaaacttgcggcagggtcttacgtgataaatgcaaataaaggtaagaaggaaagaatcgggaggttgcttgaaatgcatgcgaatagtagggaagatgttaaggtggcgttaacgggtgatattgtggcgcttgcgggattgaaagatacgattaccggggaaactttgtgtgatggcgaaaacccgattgtgcttgagagaatggattttccggatccggttattaaagttgctattgaaccgaagacgaaagcggatgttgataagatggcgaatgggttgattaagcttgcgcaggaagatccttcttttcatttttcgcgtgatgaggaagttaatcagactattattgaggggatgggagaattgcatcttgaaattatcgttgataggctaaagagggaattcaaggtagaagcgaacgtaggtgcaccacaagtaaactaccgcgaaagcatttcgcgagtctccgaagtaaaatacgtccacaaaaaacaatccggcggccaaggccagttcgccgacataaccgtacggttcgagccactcgaagcgggaagcgggtacgagttcaagagcgaaatcaagggtggggcagtcccacgagaatacattccgggtgtaatgaaagggctagaagagtcgatgtctaatggggtggttgcagggtaccctgtggttgatcttagggcggttttgacagatgggaactaccatgatgttgactctagtgtacttgcgttccagctggcggcacgaggggcgtttcgggaaggtgttaggaaagctgctccgaagattttggaaccgattatgagagttgaagttgtgacgccggaagaacatttgggggatgtgattggggatcttaattcgagaagaggacagattaatagctttggtgataagcctggtggacttaaggtggtcgattcgctggtcccacttgcggaaatgtttcagtacgtgagtacgttaagaggaatgacaaaaggccgagcttcatacacaatgcaattagcgaaattcgatgttgtacctcaacacattcagaaccagctttctgctgccaaagaagaagcagtcacagcttgatctctttgaaacatttccctttcttcatataccaatatagggaaagaaaaaacaaatgtttagtaacatgttaaattatttattcataattttatgcttattttgttacg

SEQ ID NO: 6206 - DNA, 2582 bp, Sorghum bicolor
tccatggccgccgaggtgcccgtgcgagcccccgccgccgcggcgcggtccgcgcgcagccggccggccgccgccgccgccgtcgtctccgcctcgtccgcctcgcgcctcctcctcggctaccgccccttccacgcgccgcgcttcgccgctgggcgcgccgcggtggcaggccccgtggccggactccgcccgcgctcgcgcaggccgcgcctctcggtcgtcgccatggctggcagcgaccgtcaagtgcctttacatgattaccgcaacattggtattatggcccatatagatgcaggaaagacaacaactactgagcgcattctgtattacactggaaggaactacaagattggtgaggttcatgagggaacagctacaatggactggatggaacaagaacaagagagaggaataaccattacatctgcagcaacgactgccttctggaacaaacacagaatcaacattatagatactcctggtcacgtcgacttcactcttgaggttgaacgtgctctcagggtgttggacggtgctatatgtctctttgacagtgttgctggggtagaaccacaatctgaaaccgtgtggcgccaggcagataaatatggggttccaagaatatgtttcgtgaacaaaatggatcgccttggagctaatttctttagaactagagacatgatagttgcaaacttgggtgccaaaccattggtgattcagttgccgattggttcggaggacaatttccaaggagttattgatctagtcagaatgaaagctattgtatggacaggggaggagctgggtgcaaaatttgaatacaaagacatacctgatgatctccaagagctggctcaagattatcgtgttcagatgctggaaactattattgaattggatgatgaagttatggagaattatcttgaaggaactgaaccagatgaggaaactgttaagaaattaatcagaaagggaacaatctctgccagctttgttccagttttatgtggttcagcattcaaaaacaaaggtgtccaaccattgcttgatgctgttgttgattacttgccatctccacttgatctaccttcaatgaagggtactgacccagaagaccctgaaataatatttgaaaggcaaccaagtgatgatgaaccattttctgggttagctttcaagatcatgactgatccatttgtggggtcattgacatttgttcgcatatactccgggaagctggtagctggttcatatgttctcaatgcaaataaagataagaaagaaagaattggaagactccttgagatgcacgcaaacagtaaggaagatataccagttgctgtgacaggtgacatagtagcgcttgctggtctgaaagacacaattactggtgaaacactctgtgacccagacaagcctgtagtgcttgaacgtatggaatttcctgatcctgtcattaaggttgctattgaacccaagaccaaagctgatgccgacaaaatggctaatgggttaattaagcttgctcaagaagacccgtcattccacttctctagagacgaggaaactaaccagactgttattgaaggaatgggagaactgcatcttgatatcattgtagacagactaaagagggagttcaaggttgaagcaaacgttggagctccacaagtcaactaccgcgaaagtatttccaaagttgcagaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggagtgatgaaaggattggaagaaagcttacccaatggtgtcctcgctggttacccagttgtggacttccgggctgtgctggttgatggctcatatcatgatgtcgattcaagtgtcttagcattccaaattgcagccagaggagccttccgtgagggaatgaggaaagctggtccaaggcttctcgagcctataatgagagttgaagtgataactcctgaagagcatctgggtgatgttattggtgatttgaactctaggagaggacaagttaacagcttcggggataagcctggtggactcaaggtggttgatgcttttgtgccacttgctgagatgttccaatacgtcagcaccctccggggcatgactaaggggcgagcatcctacacgatgcagctcgccaagtttgacgtcgtcccacagcacatccagaaccagctctccaccaaaacggaggaagctactgcttaattttcatttcccgtagataaatccatactgcaacagcagggcaggttgataggaagggcatcaagtgtatgtagctttgtagtgtatttaaccccgtgagggggcattatttgccattgattttggacctgataatggccttgtcgaggttttgcgatgagaggacagtgaaaatatatgtttttggttccttgctcctgttgagaagctgagaagttgcaccgttctccctcttgttctattacgatatg

SEQ ID NO: 6207 - DNA, 2307 bp, Oryza sativa
atatcggtcatcatggcacatatagatgcaggaaagacaacaactacagaacgtgttttgtactacacaggaaggaactacaaaattggtgagttccaggagggaacagttacgatggactggatggagcaagaacaagagagaggaataaccattacgtctccaccaactactgctttctggaacaaacatagaatcaacatcatcgatactcctgggcatgtcgacttcactcttgaggttgagcgtgctctcagggtgttggatggagctattatgtctatttgccagtgttgctggggtagaaccacaatctgaaaccgtgtggcgccaagctgataaatatggggttccgagaatatgttttgtaaacaaaatggaccgccttggtgctaacttctttagaactagagacatgataatcgcaaatttaggtgcgaagcctttggtaatacagttgcccattggttcagaggacaatttccaaggagttatcgatctagtcaagatgaaggctattgtatggacaggagaggaacttggtgcaaaattttcttatcaggatatacctgctgatctccaagagatggctgatgactacaaagctcagatgatggaaactattgtagagttggatgatgatgttatggagacttatctagaaggtggcgaaatagacgaggaaactgtcaagagattgatccgaaagggaacaatatctgccagctttgttcctgttctatgtggttcggcctttaaaaacaagggtgtccaaccactgcttgatgctgttgttgattacttgccatcaccacttgacctaccaccaatgaagggcactgatccagaggaccctgaactgatccttgaaagaaagcctagtgatgatgagccattttctgggttagctttcaagatcatgactgacccatttgtgggatcattgacatttgttcgcatatactctgggaagctggttgctggttcatatgttctcaatgcaaacaaagataagaaggaaagaatcggaaggcttctagagatgcatgcgaacagtaaggaagatataacagttgctgtggcaggtgacatagtagctcttgctggtctcaaagatacaattactggtgaaactcttagtgacccagataagcctgttgtgcttgaacgcatggaatttcctgatcctgtcattaaagttgctattgaaccaaagaccaaagctgatgctgacaaaatggcaaccggactaatcaagcttgctcaagaagacccatcattccacttctctagagatgaggagaccaaccagactgttattgaaggaatgggagaattgcaccttgacatcattgttgacagattaaagagagaattcagggttgaagcaaatgttggagctccgcaagtcaactaccgtgaaagtatttccaagatttcagaagtacaatacgttcacaagaaacagtctggtggatctgggcaatttgcggacattattgtgcgattcgagcctttggaggctggaagtgggtatgaattcaagagtgaaataaagggaggggcagttccaaaagaatatgtaccaggcgtgatgaagggaattgaggaaagcttgcccaatggtgtccttgctggttaccctgttgtggacctccgagcggtgctggttgatggctcataccatgatgttgattcaagtgtcctggcattccaaattgcagccagaggtgcattccgtgaaggattgaggaaggctggtccaagactcctggaacctataatgaaagttgaggtgataacccctgaggagcatttgggtgatgttattggtgatttgaactccagaagaggacaggtcaatagcttcggggataaacctggtggcctgaaggttgtcgatgctttcgtgccacttgcggagatgttccagtacgtcagcacgctgagaggaatgaccaaggggcgcgcgtcttacacgatgcagctcgccaagttcgacgtcgtcccacagcacatccagaacgagctctctgcggcgaaacaggaggaagctagtactgcttaattttttttccagattttggtagatatactaaacggcgacaccggagcaggtggataataggacatccaagtgtatgtagctttgtagcgtcaagcccctcggggagatattgtttgccattgttttggacctgataatggccttgtcaagttcttttcttctttttgaagactgccttgttaaggttttcagaagagaaagcggtacctataaaatttttgtttccttgctctagctga

SEQ ID NO: 6208 - DNA, 1775 bp, Ambrosia trifida
gggtgctaaaccgcttgtgctccaactcccaattggggcagaagatgtttttaaaggggttatagatcttgttaggatgaaggccatagtttggtctggtgaagaattaggtgctaaatttacatatgaagatattcctgctgaccttcaagaattagctgaagaatatcgcgctttaatgctcgagaacattgttgaattagatgacgaggttatggaagggtatcttgaaggagtcgagcctgatgaagcaaccgttaagaggctaattcggaagggaaccattgggggtagttttgttccggttttatgtggttcggctttcaagaacaaaggtgttcaaccattgcttgatgctgttgttgactatttaccttctccacttgacttaccacctatgaaaggtactgacccagagaacccagaaattgaaattgaacgggttgcaagcgatgatgaagcgttttctgggttagctttcaagatcatgaacgacccgtttgtcgggtctcttacatttgtaaggatatattctgggaagcttgctgctggatcttacgtaatgaacgcaaataaaggaaagaaagaaagaattgggagattacttgaaatgcacgcgaacagccgagaagatgttaaggtagcattagcaggtgatattgttgctcttgcagggttgaaagataccattaccggagaaacactatctgatgccgagaagcctattgttcttgaaagaatggatttccctgatccagttattaaagttgctattgagcctaagaccaaggcagatgttgataaaatggcaaatgggttaatcaagcttgcacaagaagatccgtctttccacttctcacgcgatgaagaaatcaaccaaacggttatcgaagggatgggagaattgcatcttgagattattgttgataggctcaagagggaattcaaggtggaagcaaatgtaggtgcgccccaagttaactaccgtgaaagcatttccaggatggcagaggtgaagtacgtccacaagaaacaatcaggtggtcaaggacagtttgcagacataaccgtccggttcgagccattagaggcaggtagtggatacgagttcaagagtgagatcaagggtggtgcggtcccaagagaatacatccctggtgtaatgaaagggttagaagagtcgatgtctaacggagtactcgctggcttccctgttgttgacctccgtgcagtattgactgatgggtcctaccatgatgttgactctagtgtactagccttccagctggcagctagaggagctttccgtgaaggagttaggaaagcggctcccaagattttggaacccattatgagagttgaagttgtgacacctgaagaacatttgggagatgttattggtgatcttaattccagaagaggacagattaatagctttggtgacaagcctggtggcctcaaggtggtggattcgcttgtgccgctagcagaaatgttccagtatgtgagtacgttaagaggaatgacaaaaggtagagcatcttacactatgcaactagcgaaattcgacgtggtacctcaacacattcagaaccagctttctgctgccaaagaagaagcagttacagcttaatctctcttcctgtaattctattttatgtttgtaatttttttcagttctcatgttttataggacaatatgaaatgcctccaattttccagcaacagatatacgaagcaacatgtttatttatccattcataaattttgctcaa

SEQ ID NO: 6209 - DNA, 1724 bp, Malus domestica
acttcaaattccagttggtgcagaagataattttaaaggagttattgatcttgtgaagatgagagctatactttggtctggagaagagttgggtgctaaatttgtttacgaggagattccatctcatcttctggagctggctcaagaatacagggctgagatgatagaaaccatagttgagttggatgatcaagcaatggagggctatctagaaggagttgaacctgatgaggaaaccattaagaaattaattaggaagggaaccatcgcaattagttttgtgccagtattatgtggttcggcttttaaaaataagggggttcaaccattgcttgatgcagttgtggattatttgccttcaccacttgatgtgccaccaatgaaggggactgatgcagacaaccctgaaatcacgattgaaagggctgcaagtgatgaggaaccatttgctgggctagcattcaagatcatgagtgatccatttgtgggatcccttacatttgtgagaatctatgcaggaaagctaacggctggatcctatgttttaaatgcaaacaagggaaagaaggagaggattggtagacttctagaaatgcatgcaaacagtagggaggatgtaaaggtagctttagctggtgatatcgttgcacttgcaggcctgaaggataccattaccggtgaaacattgagtgaccccgatcatcctatagtgcttgaacgaatggacttccctgatcctgtaattaaggttgccattgaacccaaaactaaagctgatgttgataagatgggagctggtttggttaagcttgctcaagaagacccttctttccacttctctcgggatgaagagatcaaccagacagtgattgaaggaatgggagaattgcatcttgagattattgttgatcggctcaagagagaattcaaggttgaagcaaatgttggtgcaccccaggtaaactaccgggaaagcatttcgagaacctccgaagtgaggtatgtgcacaagaaacaatcaggtggacaaggtcaatttgcagatgtcaccgtacggtttgaaccaatggaggctggcggtggatatgagtttaagagtgaaatcaagggaggtgcagtgccaagagaatacattcctggggtcatgaaaggattagaggagtgtatgagcaacggtgtgctcgcaggctttcctgttgttgatgtacgcgctgtactagttgatggttcttaccatgatgtcgactcaagtgtgttagcatttcaattggcagcaagaggagctttccgggaggggataaagaaagctgccccgaaaatgcttgaaccaataatgaaagttgaagttgttacaccagaagaacatctcggagatgtgattggtgatcttaactcgaggagaggacagatcaacagcttcaatgacaaacctggtggtctcaaggtggtggattcactggttcctcttgcggagatgtttcagtacgtgagtacgctgaggggcatgacgaaaggtcgtgcatcgtatacaatgcagttagctaagtttgacgttgttcctcagcacattcagaaccagcttgctgccaaggaggaagaagttgctgcttgattttgtttccatgtatggtcagatcaaagggaccttataatttaaatcccaactcattatttgagaaaaacccttttttttttttttttttttttgactctgcatcaaaaaa

SEQ ID NO: 6210 - DNA, 1761 bp, Coffea canephora
ggaactaacttgggtgcaaagccacttgtgattcaaattccagttggtgcagaggataatttccaaggaatagttgatcttgtcaagatgaaagcagtcatttggtgtggggaagaattaggtgcaaaatttagctatgaagacattccagctgaccttaaagagatagctgatgattacagggcgcagatgattgaggctgttgttgagatggatgatggtgctatggagaagtacctggaaggagtcgagcctgacgaggagacgatcaagaaactaattaggaaaggaactatctctggcagttttgttccagttttatgtgggtcggcttttaagaataagggagtccaacctcttcttgatgcagttgtgaattatttgccttctcctcttgacgtgccagcagtgaaggggactgaccctgagaacccagaagtgactattgaaaggtctgctgatgacggtgagccttttgctggattggctttcaagataatgagtgatcctttcgtgggatccctaacattcgttagggtctattcagggaagcttgaagcaggatcctatgtactgaatgcaaacaaaggtaagaaagagagaattggtagactcctggaaatgcatgctaacagtagagaagacgtgaaggcagtcttaactggtgatattgttgctcttgctggtttgaaggatacaattactggagaaacgttatgtgatcctgatagtcctgttgttcttgaaagaatggatttccctgatcctgtcattaaggtggcaattgaacccaagaccaaagctgatgttgataaaatggccaatggattgatcaagcttgctcaagaagatccatctttccacttctcaagggatgaagagacaaatcaaacagttattgaaggaatgggagaattgcatcttgagattattgttgatcggctcaaaagagaatttaaggtggcagctaatgttggtgcaccacaagtaaactacagggaaagcatttcaaaagtcaccgaaacaaagtatgtccacaagaaacaatctggtggggcagggcagtttgctgacatcacagtaaggtttgagcccatggagcctggtggtggatatgagttcaagagtgagatcaagggaggagttgtgccaaaagaatatattccaggtgtgatgaaaggtttagaagagtgcatgagcaatggtgtgctggcggggtaccctgtggtcgatgtccgtgctgtgttggtggatggttcttaccatgatgttgattcaagcgttctggccttccaactggctgctagaggagcgtttagggaggggatgaggaaagctgctccaaggatgctggaaccgataatgaaggttgaagttgtcacccctgaagaacatttaggagatgtgattggtgatctgaactcaagaagaggccagatcaacacatttggtgacaaacctggtggccttaaggttgttgatgccttagttccattagcagagatgttccaatacgtcagtaccctgagagggatgacaaaaggtcgtgcttcctacaccatgcaattagccaaatttgacgtggttcctcaacacatccaaaatcaactctctcaagtcaaggaggaagctgtggctgcttaatctggtttgcattacttagctgtagatgcagagcaatgccaaatactacttgaaatagtcgattctttttgtactaaaagtgttgatatttgaaattttgaatacgagttttggtag

SEQ ID NO: 6211 - DNA, 2962 bp, Pinus pinaster
ccttctcgaatgcacaacccctcgtatcaggtttgcttggacaagggaaaacgcactttcctccattcatttatcatcatacagcaaactatataatgaccgtcaattcagagaagcgtttcaattcagtgctgccccttccatgaaggcctgcaccagtatgacggtttaagcaattttgcagagtttagggttgtaaactataaactctatcgatggcggaaactctcaaggtctcaccgtgcttcttttacagttcgcacaattacattggccgtcataagtatagtggcaggaggagcaaggacgggatttcgctgaattcgtttaatggattgaaggctttagctggttttcctctacgctcaccatcaatccagggtttcagagccaatgacttgatgctttgcaaggcctctgattcaacctccaccagtgtccgtggaagaacactgatcgtttccatggctgcagatggaccatcacgggacgtgccactgtcagaatatagaaatattggaattatggcccacatagatgcagggaaaaccactactacagagaggattctttactatacaggcaaaaactataaaattggggaggttcacgagggaacagctactatggactggatggagcaggagcaagaaagaggcataactattacttctgctgcaactacatgtgcatggaatgatcatcgtataaacattattgatactcctggacatgtggacttcacactcgaagtggaacgtgcccttagagttcttgacggttctatctgtctatttgacagtgttgctggtgttgagccacagtcagagactgtatggagacaagcagataggtatggtgttcccagaatttgttttgttaacaaaatggatcgacttggagcaaactttttcaggacaagagacatggtagtaacaaacctaggggcaaaacctcttgttctgcaaattcccattggggcggaggaatgttttcagggacttattgatttggtgaaaatgaaggctgtgttgtggtctggagaggaattgggtgcgaagtttagctatgaggatattccagcagaccttctagatttagccacagaatataggaatcaaatgattgaaaccatagtagaacttgatgatgatgcgatggagaaatatctcgagggagaggaacccgacgagaaaacaatcaagagattgatcagaaagggcaccatatctatcagttttgttcccgttctttgtggctcagcatttaagaacaagggtgtgcagcctttattggatgctgttgtggattatttgccttcccctgttgacttgccaccaatgaagggaacagatgttgatgatccagaagtaaccctagaaaggcgtgctagtgatgatgaaccatttgccggacttgcttttaaaattatgacagatccctttgtaggatctcttacatttgtccgagtttactctggcgtcctcacagctggatcatatgtacttaattccaacaaagggaagaaagaaagaattggacgtttattacgaatgcatgcaattagtcgagatgatgtcaagattgctgtgacaggggatatagtagcacttgctggtttgaaggatacaataacaggagagactctttgtgatcctgataagccagttgtgctggagagaatggactttcctgaacctgttattaaagtcgcaattgaaccgaaaacaaaagctgatgtggacaagatgtctatgggtcttgtcaagcttgctcaggaagatccttcttttcacttctcaagagatgaagagagcaatcaaactgttattgaaggtatggggagttgcatcttgaaatcattgttgaccgtttgaagagagaattcaaggtcgaggctaatgtcggtgctcctcaagtaaactacagagaaagcatctcaaagattgcagagactaagtatgtgcacaagaaacaatcaggtggtcaaggtcagtttgcagatataactgtaagatttgaacctctggaacctggcagtggctatgagttcaagagtgagattaagggtggagtagtgcccaaagagtatattccaggtgttatgaagggattggaagaatgtatgagcaatggtattctagcaggctatcctgttgtcgatgtgcgggctgtccttacaaatggatcctatcatgaggtagactccagtgcactagcattccagcttgcagctcgtggtgctttcagggagggcatcagaaaggcaggtccaaagttgctagaacctataatgaaggtagaagttgtaacacctgaggagcatctaggggatgttattggtgatattaattcaaggcgtggtcagatcaacactttttctgacaagccaggaggactgaaggtgattgatgctttggtgccactggcagagatgtttcagtacgtgagtacactccgtagtatgaccaaaggccgtgcatcttatactatgcaacttgctaagtttgatgttgtacctcagcacatacaaaaccaactgtcttcaaaggtgcaagaggtggctgcttgaaaattcgtaaaatttctatgaattagtattaattggctatccatgccaaacctgtactttggtttcttcttcacatacacatcacaaagtattgttctgttacctatttggattgattcattggtaaattgaaccaaaaggcaagctcaatcttatctttgcatcagtgtttgtgatgtaaatgaaaaccaatgtttcagattttgctcagcaaaaaatttacagtattttttgatatcctttcgttccatgtattgctatacctgacagaggaagcaatagttattccaattcctattctgtaatagccaacaagactggttcaagataagatacaagtaacaataattatctttccaacactcagctttttgtagtgtgatgcaaaat

SEQ ID NO: 6212 - DNA, 2944 bp, Pinus taeda
atcatcatacagcaaactatataaagaccatcaattcagagagcgtttcaattcagtgctgccccttccatgaaggcctgcaccagtatgacggtttaagcaattttgcagagtttagggttgttaactataaactctatcgatggcggaaactctcaaggtctcaccatgcttctcttacagttcgcacaattacattggccgtcataagtatagtggcaggaggagcaaggaagggatttcgctgaattcgtttaatggattgaaggctttagctggttttcctctacgctcaccatcaatccagggtttcagagccaatgacttgatgctttgcaaggcctctggttcaacctccaccagtgtccgtggaagaacactgatcgtttccatggctgcagatggaccatcacgggacgtgccactgtcagaatatagaaatattggaattatggcccacatagatgcagggaaaaccactactacagagaggattctttactatacaggcaaaaactataaaattggggaggttcacgagggcacagctactatggactggatggagcaggagcaagaaagaggcataactattacttctgctgcaactacatgtgcatggaatgatcatcgtataaacattattgatactcctggacatgtggacttcacacttgaagtggaacgtgcccttagagttcttgacggttctatctgtctatttgacagtgttgctggtgttgagccgcagtcagagactgtatggagacaagcagataggtatggtgttcccagaatttgttttgttaacaaaatggatcgacttggagcaaactttttcaggacaagagacatgatagtaacaaacctaggggcaaaacctcttgttctgcaaattcccattggggcggaggaacgttttcagggacttattgatttggtgaaaatgaaggctgtgttgtggtctggagaggaattgggtgcgaagtttagctatgaggatattccagcagaccttctagatttagccacagaatataggaatcaaatgattgaaaccatagtagaacttgatgatgatgcgatggagaaatatctcgagggagaggaacccgacgagaaaacaatcaagagattgatcagaaagggcaccatatctatcagttttgttcccgttctttgtggctcagcatttaagaacaagggtgtgcagcctttattggatgctgttgtggattatttgccttcccctgttgacttgcccccaatgaagggaacagatgttgatgatccagaagtaaccctagaaaggcgtgctagtgatgatgaaccatttgccggacttgcttttaaaattatgacagatccctttgtaggatctcttacatttgtccgagtttactctggcgtcctcacagctggatcatatgtacttaattccaacaaagggaagaaagaaagaattggacgtttattacgaatgcatgcaattagtcgagatgatgtcaagattgctgtgacaggggatatagtagcacttgctggtttgaaggatacaataacaggagagtctctttgtgatcctgataagccagttgtgctggagagaatggactttcctgaacctgttattaaagtcgcaattgaaccgaaaacaaaagctgatgtggacaagatgtctatgggtcttgtcaagcttgctcaggaagatccttcttttcacttctcaagagatgaagagagcaatcaaactgttattgaaggtatgggggagttgcatcttgaaatcattgttgaccgtttgaagagagaattcaaggtcgaggctaatgtcggtgctccccaagtaaactacagagaaagcatctcaaagattgcagagactaagtatgtgcacaagaaacaatcaggtggtcaaggtcagtttgcagatgtaactgtaagatttgaacctctggaagctggcagtggctatgagttcaagagtgagattaagggtggagtagtgcccaaagagtatattccaggtgttatgaagggattggaagaatgtatgagcaatggtattctagcaggctatcctgttgtcgatgtgcgggctgtccttacaaatggatcctatcatgaggtagactccagtgcactagcattccagcttgcagctcgtggtgctttcagggagggcatcagaaagtcaggtccaaagttgctagaacctataatgaaggtagaagttgtaacacctgaggagcatctaggggatgttattggtgatattaattcaaggcgtggtcagatcaacacttttgctgacaagccaggaggactgaaggtgattgatgctttggtgccactggcagagatgtttcagtacgtgagtacactccgtagtatgaccaaaggccgtgcatcttatactatgcaacttgctaagtttgatgttgtacctcagcatatacaaaaccaactttcttcaaaggtgcaagaggtggctgcttgaaaatttgtaaaatttctatgaattagtattaattggctatccatgccaaacctgtactttggtttcttcttcacatacacatcacaaagtattgtagtcttacctatttggattgattcattggtaaattgaaccaaaaggcaagctcaatcttatctttgcatcagtgtttgtgatgtaaatgaaaaccaatgtttcagattttgctcagcaaaaaatttacagtatttcttgatatcctttcattccatgtattgctatacctgacagaggaagcaatagttattcctattctgtaatagccaacaagactggctcaagataagatacaagtaacaataattatctttccaacactcagtttttgtagtgtgatgcaaaacaaggatatttcttgttatctggaacagtgataagttatgttcttcaaaaaaaaaaaaaaaa

SEQ ID NO: 6213 - DNA, 2368 bp, Podocarpus macrophillus
ctggatggagcaggagcaagaaagaggaataacaattacttctgctgcaacaacagctgtctggaataatcatcgtataaacatcattgatactcctggccatgtggatttcactttggaagtggagcgagcacttagggtactcgatggaactatctgtttgtttgacagtgttgctggtgtggaaccacaatcagagactgtatggagacaagcagataagtatggagttcctaggatatgctttgttaataaaatggatcgacttggagcaaactttttcaggactagagacatgataataaaaaatctaggtgcaaaacctcttgttatacaaatcccaattggtgcagaggatagatttcaaggagttgttgatctggtcaaaatgaaggcagtattttggtctggggaagaactaggtgcaaagtttagctatgaggacatccctgcggatcttgtagaactagccaaagaatatagaaaccaaatgattgaaactatagtggatcttgatgatgaagccatggagaagtatcttgagggagcggagcttgatgagcaaacaataagaaaattgatcagaaagggcactctcagtcttaaatttgttccagttctttgtggttcagcatttaaaaacaagggtgtgcagcctttactggatgctgttgtggattatttgccttcccctattgatttgccaccattgaagggaacagatgcagaaagtccagagttgatcttggaaagacatccaagtgatgatgaaccatttgcagggctcgcttttaaaatcatgacagatccatttgtagggtctcttacatttgtacgtgtttattctggcaaggtaagtgctggatcatatgtgcttaattccaacaaagggaagaaggagagaattggacgattactgcaaatgcatgcaaatagtcgagaggatatcaaagtttctgtgacaggggacatagtggcatttgccggcttgaaggatactattacaggagagacactttgtgatccggacaaacctgttgtgctggaaagaatggaatttcctgatcccgttatcaaagttgcaattgaacctaaaacaaaagctgatgtggacaagatgtcatttggtcttgttaaacttgctcaggaagatccttctttccacttctcgagagatgaggagaccaaccaaacagttatagaaggaatgggtgagttgcatctagaaatcattgttgatcgtctgaagagagaattcaaggttgaggctaatgtgggtgctccacaagtgaactacagagaaagtatctcgaggacagcagaagtgaagtatgtgcacaaaaaacaatcaggtggtcaaggtcagtttgcagatattagtgtaagatttgaaccaatggaagctggcagtgggtacgagttcaagagtgaaattaaaggtggagctgtgcccagggaatacatcccaggtgtaatgaagggattagaggagtgcatgggcagcggtatcctgggaggctaccctgttgttgatgtgcgggctgtccttactgatgggtcatatcatgacgtagactccagtgttctagcattccagcttgcagctcgtggtgctttcagggaaggcataagaaaggcaggtccaaggttgctggaacctgtaatgaaagttgaagttgttacacccgaggagcatttaggagatgttattggtgatctcaattcgaggcgtggtcagatcattagctttgacgacaagccaggaggacttaaggtaattgatgctttggtgccgctggcagagatgtttcagtatgtgagtaatctccgtggtatgactaaaggtcgtgcatcttatatcatgcaacttgctaaattcgatgttgtaccccagcatattcaaaatcaaatctctacaaaatcacaggaggttgctgcttgaggttttgaaaaaatgtttagagttggtatgagctgaaagacccttcacattctgctcaattataaatgtacgagtgtatctgatgtgtgaaacatactcgtttctacctatttgtttttattcattggtaaatcaaattaaagtgtcaacctcgatttcttttatgcatcagtacttgtgatggaacggagtgaaaagttctaatatttgcttcaagaatgcagcagttacagctgtaattaatttgcagctattgctatacttgtaagaggtaagaattaacatgcgtcacattgtttgctttacttacaatgggggcctagaaataatacattctagaaaaaagtactcgcacaccattctcttaatttcaaatatatccatcatgccaataaaaatgtggcatgtggaaggtatgttgctaag

SEQ ID NO: 6214 - DNA, 2697 bp, Sequoia sempervirens
caaagcaaggagggcctgaaggattttgtaggatttagggttttcattaaataaaattcagtaaataatggctgaaactcttaagcttgggaagtgcttctctcgcagtagtttacagaataataatggcattggccataatagtttacagaataacagctgccttggccacaagcaaaatgggagcagaagaataaccagaagaggttttgtagtaaattccttacatagtttgaaaagtttagcaggttttcctttaccctcatcatcatcatcagtacagaggccggggcacaatcttagccggttgcttcagagagcctctgtctcaaatgtctcgaacagaatgcccattgtgtgcatggctgcagatggtgaacgcgaggtgccactctcagattatagaaatattggaattatggcccacatagatgcaggaaagactactaccacagagaggatattattttacacaggcagaaattacaagattggggaggttcatgaagggactgctacgatggattggatggagcaggagcaagaaagaggcataacaatcacttctgctgcaacaacagctgtctggaataatcatcgtataaacattattgatacacctggtcatgtggacttcactttggaagtggagcgtgctcttagggtacttgatgggactatttgtttgtttgacagtgtggctggtgtggagccacagtcagagactgtttggagacaagcagataggtatggagttcccaggatttgctttgttaataaaatggatagacttggagcaaactttttcaggactagagatatgataataacaaacctaggggcaaaacctcttgttctgcaaatcccaattggggcagaggatagctttcgaggagttgttgatttgatcaaaatgaaagcgatagtgtggtcaggggaagaactaggtgcaaagttcagctatgaggacattccagctgatcttttagatctggccttggagtataggaatcaaatgcttgaaactatagtggaacttgatgatgaggcaatggagaaatatcttgagggagaggagctcgatgagaaaacaatcaagaaattgatcagaatgggcaccatatccataaaatttgttccagttctgtgtggttcagcttttaagaacaagggtgtgcagcctttattagatgctgttgtggattttttgccttctcctcttgacttaccaccattgaaggggacagatgcagacgatccagaggtgatcctagaaagacgtccaagtgatgatgaaccatttgcaggacttgctttcaaaattatggcagattcatttgtggggtctcttacatttgtacgagtttattctggcaagctaaattctgcatcttatgtgcttaattccaacaaaggaaagagagagagaattggacgattattgcaaatgcatgcaaatagccgtgaggaagtcaaggttgctgtggcaggggacatagtagcacttgctggcttgaaggagactataactggagagacactttgtgatccagataaacccattgtgctggaaaggatgaactttcctgatcctgttattaaggttgcaattgaacctaaaacaaaagctgatgtggataagatgtccatgggtcttatcaagcttgctcaggaagatccttctttccacttctcgagagatgaagagggcaaccaaactgttatagaaggaatgggggagttgcatctggaaatcattgttgatcgtttgaagagagaattcaaggttgaggctaatgtgggtgcacctcaagtgaactatcgagaaagcatttcaaagacagcagaagttaaatatgtgcacaagaaacaatcaggtggtcaaggtcagtttgcagacatatctataagatttgaacctattgaagctggtggtgggtacgaattcaaaagtgcaattaaaggtggagttgtgcctaaggagtatataccaggtgtaatgaagggattagaagagtgtatgaacaatggtgttctggcaggcttccctgttgttgatgtgcgggctgtccttgttgatggatcatatcatgatgtggactccagtgtactagcattccagcttgcagctcgtggtgctttcagggaaggaatgagaaaggcaggtccaaagttgctagaacctataatgaaagtagaagttgtgacacctgaggagcatttaggagatgttattggtgatatcaattcaaggcgtggtcagatccacagctttggtgataagccaggaggactaaaggttgttgatgcattggtgccgctggcagagatgtttcagtatgtgagttcactccgtagtatgaccaaaggccgggcatcttataccatgcaacttgccaagtttgatgtggtacctcagcatattcaaactcaactttccacaaagtcagaagaggttgctgcttgagtttggcggaaattttatgaaattgtataagctggatgtccaagcaatcaatgtattcttctcttttctaaatgtatctaatgcatgaaaatactatcatcttgtgtatctgttcattcatttgtaaattgtagaaaaacaccataagtaatgttatttttgaatcggcactcgttgatgtaaggagattaaaccccaaatatttgctacaagagtacggcagttcaaat

SEQ ID NO: 6215 - DNA, 2507 bp, Setaria italica
gcgcaagccgcggctctcggtcgtcgccatggccggcagtgatcgccaagtgcccttggaggattatcgcaatatcggtattatggcccatatagatgcaggaaagacgacaactacagaacgcattctgtattacactggaagaaactacaagattggcgaggttcatgagggaacagctacgatggattggatggaacaagaacaggagagaggaataaccattacatctgcagcaaccacggccttctggaacaaacacaggatcaacattattgatactcctgggcatgtcgacttcactcttgaggttgaacgtgctctcagggtgttggatggtgcaatatgtctctttgacagcgttgctggggtagaaccacaatctgaaactgtgtggcgccaagcagataaatatggggttccaagaatatgttttgtgaacaaaatggatcgccttggagctaacttctttagaactagagacatgatagttgcaaacttgggtgccaaacctctggtgattcagttgcctattggttcagaggacagtttccaaggagttgttgatctagtcaggatgaaagctattgtatggacaggggaggagctgggtgcgaaatttgaatatcaagacatacctgctaatctccaagagatggctgaagactatcgtgttcagatgttggaaactattattgaattggatgatgaagttatggagaaatatcttgaaggaattgaaccagatgaggaaactgttaagaaactaatcagaaagggaacgatttctgccagctttgtcccagttttatgtggttcagccttcaaaaacaagggtgtccaaccattgcttgatgctgttgtggattacttgccatctccacttgatctacctgcaatgaagggtactgacccagacgaccctgaactggtccttgaaaggaacccaagtgatgatgaaccattttctggcttagctttcaagatcatgactgatccatttgtggggtcactaacatttgttcgcatatactccgggaagctggtagctggttcatatgttctgaatgcaaacaaagataaaaaggaaagaattggaaggcttctagaaatgcatgcaaacagtaaggaagatataacagttgctgtgactggggacatagtagcgcttgctggcctgaaagacacaattactggtgaaacactatgtgaaccagataagcctgtagtgcttgaacgtatggaatttcctgatcctgtcattaaggttgctattgaacccaagactaaagctgatgctgacaaaatggctactgggttaatcaagcttgctcaagaagacccatcattccacttctctagagatgaggaaaccaaccaaactgttattgaaggaatgggagaattacatcttgatatcattgtagacagactaaagagagagttcagggttgaagcaaacgttggagctccacaagtcaactaccgtgaaagtatttccaaagtcgcagaagtacaatacgtccacaaaaagcagtctggtggatctgggcagtttgcagacattattgtgcgctttgaacctttggaagctggaagtgggtacgaattcaagagtgaaatcaagggagggtcagtgcccaaagaatatgtaccaggagttatgaagggattggaagaaagcttacccaacggtgtccttgccggttacccagttgtggacttccgagcagtgctggttgatggctcgtaccatgatgttgattcaagtgtcttagcattccaaattgcagccagaggcgctttccgtgaaggaatgaggaaagctggtccaagacttctggagcctataatgagagttgaagtggtaactcctgaagaccatctgggcgatgttattggtgatttgaactctagaagaggtcaagttaacagcttcggggataagcctggtggactcaaggtggttgatgcgttcgtgccacttgccgagatgttccagtacgtcagcaccctccgggggatgacaaaggggcgtgcatcctacacgatgcagcttgccaagttcgacgtcgtcccgcagcacatccagaaccagctctccgcggcgaaaacagaggaagctgctgcttaattttcatttcccgtagatatacccacacgccgacagcagagcaggtttataggaaggacatcaagatgtatgtagcgttgtagcgagtccaaccctgcgaggggacattatgtgccattgattttggacctggtaatggccttgtcgagttttctcaatgagaaaaacagtaattgtaagtttttttgtttccttgctccagttgagagttcgtgcgtcattctcccgtcttcttgttcggttctccatttgctcatatgcattagtctttacaacgtcacatgtgaaagacaacgtatctttgttgaagatgcaagtgcaacaagcaaatggagaaccgaacaagaagacgggagaatgacgcacgaactct

SEQ ID NO: 6216 - DNA, 2749 bp, Pseudotsuga menziesii
tgtagggtttagggttgttaactagaaactatatcaatggcggaagctctcaagctctccccatgcttctcctacagtttacagaattacagtagccgtcgtaagtatagtagcaggaggagcaaggaagggatttcgctgaattcatttaatgggttaaaggctttagctggttttcctctacgttcaccatcaatccagggtttcagagccaatgatttgttgcttcgcaaggcctctgtttcaacctccaccaatgttcgtggaagaacacccattgtttccatggctgcaggagcatcacgggaagtgccactgtcagactacagaaatattggaattatggcccacatagatgcagggaaaaccactactacagagagggttctttactacacaggcagaaactataaaattgggggaggttcatgagggtactgctacaatggactggatggagcaggagcaagaaagaggcataactattacttctgctgcaactacatgtgcatggaataatcaccgtataaacattattgatactcctgggcatgtggacttcacattggaagtggagcgtgctcttagagttcttgacggttctatctgtctatttgacagtgttgctggtgttgagccacagtcagagactgtctggagacaagctgataggtatggtgttcccagaatttgctttgttaataaaatggatagacttggagcaaactttttcaggacaagagacatgataataacaaacctgggggcaaaacctcttgttctgcaaattccaataggggcagaggatcgttttcagggagttgttgatttggtgaaaatgaaggctgtgttgtggtctggagaggaattgggtgcaacatttagctatgaggacattccagcagatcttctagatttagccacagaatataggaatctactgattgaaactatagtagaacttgatgatgatgccatggagaaatatcttgagggagaggaacctgatgagaaaacaatcaagagattgatcagaaagggtaccatatctatcagttttgttcctgttctttgtggctcagcatttaagaacaagggtgtacagcctttattggatgccgtcgtggattatttgccttcccctcttgacttgccaccaatgaaaggaacagatgttgatgatccagaagtaaccctagaaaggcttgctagtgatgatgaaccatttgctgggcttgcttttaaaattatgacagatccctttgtgggatctcttacatttgtccgaatttactctggtgtcctaacagctggatcatatgtacttaattccaacaaggggaagaaggagagaattggacgtttattacaaatgcatgcaattagtcgagatgatatcaagattgctgtgacaggggatatagtggcacttgctggtttgaaggatacagtaacaggagagagtctctgtgatcctgataaccccattgtgctggagagaatgaactttcctgaacctgttattaaagtcgcaattgaaccaaaaacaaaagctgatgtggacaagatgtctatgggtcttgtcaaacttgctcaggaagatccttcttttcacttctctagagatgaggagagcaatcaaactgtcatagaaggcatgggagagttgcatcttgaaatcattgttgaccgtttgaagagagaattcaaggttgaggctaatgtgggtgcacctcaagttaactaccgagaaagcatctcaaaaactgcagagactaagtatgtgcacaagaaacagtcaggtggtcaaggtcagtttgcagatgtaactgtaagatttgaacctctggaagctggcagtggctatgagttcaagagtgagattaaaggtggagtcgtgcccaaagagtatattccaggtgttatgaaggggttggaagagtgtatgagcaatggtattctagcagggtatcctgttgtcgatgtgcgggctgtccttacaagtggatcatatcatgaggtggactccagcgcactggcatttcagcttgcagctcgtggtgctttcagggagggcatcagaaaggcaggtccaaggttgctggaacctataatgaaggttgaagttgtaacacctgaggagcatctaggggatgttattggtgatatcaattcaaggcgtggtcagatcaacacttttgatgacaagccaggaggacttaaggtgattgatgctttggtgccactggcagagatgtttcagtatgtgagtacgctccgtagtatgaccaaaggccgtgcatcttatactatgcaacttgctaagtttgatgtggtaccccagcatattcaaaaccaactttcttcgaaggtgcaggaggtggctgcttgaaaatttgtaaagcttctatgaattagtatcaatcagctacccatgtcaaacctgtactttggtttgttcttcttatacgcatcacaatgtactgttgtgttacctgtttggattgatgcattggtaaattgaacgaaaaaggcaagtttaatcttatctttgcatcggtgttagtgatgtaaaagaaaaccaaagtgtaagattttgctcagcgaaaacctaacaggatttctagatacttctcctttccaagtattgctatacctgacagaggttaagcaatggttatccctattctgtaatagccaagccaaggctggctgaagttaagatacaagtaataaaaattatctttcc

SEQ ID NO: 6217 - DNA, 2360 bp, Hordeum vulgare
gcgcaggccgcgcctctcggtcgtcgccatggccggcaatgatcgccaagtgcctttggaggattaccgcaatattggtattatggcccatatagatgccggcaaaacaacaacaacagagcgcattctctattacactggaaggaactacaaaattggtgaggttcatgagggaacagccactatggactggatggagcaagaacaggagagaggaataaccattacatctgcagcaacaactgccgtctgggacaaacatagaatcaacattattgatactcctgggcacgtcgacttcactcttgaggttgaacgtgctctcagggttttggatggtgctatatgtctctttgacagtgttgctggggtagaaccacaatctgaaactgtgtggcgccaagcagataagtacggagttccaagaatatgttttgtaaacaaaatggatcgccttggagctaacttctttagaactagggacatgatagtggcaaacttgggtgcaaagcctttggtgatacagttgccaattggttcagaggacaatttccaaggagttgttgatctaatcagaatgaaggctattgtctggacaggagaggaacttggtgcagaattttcataccaagacatacctgctgatcttgaggagttggctcaagactatagacttcagatgatggaaactattgttgaattagatgatgaagctatggagggatatctagaaggaaatgaaccagatgaggcaactgtgaagaaattaatcagaaaaggaacaataggtgccagctttgtccccattttatgtggttcggccttcaaaaacaagggtgtccagccattgcttgatgctgttgttgattacttgccatcaccactagacctgccaccaatgaagggtactgacccagacgacccggaagtggttcttgaaagacttcctagtgacgatgaaccattttctgggttagctttcaagatcatgactgatccatacgtggggtcactaacgtttgtccgcatatactcagggaagctgatcgctggctcatacgttctcaatgcaaacaaagataagaaggaaagaattggaaggcttctagagatgcatgcaaacagtaaggaggatataacagttgcagtgacaggcgatatagtagctcttgctggtctgaaagatacaattaccggtgaaacactctgtgacccagataaccttgtggtgcttgaacgcatggaatttcccgatcctgtcattaaggttgctattgaaccaaagaccaaagctgatgctgataaaatggcaaatggattaataaagcttgctcaggaagatccatcattccacttctctagagacgaggaaactaaccagacagttattgaaggaatgggagaattacaccttgacatcattgtagacagattaaagagagagttcaaggttgaggcaaatgttggagctccacaagtcaactaccgtgaaagtatttccaaaattgcagagactcagtatgtccacaaaaagcagtccggtggttcagggcagtttgcagatattattgtgcggtttgaacctatggaggctggaagtgggtatgaattcaagagtgaaattaagggaggggcagtgccaaaagaatacgtacccggtgtgatgaagggaattgaagaaagcttacccaacggtgtccttgctggttacccagttgtggatttacgagcagtgctggttgatggctcctaccacgatgttgattcaagtgtccttgccttccaaattgcagccaggggggccttccgtgaaggattgagaaaagctggcccacgactcctggaacctatcatgaaggttgaagtgattacccctgaggagcatttgggtgatgttattggtgacttgaactctagaagagggcaagttaacagcttcggagataagccaggtggacttaaggtggttgatgctttcgtgccgttggccgagatgttccagtatgtcagcagtctgaggggaatgtccaaggggcgcgcgtcgtacacaatgcagcttgccaagttcgacgttgtcccacagcatatccagaaccaactttctgcggcaaaacaagaggaagctgctgcttaaatcttcggcattcgtagataatatatatgaggacggcagagcaggtgagtataggaggacatcaaggtgtatgtagctttgtagtatcaaacccagtgggtgatattatttgccattgtttttggacctgataatgtccataattttgcaagctggtataatttcataatgaccttgtcaagttctcacaaatgagaaaacagtttgttataagttttgcttacat

SEQ ID NO: 6218 - DNA, 2589 bp, Distylium racemosum
ctttaggttcatcaacatttcaaggattgaaattcagccagctgcatcacaaggcttcagtttcaacctcccccaatgtctccatcacacttcccattgtttgcatgtctgcagacgatacaggacgggaagttccattgtcagattataggaatattggaattatggcccacatagatgcagggaaaacgaccactacagagaggattctatattatacaggaaaaactacaaaattggggaggtccatgaaggaactgccacgatggactggatggagcaggagcaagaaagaggcataacaattacttccgctgcaacaacagctgtctggaataatcatcgtataaacattattgatactcctggtcatgtggacttcactttggaagtggagcgagctcttcgagtacttgatggtactatctgtttgtttgacagtgttgctggtgtggagccacagtcagagactgtatggagacaagcagataggtatggagttccccgactttgctttgttaacaaaatggatcgacttggagcaaatttcttcaggactagagacatgatagtgacaaacctaggggcaaaacctcttgttctgcaaatcccaatcggggcagaggatcgtttccaaggagttgttgatttgatcacaatgaaggctgtagtgtggtctggagaagaattgggtgcaaagttcagctatgaggatattccagcagatcttgtagatattgccacggaatatagaaatcaaatgattgaaactatagttgaacttgatgatgaagccatggagaagtatctcgagggagaggagcttgatgagaaaaatataaaaaaactgattagaaagggcactgtatctattaagtttgttccagttctttgtggttcagcatttaagaacaagggtgtgcaacctttactggatgctgttgtggattatttgccttctcctcttgatttgccaccaattcaaggaacagatgcagagaatccagagatatccctagaaaggtgtgcaagtgatgatgaaccattttcagggcttgcttttaaaattatgactgatccttttgtgggttctcttacatttgtacgaatttattctggcaagttaaatgctggaacatatgtgctaaattccaacaaaggaaagaaggagagaattgggcgattactacaaatgcatgcaaatagtcgagatgatatcaaggtagctgtggcaggggacatagtggcacttgctggcttgaaggatactataacaggagagactctttgtgatcaggataatcctgttgtgctggaaagaatggaatttcctgatcctgttattaaagttgcaattgaacccaaaacaaaagctgatgtggacaagatgtcacttggtcttgtaaaacttgctcaggaagatccttctttccacttctcaagagatgaggaaaccaaccaaactgtcatagaaggaatgggggagttgcatctggaaatcattgttgatcgtttgaagagagaattcaaggttgcggctaatgtgggtgctcctcaagtgaactaccgagaaagtatctcaaggatagcagaagtgaagtatgtgcacaaaaaacaatcaggtggtcaaggtcagtttgcagatgtaagtgtaagatttgaacctatggaagctggcactgggtatgaattcaagagtgaaattaaaggtggagctgtgcccagggagtatattccaggtgtaatgaagggattagaagagtgcatgagcaatggtgttctggcaggctaccctgttgttgatgtgcgggctgttcttacagatggatcatatcatgatgtggactccagtgcactagcgtttcagcttgcagctcgtggtgctttcagggaaggcgtaagaaaggcaggtccaagactgctagaacctgtaatgaaggttgaagttgtgacacctgatgagcatttgggggatgttattggtgatattaattcaaggcgtggtcagatcattagctttgatgacaaaccaggaggactaaaggtgattgattctttggtgccgctggcagagatgtttcagtatgtgagtagactccgtggtatgaccaaaggccgtgcatcttataccatgcaagttgctaaatttgatgtagtaccccaacatattcaaaatcaaattgctacaaagtcgcaagaggttgctgcttgaggttttgtaaatatttttaaagtcagcattggctgaagttccaaccaatcttccctttctgctgtattctaaatgtatttattacatgaaaatacttttcttctcatagttgacttctctcgccccggtgcaggtcgccgcgatatgcttcaaataacagttggctgggaacggggaactccccttcgacttatcggcagcgatcctcggttgtacatggctggcttacgaaattacgcggaacgctcattgacgacgaacgtgaacgacaggaaggggatacaaggagatacaagcgtgaccaaaaagatacaagaactaggcctcgcacctaagcggccgctcatctcgctcttccgtcggtacccccaaggagc

SEQ ID NO: 6219 - DNA, 1805 bp, Flaveria ramosissima
atagtgttgctggtgttgaaccacagtcagaaactgtgtggaggcaagcagataagtatggggttcctagaatttgttttgttaacaaaatggaccggcttggtgctaacttttttagaacacgtgacatgattgttacaaatttgggtgctaaaccacttgtgctccaactcccgattggggcagaagatgttttcaaaggggttatagatcttgttaggatgaaggccatagtgtggtctggtgaagaattaggtgccaaattttcatatgaagatattccttctgaccttcaagaattatctgaagagtatcgcgcattgatgctcgagaccattgttgaattagatgacgaggttatggaagggtaccttgaaggggtggagcccgacgaacagaccgttaagaagttagttagaaagggaaccataggaggtagttttgtaccggttttatgtgggtctgctttcaagaacaaaggggttcaaccattgctcgatgctgttgttgactatttaccctctccacttgacttgccacctatgaagggtaccgacccagagaacccagaaatcgaaattgatcgggttgcaagtgatgatgctccttttgctgggttagctttcaagatcatgaatgacccgtttgtcggatcacttacttttgtaaggatatatgctgggaagcttgctgctggatcttatgtgatgaatgcaaataaaggaaagaaagaaagaattggaagattacttgaaatgcatgcgaatagcagagaagatgttaaagtagcattagctggtgatattgttgctcttgcagggttaaaggataccattactggagaaacattatgtgatcctgagaagcccattgtgcttgagcgaatggatttccccgatccagttattaaagttgctattgagcctaagaccaaagcagatgttgataaaatggcaaatgggttaatcaagcttgcccaagaagatccgtctttccatttctcacgtgatgaagaaattaaccaaacggttattgaagggatgggagaattgcatcttgagattatcgttgacaggctcaagagggaattcaaggtggaggcgaatgtaggtgcaccacaagtaaactaccgtgaaagcatatccaaggtgtctgaggtgaagtacgtccacaagaaacagtcaggtggtcaaggacagtttgcagatatcaccgtacggtttgagccattagaggcaggtagtggatacgagttcaagagtgaaatcaagggtggtgctgtcccaagagaatacatccccggtgtgatgaaagggttagaagagtccatgaccaatggagtacttgcaggcttccctgttgttgaccttcgtgcagtattgactgatgggtcctaccatgacgttgactctagtgtactcgccttccagctggcagccagaggagctttccgtgaaggagttaggaaagcaggacccaagattctggaacccattatgagagttgaagttgtgacacctgaagaacatttgggagatgttattggtgatcttaattccagaagaggacagattaatagctttggtgacaagcctggtggcctcaaggtggtggattcccttgtgccgcttgcggaaatgttccagtatgtgagtactctaagaggaatgacaaaaggtcgagcatcctacactatgcaactagcgaaattcgatgtggtacctcaacacattcagaaccagctttctgctgcaaaggaagaagcagttgcaacttaatatttctttcactgattctatttaatg

SEQ ID NO: 6220 - DNA, 2592 bp, Festuca arundinacea
  misc_feature (238)..(238): n is a, c, g, or t
  misc_feature (259)..(259): n is a, c, g, or t
  misc_feature (266)..(266): n is a, c, g, or t
  misc_feature (304)..(304): n is a, c, g, or t
  misc_feature (373)..(373): n is a, c, g, or t
  misc_feature (385)..(385): n is a, c, g, or t
  misc_feature (424)..(424): n is a, c, g, or t
  misc_feature (691)..(691): n is a, c, g, or t
  misc_feature (2329)..(2329): n is a, c, g, or t
  misc_feature (2398)..(2399): n is a, c, g, or t
  misc_feature (2403)..(2405): n is a, c, g, or t
  misc_feature (2418)..(2418): n is a, c, g, or t
  misc_feature (2425)..(2425): n is a, c, g, or t
  misc_feature (2444)..(2444): n is a, c, g, or t
  misc_feature (2474)..(2474): n is a, c, g, or t
  misc_feature (2486)..(2486): n is a, c, g, or t
  misc_feature (2488)..(2488): n is a, c, g, or t
  misc_feature (2496)..(2496): n is a, c, g, or t
  misc_feature (2506)..(2506): n is a, c, g, or t
ggcacgagggctcaccctcgagcgcaggcggcagcaagcaaaggccaaggcaaagcacgcacgcacagacagcaccatggccgccgaggcagtcccgcgggccgccgtgccggcgcgccggccgtccgtcgccgccgccgcttccgcctcgcgcctcctcctcggccagcgccccttcctcgcgccgtccgcgtcccgcttcgccgccgggcgcgccgcggtggccggcccggccgcnggactccgcccgtgcacgcgnaggccgngcctctcggtcgtcgccatggccggcaatgatcgccangtacctttggaggattaccgcaatattggtattatggcccatattgatgctgggaaaacaacaactacngagcgcattctntattacactggaaggaactacaaaattggtgaggttcangagggaacagccactatggactggatggagcaagaacaggagagaggaataaccattacatctgcagcaaccactgctgtctgggacaaacacagaatcaacatcattgacactcctgggcacgtcgacttcactcttgaggttgaacgtgctctcagggtgctggatggtgctatatgtctctttgacagtgttgctggggtagaaccacaatctgaaactgtgtggcgccaagcagataagtatggagttccacgaatatgtttngtgaacaaaatggatcgccttggagctaacttttatagaactagggacatgatagtggcaaacttgggtgcaaatcctttggtgatacagttgccgataggctcagaggacaatttccaaggagttgttgatctagtcagaatgaaggctattgtatggacaggagaggaacttggtgcacaattttcatacgaagacatacctgctgatctcgaagaaatggctcaagaatacagagttcgtatgatagaaactattgttgaattggatgatgaagctatggagggctatctggaaggaaatgaaccagacgaggaaactgtgaagaaattaatcagaaaaggaacaataggtgccagctttgtccccattttatgtggttcagcattcaaaaacaagggtgttcagccattgcttgatgctgttgttgattacttgccatcaccacttgacctgccaccaatgaaaggcactgacccagatgaccctgaattggttcttgaaagacttcctagtgatgacgagccattttctgggttagctttcaagatcatgactgatccatatgtggggtcattaacatttgtccggatatactcagggaagctgattgctggttcatacgttctcaatgcaaacaaagataggaaggaaagaatcggcaggcttctggagatgcatgcaaacagtaaggaggatataacagttgctgtgacaggtgacatagtagcccttgctggtctgaaagatacaattactggtgaaacactatgtgacccagataaccttgtagtgcttgaacgcatggaattccctgatcctgtcattaaggttgctattgaaccaaagaccaaagctgatgctgacaaaatggcaaatggattaataaagcttgctcaggaagatccatcattccacttctctagggacgacgaaaccaaccagacagttattgaagggatgggagaattacaccttgacatcattgtggacagattaaagagagagttcaaggttgaggcaaatgttggagctccacaagtcaactaccgtgaaagtatttccaaaattgcagagactcattatgtccacaaaaagcagtccggtggatcagggcagtttgcagatatcattgtgcggtttgagcctatggaagctggaactgggtatgaattcaagagtgaaataaagggaggggcagtgccaaaagaatacataccaggcgtgatgaagggaattgaagaaagcttacccaacggtgttcttgctggttacccagttgtggatttacgagcagtgctggttgatggctcctaccatgatgttgattcaagtgtccttgcattccaaattgcggccaggggggccttccgtgaaggattgaggaaagctggcccacggctcctggaacctgtaatgagggttgaagtgatcacccctgaggagcatttgggcgatgttattggtgatttgaactctagaagaggacaagttaacagcttcggggacaagcctggtggactgaaggtggttgatgcattcgtgccgcttgccgagatgttccagtatgtcagcactctgagaggaatgtccaaggggcgcgcgtcatacacaatgcagctcgccaagtttgacgtngtcccacagcatatccagaaccagctgtctgcggcaaaacaagaggaggctgctgcttaatttttcggnnttcnnnagatatatacatnggcgacnggagagaaagtgaataggncatcaaggtgtatgtagctttgtacaggcnttaattatttgntnttgttttnggacctgatnacatcataattttttacaagctgttaattttactacgaccttggcaggttcgcacaagcgtgagaactattaaatttcctcgtgcc

SEQ ID NO: 6221 - DNA, 1720 bp, Flaveria ramosissima
ccgattggggcagaagatgttttcaaaggggttatagatcttgttaggatgaaggccatagtgtggtctggtgaagaattaggtgccaaattttcatatgaagatattccttctgaccttcaagaattgtctgaagagtatcgagcattgatgctcgagaccgttgttgaattagatgatgaggttatggaagggtatcttgaaggggtggagcccgatgaagagaccgttaagaagttagttagaaagggaaccataggaagtagttttgtaccagttttatgtgggtccgctttcaagaacaaaggggttcaaccattgcttgatgctgttgttgactatttaccctctccacttgatttgccacctatgaagggtaccgatccagagaacccagaaatcgaaattgatcgggttgcaagtgatgatgctccttttgctgggttagctttcaagatcatgaatgacccatttgtcggatcacttacatttgtaaggatatatgctgggaagcttgctgctggatcttatgtgatgaatgcaaataaaggaaagaaagaaagaattgggaggttacttgaaatgcatgcaaatagcagagaagatgttaaagtagcattagctggtgatattgttgctcttgcagggttaaaagataccattactggagaaacattatgtgatcctgagaagcccattgtgcttgagagaatggatttcccggatccagttattaaagttgctattgagcctaagaccaaagcagatgttgataaaatggcaaatgggttaatcaagcttgcccaagaagatccgtctttccatttctcacgtgatgaagaaattaaccaaacggttattgaaggaatgggagaattgcatcttgagattatcgttgacaggctcaagagggaattcaaggtggaagcgaatgtaggtgcaccacaagtaaactaccgtgaaagcatttccaaggtgtcagaggtgaagtacgtccacaagaaacagtcaggtggtcaaggacagtttgcagatataaccgtacggttcgagccattagaggcaggtagtggatatgagtttaagagtgagatcaagggtggtgcagtcccaagagaatacatcccaggtgtaatgaaagggttagaagagtcgatgactaatggagtacttgcaggcttccctgttgttgaccttcgtgcagtattgactgatggttcctaccatgatgttgactctagtgtactagccttccagctggcagctagaggagctttccgtgaaggagtcaggaaagcaggacccaagattttggaacccattatgagagttgaagttgtgacacctgaagaacatttgggagatgttattggtgatcttaattccagaagaggacagattaatagctttggtgacaagcctggtggcctcaaggtggtggattcccttgtgccgcttgcggaaatgttccagtatgtgagtactttaagaggaatgacaaaaggtcgagcatcctacactatgcaactagcgaaattcgatgtggtacctcaacacattcaaaaccagctttctgctgccaaggaagaagcagttgcaacttaatctttctttcagtgattctatttaatgtttgtatttttttatcttttgcttttttatgttttataggacataagaaaatcctccaattttccatcaaaagatatacgaaacaaca

SEQ ID NO: 6222 - DNA, 2678 bp, Brachypodium distachyon
gaagcacacataagcgctcacccacaagcgcaggcggcaggcgcaggcaggagagttcgcggcaaaggccaaggaaagcgcacacgagacagtacaatggccgccgaggcactcccgcgagccgccgcaccggcgcgccggccgtccgtcgcctccgcttccgcctcgcgcctcctcctcggccaccgccccttcctcgcgccgtccgcctcccgcttcgccgccgggcgcgccgcggtggccggcccgcctcccagcctccgcccgcgcccgcgcagaccgcgtctctcggtcgtcgccatggctggcactgatcgccaagtgcctttgggggattaccgcaatattggtattatggcacatatagatgctgggaaaacaacaaccaccgagcgtattctctattacaccggaaggaactataaaatcggcgaggttcatgagggaacagccactatggactggatggagcaagaacaggagagaggaataaccattacatctgcagcaaccactgctgtctgggacaaacatagaattaatattattgatactcctgggcatgtcgacttcactcttgaggttgaacgtgctctcagggtgttggatggcgctatatgtctctttgacagtgttgctggggtagaaccacaatctgaaactgtatggcgccaagcagacaagtacggtgttccaagaatatgttttgtaaacaaaatggaccgccttggagctaacttctttagaactagggacatgatagtggcaaacttgggtgcaaaacctttggtgatacagttgccgattggttcagaggacaatttccaaggagttgttgatctagtcagaatgaaggctattgtatggacaggagaggaacttggtgcacaattttcataccaagacatacctgctgatctcgaagaaatggctcaagactacagagttcagatgctggaaactattgttgaattggatgatgaagctatggagggatatctagaaggaaatgaaccagatgaggaaactgtaaagagattaatcagaaaaggaacaataggtgccagctttgtccccattttatgtggttcagccttcaaaaacaaaggtgtccagccattgcttgatgctgttgttgattacttgccatcaccacttgaccttccaccaatgaagggtactgacccagacgatcctgaagtggttcttgaaagacgtcctagtgacgatgagccattttctgggttagctttcaagatcatgaccgatccatatgtgggatcgctgacatttgttcgcatatactcggggaagctggttgctggttcatatgttctcaatgcaaacaaagataggaaggaaagaattggaaggcttctagagatgcatgcaaacagtaaggaagatataacagttgctgtgacaggtgacatagtagctctagctggcctgaaagatacaattaccggtgaaacactctgtgacccagatagccttgtagtgcttgaacgtatggaatttcccgatcctgtcattaaggttgctattgaaccgaagaccaaagctgatgctgacaaaatggcaaatggattaataaagcttgcccaagaagatccatcattccacttctctagagacgatgaaaccaaccaaacagttattgagggaatgggagaattacaccttgacatcatcgtagacagattaaagagagagttcaaggttgaggcaaatgttggagctccacaagtcaactaccgtgaaagtatttcgaagattgcagaggtacagtatgtccacaaaaagcaatctggtggatcagggcagtttgcagatattattgtgcggtttgaacccatggaggctggaagtgggtatgaattcaagagtgaaataaagggaggggcagtgccaaaagaatatgtaccaggagtgatgaagggaattgaagaaagcttgcccaatggtgtccttgctggttacccggtcgtggatttacgagcagtgctggttgatggctcgtaccacgatgtcgattcaagtgtccttgcattccaaattgcagccaggggggccttccgtgaaggattgaggaaagctggtccaagactcctggaacctgtaatgagggttgaagtaattacccctgaggagcatttgggtgatgtgattggtgatttgaactctagaagaggacaagttaacagcttcggggataaaccaggtggacttaaggtggttgatgctttcgtgcctctcgccgagatgttccagtatgtcagcactctgagaggaatgtccaaggggcgcgcatcctacacgatgcagcttgccaagtttgatgttgtcccacagcatattcagaaccagctctctgcagcaaaagaggaagctgctgcttaattttttcgtttgcgtacatatacatggtgacggttgagcaggtgaataggacatcaaaggtgtattgtagctttgtagtgtcgaacgggatttaccatttgttttcggacttgatcatgttataattttttcaagctgttagtgtcatcatgaccttgccaagtttcagagaagagaaaacagttcgttactaattttgtttcctgtttacaccgctgttgcttcgttttgttaatgtgttgaacatttccgcacattactaattgtttcactac

SEQ ID NO: 6223 - DNA, 2703 bp, Avena sativa
caggcggcagcaagcaaaggccaaggcaaagcacgcacgcacacacagacaccatggccgccgaggcactcccgcgggccgccactcggacggccgcgcgccggccgtccgtggccgccgcttccgcctcgcgcctcctcctcggccagcgccccttcctcgcgccgtccgcgtcccgcttcgccgccgggcgcgccgcggtggccggcccggccgccggaatccgcccgcgcacgcgtaggccgcgcctctcagtcgtcgccatggccgggaatgatcgccaagtacctttggaggattaccgtaatattggtattatggcccatattgatgctgggaaaacaacaactacagagcgcattctctattacactggaaggaactacaaaattggtgaggttcatgagggaacagccactatggactggatggagcaagaacaggagagaggaataaccattacatctgcagcaaccactgctgtctgggacaaacacagaatcaacatcattgacactcctgggcacgtcgacttcactcttgaggttgaacgtgctctcagggtgctggatggtgctatatgtctctttgacagtgttgctggggtagaaccacaatctgaaactgtgtggcgccaagcagataagtatggagttccacgaatatgtttcgtgaataaaatggaccgccttggagctaatttttatagaactagggacatgatagtggcaaacttgggtgcaaatcctttggtgatacagttgccgataggttcggaggacaatttccaaggagttgttgatctagtcagaatgaaggctattgtatggacaggagaggaacttggtgcacaattttcatacgaagacatacctgctgatctcgaagagatggctcaagagtacagagttcggatgatagaaactattgttgagttggatgatgaagctatggagggttatctggaaggaaatgaacctgatgaggaaactgtgaagaaattaatcagaaaaggaacaataggtgccagctttgtccccattttatgtggttcagcattcaaaaacaagggtgtccagccattgcttgatgctgttgttgattacttgccatcaccacttgacctgccaccaatgaaaggcactgacccagatgaccctgaattggttctcgaaagacttcctagtgacgacgagccattttctgggttagctttcaagatcatgactgatccatatgtgggttcattaacatttgtccgtatatactcggggaagttgattgctggttcatacgttctcaattcaaacaaagataggaaggaaagaatcggaaggcttctagagatgcatgcaaacagtaaggaggatataacagttgctgtgacaggtgacatagtagcccttgctggtctgaaagatacaattactggtgaaacactatgtgacccagataaccttgtagtgcttgaacgtatggaattccctgatcctgtcattaaggttgctattgaaccaaagaccaaagctgatgctgacaaaatggcaaatggattaataaagcttgctcaggaagatccatcattccacttctctagggacgacgaaaccaaccagacagttattgaagggatgggagaattacaccttgacatcattgtggacagattaaagagagagttcaaggttgaggcaaatgttggagctccacaagtcaactaccgtgaaagtatttccaaaattgcagagactcattatgtccacaaaaagcagtctggtggatcagggcagtttgccgatattattgtgcggtttgagcctatggaagctggaactgggtatgaattcaagagtgaaatcaagggaggggcagtgccaaaagaatacataccaggcgtgatgaagggaattgaagaaagcttacccaatggtgtccttgctggttacccagttgtggatttgagagcagtgctcgttgatggctcctaccatgatgttgattcgagtgtccttgcattccaaattgcagccaggggggccttccgtgaaggattgaggaaagctggtccaagactcctggaacctgtaatgagggttgaagtgattacccctgaggagcatttgggtgacgttattggtgatttgaactcgagaagaggacaggttaacagcttcggggataagccaggtggactgaaggttgttgacgctttcgtgccgcttgccgagatgttccagtatgtcagcaccctaaggggaatgtccaagggccgcgcgtcctacacgatgcagctcgccaagttcgacgtcgtcccacagcatatccagaaccagctctcagcagcaaaacaggaggaggccgctgcttaatttttttggtgagtctcatagatatatacgtggcgacgggagagcaagtgaataggacatcaagatgtatgtagctttgtagtgtcgaacccagcgggtgttaattatttgccattgttttcagacctgataacgtcgtaatttttacacgagataactgttcattataaattttgcttcagttcagtcaatgttcctttctcttttcttgtaatgctatatgattagattgcatgttgtcattggaggtgtttttacaactcttgctatatatatcgctgcaccatgtgaaaattggtctgtgagagagatggaattctcagaaccttggtcc

SEQ ID NO: 6224 - DNA, 2536 bp, Avena sativa
caggcggcagcaagcaaaggccaaggcaaagcacgcacgcacacacagacaccatggccgccgaggcactcccgcgggccgccactcggacggccgcgcgccggccgtccgtggccgccgcttccgcctcgcgcctcctcctcggccagcgccccttcctcgcgccgtccgcgtcccgcttcgccgccgggcgcgccgcggtggccggcccggccgccggaatccgcccgcgcacgcgtaggccgcgcctctcagtcgtcgccatggccgggaatgatcgccaagtacctttggaggattaccgtaatattggtattatggcccatattgatgctgggaaaacaacaactacagagcgcattctctattacactggaaggaactacaaaattggtgaggttcatgagggaacagccactatggactggatggagcaagaacaggagagaggaataaccattacatctgcagcaaccactgctgtctgggacaaacacagaatcaacatcattgacactcctgggcacgtcgacttcactcttgaggttgaacgtgctctcagggtgctggatggtgctatatgtctctttgacagtgttgctggggtagaaccacaatctgaaactgtgtggcgccaagcagataagtatggagttccacgaatatgtttcgtgaataaaatggaccgccttggagctaatttttatagaactagggacatgatagtggcaaacttgggtgcaaatcctttggtgatacagttgccgataggttcggaggacaatttccaaggagttgttgatctagtcagaatgaaggctattgtatggacaggagaggaacttggtgcacaattttcatacgaagacatacctgctgatctcgaagagatggctcaagagtacagagttcggatgatagaaactattgttgagttggatgatgaagctatggagggttatctggaaggaaatgaacctgatgaggaaactgtgaagaaattaatcagaaaaggaacaataggtgccagctttgtccccattttatgtggttcagcattcaaaaacaagggtgtccagccattgcttgatgctgttgttgattacttgccatcaccacttgacctgccaccaatgaaaggcactgacccagatgaccctgaattggttctcgaaagacttcctagtgacgacgagccattttctgggttagctttcaagatcatgactgatccatatgtgggttcattaacatttgtccgtatatactcggggaagttgattgctggttcatacgttctcaattcaaacaaagataggaaggaaagaatcggaaggcttctagagatgcatgcaaacagtaaggaggatataacagttgctgtgacaggtgacatagtagcccttgctggtctgaaagatacaattactggtgaaacactatgtgacccagataaccttgtagtgcttgaacgtatggaattccctgatcctgtcattaaggttgctattgaaccaaagaccaaagctgatgctgacaaaatggcaaatggattaataaagcttgctcaggaagatccatcattccacttctctagggacgacgaaaccaaccagacagttattgaagggatgggagaattacaccttgacatcattgtggacagattaaagagagagttcaaggttgaggcaaatgttggagctccacaagtcaactaccgtgaaagtatttccaaaattgcagagactcattatgtccacaaaaagcagtctggtggatcagggcagtttgccgatattattgtgcggtttgagcctatggaagctggaactgggtatgaattcaagagtgaaatcaagggaggggcagtgccaaaagaatacataccaggcgtgatgaagggaattgaagaaagcttacccaatggtgtccttgctggttacccagttgtggatttgagagcagtgctcgttgatggctcctaccatgatgttgattcgagtgtccttgcattccaaattgcagccaggggggccttccgtgaaggattgaggaaagctggtccaagactcctggaacctgtaatgagggttgaagtgattacccctgaggagcatttgggtgacgttattggtgatttgaactcgagaagaggacaggttaacagcttcggggataagccaggtggactgaaggttgttgacgctttcgtgccgcttgccgagatgttccagtatgtcagcaccctaaggggaatgtccaagggccgcgcgtcctacacgatgcagctcgccaagttcgacgtcgtcccacagcatatccagaaccagctctcagcagcaaaacaggaggaggccgctgcttaacttttttggtgagtctcatagatatatacgtggcgacgggagagcaagtgaataggacatcaagatgtatgtagctttgtagtgtcgaacccagcgggtgttaattatttgccattgttttcagacctgataacgtcgtaatttttacacgagataactgttcatta

SEQ ID NO: 6225 - DNA, 2587 bp, Pteridium aquilinum
ctcctctcaggagcgtgcaccgccatagccaggccccttgtccatagcttctgcgggagctcgcttcgccatagctgagcttgctttttttttgacggtttctatcaagctttcctcgccatagcctgccttctctaagcagcttgaatggcttcttctgtggctaagataagctcttcaccttctccggtgctgtcgtcgcaggcgagtagcagcaaaagcgcgcaagaaaacagaagattcaatggcctggcctcgtttgctggcctcaagaaattgacgggtttccctgtggcttcttcgtctgctgttgcttcccagtggtctgaagcaatgaagtgggtttatgcgcctaccgatcgtagcggttccagaagaagctctgtgcttgccatggctgctgatgtaggtgaaaagcgagaggtgccattgcatgattaccggaacattggtatcatggcgcatattgatgctggcaaaacaaccacaactgagcgtattctcttctacactggtcgaaactacaagattggagaggtgcatgagggtacagccacaatggactggatggaacaagagcaagagagaggcatcactatcacctctgctgcaaccactgcaaagtggaaggatcaccgcattaatatcattgacacaccagggcatgtggacttcaccttggaggttgaaagagcattgagggtcctcgatggcgcaatttgcctctttgatagtgttgctggggtggagccgcaatctgagactgtatggagacaagctgataagtatggggttccaagaatttgcttcgttaacaagatggatcggcttggtgctaactttttttcgcacgcgcgatatgatcgtgagcaacttgggtgcaaaacctcttgtcctgcaactccctattggagcagaagacacattcaaaggggttgtagatctggttctgatgaaggctattgtgtggagtggggaagagcttggtgcaaagttcgagtacgttgatattcctgaggatcttgctgatttggcagctgattacagggcccaaatgattgaggtgattgttgagcaagatgatgatgctatggagcagtatttagagggcgtagagcccgatatcgaaacaatgaagaaactcattcgtaaaggaacaattgcgcttgcatttgtgcctgtcctatgtggatcagccttcaagaacaaaggagtgcagcctcttcttgatgctgttgtcgattatctaccatcaccgcttgatttacccaccatgaagggctcggctcctgacgaccctgatactattctagagaggaaacctagtgacgatgagcccttctctggtttagctttcaagatcatgacagatcccttcgttggctcccttacctttgtccgtgtctactctggtgtactctcaggtggttcttatataatgaatgcgaataagaataagaaggagaggatagggaggttactagaaatgcacgccaacagtcgggaagatgtcaagacagcaagaacgggtgatattgttgctttggctggtctgaaggacacaataactggggagactctttgcgacccagacaaacctgttgtgctggaaagaatggatttcccagacccagtcatcaaagtggccattgagcccaaaaccaaggctgatattgacaagatggccaatggcctcatcaagttagcacaggaggatccatccttccatttctcacgagatgaagagagcaaccagactgtaattgaaggaatgggggagttgcacttggagattattgttgacagactgaaaagagagttcaaggtagaagccaatgttggtgcccctcaggtgaactatagagagagcatttctcgacctgtggaaattaagtatgtgcataagaagcagtcaggtggacaaggtcaatttgcagaggtggttattaaatttgagcccctagaagctggaagtggctacgagttcaagagtgaaattaaaggtggaacggtacccaaggagtatatacctggagtggtcaagggtttagaggagtgtatgagtaacggtgtgctggctggttttccagtcgtggatgtgaaagctattctaactgatgggtcttatcatgaggtagactctagtgtcttggcattccaacttgcggcaagaggggctttcagagaggggatgaacaaagctgcccctaagcttttggaaccaatcatgaaagtggaggttgtcactcctgaagatcatcttggtgacgtcattggtgatttgaactctcggcgtggacaaatcaacagctttggtgacaagcctggtggattgaaggttgttgatgcactcgtccctctgtcagaaatgttccaatatgtgagcacattgcggggaatgaccaagggaagggcttcatacactatgcagcttgccaagtttgacattgtgccccaacatatccagaatcaaatctcggccaaggcacaaacagctgctgcggcttgaatgccttcttcattatgagaagcatggatctcagtgtaaattagtgactcttaaacttgccattccttaggtatagcc

SEQ ID NO: 6226 - DNA, 3076 bp, Taxus baccata
cgccatcatgcaatgtatcatgccatctctgcatattccttgccttaggtgcctgctcacagcgcacatttccaccatgcaacatccatcgagctaccccgcttatgccatagcgatctaggttgagcgcttgttggcctcagcagagccctcgtgcttctcctggctgagcttgtcgctgatggcaccagtggcaccggatgcgcggtcggtcagggagtcttggccggggacgttgcccttggcttgctgcttgttgccctccttgctggcctctgcggacttgccttgtacggtctcagagacgtagttggcggcgttggagacagagttgtaaccgttcatttggctgcttaggtttttggttggatgaggaatgagtagagaacatgtactacttatcctccacccatcctctaatgcaattcaaaatgaaaatcaatccattccagcaatcttctgtgacaacaatacaaggagggcctggatttcgcagggtttagggttttcattcaacagatttcagtcaataatggctgaaacactcaagcttgccaagtgcttctcttgcactagtttacagaacaacaatggcctttgccataaccataaaggttgtacaagaacgagcaaaaaccgtcttgtggcgaattcatttcatagactgaagagtttagcaggttttcctctaccctcgtcgtcaacaacatcaatacaggggtctaaatacaatcttagccagtttcttcacaggacatctcttccaaaagcctccaggagaatgcccattgtttgcatggctgcagatggtgagacaggacgtgaggtgccgctctcagattataggaatattggaattatggcccacatagatgcagggaaaactaccaccaccgagaggattctattttacacagggaaaaattacaaaattggggaggttcatgaagggactgctacgatggactggatggagcaggagcaagaaagaggcataacaatcacttctgcagcaacaacagctgtctggaataaacatcggataaacattattgatactcctggtcatgttgacttcactttggaagtggagcgggctcttagagtacttgatgggactatttgcttgtttgacagtgttgccggagtggagcctcagtcagagactgtatggagacaagcagataagtatggagtacccaggatttgctttgttaacaaaatggataggcttggagcaaacttttataggactagagacatgatagtgacaaacctaggggcaaaacctcttgttttgcaaatcccgattggtgtagaggatagcttccaaggacttgttgatttgatcaaaatgaaggctgtattgtggtctggagaagaattgggtgcaaagttcagctatgaagacattccagcaaatcttctagatttggccacagaatataggaatcaaatgcttgaaactatagtggaacttgatgatgaggccatggagaaatatcttgagggagaggagctcgatgagaaacaatcaagaagttgatcagaaagggcaccatatctattgtatttgttccagttctgtgtggttcagcatttaagaataagggtgtgcagcctttattggatgctgttgtggattatttaccttcccctcttgacgtgccaccattgaatgggacagatccagatgatccagaggtgatcctagaaagacgcccagacgacaatgatccatttgcaggacttgctttcaaaattatggcggattcatttgtggggtctcttacatttgtacgagtttattctggcaagctgaatgctgcatcttatgtacttaattccaacaaagggaagaaggagagaattggacgattattacaaatgcatgcaaatagtcgagaggaagtcagggttgctgtggcaggggacatagtggcacttgctggcttgaaggatactataactggagagacgctttgtgatccagataatcctgttgtgctggaaagaatgaactttcctgaccccgttattaaagttgcaattgaacctagaacaaaagctgatgtggacaagatgtcaatgggtcttgtcaaacttgctcaggaagatccttctttccacttctcaagagacgacgaggccaaccaaactattatagaaggaatgggggagttgcatcttgaaatcattgttgatcgtttgaagagagaattcaatgtcgaggcaaatgttggtgctcctcaagttaactatcgagaaagtatatcaaggacggcagaagttacatatgtgcacaagaaacaatcaggtggtcaaggtcagtttgcagacataactgtaagattcgaacctatggaaactggcagtggatacgaatttaagagtgtaattaaaggtggagttgtgcctaaggagtatataccaggtgtaatgaagggattagaagagtgcctgggcaatggtgttctggcaggcttccctgttgttgatgtgcgggctgttcttacagatggatcatatcatgatgtggactctagtgtactagcattccagcttgcagctcgtggtgctttcagggaaggaataaggaaagcaggtccaagattgctggaacctataatgaaagtcgaagttgtgacacctgaggagcatttaggggatgttattggtgatctcaattcaaggcgtggtcaaatccacaactttggtgagaagccaggaggactaaaggtggtcgatgctttggtgccgctggcagagatgtttcagtatgtgagtacacttcgtagcatgtccaaaggccgggcatcttataccatgcaacttgaaaagtttgatgtggtacctcagcatattcaaagtcaactttctacaaaatcacaagatgttgctgcttgaggttttgcagaaaatttatgaacaagtatctgactggatgtccaagcaagcattgtattctggtcctttcgaattgtatctaatgcatggaaaatactatcatcttccgtatttgtttcgttcattggtaaaatgaataaaaatgctatgctaacaaaaaaaaaaaaaa

SEQ ID NO: 6227 - DNA, 4111 bp, Pennisetum glaucum
tagaactagagacatgatagttgcaaacttgggtgccaaacctctggtgattcagttgcctattggttcagaggacagtttccaaggagttgttgatcttgttaggatgaaagctatagtatggacaggggaggagctgggtgcgaaatttgaatatcaagatatacctgctgaactccaagagatggctgaagactatcgtgttcagatgttggaaactattattgaattggatgatgaagttatggagaaatatcttgaaggaactgaaccagacgaggaaactgttaagaaactaatcagaaagggaacgatttctgccagctttgtcccagttttatgtggttcggccttcaaaaacaagggtgtccaaccattgcttgatgctgttgtggattacttgccatctccacttgatctacctgcaatgaagggtactgacccagacgaccctgaaatagtccttgaaaggaaccccagtgatgatgaaccattttctggcttagctttcaagatcatgactgatccatttgtggggtcactaacatttgttcgcatatactctgggaagctggaagctggttcatatgttctgaatgcaaataaagataaaaaggaaagaattggaaggcttctagagatgcacgcaaacagtaaggaagacataacagttgctgtgactggggacatagtagcgcttgctggcctgaaagacacaattactggtgaaacactatgtgaaccagacaagcctgtagtgcttgaacgtatggaatttcctgatcctgtcattaaggttgctattgaacccaagactaaagctgatgctgacaaaatggctactggattgatcaagcttgctcaagaagacccatcattccacttctctagagatgaggaaaccaaccaaactgttattgaaggaatgggagaattacatcttgatatcattgtagacagactaaagagagagttcagggttgaagcaaacgttggagctccacaagtcaactaccgtgaaagtatttccaaagtcgcagaagtacaatacgtccacaaaaagcagtctggtggatctgggcagtttgcagacattattgtgcgctttgaacctttggaagctggaagtgggtatgaattcaagagtgaaatcaagggagggtcggtgcccaaagaatatgtaccaggagttatgaagggattggaagaaagcttgcccaacggtgtccttgccggttacccagttgtggacttccgagcagtgctggttgatggctcgtaccatgatgttgattcaagtgtcttagcattccaaattgcagccagaggtgctttccgggaaggaatgaggaaagctggtccaagacttctggagcctataatgagagttgaagtggtaactcctgaagaccatctgggtgatgttattggtgatttgaactctagaagaggtcaagttaacagcttcggggataagcctggtggactcaaggtggttgatgcgttcgtgccacttgccgagatgttccagtacgtcagcaccctccggggaatgaccaaggggcgtgcgtcctacacgatgcagctcgccaagttcgacgtcgtcccgcagcacatccagaaccagctctctgcagcgaaaacagaggaagctgctgcttaatcttcattcccgtagatattacccacacgccaaagggcagagcaggtttataggaaggacatcaaggtgtatgtagcgttgtagcgagtccaatcccgcgagggtacattatttgccattgattttggacctggtaatggccttgttgagttttctgaacaacagtaattgtatgttttttttttcgtcttcaagacaactccaacctatattcatgtcagaaaaaggcagagtagcatagcttacatcagtggctctagaggtattccttacgtcaaaaccgtccaaagaatgggctatatactatagaaactgccaccacatttcccatcaaaatgttacatatacaaactctgttcctagatacacgtgacaagcactaagttgcttgtcaagatggatatataaaatcaaattcataatagaaagggaaaaaatactgacaaaactatatgattttcatccaacaaaagaatggaaaacagagtcccatcattagttgttatgtcagacgttgtagtccaagctctgaggaaataagcctgagcagcacttgtacaagctcccgcaccctagcttctcttgagacaacaagctcagagaaagtgggaagcaaagataataaatgagctcgtccatgggatttgttttcccccaaagcctctttcagatatgtaggtatgttcagagcattagctgcatcgatgtctatgattagtctagcaagctcttgaagaacacaaattgtttcctcaaccctcacactaggcaaaggatgttctccttggtcattttcatctgctaaaaactgccccaatataacctcacaccgctttataagaatggaaattgaaactttgctggtttctgatgctgaagcacatgtgcttgcctttgctatagagctgcataaagaaaacatcatctgcaaacagctcagtgaaaatcggctgcagtgcaaaggtaaaagaccaacagtttgaacagggagggatcctgttcgtgaggcacagcgatcaagacagttcacaagcctttgcaaaacctcaactggagcatccttttgcaatctcagaatatcatctccaaagacaccgaggacactcatctcaaaggtctcatcagctgtaatagaatcagctgaaggaacatctgatgacaacacacgtccacaagaaccaacaagaaaggtttcatacacatctgcgacctccttccagaaacgagctctagaaagtctatatgaattcacatcacttctgcaatccgcattgtcctgcctcacctcatctgtcacaacacgattgaagcattcagcagatattctccaaagggtgccccttgggttgtctctccttgtattcatgcacctcccaaggccttgaatgacttctggtgaggaagtaaacctttcatttggtggagcctccagaaaaaggttgacaatgattggcacaagcttttctacaaacaaaagaccccaaccacagcccacaccactatccaattttgtaccgctgtcattgagcttactgcgttcaacgagggcacgctttgtaccatctactggtgcatcggaattctgattgtgtatttgtttattgtttccctggagtgggccttctggcccattcagatagcataatagctcaaggagtagaggcgcccacatggaagacaatgtagctgttgggcgtagcataggaatgatttccagtatacctcgttgtacagcagggatactacccagttcattgtcataatcagcaggagtcatggtagccttaatcatcagatgcataattgccatgagccttagatacatgtcatcattaaacagagattgtgcttgaacgtaaagatcaccaagaccacggaggacctcctgcttcactttgtcagtggagtcgttcttaaaatttggtgatgtttgaagaacaagttcataaatatcaaggacagatttgacatacgaagattccagattgccctttagacagtttgcgccaacaaatgtctgcaagcaatttatggcagcaagagcaacctccttgctaccatttaagatgctatttttaatgaaatcaagtaaaagcacccaaccagaagaaaatttgctcaattgctggaggaaagggaaaaaggagcgtaaaagccgtgcaataccacctagtacaaggacaatagtttcatcccattgcttttgtgctgtatttcgactgtgatggataagcatatgaacagctttgcctgcccgagttcctagctccttcccttgccactcatctcgagatgaggtagatgccaagtgggaaacatgctctaacatagggaaaacatatgaccacagacaatcctcccacatacttttagaaagcttttggccatgggtgctgagagtctgaaagagagtcctaacagccgagttccggacctcaggacgatcat

SEQ ID NO: 6228 - DNA, 1857 bp, Arachis hypogaea
aagctatagtttggtccggagaagagttgggtgccaagtttgactatgtagatattccagaagatcttcaagagttggctcaggattaccgatcccagatgatagaaaccatagttgagctggatgatcaggctatggagaattacctggaaggagttgaaccagatgaagaaactataaaaaaactaatcaggaagggaaccattgcagcaagttttgtgccggtgatgtgtggctcagctttcaaaaacaaaggggtccaacctttacttgatgctgtggtggattatctaccttccccaattgatttgccaccaatgaagggcagtgatcctgaaaaccctgaagtgacaatagacaggaaagcagatgacgatgaaccattttctggactagcttttaagatcatgagtgatccatttgtaggttccctcacgttcgtcagggtgtattctggaaagcttactgcgggctcttatgtactcaatgcaaacaaggggaaaaaagagagaattggcaggcttctagaaatgcatgcaaacagcagagaggatgttaaagtagctttgacaggtgatattattgctcttgcaggtttaaaagatactattacaggtgaaacgttgtctgacccggagaatccggttgtgcttgagcggatggacttccccgacctgttataaaggttgcaattgaacccaaaactaagctgatgttgacaggatggctgctggtttaatcaaacttgcacaggaagacccttctttccacttctctagggacgaagagattaaccagacagtaattgaaggaatgggagaattacatctcgaaatcattgttgatcgactcaaaagagaatttaaggttgaagccaatgttggtgctccccaagtgaactatagggaaagcatttccaaagtctcggaagtaaagtatgtacacaagaaacagtcaggtggacagggtcagtttgcagatatcacagttcggtttgaacccatggacccagggagtggatatgaattcaagagtgaaataaagggaggtgctgtaccgaaagagtacattccaggggtcatcaaaggattggaagagtgcatgagcaatggtgttcttgctggcttccctgttgttgatgtacgtgcagtgcttgtggatggttcttaccacgatgtagattcaagtgtgctggcattccagcttgcagcaagaggagccttccgggaaggaatgaggaaagccgggccaaggatgcttgaacctataatgaaagtagaagttgttactcctgaagaacatttgggtgatgtaattggtgatctcaactcaagaagaggtcagatcaacagctttggtgacaaaccaggtggccttaagattgtggatgctctggttcctcttgctgagatgtttcaatacgtgagcacactcagaggaatgacaaagggacgtgcttcctacacaatgcaattagccatgttcgacgtggttccacagcacattcagaaccaacttgccacaaaggagcaagaagttgccgcttagtgtatctttcccttgttcacaaggacatttttctgttaatgtaatttatgttcattgtccactagttggggtttacttatctttttgaatttttcttctcttaattgtaattttcctttgtccaatacaagattagccagaaatttttcagaaagaaagataacaacactgttgttcttaggttgtagagagcgaactgtatttgttactgggagagtatgatgatgtttgaaagcaatttttgtgggcgtgataatcgtgattcgtgacagaactcgagaattcaggacatgaaattattacatatcc

SEQ ID NO: 6229 - DNA, 2237 bp, Euonymus alatus
gggacaattctctgcatttgccatgtctactgaagagtcaaagcgtgcagtaccattacaagattatcgaaacattgggattatggctcacatagacgctggaaagaccactactactgaacgaattctttattacactggaaaagcctataaaataggagaggtacatgagggaacggctgtaatggattggatggaccaagagcgagaaagagggattaccattacttctgctgctactaccacattctggaacaaacaccggattaatattattgatactcctggccatgtcgacttcacactagaagtggagcgtgcgcttagggttttggatggcgctatatgtttgtttgacagtgttgcccggtgtggagccgcaatctgaaactgtatggaggcaagcagatagatacggggtacctagaatttgttttgtgaataagatggatcggcttggtgcaaacttttttagaacaagagacacgatagtaaccaacctaggagctaaaccacttgtacttcaattgcctattggttcggaagctacatttcaaggagttgttgatcttgtcaagatgaaagctgtgatttggtcaggagaagaattgggtgccaaattttcctatgaggacattccagctgatcttcaagagttggctcaggattaccgtgcacagatgatagaaaacatagttgaacaagacgatgaggctatggagaactacttagaaggcgtcgagccggatgagcaaaccattaagaatttaattaggaagggagccattggaggcagttttgtgccggttttatgtggctctgcctttaaaaataagggagtccagccgctgcttgatgctgttgttgattatttgccttctccacttgacgtgcccgcaatgaagggtactgatcctgagaacccagaagtgacaattgagaggagtgcagatgacgatgaaccttttgctggactagcttttaagattatgagtgatacacatgtgggatctcttacgtttgtgagagtgtatgctgggaagctaagtgcatcgtcctatgtattgaatgcaaacaaaggaaagaaagagagaattggcagacttcttgaaatgcatgccaacagcagagaggatgtcaaggtcgctttagctggtgatattgttgctgttcaaggtttaaaagatacaataacaggggaaacactgtgtgatcctgaacatcctattgtgcttgagcggatggacttccctgatccagtaattaaggtttcgattgaacccaagactaaagctgatattgataagatggcaattggtctgataaagcttgctcaagaagacccttcgttccacttctctagagatgaagaagttaaccagactgtaattgaaggaatgggagaactccatctagagattattgttgatcgtctcaagagggaatttagggttgaagctaatgttggtgcaccccaagtaaattaccgcgagagcatttctagagtcacagaagttaagtatgtgcacaaaaaacagtctggtggacaagggcagtttgctgacataacagtacgatttgagcccatggagcctggtagtggatatgagttcaaaagtgaaatcaagggaggtgctgtgccaaaagaatatattccaggggtaatgaaaggattggaggagtgtatgagtaatggtgtgctagcaggatttcctgttgtagatgtgcgtgctgtattagttgacggttcttaccatgacgtagattcaagtgttttggcatttcaacttgctgctagaggagctttccgggaggggatgagaaaagctgcaccaaagatgctagaacctgttatgaaagtcgaagttgttactcctgaggagcacttgggagatgttattggcgacctcaactcaaggagaggccagattaacaactttggtgacaaacccggtggtcttaaggtagtagattctcttgttccactagcagagatgtttcagtatgtaagtacgctccgtggaatgacgaaaggccgtgcatcatacacaatgcaattagccaagtttgatgttgtccctcaacacatccagaaccagctcgcttcgaaagagcaagaagttgctgcttgattttgttcatttgattgcaatggaacattatactcttgtatcatatactttgagaggagcaattttttgtttcccttgtggaagggcatcattaaagccagtata

SEQ ID NO: 6230 - DNA, 1994 bp, Curcuma longa
tactagatggtgctatttgtctctttgacagtgttgctggtgtggagccacaatctgagactgtttggagacaagcagacaattatggtgtcccaagaatatgttttgtcaacaagatggatcgccttggagctaactttttccgaacaagggatatgataatctcgaacttaggtgccaaacccttggtccttcagttgcctgttggtgcagaagatagatttcaaggaattattgatctattgaaaatgaaagctgtcatatggacaggtgaggaacttggtgccaaatttacctatgaagacatacctgctgatctgcaagacattgctcaggagtaccgcagccagatgatagaaactgttgttgagttagatgatgaaactatggagcgctacctagaaggagttgagccagatgaagcgacactgaagaagctaattagaaaaggcactgtatcaagcaattttgtgccagttttatgtgggtcagcatttaaaaacaaaggtgttcagccattgcttgatgctgtggtggattatctaccatcacctctcgagttgccaccaatcaaaggtaccgatgctgataacccagaggtcaccattgaaaggcttcctaaagatgatgagccatttgctggattggctttcaagatcatgaatgattcatttgtaggatctcttacattcgtaagagtttactcagggaaattagctgcgggttcttatgttctgaatgcaaacaaaggaaagaaagagagaataggacgacttctagagatgcatgctaacagtagggaggatgtcaaggtagctttaactggtgatattgtggctcttgcaggcctgaaagatacaatcacaggtgaaacactctgtgatccagataaccctgtagtccttgaaagaatggactttccagatcctgtcattaaggttgcaatagaacccaagaccaaggcagatgttgacaaaatggcaactggtctgatcaagttggctcaagaggatccttctttccatttctcaagggatgaagaaactaaccaaactgttattgagggaatgggggagctgcatcttgatatcattgttgatcgtttgaagagggagttcaaggtcgaggcaaatgtaggtgcaccacaggtaaactatagagaaagcatctcaagaatatctgaagtccaatacatccataagaaacagtctggtggggcagggcaatttgcagacattacagtcagatttgagccattggaaccaggtagtgggtatgagttcaagagtgagataaagggaggagcagtaccaaaggaatacattccaggtgtcatgaaagggttggaagaatgcatgagcaatggtgtgctagccggctacccggttgtcgatgtcagagcagttttggttgatggaacctatcatgatgttgattccagtgtcctggcatttcagctggcagccaggggtgctttccgccaaggtattagaaaagctaacccaagattgctcgaacctattatgaaagtggaggtagtcactccagaagagcatttaggtgatgttattggtgatcttaattcaagaagaggccagattaacaactttggtgataagccaggtggtcttaaggttgtagatgctttggtaccattggctgaaatgttccagtatgttagtacgcttcgtgggatgacaaaaggacgagcatcttacacgatgcagctcgctaacttcgacgtcgtccctcaacacatccaaaacgaactctctgctaaagaagaagccgcaacagcttgaaggcttgtggaatctgtttcttgtggaatctattttgttggaaccaaacacaacagtttgtattcttcatattcattgagaatgtaaaggacaggtcaggccttaagctatatcccaagtagtaacaaagttatattttagttgattaatgtacttggatgaatgtttttgtgtttttattcattacacttt

SEQ ID NO: 6231 - DNA, 2544 bp, Flaveria ramosissima
attggggaatccatatattcatactctcactgttatcccattgtcacttccaataataatctatctagtggcgccagtgttccaatggcggcagaagctgttaccgccgcttacctctgcagcttctccggcaacaatggtggttccgccgcccgccgccaccttctctctccctccgcctccctccgtcgccaccaccaccaccaacaacaacgttcgcttacgtcatctttcttcgggacgcaacgactcaaattaactaagttgaattctcgcgttcagaagaggaatctatcggttgttgctatggctgcctctgaagatgcaaaacgtgaggttcctctgaaggactaccgcaacattggtattatggcccacatagatgccggaaaaactaccacaacagagcgtgtactttactacactggtagaaactacaagattggtgaggtacacgagggtacggccacaatggactggatggaacaagagcaggagagaggaatcaccataacttcagctgcaaccaccacattctggaacagtcaccgcatcaacatcattgatacacctggccatgtggacttcacacttgaggtggaacgtgcccttagggttcttgatggtgccatttgcttgttcgatagtgttgctggtgttgaaccacagtcggaaactgtgtggagacaagcagataagtatggggtgcctagaatttgttttgttaacaaaatggaccggcttggtgctaactttttttagaacacgtgacatgattgttacaaatttgggtgctaaaccacttgtgctccaactcccgattggggcagaagatgttttcaaaggggttatagatcttgttaggatgaaggccatagtgtggtctggtgaagaattaggtgccaaattttcatatgaagatattccttctgaccttcaagaattatctgaagagtatcgcgcattgatgctcgagaccattgttgaattagatgacgaggttatggaagggtaccttgaaggggtggagcccgacgaacaaaccgttaagaagttaattagaaagggaaccataggaggtagttttgtaccagttttatgtgggtctgctttcaagaacaaaggggttcaaccattgctcgatgctgttgttgactatttaccctctccacttgacttgccacctatgaagggtaccgacccagagaacccagaaatcgaaattgatcgggttgcaagtgatgatgctccttttgctgggttagctttcaagatcatgaatgacccgtttgtcggatcacttacttttgtaaggatatatgctgggaagcttgctgctggatcttatgtgatgaatgcaaataaaggaaagaaagaaagaattggaagattacttgaaatgcatgcgaatagcagagaagatgttaaagtagcattagctggtgatattgttgctcttgcagggttaaaggataccattactggagaaacattatgtgatcctgagaagcccattgtgcttgagcgaatggatttccccgatccagttattaaagttgctattgagcctaagaccaaagcagatgttgataaaatggcaaatgggttaatcaagcttgcccaagaagatccgtctttccatttctcacgtgatgaagaaattaaccaaacggttattgaagggatgggagaattgcatcttgagattatcgttgacaggctcaagagggaattcaaggtggaggcgaatgtaggtgcaccacaagtaaactaccgtgaaagcatatccaaggtgtctgaggtgaagtacgtccacaagaaacagtcaggtggtcaaggacagtttgcagatatcaccgtacggtttgagccattagaggcaggtagtggatacgagttcaagagtgaaatcaagggtggtgctgtcccaagagaatacatccctggtgtgatgaaagggttagaagagtcaatgaccaatggagtacttgcaggcttccctgttgttgaccttcgtgcagtattgactgatgggtcctaccatgacgttgactctagtgtactcgccttccagctggcagccagaggagctttccgtgaaggagttaggaaagcaggacccaagattctggaacccattatgagagttgaagttgtgacacctgaagaacatttgggagatgttattggtgatcttaattccagaagaggacagattaatagctttggtgacaagcctggtggcctcaaggtggtggattcccttgtgccgcttgcagaaatgttccagtatgtgagtactctaagaggaatgacaaaaggtcgagcatcctacactatgcaactagcgaaattcgatgtggtacctcaacacattcagaaccagctttctgctgcaaaggaagaagcagttgcaacttaagatttctttcactgattcatttaatgtttgtattttttgtctttcacttttttatgttttataggacataagaaaatctccaattttccatcaaagatatacgaagcaacattctttagaat

SEQ ID NO: 6232 - DNA, 2214 bp, Cynara scolymus
  misc_feature (377)..(378): n is a, c, g, or t
  misc_feature (1144)..(1144): n is a, c, g, or t
  misc_feature (1191)..(1191): n is a, c, g, or t
  misc_feature (1661)..(1661): n is a, c, g, or t
  misc_feature (1918)..(1918): n is a, c, g, or t
  misc_feature (2191)..(2191): n is a, c, g, or t
actctctcaccatggctgcagaaacatgttccttgtcatcaaataccgcggcttcactctgcaacttctccggttccaatggcggttcctccacaatgccgctccttcttttccttctttctcccgccacctccctccgtcgtcaccatcaccaacaccgtagtcttacgtcttctttcttcggaactcaacggcttgctccgaataaatcaatttctcacttccaaaagaggaatctatcggtgtttgcaatggctgctgctcctgaagatggaaagcgggaggttcctttaaaggactatcgtaatatcggcattatggctcacatagatgccggaaagactactacaaccgaacgtgtccttttctacacgggnnggattcaaatcggtgaggtacacgagggtaccgccacaatggactggatggagcaagaacaagagagaggaatcacgataacttcggctgcaaccaccacgttttggaacaaacatcggattaacatcatcgatactcctggccatgtcgacttcacacttgaagtcgagcgggctctccgtgttcttgatggtgccatttgtttgtttgatagtgttgctggagttgaaccccaatctgagacggtctggaggcaggctgataagtacggggtgccgagaatttgtttcgttaacaaaatggaccgaatgggggcgaacttctttagaacccgcgacatgattatttcgaatttgggtgcgaaaccacttgtgctccaaatcccgattggggcagaggaggttttcaaaggggttattgatcttgtgaggatgaaagctatcgtttggtccggtgaagaattgggtgccaagttttcatatgaggatattccttccgatcttcaagatttagcagaagaatatcgggcgctaatgattgagacgattgtcgaattggatgacgaggttatggaggggtatcttgaaggggttgagccagatgaggaaaccgttaagaagttaatccggaaaggaaccatcggaggtagttttgtgccggttttatgtggctcggcttttaagaacaaaggggttcaaccgttgcttgatgctgttgtcgactatttaccctctccgcttgatgtcccacctatgaagggtactgntccggagaatccagaaatcgaaatcgcaaggctcccgagtgacgaanaaccgtttgccgggctcgcattcagatcatgaacgatccttttgtaggatcgcttacgtttgtaagatatatgctgggaaacttgctgctggatcgtatgtaataaatgcaaacaaaggaaagaaagaaagaatcgggagattacttgaaatgcacgcgaatagtagagaagacgttaaagtggcgttggctggtgatattgttgctcttgcagggttgaaagatcgattactggtgaaacattatgtgatcccgagcatccgattgtgctcgagaggatggacttccctgatcctgtcataaaagttgctatcgaacccaagaccaaagcagatgtggataagatggcaaatggtttaatcaagcttgctcaagaagacccgtctttccacttctcacgtgatgaagaaattaaccaaactgtcatcgaagggatgggagaattgcatctcgagattatcgttgatagnctcaagagggaatttaaggtagaagcgaatgtaggcgcaccacaagtaaactaccgcgaaagcatttctcgagtagcagaagtgaagtatgtccacaagaaacagtcgggcggtcaaggacagtttgccgatataaccgtgaggttcgagcccttagaggccggcagtggatacgagttcaagagcgagattaagggcggtgcagtcccaagagaatacattcccggtgtgatgaaagggctggaagagtcaatgtntaacggagtggttgcgggattccccgttgttgaccttcgggcagttttaaccgatggttcctaccacgatgttgattctagcgtcctagcgttccagctggcggcaagaggagctttccgtgaaggaattaggaaagccgcacccaagattttggaaccaataatgagagtcgaagttatcacacctgaagatcatttgggagatgtaattggtgatcttaattccagaagaggacagattaatagctttggtgataaacccggtggactcanggtggtggactccctcgtgccgc

SEQ ID NO: 6233 - DNA, 3030 bp, Physcomitrella patens
ggtgcctggatttgtgtttgtggtgagaggattgtggagcggcaattgctccatcgtggctgttctgtcgccctcaaatttcccttctctcccctcgccctcttcactacctgtttggtcttttctgcctctacaagaccctttctccccaaatccggtttcctcagtcatcccggactttcctggattcagtgttcggtacagccccacattctcaaggttactcctcgtttcttcttcttcttgaggagtgcgaggtgaagagtaagacagagagatggcggcgtcagtggcgcaggccagtcacttgggtgcctcggctctggctcagtcctgctcctgccgcgatgttgagggcaccgcgaagagggccacaggcagcgtgtcatcgtttaccgggctgaagaaaaatgccaggggtatgcctctgtgtgcgtcgtcgagtgactgtgcgttccagagggatgctctccgccgctccgcgttcggaagttcctctgtcgctggtggtggtcgcaaggcggtcgtttgcatggctgctgaagagaaaagggaatttcctctatccgactaccgtaacatcggcatcatggctcacatcgatgctggaaagaccacaacaactgagcgtatcctgttctacacggggaaaaattacaagattggtgaagttcacgaagggacagccaccatggactggatggaacaggagcaagaaagaggtatcacaatcacctcggctgccactactgcgaagtggaaggatcaccgaatcaacatcatcgacactcctggacacgtagacttcaccttggaggtggagcgtgcgctgcgagttctggatggagcaatttgcctattcgacagtgtggccggagtggagccgcaatcggaaaccgtctggcgtcaggccgataagtatggtgttccgcgtatctgcttcgtgaacaagatggatcggctgggtgccaatttcttccgaaccagggacatgattgtgagcaacttgggtgccaaacccctagtccttcagattcctattggagccgaggaccagtttttagggatcgtggatcttgtcaggatgaaggccgtggtttggaacggagagcagcttggggcagccttcgaggacagagagatccctgaggatttactcgaactggcggaagagtacagggcgttgatgattgagaccatcgtggatcaagacgacgccgccatggaagcatacctggaaggcattgaacctgacgaagagacaatcaaaatgatgatcaggaaggggacaatttctttgtcgtttgtccctgttctctgtgggtccgccttcaagaacaagggtgttcagcccttgctagacgcagtggttgcgtaccttccttcacccttggacttgcctccgatgaagggatgtgacgtggataatcccgacattccagtggacaggaagcccagcgacgatgagcctttctctgggctagctttcaagatcatgaacgattcctttgtcggttctttgacctttgtacgtatttactccggaacgcttgcggcgggcacgtatgtgctgaactcaaacaagggtaagaaggagcgtatcggtcggcttctggagatgcatgccaacagtagggaggatttgaaggttgctcgcgcaggagatattattgccctcgcaggtctgaaggataccgtgaccggggagactctgtgcgactccgacaaacctgtggtgttggagcgtatggatttccctgaccctgtgatcaaggtggccatcgagccgaagaccaaggcagatgtggacagaatgtctgttggactgatcaagctcgcccaggaggatccatctttccatttctctagagatgaggagacgaaccagacggtgattgaggggatgggagagctgcatctggagatcattgtagatcggctgaagcgtgagttcaaggtggaagcaaatgtgggcgcaccccaggtgaactacagggagagtatttcaaagcctgcgactgttaagtacactcacaagaagcagtccggaggccaagggcaattcgctgagatcgaagtccgttttgagccattggaagctggaagtggatacgagttcaagagcgagatcaagggtggatccgtgccccgtgagtacgtgcctggtgtggtgaagggcctggaggacatgatgaacaacggtgtgctggccggttacccagtggtggatgttcgcgctgtgttgttggatggttcataccacgaagtggattccagtgttctggccttccagctggctgcccgaggtgcattcaaggagggtatctctaaggccggccccaagctgctggagcccatcatgaaggtggaggtggtgactccggaggaacacatgggtgatgttattggtaacctaaactcccgacgtggacaaattgagacgcttggtgacaagcccggcggcatgaagctgattactgcttctgtaccgctgtcggagatgttcaactacgtgagtaccttgcggggcatgacgaagggcagagctcagtacacgatgcaactgtccaagtttgatgttgtacccacaaacatccagatggaaatcacatcgaagaagatggagactacagcttagagtaacttacgctataaatctagatactatcacttagagtaagatgattgtcatgtggagcctttcatgaatgatatatctcgaaggctaaaggtgtggtgtagaagacagtttgtagaatgaatcctgtaggttatttttgttcctgccaatgagctctgtacagctcctcatggaacggttttgtatttgatcatccatattgcgggccttctctggctggctgttaagcaaacaagtcaaagatgattgcggaaacgacttgttttgttcagtgtttgattgctgaaaactcacaacgttctatgattctcatcatccgacgtctctaatgtaagacacgttcttaaaattcacttaatgatttcagtttccttagcgaaatcttttct

SEQ ID NO: 6234 - DNA, 2715 bp, Ceratodon purpureus
ccccgctcttgccttcaattcccctcttctcttttgctacccatctgcttcggatatcatcaggaactcggaccacactgccgctgtgttctgagtcccacctccttctcctgcgccaccctctcatcttctttcagacaggaagtagagatatggcggcgtcaatggcgcaggccagccatctcgggacttcggccgtggtgcagccgtgttcttgccgcgatgtggaggggacttctaggaggtccgccaccagcagcgtagcggcattcgccggcctcaagaatgcaaagagtgttcctcttgcatcgtctctgggcgattccgcagcgcaaagagatgcactccgccgttctgccttcggcagcgcatctgttactaccggcggtcgcaaggccgtcgtatgcatggcagctgaagaaaagagagagtttcctctccagcagtaccgcaacatcggtattatggctcacatcgatgccgggaagaccaccactactgaacgtatcctcttctacactggaaggaactacaagatcggtgaagtccatgaaggaaccgcaaccatggattggatggaacaggagcaagagcgaggtatcacaattacctctgctgctactacagccaaatggaaagaccaccgtatcaacatcattgatacacccggtcacgtggacttcacgttggaagtggagcgagccttgcgagttctagatggagcgatatgcctgtttgacagtgtggctggagtggaaccgcaatctgagactgtgtggcgccaggctgacaagtactgcgttccacgtatctgcttcgtgaacaagatggatcgtctgggtgccaatttcttccgaactcgggacatgatcatcagtaatttgggagctaagccccttgtgcttcagattcccattggagctgaggactcctttgcaggaattattgacctcgttaggatgaaagccgtcgtttggaacggggaagagctaggtgctgcttttgaggaccaggacattcctgagaacctgcttgaacttgccgaagaatacagggcaactatgattgagcttgttgtggagcaagacgacgaagccatggaagcgtacttggaaggtcaggagcctgatgaagcaaccatcaatagactgatcaggaagggaacgattgcacttgattttgtaccagttctttgtggctctgccttcaagaacaagggtgtccagcccctgcttgacgccgttattgcgtaccttccttctccacttgataagcctccaatgaagggttgtgactacgagaaccctgacattgcagtggacaggaagccaggagacaacgaacccttttcgggacttgctttcaagatcatgaacgactcctttgtcggttcgctgacctttgtacgcgtgtactctgggactctctcagctggtacgtatgttatgaactcaaacaagaacaagaaagagagaattggtcgtcttttggagatgcacgcgaacagtcgagaggatgtgaagatcgcgcgtactggagacatcattgcccttgcaggtcttaaggatacagtcactggagagactctctgcgacccggagaatccagtcgtccttgagcgcatggacttccctgaccctgtgattaaggtcgcgattgagcccaagactaaggcagacgttgacaaaatgtccatggggctgatcaagctggcccaggaggatccatcattccacttctctagagatgaagagacaaatcaaaccgtcattgaggggatgggagagttgcatttggacatcattgttgatcgcctgaagcgtgaattcaaggtggaggcagaagtgggtcaaccccaggtcaactacagggaaagtatctctaaagtttcgacagtcaaatacactcacaagaagcaatccggaggacaaggtcaattcgctgagattgaagtcaaatttgagccactggaggccggaagtggttacgaattcaagagtgagatcaagggaggatccgtaccccgtgaatacgttcccggtgtggtgaagggtctggaggagtgcatgagcaatggtgttctcgcaggttacccagtggtggacgtacgcgccgtgttgttggatggatcttaccacgaagttgattctagtgttctggcctttcagttagctgctcgaggtgcatttagggagggtattgccaaggctggtccgaagctgctagaacccatcatgaaggtcgaggtggtgaccccagaggaccacatgggtgatgtcattggcgatctcaattcccggcgtgggatgattaatggttttgttgacaagcctggaggcatgaaagtggtggacgctcttgtgcctttgtctgagatgttcaagtatatcgacactttgcggagcatgaccaagggcagggctcaatataccatgcaattagccaagttcgatgttgtgccccaaaacattcaaaacaaaattacagccaagaatacttctgtggcagcctagagcgaacgacattattttagacttcttagtttcatagattttcattattactgctgttcatcgtctggagcctcatcaccatggatgttctatgagggaatttgtagaatgagacagcgttcccatctagtttgtttacggaacaatcttgtactttgccacctagactggctgttattaaatgttgacaatggttgctatt

SEQ ID NO: 6235 - DNA, 2173 bp, Vitis vinifera
gagggaacggctacaatggactggatggagcaagaacaagaaagaggaattactataacttctgctgcaactaccacattttggaacaaacatcggattaacattattgatacccctgggcatgtcgacttcactcttgaggtggagcgggctctcagggttttggatggtgctatatgcttgtttgacagtgttgctggtgtagaacctcaatctgaaactgtatggagacaagctgataaatatggggtgcctagaatttgctttgtcaataaaatggatcgtctcggggcaaacttcttccggaccagagacatgatagtgacaaacttgggcgctaaaccacttgtgattcaattaccaattggtgcagaagataattttcgaggagttattgatcttgtaaagatgcaagctgtgttatggtcaggagaagaattgggtgcaaagtttgcgtatgatgatattccatctgatcttctagaactggctcaagactatcggtcacagatgatagaaaccatagttgagttggatgatgaagctatggaaggctatctggaaggagttgagcctgatgaggaaactatcaagaaattaatcaggaagggaaccatttcagccagctttgtcccagttctgtgtggctcagcatttaaaaacaagggagttcaaccactgcttgatgcagttgtggattatttgccttcaccattggacctaccggcaatgaaaggaactgaccctgagaacccagaggtgacagttgaaagagctgcaagtgatgaagaaccatttgctggtctagctttcaagattatgagtgaccccttcgtggggtcccttacttttgtgagagtttatgcagggaagctagctgcaggatcttacgtgctgaatgcaaacaaaggaaagaaagaaagaattggaagacttctggaaatgcatgccaacagcagagaggatgttaaggtagctttagcaggtgatattgttgcacttgcaggtctgaaagatacaattactggtgaaactttatgtgatccagagaatcctattgtgctcgagcgaatggacttccctgatcctgttataaaggttgctattgagcctaaaactaaagcagatgttgataaaatggcatctggcttggtcaagctagctcaagaggatccatctttccacttctcacgggatgaagagatcaaccagacagtcattgaaggaatgggagaattgcatcttgagattatcgttgacaggctcaagagggaatttaaggtggaagctaatgttggcgcaccccaagtaaactaccgtgaaagcatttctaaagtctcggaggtgaagtatgtgcacaagaaacagtcaggtggacaaggacagtttgctgatatcactgtaaggtttgagcccattgaggcaggtagcgggtatgagttcaagagtgaaattaagggaggtgctgtgccaaaagaatacattccaggggtgatgaaaggattggaggaatgcatgagtaatggtgtgcttgcaggctttcctgttgttgatgtacgtgctgtgttagttgacggatcgtaccatgatgtggattcaagtgtcttggcattccagctggcagccagaggcgcattccgtgaggggatgaggaaagctgctccaaagatgctggaacctattatgaaagtcgaagttgtcacacctgaagaacacttgggagatgtgatcggtgatctcaactcaaggagaggccagatcaacagctttggtgacaaacctggtggtctcaaggtggtggatgctctggtccccctggcagagatgttccaatatgttagtacgctccgaggaatgacaaaaggccgtgcatcctataccatgcaattagccaagtttgaagttgttcctcaacacatccagaatgaactcgctgctaaagagcaagcagttgctgcttgatttggctttcctttcgccaagaccacagaagggaagcttcataattttttatttactttgtctttgggcctagaaaaaactgttttccttttccatttttccccctcttctgtatcaattttatatatgaaatgcaagtccctttgaaggaaaaggctgaacgtcttaaggctggagaataaactcattttggggctggagagacgtgaga

SEQ ID NO: 6236 - DNA, 2477 bp, Selaginella moellendorffii
gtattgggccagtgtgggaataagcgaggcggtaatggcaatggcggaagcggccgctactcttccagcagcgaagttcccctcttgctcatcgatttcttcggtcgccgggaactcgcaagcgagattatgctgcggcgccagatcgagagcgccgtttgtgggcctccggggctttccagggctcagattttcagggcagaatggcgcggccaagaatgcgcgggcttgcaatgctgcgaggcgtgggattgtgtgtatggcggcttccgatacacgagagtttccactcgaggactaccgaaacattggaatcatggctcacatcgacgctggcaagactacaacaaccgagcgcattctttactacaccggcaagaactacaagatcggcgaagttcacgaaggaaatgcgaccatggactggatggaacaggaaagagaacgaggcattactataacttccgctgccacaaccgccgtgtggaagaaccatcggatcaacatcattgacactccggggcacgtcgactttactcttgaggtggaacgagctctcagagttttggacggggctatttgcctcttcgacagcgttgccggtgtggagccacagtcagagaccgtgtggaggcaggctgacaaatacggggtgccgaggatctgctttgtaaataagatggataggatgggagccaattttttccggacgagggacatgatcgtcagcaacttaggagccaaaccgctggtactacagcttccgataggagcggaggatacattcaaaggggtggtcgatttgattaccatgaaggctattttgtggagcggagaacagctaggtgcgaagtttagctacgaggagattcccgacaacttggcaaaggacgcgaaagattacagggcacagcttgtcgagctggtggtggaacaagacgatgaagttatggagcagtacttggaaggagtggagccggatgaagcaaccatcaagagacttatacggcagggaacgatctcaaacagctttgtcccagttctttgcggatcggcattcaagaacaaaggtgtgcagcctctgctggatgcggtgatagagtttcttccttctccagtggagttgccttcgatcaaagggactgacatggacgatccggaggtcgttctcgagcgaaaaccatgtgacaaagaaccattctcggggctggccttcaaggtgatgacagatccttttgttggagcactgacgttcatgcgggtctactccggcgttctcacggccggatcttacgccctcaatgcgaacaagaacaagaaggagaggatcgggcgtctgctccagatgcacgcaaactcacgggaagatgtcaaggttgcagtgactggagacatcgtagctctcgctggtttgaaggacacgatcacaggggagacgctgtgtgatccagagaagccagtgatcctggaaagaatggacttccctgatcccgtcatcaaggtggcaatagaaccaaagacgaaggctgatgtcgacaagatgtcaactggccttatcaagcttgcgcaagaggatccgtcgttccatttctccagagacgacgaaacaaaccaaacagtcatcgaaggcatgggagagctccatctggaaatcatcgttgacaggctgaaacgggagttcaaggtggaagctaacgtgggagctccacaagtgaactatcgcgagagtatctccaagccaactgaggtgaagtacgtacacaagaaacagtcaggaggacaaggccagttcgcagaggttgtgattaagttcgagccactggagcctggcagcggatacgaattcaagagcgagatcaaaggtggaaccgttcccaaggaatacgttccgggggtggtgaaaggcctcgaggacagtatcagcaacgggatcctggcaggctacccggtggtggactttcgagcaaccttggtcgatggttcttaccacgacgtcgactccagcatcctggcgttccagctcgcagctcggggagctttcagggaggggattcccaaagcagggcccaagcttctggaaccagtgatgaaggtggaagtggtgacaccggaggagcacatgggagacgtgatcggagacttaaactcgaggagaggccagatcaacagcttgggagagaagcccggtggcttgaaggttgtggatgcgtttgttccactggcggagatgttccagtacgtgagtaatctccgaggaatgacaaagggacgagcaagctactcgatgcagctctccaaattcgagatcgtgccacagcatgtccaaacgcaaatcacctccaaagctcaaacagtcgctgcggcctaaaacgcttctctttaacttccttcgcgcgattttaaagattttgtataacagcatattcgaaatgccttgaaatctggacgattcagagcaaaacgtcactttaaacctc

SEQ ID NO: 6237 - DNA, 1701 bp, Flaveria ramosissima
tgcaaccaccacattctggaacaatcaccgcatcaacatcattgatacacctggccatgtggacttcacacttgaggtggaacgtgcccttagggttcttgatggtgccatatgcttgtttgatagtgttgctggtgttgaaccacagtcagaaactgtgtggagacaagcagataagtatggggttcctagaatttgttttgttaacaaaatggaccggcttggtgctaacttttttagaacacgtgacatgattgttacaaatttgggtgctaaaccacttgtgctccaactcccgattggggcagaagatgttttcaaaggggttatagatcttgttaggatgaaggccatagtgtggtctggtgaagaattaggtgccaaattttcatatgaagatattccttctgaccttcaagaattatctgaagagtatcgcgcattgatgctcgagaccattgttgaattagatgacgaggttatggaagggtaccttgaaggggtggagcccgacgaacagaccgttaagaagttagttagaaagggaaccataggaggtagttttgtaccggttttatgtgggtccgctttcaagaacaaaggggttcaaccattgctcgatgctgttgttgactatttaccctctccacttgacttgccacctatgaagggtaccgacccagagaacccagaaatcgaaattgaccgggttgcaagtgatgatgctccttttgctgggttagctttcaagatcatgaatgacccgtttgtcggatcacttacttttgtaaggatatatgctgggaagcttgctgctggatcttatgtgatgaatgcaaataaaggaaagaaagaaagaattggaagattacttgaaatgcatgcgaatagcagagaagatgttaaagtagcattagctggtgatattgttgctcttgcagggttaaaagataccattactggagaaacattatgtgatcctgagaagcccattgtgcttgagcgaatggatttccccgatccagttattaaagttgctattgagcctaagaccaaagcagatgttgataaaatggcaaatgggttaatcaagcttgcccaagaagatccgtctttccatttctcacgtgatgaagaaattaaccaaacggttattgaagggatgggagaattgcatcttgagattatcgttgacaggctcaagagggaattcaaggtggaggcgaatgtaggtgcaccacaagtaaactaccgtgaaagcatatccaaggtgtctgaggtgaagtacgtccacaagaaacagtcaggtggtcaaggacagtttgcagatatcaccgtacggtttgagccattagaggcaggtagtggatacgagttcaagagtgaaatcaagggtggtgctgtcccaagagaatacatccctggtgtgatgaaagggttagaagagtcaatgaccaatggagtacttgcaggcttccctgttgttgaccttcgtgcagtattgactgatgggtcctaccatgacgttgactctagtgtactcgccttccagctggcagccagaggagctttccgtgaaggagttaggaaagcaggacccaagattctggaacccattatgagagttgaagttgtgacacctgaagaacatttgggagatgttattggtgatcttaattccagaagaggacagattaatag

SEQ ID NO: 6238 - DNA, 2192 bp, Selaginella moellendorffii
gaaacattggaatcatggctcacatcgacgctggcaagactacaacaaccgagcgcattctttactacaccggcaagaactacaagatcggcgaagttcacgaaggaaatgcgaccatggactggatggaacaggaaagagaacgaggcattactataacttccgctgccacaaccgccgtgtggaagaaccatcggatcaacatcattgacactccggggcacgtagactttactcttgaggtggaacgagctctcagagttttggacggggctatttgcctcttcgacagcgttgccggtgtggagccacagtcagagaccgtgtggaggcaggctgacaaatacggggtgccgaggatctgctttgtaaataagatggataggatgggagccaattttttccggacgagggacatgatcgtcagcaacttaggagccaaaccgctggtactacagcttccgataggagcagaggatacattcaaaggggtggtcgatttgattaccatgaaggctattttgtggagcggagaacagctaggtgcgaagtttagctacgaggagattcccgacaacttggcaaaggacgcgaaagattacagggcacagcttgtcgagctggtggtggaacaagacggtgaagttatggagcagtacttggaaggagtggagccggatgaagcaaccatcaagagacttatacggcagggaacgatctcaaacagctttgtcccagttctttgcggatcggcattcaagaacaaaggtgtgcagcctctgctggatgcggtgatagagtttcttccttccccagtggagttgccttcgatcaaagggactgacatggacgatccggaggtcgttctcgagcgaaaaccatgtgacaaagaaccattctcggggctggccttcaaggtgatgacagatccttttgttggagcactgacgttcatgcgggtctactccggcgttctcacggccggatcttacgccctcaatgcgaacaagaacaagaaggagaggatcgggcgtctgctccagatgcacgcaaactcacgggaagatgtcaaggttgcagtgactggagacatcgtagctctcgctggtttgaaggacacgatcacaggggagacgctgtgtgatccagagaagccagtgatcctggaaagaatggacttccctgatcccgtcatcaaggtggcaatagaaccaaagacgaaggctgatgtcgacaagatgtcaactggccttatcaagcttgcgcaagaggatccgtcgttccatttctccagagacgacgaaacaaaccaaacagtcatcgaaggcatgggagagctccatctggaaatcatcgttgacaggctgaaacgggagttcaaggtggaagctaacgtgggtgctccacaagtgaactatcgcgagagtatctccaagccaactgaggtgaagtacgtacacaagaaacagtcaggaggacaaggccagttcgcagaggttgtgattaagttcgagccactggagcctggcagcggatacgaattcaagagcgagatcaaaggtggaaccgttcccaaggaatacgttccgggggtggtgaaaggcctcgaggacagcatcagcaacgggatcctagcaggctacccggtggtggactttcgagcaaccttggtcgatggctcttaccacgacgtcgactccagtatcctggcgttccagctcgcagctcgaggagctttcagggaggggattcccaaagcggggcccaagcttctggaaccagtgatgaaggtggaagtggtgacgccggaggagcatatgggagacgtgatcggagacttaaactcgaggagaggccagatcaacagcttgggagagaagcccggtggcttgaaggttgtggatgcgtttgttccactggcggagatgttccagtacgtgagtaatctccgaggaatgacaaagggacgagcaagctactcgatgcagctctccaaattcgagatcgtgccacagcatgtccaaacgcaaatcacctccaaagctcaaacagtcgctgcggcctaaaacgcttctctttaacttccttcgcgcgattttaaagattttgtataacagcatattcgaaatgccttgaaatctggaccattcagagcaaaacgtcactttaaatctcagccgtcgagatcggac

SEQ ID NO: 6239 - DNA, 1718 bp, Citrus sinensis
ccattgttgaattggatgatgaagctatggaaagctatctggaaggaaatgagccagacgaagaaaccatcaaaaaattaatccggaaaggaaccattgctggcagttttgtccctgtgttatgtggttcagctttcaaaaataagggcgttcaaccattacttgatgctgttgttgactatttgccttcaccacttgacttgccagcaatgaagggaactgatcctgaaaatcctgaagcaacacttgagagggcagccagtgatgatgaaccatttgctggactagctttcaagattatgagtgacccgtttgttggttccctcacattcgtgagagtgtatgctgggaagctttctgcaggatcttatgtgctgaacgcaaacaaaggaaagaaggagagaattggtagacttttggaaatgcatgccaacagtagggaggatgtaaaggttgccttagcaggtgacatcattgctcttgcaggtcttaaagacaccattactggtgaaacactttgtgatgcagaccatccaattctgcttgaacgaatggacttccccgatcctgtgattaaggttgcaattgagcccaagactaaagctgatattgacaaaatggcaaatggcctgatcaaacttgctcaagaagacccttcattccacttctcacgagatgaagagatcaaccagacagtgattgagggtatgggagaattgcatcttgagattatcgtcgatcgcctaaagagggaatttaaggtagaagctaatgttggtgcaccccaagtcaactatcgtgaaagcatttctaaagtctctgaagtgaagtacgtacacaagaaacagtcaggcggacaaggacagtttgctgatatcaccgtgcgatttgagcctatggaggcaggaagtggatatgagttcaagagtgagatcaagggaggtgcagtgccaaaagaatatattcctggggtgatgaaaggactagaagaatgcatgagcaatggtgtgcttgcaggcttccctgttgttgatgtacgtgctgcactagttgatggttcctaccatgatgttgattctagtgtcttggcatttcaacttgcggccaggggagctttcagggagggcatgagaaaggctggccctaaaatgctggaacctataatgaaagtcgaagttgtcacacctgaagaacacttgggagatgtgattggtgatctcaactcgaggagaggtcagatcaacagttttggtgacaaacctggtggtttgaaggtggttgatgcgctggttccactggcagaaatgttccaatatgttagtacactccgagggatgacaaaaggccgtgcatcatacattatgcagttagctaaattcgatgttgtccctcaacacatccagaaccaacttgcagcgaaagaacaagaagttgctgcttgaatgaatttttctctgaggaaacaggaatcactatatattttttcattaacttgatataaatcaagggaaggtttctttttgtactaattttatagatgagctgaaaaacacttagaaagttgcggacgtcaatctcatcatcgccgaacaacatcttgtatcattgtgtttgtggcataagatttgagaaagatttgatctttttcataagttataaagaaaaaagggtggtaatcttaaaacagaaaggaatgacaaatctacccttatcccata

SEQ ID NO: 6240 - DNA, 1041 bp, Gossypium hirsutum
atgggaatcgttttgttgttcgcagccttggcacccaaatcatcgcaattttgcaatattttcccccctcttatttcccttgtccgaagaaacaacattgaaaaccctaaccctagccacatcttcacccaaatctttaattatttgcgcttttctcatcaaaattcatcaaatcatcggaatcgatggcagctaaaccgcttacaagtgaagcaattgctctgacagaaaagaagatggacatgacattggatgatatcattaaaatgtcaaaaactagttcaaataaaaccaagaagcagcgaagggtactgaataaaggtcagaaaccttttaataatgctgctaaagcaaaggctttgaaggttcaacagtatatggattcgcggtcctctgtcagacagggatttctagctcaaagaagatcaaacatcccggggaatcaatttcctttggcagctgaggctgcacgcagggctgcagttgccccagttcgaattaagaatgtaaatggtgtcagggtggctaatttgaacaaacctaggtaaataatggatcttctacaatattgatgacctctggaaagtggtcctggttaacttaattcaagttgcatgttatgtggaactccctatattttttattacttttcttgcggagaagtggcctaacttggtgttatcttgaaagtttagggtttttgtgcaccctacgcaaaatagtatacttttagttctttatttccatgatgtgcaatgttcgttaatcagattaagtggtgctgattgtggaattgtttttctgccatatgggatggatattgaagcatggagtagcaagtgttaaatgtgtttatcatgtttgaagcaggtggatctagagaagtaacattactaatttgataaatgcaatcgcacagagctgtatacatgcattccgtggaatgacattgttatgtgattggacaaactttttaaatgtcaatttggtagtttgtttacatgcttatgtgtgctgtagctcatctgctgggtcattgcc

SEQ ID NO: 6241 - DNA, 962 bp, Gossypium hirsutum
gtccgaagaaacaacattgaaaaccctaaccctagccacatcttcacccaaatctttaattatttgcgcttttctcatcaaaattcatcaaatcatcggaatcgatggcagctaaaccgcttacaagtgaagcaatcgctctgacagaaaagaagatggacatgacattggatgatatcattaaaatgtcaaaaactagttcaaataaaaccaagaagcagcgaagggtactgaataaaggtccgaaaccttttaataatgctgctaaagcaaaggctttgaaggttcgacagtatatggattcgcggtcctctgtcagacagggagttctagctcaaagaagatcaaacatcccggggaatcaattccctttggcagctgaggctgcacgcagggctgcagttgccccagttcgaattaagaatgtaaatggcgtcagggtggctaatttgaacaaacctaggtaaataatggatcttctacaatattgatgacctctggaaagtggtcctggttaacttaattcaagttgcatgttatgtggaactccctatattttttattacttttcttgcggagaagtggcctaacttggtgttatcttgaaagtttagggtttttgtgcacgctacccaaaatagtatgcttttagttctttatttccttgatgtgcaatgctcgttaatcaggttaagtggtgctgatcgtggaattggttttctgccatatgggatggatattgaagcatggagtagcaagtgttaaatgtgtttatcatgtttgaagtgggtggatctagagaagtaacattactaatttgataattgcaatcgcacaagagctgtatgcatgcattccgaggaatgacgttgttatgtgattggacaaactttttgaaatgtcaattgggtagtctgcttacatgcttatgtgtgctgtagctcatctgcttggtcattgcc

SEQ ID NO: 6242 - DNA, 1180 bp, Theobroma cacao
gtttactcgttttgttgttggcgtaaccacgaagcatccaaaccactgcaatttttttcccctcttttgcctttttcgaagaaagtaacttcgaaaaccctaaccctagccccagcttcacccaagtcttggattcgtttcgctttcctcgttgaatttctcgtttcgaaatcggtgcgtttctttctttaatccttttctttttcttgattctctcgcgtattatctgcaaatcgatatctgtattgtttgtttgatggcggctaaaccacttacaagtgaagcaattgcactcacagaaaagaaaatggatatgacgttggatgatatcattaaaatgtcaaaaaattcaactaaagccaagaagcagcaaagggctccgattaaaagtcagaaacctgtgaataatgctgcaaaagagaaggctttgaaggtgcaacagtatatggactcacggtcctctcttagacagggggttctcgcgcaaagaaggtcaaatttccaggggaaccgattccctttggcagctgaggccgcacgtagggctgcaattgccccaattcgggttagagcttttaatggtagcagggtggctaatatgaataaaccaaggattggagcaccacccgtccaaaggagggctgtaaatggaggctttgctgcaaagccacatcagcagcagcagcagcagcagcagcagcaggagcagcaaggaaatgtagcaactaagcaaaggcctcagacgctggattcgctgtttgccaatatgaaggaacagagaatgagggtgttgtcacgtcagcacaatactgcacaacgcaatggtggtggccggcaaagaatgccttggggaaggggccggttcggcaactgatgtgcgtgagatgtatccctttaggagaagtgtagagccctcttctatcctgtcatttctgcctactacgtggatgctaatctgaggttgctttatactggcttcttgtcttcaacatttgctatcaacttgctcttctagctttctatgtgagaatgtgacaattcagttgtactttttaggttctgctgaactagcgatgtatagtagtgttctttcaattgctattggttcttcgaactgtgcctcttgagcacttggggaaatgtaatggtgtttttaggcaatgaaacatccagtccagaa

SEQ ID NO: 6243 - DNA, 2410 bp, Lotus japonicus
ttttctttttggaaatttttaaggttgagactaggtcgcatgttcatgagacaaggaagcagaaggcagagtccaagtcacatgatgcagaacactctcctaagaaggccaagttggaaactgaggatggtcaaaccaatggaaaatctgcaactgatgttttagaagaatatgatgagttctgtaaagccacaaaggagcacctcacttcagagcaaatgaaggagattttggaggctaatggacttgattcctctggctctaatatagaaattacacgaagatgccaagacttgatgttttttggtgcattggagaaatgctctgtttgcaatggcaatttggagtttgatggcaggcgttatgcttgcaaagggttctatagtgagtggtgtagttgcactttcagcaccagggaccctccaaggaaagaggaacccattaagctaccagattctgtccagaactctttggtttcagatttgctgaagaaatatcaggatccgagtcaaaggcctcagagagatttaagctcagttttggacaagccttttactggaatgatgatatctctgatgggtcgtcttagtaggacacatgtaagaaccacttgcaatagggcaacttgtttggtggcttcaccagctgagcgagaccgaggtggcacatccaaacttgcagaagccatggagaggggcatacctgtggttagggagggttggttaactgatagcatggagaagcaagaaccacaacctttagaagcttatgatcttgtctctgatctttctgtggctggcaagggaatcccatgggacaaacaagaccctggggaggaggctattgaatcactctcagcagaactcaagctatctgggaagagaggggtctataaagattccaagttgcaggatcaaggtggaaagatatttgaaagagatgggatattgtacaattgtgccttctctgtttgtgaccaaggacgagaactaaatgactactgtgtcatgcaactgattatggtcccagagaatcgtttgcacctctactttaaaaagggtagagttggagatgatccaaaagcagaggagcgagtagaagagcatgagaatgttgacaatgctgttaaggagtttgtaaggctctttgaggaaataacaggaaatgaatttgaatcatgggaaagagagaagaagttccagaagaagccattgaagttttaccctattgacatggatgatggagttgaagttagacatggagcacttggacttaggcagctaggaatagcagcaacacattgcaaacttgagcctatggttgcaaattttatgaaggttttgtgcagccaggggatatataagtatgcattgatggagatgggttatgattcaccagaccttccaataggaatggttacaaatcttcacctgaaaagatgtgaggaagtcttgttagaattcatagagaaggtgaagtcattgaaagagactgggccaaaggctgaggctgtttggtctgattttagccagagatggttcacactgatgcactccacaaggcctttcatttttagggattatcaggagattgcagatcatgctgctgctgccttggagagtgttcgagacataacccttgcttctcacctcataggagatatgagtggctctaccattgatgacccattgtcagacacatatagtaaattgggttgctcaatttctcccttggagaaaaattcagatgattatgagatgattgtgaagtaccttgaaaaaacttatgaaccagtcaaagttggtgactgtgaatatggggtgtcagttgaaaatatttttgctgtggaaccaagtgctggtccttcctatgaagacatagtcaagatgccaaataaggttcttctatggtgtggatcacgaagctcaaatcttctgaggcacttgcacaaggggttcttgccagcaatatgctcgctaccagttccgggttatatgtttggcaaagctattgtttgctccgatgctgcagcagaggctgctaggtatggtttcactgctgtggacaggccagaagggttcttggttttggccattgcttctctaggaaatgagattaccgagttgaaaagcccaccagaggatacaacacctttggaggaaaagaagcttggagtgaaggggttggggaagaagaaaacagatgaatcagaacattttgtttggaaagatgacataaaagtcccttgtggacgaataattccatcagagcatgaagatagccccctggaatataatgaatatgctgtctacgatcctaagcaggtacgtataagctacttggtgggagtgaagtatgaagagaaaggcactgtgatggacacagcagagtgaaagaacaacaaaaagat

SEQ ID NO: 6244 - DNA, 2269 bp, Glycine max
tctttctttctttcactctcttgaaggaaagtccaacaaattcaacaagcaaccccaaaacttcacagaatcagttaaacaccccaagaaaacggaaaatgacagaatctccaccaaaccttctatgcactctctgtctgtttcgttgcaaagaagagtgttgaagcttttcttcttcctctgccttgtcttcttccctttgccttcaacctcgttttcttttcttcgtcttctatcaccgattccgattctcttcttccttattttattgatcctctctgcgattaccaattttctcatttcctccgttttctcggcgaccgaacggaggagtagaacgcagttctgaaaacgattggaaaatgctgggaactgcactgcaattcggcggcgttcgcggcgatgatcggttttacattccggtgaagacgcggaagagccagaatcagcgcaaacagagtcacagagccaagaacaatgaacctgaaaacacggatttagtttcgaagagcaaaatcgatatctctgaggataacaacagcaatagcgatagcaatctcaaccaatctctgaaaccaactctttctccgtccgtagagtctgtcagtaacatcgataggttcttggagtccacaacaccgtcagttccggctcagtatttctccaagacaacgatgagaggatggaagttttgcgatgtggagtatcagtcttattttgcactgagtgatctgtgggagtcttttaaggagtggagtgcgtacggagctggagtgcctttggtgcttgatcaaagtgattctgttgttcagtattatgttccgtatttgtcggctattcaactctatgctcactctgctgagaaggcaactgcaaagccaaggtacaccggtgaagatagtgatggtgattactacagagattcatgcagtgaaggaagtagtgattatgaatatggaaaaaggactgaatttatgactcaaagaagtagtcagtatctaacaggtgtactgtgcaagaaggattttctagtgatgatagtgaaactgggaatcctcaagatctactttttgagtattttgaacaagatcctccgtatagtcattcaagatcttgcacgccactatcctgccctcaagtcgttgagaagctgtgatttattaccagtcagttgggtgttttgggccaggtatcctatatatcgaatacccacaggtccaactttaaaagatttagatggatgctttctaacataccatacactccatacacccttgacaggaagtggtcgtactcatgctccaacactggtttatcccagtgagatggatggtgtaccaaagatttctatacctacttttgcaatggcttcctataagttaaaggggtctatttggatgaaaaaaggagttagtgaatctcaacaagtgagttccctcttgcaggctgctgataactggttaagactagttcaggttaatcacccggattttcagttctttaaatcacatggcacataccatagatgaactgcataagccgacatgtctttcctgcttttggctaaaactgagccttaatttctgtgttcgttgcttggtgcaaacttggtaaaagcccatccatctgtagagattgtgatgacgcgatagctgcctaattttggattcttgtgatatgcctaagcagcacaaaaagatgaagccaatatgaagcaatgaattcatagagattgctaaagtgaaaaagaaaaagaaagaaaaaatgttttatatggaggaaaaactatcagataattggagggtcctaatgaaatgagagaaaaactaaatataaaaccagagtggagtatggcaaacaagttcacaggaaggatatgtggggattaagccagactgtacgagcattttcagttcagtaatggttgagatcacgttaatttctagagataaaatatttacggatcttgtgatttagaagaaaatgggtgaattacagagactttgctgtgttgcgtggcccaattttggtactatatctgatgaacatgttgttgctctggtgaggagagattgtagtgtaagtgtacaatattttgctgtttcaaaataagttttacactcttacgatgtttatacatgttcttgtactattagagatgttcataattagctcgaagatggtggaatactcagtagagaacgtatgatatcaatcatgtagttttcgacttttcgcacattgataaatctaaactacttgtattgag

SEQ ID NO: 6245 - DNA, 844 bp, Medicago truncatula
tcactcatgatgttatagaaagaggttttgtacctgtggagtttgagggttgcttagtcgcatatagtgaaggacatagtgcccaactgcaaaagaaacttgtgttaaacgacgctatttcagatctgttttcaattgagaataatgaaagtcgtgatgacatggaatattgcggacctctattgacagagttccaaaagtttatttgattaagccaaagtgaaatattgggtggttcgattaagaagaaatctccaaagtccatgcttcatgatcgccgttcttatgaaatgaattttgatgattatcaatgtgcctgtcgaatcccgaaaaggaagggagcatgctttagagatttaccatgtgctcgcatgcagaacaaaaaagtcgaattgaatcctgatgtgaagcgtgaatttttggcttcagggaatccactggttcccaattatgcaattacttttgtgtgtggaacttcaccactgccttttgctcggatatggtgggacaagactgttcctaccgttgtcacaagggcagaaccccataatcagaaaattctacatccagagcaagatagagtgctatccattcgtggaaatgctagattacaaggttttccagacttttataagctctgcggatcttccaaagaaaggtacattcaagttggaaatgcagttgcggttccagttggtcgagcattaagatattgtcttggccttgcatctcagggtgcttctgctgacgggcctttgtacacgttacctgatcagtttcccagggaaaaagaagaaccttccattgtgccatctgaagaagttgtgaacaatgcaccttgaat

SEQ ID NO: 6246 - DNA, 2278 bp, Medicago truncatula
aaaactcgttcaaggtctaatagtgatgaagatgaagttcttcaagctagatgtcactatacagaggccaaagttgatggaggtgtgatctacaagctatatgacgatgctcacgtgaaaggagagaaagatgactaccatttcatttgtaaaatcatggagatgtttgaagcagttgatggagagttgtatttcacagcccaatggtattataggtccaatgacacaacaactaggaaatctcattaagccaaaacgagtatttttgtcagaagtccaggatgacaatccattggattgtcttgttgagaagttaaccattgccctattagagctcaagaaggattttgatgcaacgaatgatgtaattccaccttgcaaatattactgtgacacactttatcttctgccctactccacatttgttaaattaccaacataagctaaagaaaatgttagtgaaatttcctcaacaatttctaatgaaactgaagtaaatgcaaaatctgaggttgactctaaaagtgcaatcactgatattaatgatgataagaaaaaaccagagctgaagttgctagatttgtactctggttgtggaggaatgtcaactggattatgtcaatggaggattttgtctggttcagatattgttactaaatgggttgtggaccttaacaaagatgcttgtcagagccttaaactcaatcatccagaaactgaggttagaaatgtcagtgcataacttttcctcttgttgttgaagaagtgggagaagctttgttgttacttctccttaattgaaaattttgtgccacatgaagaataagctaatctttttaatgaagaagatgaagaggaggaagaggatgatggcgctactgaagaggatgatggtaaataaatatttgaagtttctgaagtgcatgatgtacgttatgatgatgcaaataaggaaactggacctggattatacattaaggtttcttggaagggctacaattatgataaagacatttgggagcccattaatggtttgagtaattgcaaggaaatgattaaggactttgtcactcgtggcttcaagtcaagcatcttaccattgtcgggacatgtggatgtagcatgtggaggacctccttgttagggagtaagaggcttcaaccgttttaggaactttgctaatcctttagacgatgaaaagaacaagcaattaatggtgtatatggatattgttcagtaccttcagcctagattcacattaatggaaaatgtggttaatcttcttagatttttagaaggatttctgggaaggtatgcattgggccgtcttgttcaaatgaattatcaaagtcggctgggaattctggctgccagagcgtatgggcttcgtcaatttcgccttcgtgtctttttatgggggggcacaccttcagagaatctgcatcaatttccacttcgaactcatgatgttatagaaagaggttttgtacctgtggagtttgagggttgcttagttgcatatagtgaaggacatagtgcccaactacaaaagaaacttgagttaaacgacgctatttcagatctgttttcaattgagaataatgaaagtcgtgatgacatggattattgtggacctctattgatagatttccaaaagtttattagattaagccaaagtgaaatattgggtggttcgattaagaagaaatctccaaagtccatgcttcatgatcgccgttcttatgaaatgaattttgatgattatcaatgcgcatgtcgaatcccaaaaaggaagggagcatgctttagagatttaccgtgtgttcgcatgcagaacaaaaaagtcaaattgaatcctgatgtgaagcgtgaatttttggcttcagggaaaccactggttcccaattatgcaattacttttgtgtgtggaacttcaccactgccttttgctcggatatggtgggacaagactgttcctaccgttgtcacaagggcagaaccccataatcagaaaattctacatccagagcaagatagagtgctatccattcgtggaaatgctagattacaaggttttccagacttttataagctctgcggatcttccaaagaaaggtacattcaagttggaaatgcagttgcggttccagttggtcgagcattaagatattgtcttggccttgcatctcagggtgcttctgctgacgggcctttgtacacgttacctgatcagtttcccagggaaaaagaagaaccttccattgtgccatctgaagaa

SEQ ID NO: 6247 - DNA, 1738 bp, Medicago truncatula
tgttctgttactatgaaacaggcagcaagcaagctttgatatcgttgtcagacaagaaggatctcgcatttgttggaaacggacttcaggaattaggattcactattgtttcaactggaggaacagcttctgcattggagagtgctggagtcgctgttactaaagttgaacagcttacacagttccctgaaatgcttgatggtcgtgtcaaaactctgcaccctaacatacatggaggtatccttgctcgaagagatcaaaagcatcatattgaagctctcagtacacatggaattggtacttttgatgttgtggtggtgaacttgtatccattttatgataaagttacatcaaccggaggcattgaatttgaggatggaattgaaaacattgacatcggtggtccagccatgattcgtgctgctgcaaagaatcacaaagatgttttggtagtggttgattcagaagattaccccgcccttctggaatttcttaaaggaaacgaagacgaacagttcaggctaaagcttgcatggaaagcttttcagcatgttgcttcatatgattctgcagtatctgagtggctgtggaagcaaagtgtgggagataaatttcctcctagtttgacagtgcctctttcactcaaaagttctctccgttatggtgaaaatcctcatcaaaaagctgcattctatgttgacaaaagacttgcagaggtcaacgctggtgggattgctacggctatccaacaccatggaaaggaaatgtcatataataactacctggatgctgatgctgcttggaactgtgtgtgcgagtttagaaaccccacatgtgtagttgtgaagcatactaatccttgcggcgtagcttcacgcgatgatattctggaagcctacagactagctgttaaagctgatcctgtcagtgcatttggcggaattgtagctttcaacgtggaagttgatgaggttcttgctaaggaaataagagaatttagaagcccaaccgatggggagacaaggatgttctatgaaatagtggttgcacccagctatacagagaagggacttgaaattcttcgtggaaagtcgaagactttaaggattcttgaagcaaaaaagaatgaagcaggaaagctttcactcagacaagttggtggagggtggttagctcaggattcagatgacttgactccatccgacatcaagttcaatgtagtgtcagagaagactcctcaagatggtgagcttcgcgatgcggagtttgcatggttgtgtgtgaagcatgtcaaaagcaatgctattgtcatagctaaggacaattgtatgttaggtatgggaagcggccaaccgaatcgtgtggagagtttaagaatagcaatgaggaaagctggagctgatgttaaaggcgcagccttggctagtgatgctttcttcccctttgcttggaaagatgctgtggaagaagcatgtgaaagtgggattggtgttattgcagaaccaggtggtagtataagagatcaggatgctgtagactgttgcaataagtatggtgtttcactactcttcaccaatgtgaggcacttcaggcactgatcatttttgttataggagaactttctatttcaaatatctctaaacattaagcagtgcttctgaaacctatttttgacatcaagtaggtcgtaagaatgttgtactatatattttatcagcgttgttaaatagcggctata

SEQ ID NO: 6248 - DNA, 2394 bp, Cajanus cajan
ggggaacacaaccccgtttagtgaaaagtacaaacctaagtcaaaagaattattaaacataactcattggttgtgtcacactaacacactcagaatgtttgtttccggtgcttcctccgcctccactcgcattctctgtggaacctttcactctccttcttccctcgcaactccccataacttttcttctcatctcttttccacaacttgggtgccgtcatcttcactgaacttcaggtgtattcctattaaagccatgactgagattgatactataacagtgtcaaaaactgcttctgcttcctcttctcctggaaccaagcaagctttgatatcattgtcaaacaaaaaggatcttgcatttgttggcaatgggctccaggaattaggatacaccattgtttcaactggaggaacagcttctgcattggagagtgctggagtagctgttactaaagttgagcagcttactcaattccctgaaatgcttgatggtcgtgtcaaaactttgcaccctaatatacatggtggaatccttgctcgaagggaccaaaaacatcatattgaagccctcagtacacatgggattggtacttttgatgttgtggtggtaaacttgtacccattttacgataccgtcacatcagctggtggtgttgaatttgaggatggaattgaaaatatcgacattggtggtcctgccatgattagagctgctgcaaagaatcacaaggatgttttggtagtggttgacacagaagattaccctgcccttctggaatttcttaaaggaaaccaggaggatcaaaagttcaggctaaagcttgcatggaaagcttttcagcatgttgcttcctatgactctgcagtatctgagtggttgtggaagcagagtgtgggagataaattccctcctagcttgacagtgcctctttcactcaaaagttctcttcgttatggtgaaaatcctcatcaaaaagctgcattctatgttgacaaaagtctttccgaggttaacactggtggaattgctacagctatccaacaccatggaaaggagatgtcatataataactacttggatgctgatgctgcttggaactgtgtatgtgagtttaggaaccccacctgtgtagtagtgaagcatacaaatccatgtggggtagcatcacgtgatgatattcttgaagcctacagactggctgttaaagctgatcccgtgagtgcatttgggggaattgtagccttcaacgtggaaattgatgaggcacttgctaaagaaattcgagaatttagaagtcccacagatggggagacaagaatgttttatgaaattgtggttgcacccagctatacagagaagggacttgaggttcttcgtggaaagtcgaagactctaaggattcttgaagcaaaaaagaatgaagcaggaaagctttctctaagacaagttggtggaggatggttagctcaggattccgatgacttaaccccacatgacatcaagttcaatgtagtctctgataaggctccacaggataatgagcttcgtgatgcggagtttgcgtggttgtgtgtgaagcatgtcaaaagcaatgctattgtgattgctaagaacaactgtatgttaggtatgggaagcgggcaaccaaaccgtgtcgagagtttgagaattgcaataaggaaagctggagatgatgtcaaaggggccgctttggccagtgatgccttcttcccatttgcttggaaagatgctgtggaagaagcatgtgaaagcgggattggtgttattgcagaaccaggtgggagtatcagagaccaggatgccatagactgttgtaataagtatggtgtttcactactctttaccaatgtgaggcactttaggcactgaaattttgctttggtttaacttcctgtttctactatccaagcggtgttgctgaaacttttgcttccaaagggtagcactgagacctgttttgaaattaagtggctgtatgagtaaggataaggattgtactatccaatttatatagaaaaataaattaatcttctcttggtttctaatgtcttattgtacatgagaataatgtgatatgaaaatcttctgctatgaacagaatcaaattagacattcttgctgcaactgttcgatcgattatgctaagttggaagaaaaaacatgtaggatttttaatttgagaaagtccatatttggataagttttcctttaacaattataagaaaataagatgaaatagaaatgctctcgtaagtcataagataaagtgttgatgaaaatttattcaaacaggtcctcaatactcaatagtgaaggtaaaagttgagacttgagaacattggtcgaaagccattaagtatgagagcttg

SEQ ID NO: 6249 - DNA, 2112 bp, Glycine max
gtgtcacactaacactcatcactcggaggatgtttgtgttgggtgtttcttcctcctccttcgccgccgccgccgcctccgccgctgcaaccaccaccacctccactcaccaccttctctgtggaacccttcactctgcttctttcctctcaactacccatccctttcccacaacttcgttgcggtcatcttcactgcacttcaggtgtgttcccatcagagccatggctgagattgatactatatcagtgtcaaaatctgcttcttcttctgctccaggcagcaagcaagccttgatatcattgtcagacaagaagggtcttgcatttgttgggaatgggctccaggaattaggatactctattgtttcaactggaggaacagcttctgcattagagagtgctggagtagctgttactaaagttgaacagcttactaagttccctgaaatgcttgatggtcgcgtcaaaactttgcaccctaacatacatgggggtatcctggctcgaagggaccaaaaacatcatatcgaagccctcagtactcatgggattggtacttttgatgttgtggtggtgaacctgtacccattttacgataaagtcacatcagctgggggcattgaatttgaggatggaattgaaaatgttgacattggtggtccagccatgattagagctgctgcaaagaaccacaaggatgttttgatagtggttgatacagaagactaccctgcccttctggaatttcttaaaggaaaccaggatgatataaagttcaggctaaagcttgcatggaaagcttttcaacatgttgcttcctatgactcagcagtatctgagtggttgtggaaacagagtgtgggagataaattccctcctagcttgacagtgcccctctctctcaaaagtcctctccgttatggtgaaaatcctcatcaaaaagctgcattctatgttgacaaaagcctttctgaagttaatgctggtggaattgctacagccatccaacaccatggaaaggagatgtcatataataactacttggatgctgatgctgcttggaactgtgtatgcgagtttaggaaacccacgtgtgtagtagtaaagcatactaatccatgtggggtagcatcacgtgatgatattcttgaagcctacagactagctgttaaagctgatcccgtgagtgcatttggtggaattgtagctttcaatgtggaaattgatgaggcacttgctaaagaaattcgagaatttagaagccccacagatggggagacaaggatgttttatgaaatagtggttgcgcccagctatacagagaagggacttgagattctctgtggaaagtctaagactctaaggattcttgaagcgaaaaagaatgaagctggaaagctttcactcagacaagttggtggaggatggttagctcaggattcagatgacttaaccccacaggacatcaagttcaacgtagtctctgagaaggctccacaggatgatgagctttgtgatgcggagttcgcatggttgtgtgtgaagcatgtcaaaagcaatgctattgtgatagctaagaacaattgcatgttaggtatgggaagtgggcaaccaaaccgtgtcgagagtttgagaattgcaataaggaaagctggagatgatgttaaaggagcagccttggtcagtgatgccttcttcccatttgcatggaaagatgctgtggaagaagcatgtgagagcggaatcggtgttattgcagaaccaggtgggagtatcagagaccaggatgccatagactgttgtaacaagtatggtgtttcactactctttaccaatgtgaggcactttaggcactaacctagttttttgcttcggaataacttcatgcttccatcattcaagcggtgttactgaaacttgtgcttccaataggtagcactgaaacctgtttttgaaatcaagtgactgtatgagtaagattgtactatccaatttatatagaaaaataaaaattgatgttctgctactttctaatgtcttatgtacattagaataatgtgatggagtaatcttttgcaatgaacagaatcaaattagacatttttgctgt

SEQ ID NO: 6250 - DNA, 2504 bp, Theobroma cacao
aataaaatgaaaaataagaaacagcagtagacatggaagaagattctactaccactatttaaggagagagagtgtgtgggagtgggacaaaaacaaaagaaagagagagatgtttggggcagctgcttcttcttctactactgccgcaaccaccgccgctaacgctgcccacgcggcgaacactctcaacaccgctcgctgcgccttccaaaggaatactttcatttctccctctccttcttcttcttatcactcgattgtctgcggtcgctttcgttttctctcgctacgctccagcaacgctgtttcaaccaaagccatggctgactctcaaaccctcgctgttccaaaacacgaccctcagtcctctgcccctggcaataagcaagcgttgatatctttgtccgacaagaaggacctggcctttcttggcaatggccttcaagaattagggtacacaattgtttcgactggaggaactgcatctgccttggaaaattctggtgtctctgtaaccaaagtggagcagcttacttgtttccctgaaatgcttgatggtcgtgtgaaaacgttacatcctaacatacatggtggtattcttgctagaagagaccaaaaacatcacatggaagctcttaatgaacatggaattggtacatttgatgtggtggttgtgaacttgtatcccttttatgataaagttacttccaccggaggaattgaatttgatgacggcatagagaatattgatattggtggccctgccatgattagagctgctgcgaagaatcacaaggatgtcttggttgttgttgattcacaagactatcctgcactccttgaatacctcaaaggcagtcaggttgatcaacagttccggagaaagcttgcttggaaggcttttgagcatgttgcttcttatgattctgcagtttcagagtggctctggaaacaaactgtgggagataaattccctcccaacttgacggttccattatccctcaaaagtttacttcgatatggtgaaaatcctcatcagaatgctgcattttacattgacaagagtctctctgaggtcaatgctggtggtattgcaacagctattcaacaccatgggaaggaaatgtcatataataactatttagatgctgatgcagcatggaactgtgtgtcagagtttaggaaccctacatgtgtggttgtaaagcacacaaatccctgtggggtagcttctcgtgatgatatccttgaggcttacaggctggctgtgaaagctgatccagtgagtgcgtttggaggaattgtagccttcaacatagaagtagatgaggctcttgctaaggagatccgagagttccgaagcccaacagatggtgaaactcggatgttttatgagattgttgtggctcccaagtatacagagaaggggcttgagatcctccgtggaaaatcaaagacattgaggatccttgaggcaaagaagaatgagaaaggaaagctctcacttcgacaagttggtggtggttggttagcccaggattcagatgacttgaccccccaagatatccagttcaatatagtatctgagaagaagccacaagatagtgagcttcgtgatgcagaatttgcatggctatgtgttaagcatgtcaaaagcaatgctattgtagtagcaaaggacaatcgtatgttgggtatgggaagcgggcagccaaaccgtttggagagtttgagaatagctttgaggaaagcaggagatgaggtcaaaggagctgctttggctagtgatgcattcttcccatttgcttggaaagatgcagtggaagaagcttgcgaaagtggtattggagtcattgctgagcctggtgggagcattagagatggggatgccgtggactgttgtaacaagtatggagtttcattagttttcaccaatgtgaggcactttaggcattgatacttgcagttctccattttgcctgggctcaacctgatgcttcaacctagcttcaatggggaagactgtagttgcgggaggatgcatgaatatgccgcaatgttgtgcaatttatatgagtgtaccttcacagcataagaaatgttgtgtttatatttaaattttttaagttgatcctgcagttttgtactggacctctattgctgttctttgtttgcaaaataatagagaatgagagcttaatttagattgtccaaagcccctgacacttcgaccttaatgactaaattcagaggcccgtctttctctcctttttaaatttcccgcattctttaagtttctgttaccacagattcatagtgaactggaaagatactcaaaccagcaaatgcttaatcaggtttctttattaatcctattgaactgaaaggaaagcccgttgggcaaaaattttggagactttcaagttcaatctgcttcagccatgagtctatccagtgcattcttcattgacctagttcagtgttaataaagaaattcttggctg

SEQ ID NO: 6251 - DNA, 2044 bp, Gossypium hirsutum
ctgctcacgccgccaacaacatacgccgcacctttcacactaatccttttaattctctctcttcttctcatcactctattctctgcgctcgctttcgttgcctctctctacgctctttcaccgctgtttccaacaaagccatgtctcaccctcaaaccctcgatgctcctcaccctcaatcctctgccgctggcaataagcaagcactaatatctttgtctgacaagaaagacctggctttgcttagcaatggccttcatgaactggggtatactattgtttcaactggaggaactgcatctgccttagaaaatgctggtgtatctgtaacgaaagtggagcaacttacttgtttccccgaaatgcttgacggtcgtgtgaaaacactacatcccaacatacatggtggtattcttgctagaagagaccaaaaacatcatatggaagctcttaataagcatggcattggtacatttgatgtggtggttgtgaacttgtaccccttttatgataaagttacttctacgggaggaatcgcatttgacgatggcatcgagaatattgatattggtggccctgcaatgattagagctgctgcaaagaatcacaaggatgtcttggttgttgttgactcacaagactatcctgcactccttgaattccttaaaggcagtcaggatgatcaacagttccggagaaatcttgcttggaaagcttttgagcatgttgcttcttatgattctgcagtttcagagtggctctggaaacagactgggggagataaattccctcccaagttgacagtgccattatccctcaaaagttcacttcgttatggtgaaaatcctcatcagaaggctgcattttatgttgacaagagtctgtctgaggtcaatgctggtggtattgctactgctattcaacaccatggaaaggaaatgtcatataataactatttagatgccgatgctgcttggaattgtgtctccgagtttaggaaccctacatgtgttattgtaaagcacacaaatccatgtggcgtagcttctggtgatgacatccttgaggcttacaggcttgctgtgaaagccgatccagtgagtgcatttggaggaattgtagccttcaacatagaagtagatgatgctcttgctaaggaaatccgagagttcagaagcccaacggatggtgaaactcggatgttttatgagattgttgtggctcccaagtatacagagaagggacttgagatcctctgtggaaaatcaaaaacattgaggatccttgaagcaaagaagaatgagaaagggaagctctccttacgacaggttggtggtgggtggttagcccaggattcagatgacttgaccccccaagatatccagttcaatgtggtatctgagaagaagccacaagataatgagcttcgtgatgcagaatttgcatggctgtgtgtcaagcatgtcaaaagcaatgctattgtaatagcaaaggacaaccgtatgttgggtatgggaagcgggcagccaaaccgtctggagagcttgagaatagctttgaggaaagcaggagatgaggtcaagggagctgctttggctagtgatgcattctttccatttgcttggaaagatgcagtggaagaagcttgtgaaagtggtattggagtgattgcagagcctggtgggagcattagagatggggatgctgtggactgttgtaacaagtatggagtttcattgcttttcacaaaagtgagacactttaggcattgatgcaatttcatttttgcccccatgggttcaacttgtgctctaagaggaagagtagttgcgggaggatgcaagcaaatgctgccgcaatgtcgtgcaatttgtatggctgtaatcttcacaaataagaaacgtttgtgtttgtatttaaattttagaagatgaaccctgcagttttgcagtgtacatttattgctcttctgagcttgccaaaataatagaaataagagatctaatatagattgtcctcaaaaaagaaaaaagtaccgactgcg

SEQ ID NO: 6252 - DNA, 2289 bp, Ricinus communis
cggcgtcgacgttacgtcatttgtatccgtgcagagtcattgtaaaagggtgagtgagctaaagttgctctcccttggcaacagcagtcagcagcagcgaccgcttaaaaaaggaaaaagaaaagaaaaattcttcaaagtatgtttggcttgactgctactctctccaccgctaccgccgccgcttccgccactaactctcttccttctcgcactccctgcaccggcctgcatcatcatagaagtacttcgtctgccgtcaccgccgctgttgctggttgcactcaatcggcttcaattgtgtgcgttcaagttcacgccacgtctttgaggcccagttgtagtgcagtaaaagctatggctgattctcaaaccctttcagtgtctaaaaatcagcctcaatctccttcttctggcaataagcaagctttgatttctttatccgataaaagggacctggctttacttgggcgtggactacaaaacttagggtacacgattgtttcgacaggaggaacagcatcttctttggaaagtgctggagtatctgtaactaaagtggagcagcttacttcttttcctgaaatgcttgatggtcgtgtaaaaactttacatcccaacattcatgggggtattctagctagaagggaccaaaagcatcacatggaagctcttaacgaacatggaattggtacatttgatgtggtagtggtgaacttgtaccccttttatgataaagttacttcatctggacaaattgattttgaggatggaattgagaacattgacattggtggccctgccatgattagagctgctgcaaagaaccacaaagatgttttggtggttgttgactctgaagactatcctgcgttgctagattatcttcaaggcgaccaagatgatcagcagttccgtagaaatcttgcctggaaagcttttcaacatgttgcttcttatgattctgcagtttctgagtggctttggaagcaaactgtaggagataaattcccgcccagcctaaccgtgcctctctcactcaagagttctcttcgttatggtgaaaatcctcatcaaaaggctgcattttatgttgataagagtatttctgaggtcaatgctggtggcattgcaacagctattcaacaccatgggaaggagatgtcatataacaactacttagatgctgatgcagcatggaattgcgtgtcagagtttaagaaccctacctgtgttgttgttaagcacacaaatccttgtggggtagcttcacgtgatgatatccttgaagcatataggctggctgtaaaagcagatccagtgagcgcatttggtggtattgtagccttcaatatagaggttgatgaggttcttgcaaaggaaattagggagttcagaagtccaacagatggtgaaactcgtatgttttatgagattgtggttgctcccaagtataccaaaaaggggcttgaggtcctacggggaaaatcaaagacattgaggatccttgaggcaaaaaagaatgaacaaggaaagctttcactaagacaagttggtggtggatggttagctcaggattcggatgatttaactccccaagatataaaattcaatttcatgtctgagaagactccacaagaaagtgaactgaatgatgcacagtttgcatggctgtgtgttaagcatgtaaaaagcaatgccattgtaatagcaaagaataactgtatgctgggcatgggaagtgggcagccaaaccgtttggaaagcttgagaatagccttgaaaaaagcaggagatgaggttaaaggagctgctttggctagtgatgctttctttccatttgcttggaatgatgcagtggaagaggcatgtgaagctggcgttggtgttattgcagagccaggtggaagcatcagggacaaggatgccatagactgctgcaacaagtacggcgtttcactgatttttaccaatgtgaggcactttaggcactgatagatcacattttgagtttgtttttgcaattttgagtcaaaacctagtagccaatcagcagagtttcgaaactctatcagattcctctgatgggagttcccatagttcaccaggtggtggcatcacattatgcaatttaaaatgatgtaccataagcgctcatgatatttttctttccaatctcttaaaaatgaggaaagggatttaatctcgagtttctttttgcacattttgatctcagtcaatcacattgtctacttcatttccctttttatttattattttttttgtttc

SEQ ID NO: 6253 - DNA, 2294 bp, Ricinus communis
aacggcgtcgacgttacgtcatttgtatccgtgcagagtcattgtaaaagggtgagtgagctaaagttgctctcccttggcaacagcagtcagcagcagcgaccgcttaaaaaaggaaaaagaaaagaaaaattcttcaaagtatgtttggcttgactgctactctctccaccgctaccgccgccgcttccgccactaactctcttccttctcgcactccctgcaccggcctgcatcatcatagaagtacttcgtctgccgtcaccgccgctgttgctggttgcactcaatcggcttcaattgtgtgcgttcaagttcacgccacgtctttgaggcccagttgtagtgcagtaaaagctatggctgattctcaaaccctttcagtgtctaaaaatcagcctcaatctccttcttctggcaataagcaagctttgatttctttatccgataaaagggacctggctttacttgggcgtggactacaaaacttagggtacacgattgtttcgacaggaggaacagcatcttctttggaaagtgctggagtatctgtaactaaagtggagcagcttacttcttttcctgaaatgcttgatggtcgtgtaaaaactttacatcccaacattcatgggggtattctagctagaagggaccaaaagcatcacatggaagctcttaacgaacatggaattggtacatttgatgtggtagtggtgaacttgtaccccttttatgataaagttacttcatctggacaaattgattttgaggatggaattgagaacattgacattggtggccctgccatgattagagctgctgcaaagaaccacaaagatgttttggtggttgttgactctgaagactatcctgcgttgctagattatcttcaaggcgaccaagatgatcagcagttccgtagaaatcttgcctggaaagcttttcaacatgttgcttcttatgattctgcagtttctgagtggctttggaagcaaactgtaggagataaattcccgcccagcctaaccgtgcctctctcactcaagagttctcttcgttatggtgaaaatcctcatcaaaaggctgcattttatgttgataagagtatttctgaggtcaatgctggtggcattgcaacagctattcaacaccatgggaaggagatgtcatataacaactacttagatgctgatgcagcatggaattgcgtgtcagagtttaagaaccctacctgtgttgttgttaagcacacaaatccttgtggggtagcttcacgtgatgatatccttgaagcatataggctggctgtaaaagcagatccagtgagcgcatttggtggtattgtagccttcaatatagaggttgatgaggttcttgcaaaggaaattagggagttcagaagtccaacagatggtgaaactcgtatgttttatgagattgtggttgctcccaagtataccaaaaaggggcttgaggtcctacggggaaaatcaaagacattgaggatccttgaggcaaaaaagaatgaacaaggaaagctttcactaagacaagttggtggtggatggttagctcaggattcggatgatttaactccccaagatataaaattcaatttcatgtctgagaagactccacaagaaagtgaactgaatgatgcacagtttgcatggctgtgtgttaagcatgtaaaaagcaatgccattgtaatagcaaagaataactgtatgctgggcatgggaagtgggcagccaaaccgtttggaaagcttgagaatagccttgaaaaaagcaggagatgaggttaaaggagctgctttggctagtgatgctttctttccatttgcttggaatgatgcagtggaagaggcatgtgaagctggcgttggtgttattgcagagccaggtggaagcatcagggacaaggatgccatagactgctgcaacaagtacggcgtttcactgatttttaccaatgtgaggcactttaggcactgatagatcacattttgagtttgtttttgcaattttgagtcaaaacctagtagccaatcagcagagtttcgaaactctatcagattcctctgatgggagttcccatagttcaccaggtggtggcatcacattatgcaatttaaaatgatgtaccataagcgctcatgatatttttctttccaatctcttaaaaatgaggaaagggatttaatctcgagtttctttttgcacattttgatctcagtcaatcacattgtctacttcatttccctttttatttattattttttttgtttctcg

SEQ ID NO: 6254 - DNA, 1863 bp, Chelidonium majus
cttttcagcttttcaactcttacagaaccaccaccaccacccattgctatcaaaaggcatcatcaatcatctttaggattccgtcgttattgtttcatcaaagtaaagtaagttcagtgaaagcaatggcggaggccgaaacattatcagcatcaaagactgttctcattcttcttctaatggcaacaaacaagcattgatatctttatcggacaagcggaatcttgctttgcttggaaatggacttcagggtttagggtatactattgtttcaaccggaggaacagcgtctgctttagaagaagctggagtctctgtaaccaaagtagaacaactaacttgtttcctgaaatgcttgatggccgtgttaaaacattgcatcctaatatacatgggggtattcttgctagaagagaccagaaacatcacatggaagcctagataagcatggaatagggacttttgatttagtggtcgtgaacttgtatcccttttatgataaagtttcttcaagcagtgcaattacgttcgaggatggaattgaaaacatcgatattggtgggcctgccatgatcagagctgcagcaaagaaccacaaggatgtattggttgtcgtcgactccgaagactatcctgaaatcctggaatttctgaaaggtaatcaggatgatgaacaattccgtcggaagcttgcttggaaggcatttcagcattgtgcttcttatgattcggcagtttcagagtggctatggaaacagacagttggagacaaatttcctcccagcttgacagtgcctctctcccttaaaagttctcttcgttatggtgaaaatcctcaccagaaagctgcattttacgttgacaagagtctttctgaggttaaagctggaggtatagcaactgctatacagcatcatggaaaggagatgtcttataataactatttagatgcggatgcagcttggaactgtgtatcagaattcccaaaccctacttgtgtggttgtgaagcatacaaatccttgtggtgtagcatcaagggacgatatccttgaagcatacaggttagccgtaaaagcagatccagtgagtgcattcggtgggatagttgcattcaacgtagaagttgatgaggctctggcaaaggaaatccgagaatttagaagcccaacagacggtgagacgcgtatgttttatgagattgtggttgctcccaaatattcacaaaaaggtctcgagattcttcgtggcaagtcgaagactctaaggatccttgaagcaagcaagaatggaaagggaaaactctcgctcagacaagttggtgggggttggttggcacaggactcagatgacttgacaccacaagacattgagttcagtgtagtctctaagaaaactccaaaagaaaacgagcttcatgacgcggagtttgcatggctgtgcgttaagcatgtcaagagcaacgctattgtcatagctaagaacaactgtatgttagggatgggtagtggacaaccaaaccgtctagagagtttacggatagctttcaggaaagctggagaggaggctaaaggagcagctctcgccagtgatgctttcttccccttcgcttggaaagatgcagtggaagaagcatgtgaaaatggcattggggttattgcagaacctgggggaagtattagagatagcgatgccatagactgttgtaacaaatatggggtctctctcctcttcaccaatgtgaggcacttcaggcattaatcaggtgagttggatacaaaaacctaaaactgcacttctcttggtttcctttccttggattgtgcacaaattacaactggaaactgtactaagagtctaagac

SEQ ID NO: 6255 - DNA, 1880 bp, Euphorbia peplus
tgaatgagcccctaagcttactgcttctggtaataagcaggcgcttatatctttatctgacaaaaaagaacctggtagattcttggtactggtccttcaaaaattttaggatacacaattgtttcgactggaggaacagcatctgcactggaaagtgcaggggtgtctgtaacaaaagtggagcagcttacgagttttcccgaaatgcttgatggtcgtgtaaaaactttacatcccaatatacatgggggaattcttgctagaagggaccaaaagcatcacatggaagctcttaatgaacatggaattggtacatttgatgtagtggtggtgaatttgtaccctttttatgataaagttacttccactggaggaattgagtttgaggatggcattgagaacatcgacattggtgggcctgccatgatccgagctgctgcaaagaatcacaaggatgtcctggttgttgttgactcgcaagattatcctgaactcctagagtatctcaagggagaccaggacgatcaacaattccgcagaaagcttgcctggaaagcttttcagcatgttgcctcttatgatgctgcagtttctgagtggctatggaaacaaactgttggagataaattcccacccagcctaacagttcctcttgagcttaagagttctctccgttatggtgaaaatccacatcaaaaggctgccttttacgttgacaagagtatttctgaggtcaatgctggtggtattgcaacagctattcaacaccacgggaaggagatgtcatataacaactacttagatgctgatgcagcatggaattgtgtgtcagagtttaaaaatccaacttgtgtggttgttaagcatacaaatccttgtggggtagcttccggtgatgatatccttgaagcatatagactagctgtgaaagcagatccagtgagtgcttttggcggtattgtagccttcaatatagaagttgatgaggttcttgctaaggaaattagggagttcagaagcccaacagatggcgaaactcggatgttttacgagattgtcgtggctcctaagtataccaagaaggggcttgagattcttcgaggaaaatcaaagacgctgagaatactcgaggcaaaaaagaatgagcaaggaaagctttcacttagacaagtcggagggggatggttagctcaagaatctgatgacttgacaccagaagatatccaattcaacgtcatgtctgagaagactccactagaaagtgaacttcacgatgcagagtttgcatggctctgtgtcaagcatgtaaagagcaacgcaattgtgatagcaaagaataactgtatgttgggcatgggaagtgggcagccaaaccgagttgaaagcttgagactagcattgaagaaagctggagacgaggttaagggcgctgctttggctagtgacgctttttttccatttgcttggaatgatgcagtggaagaagcatgccaggctgggattggtgcaattgcagagccaggcggcagcatcagggataaggacgctatagattgctgcaataagtacggggtttcattgctttttactaatgtgaggcacttcaggcactaatggataactcggagcattcagcttggcgattttgagttgaaatatcaacataagccaagcaacacagttttcaacttctggttctaccatatgaaacctcagaaggagaatttccctaggctagttttcatcacaaggcagcattttatgcaatgtaaaattgtaacttaatacaatgacatttcctgctcattccctataaattgtgtttgctgaaacattttaagtttttcgcacattgtcctatgatgatacatagagcttga

SEQ ID NO: 6256 - DNA, 2697 bp, Fragaria vesca
tttcgcgttcttcttcgattttgttctctatcaaaagcgtgttgttcagaataagggatgatgaagattggagattgaagattggagattagagattggagagtgaagactgaagccagatgggtttgagttcagcaaagttggggtttctgagcttttcagcttctgggtttgagttttcacgcgtttcagacatagttggtctccggaagctgatggagcgagtcatattccacaagtttgagagctgctcttgcttaatgtgatatcaaatttctcagcatatatcagccttacctaatatctgatcgccgaacaactcatgtacttccggaggctaagaagccgagtttctgcttaatcaaattcaagagcagagcagggcaggcaagagatatgctgcttcgtttgtctgctacccctcctgccactacaacacccaacaccagtcttttcctgctcttctccaccaatcttccgattactcattcttcttcttcttctttctcgccttgttcactcaggaactcctctgggctgcacaccagttgtagaccacttaaggccatggctgcccaagaggctcaatcctcagcctcagcctcaggtgataggcaggctctgatatccttgtcaaacaaaaacaatcttgccttcttagggaatgggcttcagagcttgggatataaaattgtttccactggaggaactgcatctgctttggaaagtgccggggtgtctgtcactaaagttgaagaacttacttgcttcccggagatgctcgatggtcgtgttaaaactttacaccccaacattcatggtggtattcttgctagaagagaccaaaagcatcacatggaagctcttagtaatcacggaattggtatattcgatgtggttgtggtgaatctatatcccttttatgataaagttacttcaactggaggaatagaatttgaggatggaatcgaaaatatagatattggtggtcctgccatgattagagctgctgcaaagaatcacaaagatgtcctggtggttgttgattcagaagactatcctacacttttagaatatcttaaagcggacaagtttgatcaacaattccgaagaaagcttgcgtggaaggctttccaacatgttgcttcttatgattctgctgtttcagagtggctttggaggcagactagcgaagataaattccccccaagcataacagttcctctttcgctcaaaagtccccttcgctatggtgaaaatcctcatcaaaaggctgcattttatgttgacaagagtctttctgaggttaatgctggtggcattgcaactgctatacaacatcatgggaaggagatgtcatataataactatttagatgctgatgcggcttggaattgtgtgtcagagttcaggggtcctacctgtgttgttgtaaagcatacaaatccttgcggtgtagcatcacgtgatgatatacttgaagcatacaggcttgctgtcaaagcagatccagtgagtgcatttggtggcattgtagctttcaacatagaggttgatgaggctcttgctaaagaaatccgagagtttagaagcccaacagatggtgaaacccggatgttttatgagattgtggttgcacccaagtattcaaagaaaggtcttgagatacttcgtggaaaatcaaagactctgaggatccttgaggcaagcaaaaatgagaaaggaaaactttcgctgagacaggttggtggtgggtggttagcccaggactcagacgatttaactcctcaagatatccaatttactgttgtgtctaagaagtctccacaagaaagtgagctcagtgatgcagagtttgcatggttgtgtgttaaacatgtcaagagcaatgcaattgtactagcaaagaataactgtatgttgggtatgggaagtggacagccgaatcgtctggagagtttaagaatagcattgaagaaagcaggagaggaggtcaagggtgcagctttggctagtgatgctttctttcctttcgcttggaaagatgccgtggaagaagcatgtgaaagtggagttggtgttattgcagaacctggtggcagtataagagacggagacgctatagattgctgcaacaagtatggcgtttcacttgttttcactaatgtgaggcacttcaggcattaatatcagattctagttttggttcttgctccttttactttcatcctagcgcctttgcttagagctcaaaatctagttttcgttggaccacaaggtttgttttcctctcattttaaattcatgtaatcatgtttttcttgtacaatctgaataatgcatgtattttggataccagagattttacctctgttttcagtaagctgaatgactaatgccatgaattgtaggctatctatttgtctgaagttcttagtaaacacaactaaagatcacaataatctttggtccagttcttgtttctttctttagtaggagaaaaacacaaatgtaaataaagtaataaactggtccctaattagtgggtgaatacacgaaacatgagaacgtatataaagtaaaaaagaagggtcatatttccatttgtggaaagagtgaacaaaaattgtcactaccaaaaccattaaactccaaccaatttgtcatcggttttagttatatgtgaatgttcgtcag

SEQ ID NO: 6257 - DNA, 2509 bp, Fragaria vesca
tctgcagagccttcttcagcatctcgaaggcttcgttcaccttttcctccactgcagagccttcttcagcatcaattttgggtttcgcctctgccttctctccttcctctgttttcagaccgaatttcgacaggttggatttgacgagacttaacgagacttcatagttcatagttcatagtgcatcaaagttggtggactcgtttgcgattcatctgctcaccgtcgctcgtctcctcatcgtgacgctgtcgtcggctcgtctcctcacccatcaccgtagcctgctcggtttcgtctgcttgccgttgctgtctccctgtctccccaagtccccgagtccccgttcacttccccagacgaccagaccactgagagtctgagaccagcccatgtgagatttttgtcctggatccgccactgcaggcgagagatatgctgcttcatttgtctgctgcccctcctgccagcacgacacccaacaccagtcttttcctgctcttctccaccaatcttctgattactcattcttcgtcttctttctcgccttgttcactcaggaactcctctgggctgcacaccagttgtagaccacttaaggccatggctgcccaagaggctcaattctcaacctcagcctcagcctcaggtgataggcaggctctgatatccttgtcagacaaaaacaatcttgccttcctagggaatgggcttcagagcttgggatataaaattgtttccacgggaggaactgcatctgctttggaaagtgccggggtgtctgtcactaaagttgaagaacttacttgcttcccggagatgctcgatggtcgtgttaaaactttacaccccaacattcatggtggtattcttgctagaagagaccaaaagcatcacatggaagctcttagtaatcacggaattggtatatttgatgtggttgtggtgaatctatatcccttttatgataaagttacttcaactggaggaatagaatttgaggatggaatcgaaaatatagacattggtggtcctgccatgattagagctgctgcaaagaatcacaaagatgtcctggtggttgttgattcagaagactatcctacacttttagaatatcttaaagtggacaaggatgatcaacaattccgaagaaagcttgcgtggaaggctttccaacatgttgcttcttatgattctgctgtttcagagtggctttggaggcagactagcgaagataaattccccccaagcttaacagttcctctttcgctcaaaagtccccttcgctatggtgaaaatcctcatcaaaaggctgcattttatgttgacaagagtctttctgaggttaatgctggtggcattgcaactgctatacaacatcatgggaaggagatgtcatataataactatttagatgctgatgcggcttggaattgtgtgtcagagttcaggggtcctacctgtgttgttgtaaagcatacaaatccttgcggtgtagcatcacgtgatgacatacttgaagcatacaggcttgctgtcaaagcagatccagtgagtgcatttggtggcattgtagctttcaacatagaggttgatgaggctcttgctaaagaaatccgagagtttagaagcccaacagatggtgaaacccggatgttttatgagattgtggttgcacccaagtattcaaagaaaggtcttgagatacttcgtggaaaatcaaagactctgaggatccttgaggcaagcaaaaatgagaaaggaaaactttcactgagacaggttggtggtgggtggttagcccaggactcagacgatttaactcctcaagatatccaatttaatgttgtgtctaagaagtctccacaagaaagtgagctcagtgatgcagagtttgcatggttgtgtgtcaaacatgtcaagagcaatgcaattgtactagcaaagaataactgtatgttgggtatgggaagtggacagccgaatcgtcgggagagtttaagaatagcattgaagaaagcaggagaggaggtcaagggtgcatctttggctagtgatgccttctttccattcgcttggaaagatgccgtggaagaagcatgtgaaagtggagttagtgttattgcagaacctggtgggagtataagagacggagatgctatagattgctgcaataagtatggcgtttcacttgttttcactaacatgaggcacttcaggcattaatatcagattctagttttggttcttgctccttttactttcatcctagcaccattgcttagagctcagaatctagttttcgttggaccactaggtttgttttcctctcattttaaattcatgtaatcatgtttttcttgtacaatctgaaaaatgcctgtattttggataccagagattttacctctgttttcagtaaagctgaatgactaatgccaagaattgtgggctatctatttgtctgaagttcttagtaaacacaactaaagatcagaataatctt

SEQ ID NO: 6258 - DNA, 2048 bp, Catharanthus roseus
ggtgtatgagaaacaccgcgcacatcagcagctacttgaaagatgctcgggttcactgcagccatcaccacttcctcctccgcctcccctaacgccgccaccgccttcgctgccactcctatctcacgtgccgcctccgccgctcttcacatctatactagaacagccactttctcttcatctgttcaacagtattcaacagcatatccgggtaggttaatttgttttccgattaaagcaatggctgaaactgaagttctttctacaccaaagctcgactccaaagtttctgggaggaagcacgcattgatttctctatcagataagagtgatttggctttccttggaaagggacttcaagaactaggatacacaattgtttcaactggaggaacagcatctgctttggaaagcgttggggtgcctgtaaccaaagtggaagagctcacatgttttcctgaaatgcttgatggtcgtgtgaaaactctacatcctaacatccatgggggtattcttgctaggagagatcaagaacatcacatgaaagctcttaatgaacatggaattggtacatttgatatagtagtggtgaacttatatcctttttacaacaaagtctcctcttcaagcggaatatcttttgaggatggaattgagaatattgatattgggggccctgccatgattagagctgctgcaaagaatcataaggatgtcttggttgtggttgattctggagattatcctggactcttagagtttctccgaggcaaggaagatgacctactcttcagaagaaagctagcatggaaggctttccatcatgttgcttcatatgattctgctgtttcagagtggttgtggaagcagacagctggagataagttcccccctggtctgactgtacctctatcactcaagagttcacttcgatatggtgaaaaccctcaccagaaggctgcattttatgttgacaagtctctagctgaggttaatgctggaggaattgcaacatctattcaacaccatggaaaggagatgtcgtacaataattatttagatgctgatgcagcttggaattgtgtttgtgagtttagcaagcctacatgtgttgttgtcaaacatacaaatccttgcggggtagcatcacgtgatgatattattgaagcttatagactggctgttaaagcagatccagtgagtgcttttggtggtatagtggccttcaatgtggaagttgatgaggcactggctaaggacatccgagaatttagaagtcctacggacaatgaaactcgaatgttttatgagattgttgttgctcccaagtataccgcgaagggtcttgaggttctacgtggaaagtccaagactttgagaatccttgaggcgaaaaaaaatagtaagggaagctctcactcaggcaagttggtggaggttggttagctcaggattcggatgatttagtcccagaggatattaaattctctgtagtttcagagaagactccacaagaaagcgagctttctgacgcacagtttgcttggctttgcgtgaagcatgtgaagagcaatgccgttgtcattgcaaaggacaactgcatgttgggtatgggaagcggccaaccaaaccgtttggaaagcctgagaatagcaatgaggaaagcaggagaggaagtcaaaggagccgctttggctagtgatgctttcttcccgtttgcttggaacgatgctgtagaagaagcatgtgaaagtggaatcagcgttattgctgagccaggaggaagcatcagagatggggatgctatcgactgctgcaacaaatacggagtttctcttgtctttaccaatgtgaggcactttaggcattgagaatgcagttctgtctttcaaatttcccgagctctataacaagcttagtgccaaaaattttggtaagagttatatttagtagatgatgtattagaatttagaacctttgcttatgaaagacctggctgaatagatccataggagtgtaacattatgtatgattggtggacttcctgt

SEQ ID NO: 6259 - DNA, 2211 bp, Quercus alba
agcaacagtacttttaaaacaaaaagagtactaaaaaaaaaaaaacacacaaaagatactctctcgctatgttcggtgttggtgcagcagctcctacctccaccgccgcccccaccaccaccgctcacactcgcctccacagcatcaacgctacctcttcttctaatccttttatttcggctttaattgggtgcggtcgggttcagttttgttccttgcgcttgaactgtggtggtccaatcaaagccatggctgacactaacactagcactgatactatctcggtgcccaacagtgcttctcatccctctgcttctggaaacaaacaagcactaatatcattgtcagacaagaaagatctggcttttcttggaaaagggctccaagaactgggctacacaattgtttcaactggaggaacagcatcgactttggaaagtgctggggtatctgttactaaagtggaacagcttactagttttccagaaatgcttgatggccgtgtaaaaactctacaccctagcatacatgggggtattcttgctaggagagaccaaaagcatcacatggatgacctcaataaacatggaattgctacatttgatgttgttgtggtgaacttgtatcccttctataataaagttacttcaactggaggaattgagttcgaggatggaattgagaatattgatattggtggtcctgcaatgatcagggctgctgcaaagaataacaaggatgtgttggtggttgtggatccacaagattatcctctgctcctagaatttcttaaaggaggcggggatgatcaactcttccgtagaaggcttgcttggaaggcatttcaacatgttgcttcttatgattcagcagttgctgagtggctttggaagcagacttcaggaatttctacatcttctgccgatgatgataaattccctcccagcttaactgtgccactagagcgtgcaagttctcttcggtatggtgaaaatcctcatcaaaaagctgcattttatgttgacaagaggcttgcagaggttaatgctggtggtattgcaaccgctattcaacaccatgggaagtcaatgtcttacaataactatttagatgctgatgcagcttggaattgtgtgtcagagtttaaaaaccctacctgtgtagttgtaaagcatacaaatccctgtggggtagcttcacgtgatgatatccttgaagcatacaggcttgctgtaaaagcagatccagtgagtgcatttggcggcattgtagccttcaatgttgaaattgatgaggctcttgctaaggaaatccgagagtttaggagccccacagatggtgagactcggatgttttatgagattgtggttgcacccaagtatacagagaaagggcttgaaattctacagaaaaaatccaagtctctaaggatcctcgaagcacaaaaaaatgaaaagggaaagctttcactcagacaagttggtggtgggtggttagctcaggattcagatgacttgaccccccaggatatccaatttaacttggtctctgagaaggctccacaagaaagtgagcttcgtgatgcagagtttgcatggttatgcgtcaagcatgtcaaaagtaacgccattgtaatagcaaagaataactgtatgttgggcatgggaagtgggcagccaaaccgtgtagagagtttgagaatagcattgaagaaagctggggatgaggtcaaaggggcagctttggctagcgacgccttttttccatttgcctggaaagacgcagtggaaatagcatgtgagaatggagttagcgttattgctgagcctggcgggagcatcagagatgcagatgccatagactgctgtaacaagtatggtgtatcgctcctcttcaccaatgtgaggcacttcaggcattgatgattgttagcatttctgtgtctttttcatttggtttcatccgaccacagtttggaaattttggtagtctctttcggtaggtagatgttcccttttgagtcataatgttatgcaatcaagggatttgtagaacaattggtagtataaattgtttgataaggattcaacaaattatttgatatttggggattttgatctatcaaaaatacttgtgatgttatggatttgaaataagcatcaaatccaaatccatatcttaatacagccaaaaaaaaaaagctcgcgatat

SEQ ID NO: 6260 - DNA, 2214 bp, Prunus persica
aaagaggaaacggctaggttttcccccctcttaaaataaacggcggcgccacatttgcaacatagctccgcattttctactttactgtcttcaactactctctctctcttagaagtgttacgaaagagagatgctcggtctcggtctggctgttggtcctgctgctcctgctgccacgacacccaacaccaatcttctcctgctctcctccaacaagcaaatacaaaccaatttctcttcttcttcttttctcacgtcttgttcagtcagaaacgcgcatctgctgcactcaagttgtagaacaattaaagccatggcggctgaggatacctttacagtgacaacccatgactccaaatctcctgcctccggtaatgggcttgctctgatatcattgtcagataagaaggatcttgctttcttgggcaatgggcttcaggacttggggtataaaattgtttcgactggaggaacagcatctgctttagaaagtgctgggttgtctgtcactaaagtggaacaaattacgtctttcccggagatgcttgatggtcgtgtaaaaactttacacccgaatgtacatggcggtatccttgctagaagagaccaaaagcatcacatggaagctcttagtaaacatggaattggtacttttgacgtggttgtggtgaatttataccccttttacgaaaaagttacttcaacaggaggaatagagtttgaagatggagttgagaatatagatattggtggtcctgccatgattagagcagctgcaaagaatcacaaagatgtcctggtggtggttgattcagaagactatcctgcattgctagaatatcttacgggagacaaggttgatcaacaattccgaaggaagcttgcatggaaggctttccagcatgttgcttcttatgattctgcagtttcagaatggctgtggaagcagactacagaagacaaattccctccgagcttaactgtgcctatactgcttaaaagtccccttcgttatggtgaaaatcctcatcaaaaggctgcattttatgttgacaagagtctttctgaggtcaatgctggtggtattgcaactgctatccaacaccatgggaaggagatgtcatataataattatttagatgccgatgcagcatggaattgtgtgtcagagtttaggaatcctacctgtgtagttgtgaagcatacaaatccttgtggtgtagcttcacgtgatgatatacttgaagcatacacgcttgctgtcaaagcagatcctgtgagtgcatttggtggcattgtagcattcaacatagaggttgatgaggctcttgctaaggaaatccgagagtttagaagcccgacagatggtgaaactcgggatgttctatgagattgtggttgcacccaagtacacaaagaaagggcttgaaatcctccgaggaaaatcgaagactctaaggatccttgaggcaagaaaaaatgagaaaggaaagctttcacttagacaggttggtggtgggtggttagcacaggactcggatgatttaactccccaagatatacagtttaaagttgttactcagaaggctccacaagaaagtgagcttggtgatgcagagttcgcatggttgtgcgtcaagcatgtcaaaagcaatgcaattgtaatagcaaagaataattgtatgttgggtatgggaagtggccagccaaaccgtcgggagagtttaagaatagccttgaagaaagcaggagaagaggtcaagggtgcagcattggccagcgatgccttcttcccattcgcttggaaagatgcagtggaagaagcatgtgagagcggagttagtgttattgcagaacctggtgggagcatcagagatggggatgctatagactgctgtaacaaatatggagtttcacttcttttcacaaatgtgaggcacttcaggcattgataacaattttctgccttggttctttttgttctctcctggagaagttcctgtagatggttgctcggcatccgtgcaagtcataatgaatctttttttgggtataaaataagggcttaaaaatcaaaaatttccttgaaatttcaccgaaaatttcatatttatgtagatggaatggaattctcaaaacttccagaatatttcctgatcttttggagatcagtcttcatcttagttgaaaagggaacttggctatatttctaaa

SEQ ID NO: 6261 - DNA, 1844 bp, Manihot esculenta
atgtttggcttgattaccacctctgctgctagctcgtccgctactgccaacactctgtcctctcgcattccctctgccctacttcatcaaagatccaacgccatcgctttgtgctctcaattgacttcaatcgtgtgtgttcaagttaacgggaactcatcacgatcaagttgtagtgctattaaagccatggctgagtctcataccctttcagtgccaaataatgagcctcaaacctctgcttctggcaataagcaagctcttatatctttgtctgacaaaaaggacctggcttttcttggtaatgggctacaaaatttagggtacacaattgtttctacaggaggaacagcatcggctttagaaagtgttggggtatctgtaactaaagtggagcaacttacttgttttcctgaaatgcttgatggtcgtgtaaaaactttgcatcccaccatccatggaggtattcttgctagaagggatcaaaagcatcacatggaagctcttaataaacatggaattggtaccttcgatgtagtagtggtaaacttgtatccgttttatgataaagttacatcaactggccaaattgagtttgatgatggaattgagaacattgacattggtggccctgcaatgatcagagctgcagcaaagaatcacaaggatgtcttggttgtcgttgactctcaagactatgccgcactgctagattttctcaaaggaaaccaggatgatcagcaattccgtagaaaacttgcctggaaagcttttcaacatgtcgcttcttatgattctgcagtttctgagtggctttggaaacatacagttggagataaattccctcccagtctaacggtgcctctatcgctcaagagttctcttcgttatggtgaaaatcctcaccaaaaggctgcattttatgtggacaagagtatttctgaggttaatgctggtggtattgcaacagctattcaacaccatgggaaggagatgtcatataacaactacttagatgctgatgctgcttggaattgtgtgtcagagtttaagaaccctacttgtgttattgttaagcacactaatccttgtggggtagcttctcgtgatgatatccttgaagcatataggctggctgtgaaagctgatccagtgagtgcatttggtggcattgtagcctttaatatagagattgatgaggctcttgctaaggaaatcagggagttcagaagcccaactgatggtgaaactcggatgttttatgagattgtggttgctcctaagtatacaaaaaaggggcttgagattctcaagggaaaatcgaagaccttgagaatcctcgaggcaaaaaagaacgaacaaggcaagctatcactgagacaagttggtggtggatggttagctcaggattcagatgacttgaccccccaagatatccaattcagtgttatgtctgagaagactccacaagaaaatgaattttgtgatgcaaagtttgcatggctgtgtgtcaaacatgtaaagagcaatgccattgtaatagcaaagaataactgtatgctaggcatgggaagtgggcagccaaaccggctggaaagtttgagaatagccttgaagaaagcaggagatgaggtcaaaggagctgctttggctagcgatgctttcttcccattcgcttggaatgatgcagtggaagaggcatgtgaagctgggattggtgtgattgcagagccaggtgggagcatcagggacaatgatgccatagactgctgcaacaagcgcggggtttcgttgctttttacgaatgtgagacacttcaggcactgagagattcagcaatctcg

SEQ ID NO: 6262 - DNA, 1612 bp, Cucumis sativus
gtttgctattatgttcttcagggaaaaaactagctctgatatcgttgtcagacaagaaaaatcttgcatttctaggaaatgggcttcaagaattgggctatacaattgtttcaactggaggaacggcatctacattggaaagttctggggttcatgttactaaggtggaggaggttacgtgttttcctgaaatgctggatggccgtgtaaaaactttgcatccttctatacatgggggcattcttgctagaagagaccaagggcatcatatggacgccttgaaaaaacatggaattggcacatttgatgttgttgtggtaaacttgtatcccttctatgaaaaagtaacctcatctcaagaaattaactttgaagatgggatcgagaacattgatattggtggcccagctatgatcagagctgctgcaaagaatcacaaggatgttttggtggtcgtagatactgaagactatcctgcgctgcttgaatttttgaaaggaagtgaagatgatcaacaatttcgcaggaagcttgcttggaaggcatttcaacatgtagcctcttatgattctgcagtctcagaatggctgtggaagcagactgttggagataaatttccacccagctttaccgtgcctctggctctcaaaagttctcttcgctatggggaaaatcctcatcagaaggctgccttttatgttgataagagtctttctgaggtcaatgctggtggtattgctacagcagttcaacaccatggaaaggagatgtcatataataactacttggatgccgatgctgcttggaattgtgtatcagagtttagcaatcctacctgtgtaattgtgaagcacactaatccatgtggtgtagcttcacgtgatgatattctggaagcatatagactggctgtgaaagcggatcccgtgagtgcatttggtggcattgtcgccttcaacatagaagttgatgagactcttgcaagggagcttcgggagttcagaagcccaacagatggtgaaacgcggatgttttatgagattgttgttgcaccaaagtacacagagaaagggcttgagatcttgcgtgggaaatcgaagacgttacgaattctcgaggcaggcaaaaacgagaaaggaaagctatcactcaggcaagttggtggtggatggttagcacaggattctgatgacttggttccacaagatataaaatttaacgtagtttctggaaaggctcctcaagaaaacgagcttcgggatgcagagtttgcgtggctatgtgttaaacatgttaagagcaatgccattgtgatagcaaagaataactgtatgttgggtatgggaagcgggcaaccaaatcgtcttgagagtttgcggatagccttgaggaaagcaggggatgaggtcaaaggagctgctttggctagtgatgcattcttcccatttgcttggaatgacgcagtggaagaagcatgccaaagtggagtaggtattattgcagagccagggggcagcatccgagatcctgatgccattgactgctgcaacaagtacggcgtgtctctcgtcttcaccaacgtgagacatttcaggcattgacattggagatg

SEQ ID NO: 6263 - DNA, 2016 bp, Vinca minor
tcctcaactccaatttcatgcgccgcctccaactcctcctctcttcgtgcttatactactggaacatccactttctcttcatctgttcatcagttatcaacagcagctccgcttaggttaatttgttttccgataaaagctatggcggctgaaagtgaagttattgctacatcaaaccttgactccaatgtttctggaaggaagcaagcgttgatctccctgtcagacaagtgtgatttggcttaccttggaaggggacttcaggaattaggatacacaattgtttcaactggaggaacagcatctgctctggaaagtgccggagtgtttgtaaccaaagtggaagagctcacatgttttcccgaaatgcttgatggccgtgtaaaaactctacatcctaatgtccatggggtattcttgctaggagagatcaagagcatcacatgaaagcccttaatgaacatggaattggtacatttgatatagtagtggttaacttatatccattttatgacaaagtttcatcttcaagtggaatatcttttgaggatggaattgagaatattgatattggtggccctgccatgattagagctgctgcaaagaaccataaggatgtcttggttgtggttgattctggagactattctgcactcttagagtttcttcgaggcaaggaagatgaccagctgctcagaaggaagttggcctggaaggctttccaacatgttgcttcatatgattctgcagtttcagagtggttgtggaagcagacagaaggaggtaagttcccccctggtctgtctgtacctctttcactcaagagttcacttcgatatggtgaaaatcctcaccagaaggctgcattttatgttgacaagtctcttgctgaggttaatgctggtgaattgcaacatctattcaacatcatggaaaggagatgtcctacaataattatttagatgctgatgcagcttggaattgtgtgtgcgaatttagcaagcctacatgcgttgtcgtcaaacatacaaatccttgtggggtggcatcacgtgatgatattatcgaggcttataggctggcagtgaaagcagatcccgtgagtgcttttggtggtatagtggccgtcaatgtggaagttgatgaggcactggctaaggacatccgagaattcagaagtccaaccgacaatgaaactcgaatgttttatgagattgttgttgctcccaagtataccaagaagggtcttgaggttctacgtggaaagtccaaaactttgagaatccttgaggcaaagaaaaatagtaaggggaaactctcgctcaggcaagttggcggaggttggttagctcaggattcagatgatttagtcccggaggatatcaaattctctgtagtttcagagaagactccggaagaaaatgaactttctgatgcacagtttgcttggctttgtgtgaagcatgtcaagagcaatgccattgttattgctaaggataatcgcatgttaggcatgggaagtgggcaaccaaaccgtgtggaaagcctcaggatagcaatgaggaaagcaggagaggaagtcaaaggagctgctttggccagtgatgcgttctttccatttgcttggaaagatgctgttgaagaagcatgccaaagtggaatcggtgttattgctgagcccggagggagtatcagagataaggatgctatcgactgctgcaacaaatatggagtttctctcatttttactgaagtgaggcactttaggcattgagaatgcagttctgattctcagatatcgtaccccacatttcctgagcacgataacaagcttagtccccaaaattttgttagttaagttagatcgatgtgcatcagttgatataaagatttgctgtttgagcggggtgttcaaaagaatattcaatttgtgacgggagtattttagatgattttacatatgctgcagtcgaggaaacacaagtagcatataatgtggttttatttccaatgata

SEQ ID NO: 6264 - DNA, 2135 bp, Nicotiana tabacum
tactactgagtggaacagaaagcttcatattattcataccacaatgcttggtctcaccagagctacgacttccgcctccgcctccgcctccgccaccgccgcagccacgtcagctaccgccattgctgccgccactgttcacctctgcactccgcagctccgcaccatcagaacaagaactagtttttgcttcggccaacaacagtcctcaaagacgtcgcatagggtgatggtttatccagtgaaggccatggctgaaactgcagccgctcctcactctgctcccaagtcctccacttctgggaggaagcaagcgttgatatcactttcagataagacggatttggctaagcttggcaatggtcttcaggaattggggtacacaattgtctcaacgggaggcacatcatcggcattggagggtgctggtgtgtctgtcaccaaagtggaagagctgacacgcttccctgaaatgcttgatggccgtgtaaaaactttgcatccaagcgttcatggaggtattcttgctagaagagatcaggagcatcacatggaagctctggaaaagcatgaaattggtacatttgatgttgtagtggtcaacttgtatcccttttatgccaaggtttcttcttcaagcggaatttcatttgaggatggaattgaaaacatcgatattggcggacctgccatgattagagctgctgcaaagaatcatagggatgttttggtcgtagttgattctgaagattacccagctcttttggaatttcttcgaggagataatgatgaccaacaatttcgaaggaagttggcctggaaagcttttcaacatgtcgcttcttatgattctgcagtttcagagtggctgtggaagcagactgtaggagataagttccctcctggcttgacagtgccacttcatctaaaaagcttacttagatatggcgaaaaccctcaccagaaggctgcagtttatgttgacaagtctctatctgaagttaatgctggtggaattgcaactgttatccaacaccacggcaaggagatgtcatataacaactatctggacgccgatgcagcttggaattgtgtgtgtgagtttaataaaccaacatgtgtggttgtgaagcatacaaatccttgtggagtagcatcacggaatgatatcattgaagcatataggctagctgtaaaagcagatccagttagtgcatttggtggtatagtagccttcaatgtcgaagttgatgaggctcttgcaaaggatattcgagaatttagaagccctacagatggtgagactagaatgttttatgaaatagtagtcgcaccaaagtatacagagaagggtcttgaggttctccgtgggaagtctaagactttgagaatcctcgaggcaagtaaaaacagcaagggaaagctttcactcagacaaattggtggtggttggttagctcaggactcggatgacttgacccctgaagatatccaatttaatgtcatgtctgacaaaactccacaagaaaatgagcttaatgatgcacagtttgcctggttatgtgtcaagcatgtcaagagcaatgccatagtaattgcaaagaacaattgtatgttaggaatgggaagtggacagccgaatcgtctagagagtttgcggatagctatgaggaaagctggagatgaagtaaaaggagccgctttggctagtgatgctttcttcccatttgcatggaatgacgctgttgaagaggcgtgtcaaagtggagtgagcgttattgcagagccaggagggagcataagggataaggatgcagtggattgctgtaacaagtatggagtctcgcttgtcttcaccaatgttagacactttaggcattaagcgattcatagggggcatcattggactcatgatatattatctttacaagtgtttgtgatagctgaaaggttcatctctggaaatgtttgaaagtttttaggaataatctgtgatttcaaagggaggtattctttaccatctatgagtgtgtattatagcaaaactgtagctctgtatcttctgtttggcgagcaaattttgtcgaaatacttaatgggctaagttattctatgagaagaatacagcaattcag

SEQ ID NO: 6265 - DNA, 2130 bp, Citrus clementina
accgccgctggagtcaagtgaacttattatatacttgagcattatatttttgcaatcggcaaatagagagactgagagatgattaggctgtccgccgccgcccccgccagcatagctgctcaaccgccgtactctaacatcctctacactcttctcaacaaaaagcgaattccaatcttctgcgttcgcgtccacactacctctctgcgctccagttactctcctatcagagccatggcccactctcacaccgtttctgttccaaccaatcaacccccgtcctcctcctcctctcaagcgaataagcaggcattgatttctttgtcggataaaaaggatttggcatctcttggaattgggttacaagaactggggtacacaattgtttccaccggaggaacagctacttctctagaaaatgatggggtgtctgtgactaaagtggagcagctcacctgtttcccggaaatgctggatggccgtgtaaaaactttgcaccccaacattcacggaggtattcttgccagaagagaccaaaagcatcatatggatgctctcagtgagcatggaattggtacatttgatctagtagtagtgaacttgtaccccttctatgataaagttacttctgctggagggattgattttgaggatggaattgagaacattgatattgggggccctgccatgatcagagctgctgcaaagaaccacaaggatgtgctggttgtagttgactcggaagattatcctgccctcctagaatttcttaaaggaaaccaggatgatcaacagtttcgtagaaaacttgcttggaaagcgtttcaacatgttgcttcatatgattctgcagtgtcagagtggctgtggaaacagactgctggagaagataaattccctcctagcgtcacagtgcctcttgaactcaaaagttctcttcgttatggtgaaaatcctcaccagaaggctgcattttatgttgataagagtcttgccgaggttaatgctggtggtattgctacagctattcagcaccatgggaaggagatgtcatataacaactatttagacgctgatgcagcttggaattgcgtatcagagtttaaaaatcctacttgtgtaattgtaaagcatacaaatccctgtggggtagcttcacgtgatgatatccttgaggcatataagctggccgtgaaagcagatccagttagtgcatttggtggtattgtggccttcaatgtggaagttgacgaggctcttgctacagaactccgagagtataggagtccaacagatggtgaaactcggatgttttacgagatcgtagttgctcccagctatacagaggaggggcttgagattcttcgaggtaaatcaaagaatcttaggatccttgagacaaaaaagaacgaaaagggaaagctctccctcagacaagttggcggtggctggttagctcaggattcagatgatttaactcctgaagatatccaattcaaagtggtttctgagaaaaagccgcaagaaagtgagcttcatgatgctgaatttgcatggctgtgtgtgaaacatgtcaagagcaatgccattgtaatagcaaagaataactgcatgctgggtatgggaagtgggcagccaaatcgtcgagagagtttgagaatagctatgaaaaaggcaggagatgaagttaaaggagctgctttggccagtgatgcattctttccatttgcctggaaagatgcggtggaagaggcatgtgaaaatgggattggagtaattgcagagcctggtgggagcattagagatggagatgccatagactgctgtaacaagtacggggttgctctgctcctcactagtgtcaggcatttcaggcattgacgaagatgacttgcgggagtttttcttattgtgttttctggttttgtcctgtgctgcaatcatagcaccattgccattgagttctggtatttcatactttcataggatgtttagatctcttgcacgcatagaagccttttgggttgcttggaagattgcataaacatatcatcatgctgtgccatacacatttatatattttggagaaccagatattttgtattattattcaaattttgttcgcctgat

SEQ ID NO: 6266 - DNA, 1847 bp, Cannabis sativa
cgaattttttatgggcctctttcaggtaataaacaagcattaatatcactgtcagacaagagagacctcaccttattaggggatgggcttcagaaattgggctacacaattgtgtcgactggagggacagcttctgctttagaaactgctggggtgtctgttacaaaagtagaacaactgactcgttttccggagatgcttgatggccgtgtaaaaactttacaccctaatattcatgggggtattctggctagaagagacgaaaagcatcatatggaggctctaaatgagcatggaattggtgtgtttgatattgtggtggtgaacttgtaccccttctatgatacagtcacttcaactaaagaaattgagtttgaagatggaattgaaaacattgatattggcggccctgccatgataagagctgctgccaagaaccataaagacgtcctggttgttgttgattcacaagactatcctgcccttttagaatttctaaaaggaaaccaagataatcaacaatttcgtagagagcttgcatggaaggctttccagcatgttgcttcttatgattctgccgtcgcagagtggttgtggaagcagacaaatggaggtaaatttcctcctaatatcacggtgccgatgacacttaaaagctcccttcgttatggtgaaaatcctcatcaaaaggctgcattttatgctgataagagtctttctgaagttgatggtggtggtattgcaactgctattcaacaccatgggaaggaaatgtcatacaataactacttagatgctgatgcagcctggaattgtgtggcagagtttaagaaacctacatgtgtagttgtaaagcacacaaatccttgtggtgtagcttctcgtgatgatatccttgaagcttatagactagctgtgaaggcagatccagtgagtgcatttggtggtattgttgccttcaacatagaagttgatgaggctcttgctaaggaaatcagagaatttagaagcccaacaggtggtgaaaccaggatgttctatgagattgtggttgcgcctaagtatacaaagaaagggcttgagatcctccgaggaaaatcaaagactttgaggatccttgaggcgagaaacaataagaaaggaaagctttcccttagacaggttggtggtgggtggttagctcaggacactgatgatttaacccctgaagacatacaatttaaagtcatgtctgagaaggctccagaagaaagtgagcttcgcgatgcagagtttgcatggttgtgcgccaagcacgtcaagagcaatgctattgtgatagcaaagaacaactgtatgctgggaatgggaagcgggcagccaaatcgtcgggagagtttaaggatagctttgaagaaagcaggagatgaggtcaagggagcagctttggctagtgatgctttcttcccatttgcttggaaagatgctgtggaagaagcttgtgagaatggaattggtgttattgctgagcctggggggagcatcagagatggggatgccatagactgttgcaacaagtatggtgtatcgcttgtcttcacaaatgtaaggcactttaggcattgatgacaaaagttgataccaacatttgcaatagtagcgttacaactgcctaaattttggtcggtccgctttccctgcagcaaataaagtcgttttgtactttagaggcattgatgacaattttgtaattaacttaggttgtttttggtaatgcatatttgaaccgttgtttgttttttataattagaaaatttaaaatgttttggtaaaattattattttttttttgtattttttaaaataaga

SEQ ID NO: 6267 - DNA, 2403 bp, Eucalyptus grandis
ggcggctccgatcccccagattcgatcgagtcttttctctctcttgatttggattgtgtgggggcttttgctggtttttcgatgcgatgattcgagtgaagttttgatttttccctcgtgcctttgccacgtgcacatgacagtcttccggcgccgcgcgaattgaacactcgcaaagcaaaacaccggaggcagcagaccagagtaaagcatgttgggttctcccaccgcccccacctcctcctccgccgccgccgccgccgccgccgccgtcgccgccgctttccgaagctctctgctgcactccaccaccactcaccggaccagaacttgcccttccacctctcaccaggtacctgtggcgtgtgttcgacttcagtcgtgttcgtcgtcgcgcgctgctcctccgatcaaagccatggctgccgaggctgagattctgtccgcgcccgacaaggagctgcgcccttctgctcctcggagcaagcaggcattgatatctttgtctgacaaaactgatttggcttttcttggaaagggcctccaggaattggggtatactgttgtctcaactggaggaaccgcatctgctctggaaaatgctgggttgtctgtcagcaaagtggaacagcttacttgcttccctgagatgctggatggtcgcgtaaagaccttgcatcctcatattcatgggggcatccttgctaggagagatcaacagcatcacatggaggctcttgataagcatggaattggtacttttgatgtagtggtggttaatttgtatcctttctacgacaaagttacctctgcggctgatattgaatttgaagatggaattgagaatgttgatattggtggtcctgccatgatcagagctgctgcaaagaatcataaggatgtccttgttgtggttgattcacatgactaccctgctctgttggagttcctaaagagtaatggagatgatcaacagttccgtagaaaacttgcttggaaggcctttcaacatgttgcttcctatgattctgcagtgtcagagtggctttggagacaaacaactggagagaaattccctcccagcttaacagtccctctatctctgaaaagttctcttcgttatggtgaaaatccccaccagaaggctgcattttatgtggacaagagtcttgctgaggttaatggaggtggtattgcgactgcaatccaacatcatggaaaggaaatgtcatataataactatctggatgctgatgctgcatggaattgtgtatccgagtttagcgaccctacatgtgttgttgtgaagcatacaaatccttgtggggtggcttcccgcggtgatattcttgaagcatacagactagccgtcaaagcagatcctgtcagtgcatttggtggtatagtggccttcaatgtagaaattgatgagaacttggctagggaaatccgggagttcagaagcccaacagatggtgaaactcggatgttctatgagattgtggtggcaccaaagtactcaaagaaggggctagaggttctccgtgggaagtcaaaaacattgaggatccttgaagcgaagaagaacgaaaaagggaagctttcactgagacaggtcggtgggggatggctggctcaggattccgatgatttaactcctgcagacatccaattcaatgcagtctcagggacgactccacaagagagtgaacttgaagatgcaaagcttgcatggctctgcgttaagcatgtcaagagcaatgccatcgtcatagtgaagaacaagtgcatgttgggcatgggaagcggacagccaaaccgtttggagagtttgaggatagctatgaggaaatctggagaggaggtcaagggggcagctttggcgagtgatgcattcttcccatttgcttggaacgatgcagtagaagaagcttgtcagagtgggattgctgtcattgcagaacctggtggaagcattagagatcaggatgccatagaatgttgtaacaagtatggcatctcgcttgttttcaccaatgtgaggcacttcagacattgatgctgcgcttgacctctgtctccccctccaatatctcggggaaattttgtggaaagaaatcctagtgattttgttcttcactataccgtgagcaatgggtgaatgtgttcgtactaaagatgatctgtatgtgagttttgcagtcgctcgcttgatttgtgcaattgcttttgggtctatgtgtcagagtcgccgaaatgagcgctcacagacttcgtgaccgtttttaacattttgcgttttgaacatgtatcgtagcttgaggaactaggatttgcaatagttcatgaacatgagcattatcgctgaggcaatcgataaagagaaggttttgaaagttgcaa

SEQ ID NO: 6268 - DNA, 3087 bp, Eutrema halophilum
aatccgcaaaatcttaaaaacctaaacagagccaaacactactacactcacactgttgcgaaatcaaacagctatgctcagctccgccgccaccgccaccgccaccgccgcttcagtgagttctcgctccggtgaatttctctgcggctttattcgcaggaaaacggtcgcgtcttatcgtccttcacagcctgtctactgtacgtcgcttcgtccgagtctcgtcgcggttcgagccatggcggagtctcagacagctccgaggaatccgccgcactcctcgagctcctctggaaaaaagcaagctttgatatctttatctgacaagaaggatttggcttctcttggcaacggtctgcaagagctgggatacactattgtttctactggaggaactgcctctactttagagaatgctggagtctctgtgactaaagtggagacgcttactcattttccagaaatgcttgatggccgtgtgaagactttgcacccaaacatccacggtggtatccttgctagaagagatgtggagcatcatatggaagctcttaatgagcatgggataggtacatttgatgtggtggttgtcaatttgtatccattctatagcaaagttactgctcctggtgggatcagttttgaggatgggattgagaacatcgacattggtggtcctgctatgattagagcagccgctaagaaccacaaagacgttctcattgttgttgattcagaggattatcaagctgttttagagtatctcaaaggaggacagagcgaccaacaattccgcagaaaacttgcgtggaaggcttttcagcatgttgctgcttatgattccgcggtttcagaatggctatggaagcagactgaaggaaaagagaagttccctcccagctttacagttccgctttcacttaagagttctcttcgttacggtgaaaaccctcatcaaaaggctgcattttatgttgataagagccttgctgaagtgaacgctgggggtattgccacagcgattcagcaccatggaaaggaaatgtcatacaacaactatcttgatgctgacgctgcgtggaattgtgtgtcagaatttgaaaatccgacatgtgtagtcgtgaagcacacaaatccgtgtggtgtggcctctcgggatgatattcttgaggcttaccggctagctgtaaaagctgacccagttagcgccttcggtggtattgtagccttcaatgttgaagtcgatgaggttctggcaagggagatccgagagttcaggagcccaacagacggagaaactagaatgttttacgagatcgtggttgctccaaagtacactgctaaaggtcttgaagtcctcaaagggaaatcgaaaactttgaggatcctcgaagctaaaaagaatgaccaagggaagctatcgctcagacaggttggtggcggctggttagctcaagactcagacgacataactccagaagacatcagtttcagttctgtctcagaaaaaactccaactgaaagcgaatttgcagacgctaaatttgcctggctttgcgttaagcatgtcaagagcaatgccattgtgatagctaagaacaactgtatgctagggatgggaagcggacagccaaaccgagtagagagtctgagaatagctttcaggaaagctggtgaagaagccaaaggtgctgccttggccagtgatgcattcttcccatttgcatggaaagatgctgtggaagaggcctgcgagaagggaataggagtgatagcagaacctggaggaagtattagagaccaagacgccattgattgctgcaaaaaatatggagtctctctgctcttcaccaacgttagacatttccgccattgatgatgggatcatcaaattttgctcttataaaacatcaaagagattctgaagaagaaaaacccaccaaacaaaaaaaaagtgggaaatgttgtaacaataattcgagctcgttcgacttttttgtatgattagaacatgagatctgtttggtctgataaatgtgttcttgaatttgacaatttgttgacccaaaaatcatatttttctcaacacccaaaaactgaattggatgtgtatatatatctatccaactcaaattagagagagaaagtcgacgacagtggatagagaaagagagagaagagagatggcgacagggaaagtggtgatagagagagtcggaggaagatctacggctacgagttgcttctctaagtatcctcttaagttcatacttcctggcaaggtagctcctgccggaactgacgttgtctggatttacagcatcacctatggcggcggcattgtctctggagattcgatttcatgtgaattcaccattgatgatggatgcactgcagtgcttacaacgcagtcttctactaaggtatacaaggcaataggatcaaagtgttctgaacaaacactggaagcgagaatcgggagtgaagctcttttggttgtgattccagatccagtgacttgcttctccactgcccgttactatcagaaacagttgtttagattggtttcagactctaatctagttctcgtggactggatcacaagcgggcgtcacgcaaatggtgaaaaatgggatttcgagctctataagagcattaacaatatctacctggaagatgatgaacctttattccttgacacagtgctactagagaagaggagcatccaaagcatagccgaacggatgcaagactatcaggccatagcaatggtcatactcttcgggccaaagctgggggaaatccaaaaacaagtccaagaaaacgtgaagaatatgatgtcggaacagttacagatatcttatggttctcggagacacaattctgagtcaagctctcgaagtggcttcatgaaaccagagttcatagcttcctgcagtactttcggccctgaggaaaaaggagttgtgattcgaatagcttcggattctacagagtcagtctacaacttcttgaggcaacaattggctaagctggaaccacttcttggtcaatctccctatgcttgactctttacttttcttttaa

SEQ ID NO: 6269 - DNA, 1865 bp, Cirsium arvense
aagttattcatcgcgattgagttgttatcggagcaaggcaacggcggaagctgcggaatccatggctggctctatcgcttctccgtctggaagcaagcaggcattaatttcattatcagacaagaaggatctggatattcttggcactggacttcaagaattgggatacacaattgtttcgactggaggaactgcgtatgccctggagaaagctggagttcctgtaacgaaagtagaggagcttactcagttccctgaaatgcttgatgggcgtgtaaaaactttacatcctaatatacatggaggtattcttgccagaagagaccaaagtcatcacttggcagctctggacaagcacaacatcagtacatttgaagtggtggtggtaaatttatatcccttctatgcaaaggttacttctaccgacggaattacatttgatgatggaattgagaacatcgatattggtggccctacaatgataagagctgctgcaaagaatcacaaagatgtcttggttgtcgttgattcgcaagactaccctatgcttctagaatcctcaaaggaaacaaggatgaccaacaatttagaaggaagctggcgtggaaagctttccaacacgttgcttcttatgattctgctgtttctgagtggttgtggaagcagactgaaggaggtgaatttccaccaagctctacagttccactaactctcaagagttcacttcgttatggtgaaaatcctcatcagaaggctgcattttacatcgacagcagcttgtctgaggttaatggtggtggtattgcaacagctattcaacaccatgggaaggagatgtcatataacaattatttggacgctgatgcagcttggaactgtgtttgtgagtttgaaaagcctacttgtgttgttgtaaagcatacgaacccttgtggggtagcttcgcgtgatgatctgattgaagcatataggttagctgtaaaagcagatccagtgagtgcatttggtggtatagttgccttcaacaaagaagtcgacgagactcttgctagggatatccgagaattcagaagcccaacagatggtgaaactcgaatgttctacgagattgttgttgctcccagctacagtgaaaaaggtctcgagatccttcgtggaaagtccaagactttgagaattcttgaagcaaagaaaaatagcaaagggaagctctcacttagacaagtaggtggcggttggttagctcaagattcagacgatctaacgccagaagaaattaaatttgatgtagtttctaagaaggttccggaagaaagtgaacttgatgatgcaaaatttgcatggttgtgtgtgaagcatgtcaagagcaacgccattgtaattgcaaagaataattgtatgttaggcatgggaagtgggcaaccaaatcggttggaaagtttaagaatagctatgaggaaagccggagatgaggtcaaaggagctgccttggctagtgacgctttcttcccatttgcgtggaaagatgcagtagaggaagcatgtgaaagcgggatcggtgttattgccgaacccgggggaagcataagagacggagatgcaatcgactgctgtaacaaatacaatgtttcgctcgtcttcacggccgttaggcatttccgccactgagtattataataataaaagccaaaaagttgtgtatttatttatatttatcataaagcttttggtaatattctgatgcttcaagagctgttgtaagctacgtgacccaatgtaaccataatcagaagtttctcaagtctcattgacttttttttaactgcttttcatttcataacaaaaagaaaaaagtaccgactgcg

SEQ ID NO: 6270 - DNA, 2131 bp, Citrus sinensis
taccgccgctggagtcaagtgaacttattatatacttgagcattatatttttgcaatcggcaaatagagagactgagagatgattaggctgtccgccgccgcccccgccagcatagctgctcaaccgccgtactctaacatcctctacactcttctcaacaaaaagcgaattccaatcttctgcgttcgcgtccacactacctctctgcgcttcagttactctcctatcagagccatggcccactctcacaccgtttctgttccaaccaatcaaccccagtcctcctcctcctctcaagcgaataagcaggcattgatttctttgtcggataaaaaggatttggcatctcttggaattgggttacaagaactggggtacacaattgtttccactggaggaacagctacttctctagaaaatgctggggtgtctgtgactaaagtggagcagctcacctgtttcccggaaatgctggatggccgtgtaaaaactttgcaccccaacattcacggaggtattcttgccagaagagaccaaaagcatcatatggatgctctcagtgagcatggaattggtacatttgatttagtagtagtgaacttgtaccccttctatgataaagttacttctgctggagggattgattttgaggatggaattgagaacattgatattgggggccctgccatgatcagagctgctgcaaagaaccacaaggatgtactggttgtagttggctcggaagattatcctgccctcctagaatttcttaaaggaaaccaggatgatcaacagtttcgtagaaaacttgcttggaaagcgtttcaacatgttgcttcatatgattctgcagtgtcagagtggctatggaaacagattgctgaagaagataaattccctcctagcttcacagtgcctcttgaactcaaaagttctcttcgttatggtgaaaatcctcaccagaaggctgcattttatgttgataagagtcttgccgaggttaatgctggtggtattgctacagctattcagcaccatgggaaggagatgtcatataacaactatttagatgctgatgcagcttggaattgcgtatcagagtttaaaaaccctacttgtgtaattgtaaagcatacaaatccctgtggggtagcttcacgtgatgatatccttgaggcatataagctggccgtgaaagcagatccagttagtgcatttggtggtattgtggccttcaacgtggaagttgacgaggctcttgctaaagaactccgagagtataggagtccaacagatggtgaaactcggatgttttacgagatcgtagttgctcccagctatacagaggaggggcttgagattcttcgaggtaaatcaaagaatcttaggatccttgagacaaaaaagaacaaaaagggaaagctctccctcagacaagttggcggtggctggttagctcaggattcagatgatttaactcctgaagatatccaattcaaagtggtttctgagaaaaagccgcaagaaagtgagcttcatgatgctgaatttgcatggctgtgtgtgaaacatgtcaagagcaatgccattgtaatagcaaagaataactgcatgctgggtatgggaagtgggcagccaaatcgtcgagagagtttgagaatagctatgaaaaaggcaggagatgaagttaaaggagctgctttggccagtgatgcattctttccatttgcttggaaagatgccgtggaagaggcatgtgaaaatgggattggagtaattgcagagcctggtgggagcattagagatggagatgccatagactgctgtaacaagtacggggttgctctgctcctcactagtgtcaggcatttcaagcattgacgaagatgacttgcgggagtttttcttattgtgttttctggttttgtcctgtgctgcaatcatagcaccattgccattgagttctggtatttcatactttcataggatgtttagatctcttgcacgcatagaagccttttgggttgcttggaagagtgcataagcatatcatcatgttgtgccctacacatttatatattttggagaaccagatattttttcttattattcaaattttgttcgcctgat

SEQ ID NO: 6271 - DNA, 1785 bp, Euphorbia esula
  misc_feature (209)..(209): n is a, c, g, or t
  misc_feature (268)..(268): n is a, c, g, or t
  misc_feature (412)..(412): n is a, c, g, or t
  misc_feature (561)..(561): n is a, c, g, or t
  misc_feature (1171)..(1171): n is a, c, g, or t
  misc_feature (1268)..(1268): n is a, c, g, or t
  misc_feature (1400)..(1400): n is a, c, g, or t
ggagattcttggtactggtctacaaaagttaggatacacaattgtttcaactggaggaacagcatctgcactagaaagtcaaggggtgtctgtaacaaaagtggagcagcttacgagttttcccgaaatgcttgatggtcgagtaaaaacattacatcccaatatacacgggggaattcttgctagaagggaccaaaagcatcacatgnaagctcttaatgaacatggaattggtacatttgacgtagtggtggtgaatttgtacccnttttacgataaagttacttccaccggaggaattgagtttgaggatggcattgagaatatcgacattggtgggcctgccatgatccgagctgctgccaagaatcacaaggatgtcttggttgttgtggactcccaagattatccngaactcctagagtatctcaagggagaccaaaatgatcaacaattccgaagaaagcttgcctggaaagcttttcagcatgttgcctcttatgattctgcagtttctgagtggctatggaaacaaaccgttggagataaattcccacccancctaacagttcctcttgagcttaagagttctctccgttatggagaaaacccacatcaaaaggcagcattttatgtggacaagagtatttctgaggtcaatgctggtggtattgcaacagctattcaacaccacgggaaggagatgtcatataacaactacttagatgctgacgcagcatggaattgtgtgtcagagtttaaaaatccaacatgtgtggtagttaagcatacaaatccgtgtggtgtagcttctcgtgatgatatcctcgaagcatatagactagctgtgaaagcagatccagtgagtgcttttggaggtatagtagccttcaatatagaggttgatgaggttcttgctaaggaaattagggagttcagaagcccaacagatggcgaaacccggatgttttacgagattgttgtggctcctaagtatacaaagaaggggcttgagattcttcgagggaaatcaaagacactgagaatactcgaggcgaaaaagaatgagcaaggaaagctttcacttcgacaagtcggagggggatggttagctcaggattctgatgacttgacaccggaagatatccaattcaatgtcatgtctgagaanactccactagaaagtcaacttcatgatgcagagtttgcttggctctgtgttaagcatgtaaagagcaacgcaattgtgatagcaaagaataactgtntgttgggcatgggaagtgggcagcctaaccgggttgaaagcttgagacttgcattgaagaaagccggagacgaggttaaaggagctgctttggctagtgatgctttcttcccattcgcttggaatgatgcantggaagaggcgtgtcaggctgggattggtgcaattgcagagccaggtggcagcatcagggataaggatgctatagattgctgcaataagtatggggtttctttgctttttactaatgtgaggcactttaggcactaatggataacttggagtgtctaacttggcgattttgagttgagataacaacataagccaagcaacacagttttcaacttctggttctaccatattaaacctcagaaggagaatttccctaggctagtttttcatcacaaggcagcattttatgcaatgtaaaattgtaacttaatacaatgacatttcctgctcattccctataaattgtgtttgctgaaacattttaagtttttcgcacattgtcctat

SEQ ID NO: 6272 - DNA, 2089 bp, Ambrosia trifida
gcggggggagtgagacacacactcaacaaaaccctgacaacaatgcttctgaggtttggagctccgttcaccaccgtcacctcttcaactgccgtaaccgtccgtacttcaccggcgataagttttcacttcctatcaaccgattctccgtctaacgattctgttagaaacaataacaaattttgttttcaccagtttataagctattcatcacgattgaattgcaaggcaacgaaagaagttgctgaatccatggctgcttctaccgcctctccatctgcaagcaagcaggcgttaatttcgttgtcggacaagaaggatctggatcttcttgctactggacttcaagaattgggatatacaattgtgtcaactggaggaacagcatctgctttggaaaaagctggaatttccgtaacaaaagtagaagagcttaccaagtttcctgaaatgcttgatggtcgtgtaaaaactttacatcctagtgtacatggagggattcttgccaaaagagaccaaagccatcacatggaagctctagaaaagcacagtattagtacatttgaactggtggtggtaaatttataccccttttatgaaaaagttacttctaccgatggagttctatttgatgatgggattgagaacattgatatcggtgggcctacaatgatacgagctgcagcaaagaatcacaaggatgtgttggtagtcgttgattctcaagactaccctttacttctagaattcctcaaaggaaacaaggatgaccaacattttagaaggaaactagcatggaaagctttccaacatgttgctgcatacgattctgcagtttctgagtggttgtggaagcagactgaaggagataaatttccacctagcttcacagtgccactttcactgaagagttcacttcgatatggagaaaatcctcaccagaaggctgcattttacactgatagcagcttgtctgaagttaatggtggtggaattgcaacagctattcaacaccatggaaaggagatgtcatataacaattatttagacgctgatgcagcatggaattgtgtttgtgaatttgaaaacccaacttgtgttgttgtaaagcacacaaacccgtgtggggtagcttctcgtgatgatctaattgaagcatatagattagctgtaaaagctgatcctgtgagtgcatttggtggtatagtagcctttaacaaagaagtcgatgaggcacttgctagggatatccgcgaattcagaagcccaacagacggtgaaacacggatgttttatgagattgttgttgctcccagttatagcgaaaagggtcttgaaattcttcgtggaaagtcaaagacactgagaattcttgaagcaaagaaaaatagtagaggaaagttatcacttagacaagtaggcgggggttggctagctcaagatgcagatgatttgacaccagaagaaataaaatttgatgtagtttctgaaaaatcaccccaagaaagcgagcttaatgatgcaaagtttgcatggttgtgtgtgaaacacgttaagagcaacgccattgtaatcgcgaagaataactgtatgttaggaatgggaagtggacaaccaaaccgtgtggacagtttgagaatagctttgaggaaagctggagatgaggtgaaaggagctgctttggctagtgatgcatttttcccatttgcctggaaggatgcagttgaggaagcatgtgaaagtgggattggtgtgatagcagagccaggcggaagcataagagacgctgatgcaattgattgttgtaacaagtataacgtttcgcttttgtttaccggcgtgaggcatttccgacactaagtgaagtcggtgtagttttctagatttggggattttcaaaaccctgtgtcataagagctgttctgaactccacatctttgatgaaccttgtgagagaaaatgtaccatcctaataagcttttatgtttaagggtataatttagtcattcaaatatgataataattagttgcttttgttttgatttggtagctattataagttatagctacattttatgtcaaaaaagaa

SEQ ID NO: 6273 - DNA, 2090 bp, Flaveria ramosissima
ctctgaaacacaaaaccctcacgaagatgctgaggttcagagctccgttcaccaccgtcacctcttcaacccctgctatcgtccgtacgtctccggcgaccactttcaacttcccctcaactgattatcagttctccgattcactgacaaacacatttctgctttcaccagaatataaattgtacacgaagattgaattgctatcggagtaaggcaacggcggaagctgctgaaaccatggctgctgctaacgcatcttctctgcaagcaagcatgctttgatttcgttatcagacaagaaggacttggatcttcttgccgctggacttcaggaattgggatatacaattgtgtcaactggaggaacagcatccgctttggaaaaagctggaatttctgtaacaaaagtagaagaactcactaagttccctgaaatgcttgatggtcgggtaaaaactttacatcctaatgtacatggaggtattcttgccagaagagaccaaagccatcacatggaagctccagaaaagcacaatatcagtacatttgaactggtggtagttaatttatatcccttctatgaaaaagtcacttctagcaatggagttacatttgaagatgggatcgagaacattgatatcggtggccctacaatgataagagctgcagcaaagaatcacaaggatgtgctggtagttgttgattctcaagactaccctatgcttcttgaattcctcaaaggaaagaaggatgaccaacaatttagaaggaaacttgcatggaaagctttccaacatgtcgctgcgtatgattctgcagtttccgagtggctgtggaagcagactgaaggagataaattcccacctagctttacggtgccactttcattaaagagttcacttcgatatggagaaaatcctcatcagaaggctgcattttacaccgacagcagcttgtcagaagttaatggtggtggtattgcaacagctatccaacaccatgggaaggagatgtcatataacaattatttagacgctgatgcagcttggaattgtgtttgtgaatttgaaaaccccacttgtgttgttgtaaagcatacaaacccttgtggggtagcttctcgtgatgatctaattgaagcatatagattagctgtgaaagccgatcccgtgagtgcatttggtggtatagtagcattcaacaaagaagtcgatgaggcacttgctaaggatatcagagaattcagaagcccaacagatggtgaaacccgaatgttttatgagattgttgttgctcccagttacaccgaaaagggtcttgaaatccttcgtgggaagtcaaagacactgagaattcttgaagcaaagaaaaacagcagaggaaagttatcacttagacaagtaggcgggggttggttagcgcaggattcagatgatttaacaccagaagaaatcaaattcgatgtagtttctacaaaagcaccagaacaaaacgagcttaatgatgccaagtttgcatggttgtgtgtgaaacacgttaagagcaatgccattgtaatcgcaaagaataactgtatgttaggaatgggaagtggacaaccgaatcgtgtggatagtttgagaatagctttgaagaaagctggagatgaggtcaaaggggctgctttggccagtgatgcatttttcccatttgcatggaaagatgcagttgaggaagcatgtgaaagtgggattggtgtgattgctgagcctggtggtagcataagagacggtgacgcgatagattgttgcaacaaatataatgtatcgcttttgtttactggtgtgaggcatttccgacactaagactcgctcaaaagtagcgttgtgttttgagaattttcaagcttgaggatttataacccggtgttttatctaaactccatgtgtgattttaacttatgaagatgtaccatcataatgagatcaaacctgaactcagtcataaggaaatcaaacgtggtagataaagatttaatggcaggagagttataacctgcttactttgttattcgagttacaattggttaataatgttttgactcgcttgtt

SEQ ID NO: 6274 - DNA, 2524 bp, Eucalyptus grandis
aagcaaaacacaacagtcagcacagcagagtaaagcatgttgggttctcccgccgcctccgcctccgcctccacctcctccacctcctcctccgccgccgccgccgcctcctcccgaagctctctgcttcactccacctccactcaccggaccagaactcgcctttctacctctcacccggtacctgtggtctgtgttcgacttcaatcgtcttcgtcgtggcgcgcggctcctccgattaaagccatggctgccgaggctgagattctatccgcacccgacaaggagctgcgcccttctgctcctcggggcaagcaggcattgatatctttgtctgataaaactgatttggcttttcttggaaagggcctccaggaattggggtatactgttgtctcaactggaggaaccgcatctgctctggaaaatgctgggttgtctgttaccaaagtggaacagcttacttgcttccctgagatgctggatggtcgcgtaaagaccttgcatccccatattcatggaggaatccttgctaggagagatcaacagcatcacatggaggctcttaataaacatggaattggtacttttgatgtagtggtggttaatttgtatcctttctatgacaaagttacctctgcggctgatattgaatttgaagatggaattgagaatgttgatattggtggtcctgccatgatcagagctgctgcaaagaatcataaggatgtccttgttgtggttgattcacatgactaccctgcactgctggagttcctgaagagtgatggagatgatcaacagttccgtagaaaacttgcttggaaggcctttgaacatgttgcttcctatgattctgcagtgtcagagtggctttggagacaaacaactggagagaaattccctcccagcttaacagtgcctctatctcttaaaagttctcttcgttatggtgaaaatccccaccagaaggctgcattttatgtggataagagccttgctgaggttaatggaggtggtattgcgactgcaatccaacatcatggaaaggaaatgtcgtacaataattatctggatgcagatgctgcatggaattgtgtatctgagtttagcgaccctacatgtgtcgtcgtaaagcacacaaatccttgtggggtggcttcccgcagcgatattcttgaagcatacagattagcagtcaaagcggatccagtcagtgcatttggtggtatagtggccttcaatgtagaaattgatgagaacttggccagggaaatccgggagttcagaagcccaacggatggtgaaactcggatgttctatgagattgtggtggcaccaaagtactcaaagaaggggctagaggttctccgtgggaaatcaaaaacgttgaggatccttgaagcaaaggagaacaagaaagggaagctttcactgagacaggtcggtggggggtggttggctcaggattccgatgatttaactcccgcagacatccagttcaatgcggtctcagggacaactcctcaggaaagtgagcttgaggatgctaagtttgcatggctctgcgttaagcatgtcaagagcaatgccattgtcatagcgaagaacaagtgcatgttgggcatgggaagcggacaaccaaaccgtttggagagtttgaggatagctatgaggaaatcaggagaggaggtcaagggggcagctttggcgagtgatgcattcttcccatttgcttggaacgatgcagtagaagaagcttgtcagagtgggattgctgtcattgcagaacctggcggaagcattagagatcaggacgccatagaatgttgtaacaagtatggcgtctcgcttgttttcactaatgtgaggcacttcagacattgatgctgcactttctcctgctccaatatctcaaggaagatttgctcgcttgttttcactaatgtgaggcacttcagacattgatgctgcacttgacctctgtctcccgctccaatatctcaaggaagatttgcggaaagaaatcccagtgattttgttcttcgctataatgcgagcaatgggtgaatgcgtttagtactaaagatgatctgtatgtgagttttgcagtcgcgcacttgatttatgtgattgcttttggcgctatgaatcagagtcgctgaaatgagcacttgcaaaccttgcgactgttttaactttttgtgttttgaacatgtatcgagactgggggaattaaggcttgcaatggctcgtgaacatgagcattgctgctgagatgatcgacaaagagaaggttttgaaagttggaagaattgatcagattaagcgagagatttcggtcatgagactaattaggcacccgcatgtggtggagcttcacgagctattcaacaaggtgaccaaagggaaactgaaggccgtcgcccagagacactttcgacagctaaattgctgctgtcggttgtcacagccgaggcatctatcaccgtgcctagaaaccagagaatctgttctccgatga

SEQ ID NO: 6275 - DNA, 2042 bp, Arabidopsis thaliana
gagctcaacactacacactgtttcaaaatcagactactatgctcagctcagccgccaccgccacctccgtgagtgctcgctccggcgatattctctgcggcttgtttcgcaaaaaatccgtcgcgccttttcgttttactcagcctgtctatcgtacgtcgctgtgtccaagtttcgttgctgttcgagccatggcagagtctcagactgctcagaggaatcagccgcaatcctcaggctcctctggggagaagcaagctttgatatctctatctgacaagagggacttggcttctcttggcaacggtctgcaagaattgggatacactattgtttctactggaggaactgcctctactttggagaatgctggagtctctgtgaccaaagtggagaagcttactcattttccagaaatgcttgatggccgtgtgaaaactttgcatccaaacatacatggtggtatcctcgctagaagggatgtggagcatcatatggaagctcttaatgagcatgggattggtacatttgatgttgtggttgtcaatttgtacccgttctatgaaaaagttactgctccaggtgggatcagttttgaggatgggattgagaacattgacattggtggccctgctatgattagagcagctgctaagaaccacaaagacgttctcattgttgtcgattcaggagattatcaagctgttttggagtatctcaaaggaggacagagcgaccaacaattccgcagaaaacttgcgtggaaggcctttcagcatgttgctgcatatgattctgcggtttcagaatggctatggaagcagactgaaggaaaagagaagttccctcccagctttacagttccgcttgtacttaagagttctcttcgttacggtgaaaatcctcatcaaaaagctgcattttatgttgataagagccttgctgaagtgaatgccggtggtatcgcaacagcgattcagcatcatggaaaggaaatgtcatacaacaactatcttgatgctgacgctgcatggaactgtgtgtcggaatttgaaaacccaacatgtgtagtcgtgaagcatacaaatccttgtggtgtggcctctcgtgatgatattcttgaggcttaccggctagctgtaaaagctgacccagttagtgcctttggtggcattgtagctttcaatgttgaagttgacgaggttcttgcgagggagatccgagagttcaggagcccaacagacggggaaactagaatgttttatgaaatcgtggttgctccaaagtatactgctaaaggtcttgaagtcctcaaagggaaatcaaaaactttgaggatcctcgaagctaaaaagaatgaccaagggaaactatcgctcagacaggttggtggcggctggttggctcaggactcggacgatttaactccagaagacatcagcttcaattctgtctcagacaaaactccgactgaaagcgaacttgcggatgcaaaatttgcctggctctgcgttaagcatgtcaagagcaatgccattgtgatagcaaagaacaattgtatgctggggatgggaagcggacagccaaaccgagtagagagtctgagaatagctttcaagaaagctggggaggaagctaaaggagctgccttggccagtgacgcattcttcccattcgcttggaaagatgcggtggaagaggcgtgccagatgggaataggagtgatagcagaacctggaggcagtattagagaccaagacgctattgattgctgcaaaaagtatggagtctctctgctcttcaccaacgttagacatttccgccattaaggacacatccctccagttttgctcttataaacacatccaagagagtttctgaagaagaaaacccaccaaacaaaacacaaagagtgggaaataaaactgttgtaacattaatttggattgcgttcgagtttatgtatgattagaacctgagagctgttcctacttataaatttgacatttttcacccaaaatcatatctttctctacatccag

SEQ ID NO: 6276 - DNA, 2122 bp, Brassica napus
aacagatagatatgctcagctccgccgccaccgctaccgcttccgccacctccgtgagtgctcgctctggcgatatcctctacggctacttgcgcaggaaaaccgtcgcgccttttcgctttgctcagcctaagcagcaggtatactgtaagtctctgcgtccaagtttcgttgcggtcagagccatgtcagagtctcagacagctctaaagaaccagccacagtcctcggcttcctctggaaagaagcaagctttgatatctttatctgacaagaaggatttagctactcttggcaacggtcttcaagagttgggatacactattgtttctactggaggaactgcttctactttggagaatgctggagtctctgtcaccaaagtcgagacgcttactcatttccctgaaatgcttgatggccgtgtgaagactttgcacccaaacattcacggtggtatcctcgctagaagagatgtggagcatcacatggaagctcttaatgagcatggcattggtacgtttgatgtggtggttgtcaatttgtatccattctacaacaaagttactgctccaggtgggatcagttttgaggatgggattgagaacatcgacattggtggtcctgctatgattagagctgctgctaagaaccacaaggatgtcctcatcgttgtcgattcagaggattatcaagctgttttggagtatctcaaaggaggtcagaacgaccaacagttccgcagaaaacttgcgtggaaggcctttcagcatgttgctgcttatgattccgccgtctcagaatggctatggaagcagaccgaaggacaagagaagttccctcccagcttcacagttccgctttcacttaaaagctcccttcgctacggtgaaaaccctcatcaaaaggctgcgttttatgttgataagagccttgctgaagtcaacgctggcggtattgccacagccattcagcaccatggcaaggaaatgtcatacaacaactaccttgatgctgacgctgcgtggaactgtgtgtcagaatttgaaaacccaacatgtgtggtcgtgaagcacacaaatccgtgtggtgttgcctctcgcgatgatatcctcgaggcttaccgtttagctgtgaaagctgacccagttagcgcctttggtggtattgtagccttcaatgtcgaagtggacgaggttcttgcgagggagctccgagagttcaggagcccaacagacggggaaactagaatgttttatgaaatcgtggttgctccaaagtacactgctaaaggtcttgaagttctcaaagggaagtcgaaaactctgaggatcctggaggcgaaaaagaatgaccaagggaagctgtctctcagacaagttggtggaggatggttagctcaagactcggatgatataactccagaagacatcagttttaaagccgtctcggataagactccaactgaaagcgagcttgcggatgccaaatttgcctggctttgtgttaagcatgtcaagagcaatgccattgtgatagcaaagaacaactgtatgctggggatgggaagtggacagccaaaccgagtagagagtttgagactagcttttaagaaagctggcgaggaagccaaaggagctgccttggccagtgacgccttcttcccatttgcttggaaagatgcggtagaagaggcgtgtgagaaaggaataggagcaatagcagagcctggaggtagtattagagaccaagacgccattgattgctgcaacaagtatggtgtctctctgctcttcaccaacgttagacatttccgccattgatgatgaatccaaaagagattttgaaagagtttgtgtctggggctctaggcaagaacaacacccactaaaataaaaagcaagagttgagaaatgttgtaactttaatatgaaagcgtttgactttgtgtatgattagcacctgagagatgtttcaacgaataaatttggcatttttctactcaaagatcatatttttatgaacacctggaagcaacatgatgagatgtgtatatatttagtcaactcaaattaaaacgagagagtcaacgacagtggagagagagagagagagaccagag

SEQ ID NO: 6277 - DNA, 2137 bp, Populus trichocarpa
ggcaataccagcctccacaaaaacataactacggaccgcgtactctactactccctgttgcgggcactcataaaccctgagatatgttaagcttgtctgctgctcccaccacagccgcccccgccgctaagctttctcgtgtcccctccgctgcacttcaccaaaaaactacttccgctgcttttttctcccaaaaggttcagctgaactcgctgcgatcgagctgcagtgcaatcaaatccatggctgattctcaaactatttcagtaccgaagaacgagcaacaatcccctgcttctggcaagaagcaagcactgatatctttatcagacaaaaaggacctggcttttctcggtactgggttagaacaattagggtacacgatagtttcaacaggaggaacagcatctgctttggaaggtgctggagtttctgtcactaaagtagaacagcttacccttttccccgaaatgcttgacggtcgtgtgaaaactttacacccccacatacatggtggtattcttgctagaagggaccaaaaacatcatatggaagctctcagtgaacatggaattggtagctttgacgtggtggtggtgaacttgtaccccttttatgataaagttacttcaactggaggaattgagtttgaggatggaattgagaacattgatattggtggccctgccatgatcagagctgctgcaaagaaccataaggatgtcttaattgttgttgataatgaagactaccctggacttctggaatttcttaaaggagatcgggatgaccaacagttccgaagaaagcttgcttggaaggcttttcaacattgtgcttcctatgattctgcagtttcagaatggctatggaaacaaactatgggagataaattccctcccagcttcacagtacctcttgagcttaagagttcgcttcgttatggtgaaaatcctcatcaaaatgctgcattttacgttgacaagagtatttctgaagtaaatgctggtggtattgcaacagctatccaacatcatgggaaggagatgtcatataacaactacttggatgctgatgcagcttggaattgtgtgtcagagtttcagaaccctacatgtgtaattgtaaaacatacaaatccctgtggggtagcttctcggggtgatattcttgaagcttataggttggctgtgaaaggagatccagtgagtgcatttggtggtattgtagcctttaacatagaagttgatgaggcccttgctaaggagattagggagttcagaagcccaacagatggtgaaacccggatgttttatgagattgttgttgctcccaaatatacaaagaagggactcgagatcctccgtggcaaatcgaagacactgaggatcctggaggcaaaaagtaatgagaaaggaaagctttcactaagacaagtcggtggtggatggttagctcaggattcagatgatcttgccccccaagacatccaatttaatgttgtgtctgacaagtctccagcagaaagtgagcttcatgatgcagagtttgcatggctgtgcgcgaagcatgttaagagcaatgccattgtaattgcaaagaataactgtatgctaggcatgggaagcgggcagccaaaccgtttagaaagcttgagaatatccattaggaaagcaggagatgaggtcaagggagctgctttggccagcgacgcattctttccttttgcttggaacgatgcagtggaggaggcatgtgaagctggcattggtgttattgcagagcctggtggtagcatcagggataaggacgcgatagaatgctgcaacaagtatggagtttcactgcttttcaccaatgtgaggcactttaggcactgatgagttactttaagcatttctctcgtcttttttggtcaacactgtgtttcaagcccggtaccgtagtttcaatgttttagcgtatcttctgttgttgagagttcttgcagtttgtcggcagaatgtacaagcaggccaacgtatttttgagattttacaaattaataatatactagtatcgcttttatgctcaagaaagcctccccccctcaaaattggaaaagagtcacaagttacccagataatcaaatattttc

SEQ ID NO: 6278 - DNA, 1994 bp, Ambrosia trifida
aataagcccttcgagtgagacacacactcacaaaaccctgacaacaatgctgctgaggtttggtgctccgttcaccaccgtcacctcctcaaccgccgtaactacccgttcttctccggccataacctttcacttcctctcaactgattctgttagaaacaataacaatttttgttttcaccaggttgtaagctattcatcacgattgaattgcaaggcaacgaaagaagctgctgaatccatggctgcttctaccgcctctccatctgcaagcaagcaggcgttaatttcgttgtcggacaagaaggatctggatcttcttgctactggacttcaagaattgggatatacaattgtgtcaactggaggaacagcatctgctttggaaaaagctggaatttccgtaacaaaagtagaagagcttaccaagtttcctgaaatgcttgatggtcgtgtaaaaactctacatccgagtgtacatggagggattcttgccaaaagagaccaaagccatcacatggaagctctggaaaagcacagtattagtacatttgaactggtggtggtaaatttataccccttttatgaaaaagttacttctaccgatggagttctatttgatgatgggattgagaacattgacattggtggccctacaatgatacgagctgcagcaaagaatcacaaggatgtgttggtagtcgttgattctcaagactaccctttacttctagaattcctcaaaggaaacaaggacgaccaacattttagaaggaaactagcatggaaagctttccaacatgttgctgcatacgattctgcagtttctgagtggttgtggaagcagactgaaggagataaatttccacctagcttcacagtgccactttcaatgaagagttcacttcgatatggagaaaatcctcaccagaaggctgcattttacactgacagcagcttgtctgaagttaatggtggtggaattgcaacagctattcaacaccatggaaaggagatgtcatataacaattatttagacgctgatgcagcatggaattgtgtttgtgaatttgaaaacccaacttgtgttgttgtaaagcacacaaacccgtgtggggtagcttctcgtgatgatctaattgaagcatatagattagctgtaaaagctgatcctgtgagtgcatttggtggtatagtagcctttaacaaagaagtcgatgaggcacttgctagggatatccgtgaattcagaagcccaacagacggtgaaacacggatgttttatgagattgttgttgctcccagttatagtgaaaagggtcttgaaatccttcgtggaaagtcaaagacactgagaattcttgaagcaaagaaaaatagtagaggaaagttatcacttagacaagtaggcgggggttggctagctcaagatgcagatgatttgacaccagaagaaataaaatttgatgtagtttctgaaaaatcaccccaagaaagcgagcttaatgatgcaaagttcgcatggttgtgtgtgaaacacgttaagagcaacgccattgtaattgcgaagaataactgtatgttaggaatgggaagcggacaaccaaaccgtgtggacagtttgagaatagctttgaggaaagctggagatgaggtgaaaggagctgctttggctagtgatgcatttttcccatttgcctggaaggatgcagttgaggaagcatgtgaaagtgggattggtgtgatagcagagccaggcggaagcataagagacgctgatgcaattgattgttgtaacaagtataacgtttcgcttttgttaccggcgtgaggcatttccgacactaagtgaagtcggtgtagttttctagatttgggaattttcaaaaccctgcgtcataagagctgttctgaactccacatctttgatgaaccttgtgagagaaaatgtaccatcataataagcttttatgtttaatgatataatttagtca

SEQ ID NO: 6279 - DNA, 1753 bp, Ambrosia trifida
tccgactatcttttcacttccctctcaaccgattctgttagaaacaataacaaacttagttttctaccaggttgtaagctattcatcacgattgaattgcaaggcaacgaaagaagctgctgaatccatggctgcctctaccgcctctccatctgcaagcaagcaggcgttaatttcgttgtcggacaagaaggatctggatcttcttgctactggacttcaagaattgggatatacaattgtgtcaactggaggaacagcatctgctttggaaaaagctggaatttccgtaacaaaagtagaagagcttaccaagtttcctgaaatgcttgatggtcgtgtaaaaactttacatcctagtgtacatggagggattcttgccaaaagagaccaaagccatcacatggaagctctagaaaagcacagtattagtacatttgaactggtggtggtaaatttatatcccttttatgaaaaagttacttctaccgatggagttctatttgatgatgggattgagaacattgatatcggtggccctacaatgatacgagctgcagcaaagaatcacaaggatgtgttggtagtcgttgattctcaggactaccctttacttctagaattcctcaaaggaaacaaggacgaccaacattttagaaggaaactagcatggaaagctttccaacatgttgctgcatacgattctgcagtttctgagtggttgtggaagcagactgaaggagataaatttccacctagcttcacagtgccactttcactgaagagttcacttcggtatggagaaaatcctcaccagaaggctgcattttacactgacagcagcttgtctgaagttaatggtggtggaattgcaacagctattcaacaccatggaaaggagatgtcatataacaattatttagacgctgatgcagcttggaattgtgtttgtgaatttgaaaacccaacttgtgttgttgtaaagcacacaaacccttgtggggtagcttctcgtgatgatctaattgaagcatatagattagctgtaaaagctgatcccgtgagtgcatttggtggtatagtagccttcaacaaagaagttgatgaggcacttgctagggacatccgcgaattcagaagcccaacagacggtgaaacacggatgttttatgagattgttgttgctcccagttatagcgaaaagggtcttgaaatccttcgtggaaaatcaaagacactgagaattcttgaagcaaagaaaaatagtaggggaaagttatcacttagacaagtaggcgggggttggctagctcaggacgcagatgatttgacaccagaagaaattaaatttgatgtagtttctggaaaatcaccagaagcaagcgagcttaatgatgcaaagtttgcatggttgtgtgtgaaacacgttaaaagcaatgccattgtaattgcgaagaataactgtatgttaggaatgggaagtggacaaccaaaccgtgtggacagtttgagaatagctttgaggaaagctggagatgaggtgaaaggcgctgctttggctagtgatgcatttttcccatttgcctggaaggatgcagttgaggaggcatgtgaaagtgggattggtgtgatagcagagccaggcggaagcataagagacgctgatgcaatcgattgttgcaacaagtataacgtttcgcttttgtttaccggcgtgaggcatttccgacactaagtgaagtcggtgtagttt

SEQ ID NO: 6280 - DNA, 2136 bp, Citrus sinensis
  misc_feature (45)..(46): n is a, c, g, or t
  misc_feature (1044)..(1044): n is a, c, g, or t
  misc_feature (1053)..(1053): n is a, c, g, or t
  misc_feature (1062)..(1063): n is a, c, g, or t
  misc_feature (1075)..(1075): n is a, c, g, or t
  misc_feature (1077)..(1078): n is a, c, g, or t
  misc_feature (1099)..(1099): n is a, c, g, or t
  misc_feature (1105)..(1105): n is a, c, g, or t
  misc_feature (1245)..(1245): n is a, c, g, or t
  misc_feature (1354)..(1354): n is a, c, g, or t
  misc_feature (1417)..(1417): n is a, c, g, or t
  misc_feature (1605)..(1605): n is a, c, g, or t
  misc_feature (1653)..(1653): n is a, c, g, or t
  misc_feature (1737)..(1737): n is a, c, g, or t
  misc_feature (1769)..(1769): n is a, c, g, or t
  misc_feature (1860)..(1860): n is a, c, g, or t
  misc_feature (2012)..(2012): n is a, c, g, or t
  misc_feature (2035)..(2035): n is a, c, g, or t
  misc_feature (2043)..(2043): n is a, c, g, or t
  misc_feature (2051)..(2051): n is a, c, g, or t
  misc_feature (2064)..(2064): n is a, c, g, or t
  misc_feature (2071)..(2071): n is a, c, g, or t
acatttaccgccgctggagtcaagtgaacttattatatacttgannattatatttttgcaatcggcaaatagagagactgagagatgattaggctgtccgccgccgcccccgccagcatagctgctcaaccgccgtactctaacatcctctacactcttctcaacaaaaagcgaattccaatcttctgcgttcgcgtccacactacctctctgcgcttcagttactctcctatcagagccatggcccactctcacaccgtttctgttccaaccaatcaaccccagtcctcctcctcctctcaagcgaataagcaggcattgatttctttgtcggataaaaaggatttggcatctcttggaattgggttacaagaactggggtacacaattgtttccactggaggaacagctacttctctagaaaatgctggggtgtctgtgactaaagtggagcagctcacctgtttcccggaaatgctggatggccgtgtaaaaactttgcaccccaacattcatggaggtattcttgccagaagagaccaaaagcatcatatggatgctctcagtgagcatggaattggtacatttgatttagtagtagtgaacttgtaccccttctatgataaagttacttctgctggagggattgattttgaggatggaattgagaacattgatattgggggccctgccatgatcagagctgctgcaaagaaccacaaggatgtgctggttgtagttgactcggaagattatcctgccctcctagaatttcttaaaggaaaccaggatgatcaacagtttcgtagaaaacttgcttggaaagcgtttcaacatgttgcttcatatgattctgcagtgtcagagtggctgtggaaacagactgctggagaagataaattccctcctagcttcacagtgcctcttgaactcaaaagttctcttcgttatggtgaaaatcctcaccagaaggctgcattttatgttgataagagtcttgccgaggttaatgctggtggtattgctacagctattcagcaccangggaagganatgtcatannacaactatttanannctgatgcagcttggaattgcntatcanagtttaaaaaccctacttgtgtaattgtaaagcatacaaatccctgtggggtagcttcacgtgatgatatccttgaagcatataagctggccgtgaaagcagatccagttagtgcatttggtggtattgtggccttcaangtggaagttgacgaggctcttgctaaagaactccgagagtataggagtccaacagatggtgaaactcggatgttttacgagatcgtagttgctcccagctatacagagnaggggcttgagattcttcgaggtaaatcaaagaatcttaggatccttgagacaaaaaagaacnaaaagggaaagctctccctcagacaagttggcggtggctggttagctcaggattcagatgatttaactcctgaagatatccaattcaaagtggtttctgagaaaaagccgcaagaaagtgagcttcatgatgctgaatttgcatggctgtgtgtgaaacatgtcaagagcaatgccattgtaatagcnaagaataactgcatgctgggtatgggaagtgggcagccaaatcgtcgngagagtttgagaatagctatgaaaaaggcaggagatgaagttaaaggagctgctttggccagtgatgcattctttccatttgcntggaaagatgccgtggaagaggcatgtgaaantgggattggagtaattgcagagcctggtgggagcattagagatggagatgccatagactgctgtaacaagtacggggttgctctgctcctnactagtgtcaggcatttcaggcattgacgaagatgacttgcgggagtttttcttattgtgttttctggttttgtcctgtgctgcaatcatagcaccattgccattgagttctggtatttcatactttcataggatgtttagatctcttgcangcatagaagccttttgggttgcntggaagantgcataancatatcatcatgntgtgccntacacatttatatattttggagaaccagatattttgtattattattcaaattttgttcgcctgat

SEQ ID NO: 6281 - DNA, 2071 bp, Brassica napus
aacagatagatatgctcagctccgccgccaccgctaccgctaccgccacctccgtgagtgctcgctctggcgatattctccacggctacttgcgcaggaaaatcgtcgcgccttttcgctttgctcagactaagcagcaggtatactgtaagtctctgcgtcctagtttcgttgcggtccgagccatgtcagagtctcagacagctctaaagaaccagccacagtcctcggcctcctctggaaagaagcaagctttgatatctttatctgacaagaaggatttagctactcttggcaacggtcttcaagagttgggatacactattgtttctactggaggaactgcttctactttggagaatgctggagtctctgtcaccaaagtcgagacgcttactcatttccctgaaatgcttgatggccgtgtgaagactttgcacccaaacattcacggtggtatcctcgctagaagagatgtggagcatcacatggaagctcttaatgagcatggcattggtacgtttgatgtggtggttgtcaatttgtatccattctacaacaaagttactgctccaggtgggatcagttttgaggatgggattgagaacatcgacattggtggtcctgctatgattagagctgctgctaagaaccacaaggatgtcctcatcgttgtcgattcagaggattatcaagctgttttggagtatctcaaaggaggtcagaacgaccaacagttccgcagaaaacttgcgtggaaggcctttcagcacgttgctgcctatgattctgccgtctcagaatggctatggaagcagaccgaaggacaagagaagttccctcccagcttcacagttccgctttcacttaaaagctcccttcgctacggtgaaaaccctcatcaaaaggctgcgttttatgttgataagagccttgctgaagtcaacgctggcggtattgccacagccattcagcaccatggcaaggaaatgtcatacaacaactaccttgatgctgacgctgcgtggaactgtgtgtcagaatttgaaaacccaacatgtgtggtcgtgaagcacacaaatccgtgtggtgttgcctctcgcgatgatatcctcgaggcttaccgtttagctgtgaaagctgacccagttagcgcctttggtggtattgtagccttcaatgtcgaagtggacgaggttcttgcgagggagctccgagagttcaggagcccaacagacggggaaactagaatgttttatgaaatcgtggttgctccaaagtacactgctaaaggtcttgaagttctcaaagggaagtcgaaaattctgaggatcctggaggcgaaaaagaatgaccaagggaagctgtctctcagacaagttggtggaggatggttagctcaagactcggatgatataactccagaagacatcagttttaaagcggtctcggataagactccaactgaaagcgagcttgcggatgccaaattcgcttggctttgcgttaagcatgtcaagagcaatgccattgtgatagcaaagaacaactgtatgctggggatgggaagtggacagccaaaccgagtagagagtttgagactagcttttaagaaagctggcgaggaagccaaaggagctgccttggccagtgacgccttcttcccatttgcttggaaagatgcggtagaagaggcgtgtgagaaaggaataggagcgatagcagagcctggaggtagtataagagaccaagatgctattgattgctgcaacaagtatggtgtctctctgctcttcaccaacgttagacatttccgccattgatgatgaatccaaaagagattttgaaagagtttgtgtctggggctctaggcaagaacaacacccactaaaataaaaagcaagagttgagaaatgttgtaactttaatatgaaagcgtttgactttgtgtatgattagcacctgagagatgtttcaacgaataaatttggctatttttctacttcaaagatcatatttttatgaacaaaaaaaaaaaaaaaaaactcgagactagttctcactaatcaac

SEQ ID NO: 6282 - DNA, 2007 bp, Helianthus annuus
cacgcacacaatcaccatcatcatcactcgatttcaagcaaaaccagatgctgaggtttggagctccgttacctaccgttacctcctcaaccgccgttatcagccgcacatctccggcgataacttttcacttccggtcaaccgacgccgcttctcttcaaaacagcaatttttgctttcaacaggttgtaagccattcatcgcgagtgaattgttatcgaaataaggcaacggcggaagctgctgaaacaatggctggttctgtagcatctccgtctgcaagcaagcaagcgttaatttcgttgtcagacaagaaggatctggatcttcttgccactggacttcaagaattgggatatacaattgtgtcaaccggaggaacagcatctgctttggaaaaagctggaatttctgtaacaaaagtagaagaactcaccaagtttcctgaaatgcttgatggtcgtgtaaaaactttacatcctagtgtacatggagggatccttgccaaaagagaccaaagccatcacatggaagctctagaaaaacacagtattagtacatttgaactagtggtggtaaatttatatcccttttatgaaaaagttacttctaccgatggagttgtatttgatgatggtatcgagaacattgatatcggtggccctacgatgataagagctgcggcaaagaatcacaaggatgtgttggtagttgtcgactctcaagattaccctttacttctagaattccttaaaggaaacaaagatgaccaacattttagaaggaaacttgcatggaaagctttccaacatgttgccgcttatgattctgcagtttccgagtggctgtggaagcaaaccgaaggagataaatttccacctagctttacggtgccactttcactaaagagttcacttcgatacggagaaaatcctcatcagaaggctgcattttacactgacagcagcttgtcagaggttaatggtggcggtattgcaacagctattcaacaccatgggaaggagatgtcatataacaattacttagacgctgatgcagcttggaattgtgtttgtgaatttgaaaaccccacctgtgttgttgtaaagcacacaaacccttgtggggtagcgtctcgtgatgatctaattgaagcttatagattagctgtaaaagccgatcctgtcagtgcgtttggtggtatagtagccttcaacaaagaagtcgatgaggcacttgctagggatatccgagaatttagaagcccgacagacggtgaaacacggatgttttatgagattgttgttgctcctagttatagcgaaaagggccttgaaatccttcgtggcaagtcaaagacgttgagaattctcgaagcgaagaaaaatagtagaggaaacttatcacttagacaagtaggcgggggttggctagctcaggatgcagatgatttgacgccagaagaaattaaattcgatctagtttctgaaaaatcaccagaagaaagcgcgcttaacgatgcaaagtttgcatggttgtgcgtcaaacatgttaaaagcaatgccattgtaatcgcaaagaataactgtatgttaggaatgggaagtggacaaccgaaccgtgtggatagtttgagaatagcgttgaggaaagctggagaagaggtgaaaggagccgctctggctagtgatgcgtttttcccatttgcatggaaagatgcagttgaggaagcatgtgaaagtgggatcggcgtgattgcagagccaggtggaagcataagagacgctgatgcaatcgattgttgtaacaaatataacgtttcgcttttgtttactggtgtgaggcatttccgacactaagtcgtgtatttgctagtttttttttttttggtcaaagccaggtgtctcaagtataagagcttttatgaactcaacatctttgatgaaccttgtgagagaatgtaccatcataataattgctttgttttgatttggtagctattataac

SEQ ID NO: 6283 - DNA, 2184 bp, Mimulus guttatus
aaaataggatttggtggaaaaaataggaaaatggtggaccggtgggagatgaaaattccttcaccaaaaaatttgtcggcgtcaccagccctccgccgccacggaaaacacacttacaccgccagaagctatcagccggaactttgtcgccgtgtccttcgttccggttccactaaccccgttccggcctctacagcggcgttccggcgaaccatgcccgccgtcgcttccctagcttcgaccaccgccgccgccatcaccacctactcaatcgttagctccgctcacccgtcctgcgctaactgtacctgcgccgccacctccattgctcttcaccccagaattctctctgcggccaaaaaattgccgttgacgacgttgcataagttaactgcgtttcgagttaaagccatggcagaaattccttcaactccgcggttagagtccaacgcatcattggccgggaagaagcaagctttgatttcattgtcagacaagagagacttggttttgcttggcaatggattacatgaactcggattcacaattatttcaacgggaggaacagcttcttctttggaaagttctggcgtgcctgttaccaaggtggaggaactcactcattttccggaaatgcttgatggccgtgtaaaaactttacatccgaacgtgcatggaggtattcttgcgagaagagatcaacagcatcacatgaaagcccttgatgatcatgggattggtacatttgatgtggtagtggttaacttgtaccccttctatgagaaggtttcctcttctagtgggatttcttttgaggatgcgatcgagaacatcgacattggtggacctaccatgatcagagctgccgcaaagaaccataaagatgttttggttgtagtggactcgaatgattatccagcactcttagaatatctcaaaggaggacagaatgaccaggagttccggaagtggctggcttggaaggcttttgatcacgttgcttcttatgattccgcagtttccgagtggttgtggaagcagaccagtaaagataagtttccacccagcctgacggtacctttgtctctcaagagttcacttcggtatggtgaaaatcctcatcagaaggctgcgttttacgttgataagtctcttgaggaggtcaatggtggtggctgcgcgactgccattcagcaccatggaaaggagatgtcgtataataattatctagatgcggatgcagcttggaactgcgtgtgtgagtttagtaagccgacctgtgtggttgtgaagcacacaaatccttgtggggtagcatcgcgcgacgatattatcgaagcgtacaggcttgcagtgaaagcagatccagtcagtgctttcggtggcatcgttgccttcaatgttgaagttgatgaggctcttgcgaaagatattagggagtttaggagtccaacggacggtgaaactcgtatgttttacgagattgtcgttgctcccagttataccaagaaggggctcgaaatactccgagggaagtcgaaaacattgagaatactcgaggcgactaagaataaacgagggaagctctcactgagacaagttggtggtgggtggctagctcaggaggcagatgatttgaccccggaagatatcgagttcaacgtcgtttccggaaagtctccacaagaaaacgaacttagtgacgcaaaatttgcatggctctgcgtaaagcacgtgaaaagcaatgccattgttattgccaagaacaattgcatgttgggtatgggaagcgggcaaccgaatcggctcgagagtttgagaatagcaacgaagaaagcaggggatgaaatcaagggagctgcattagccagcgatgccttcttcccatttgcgtggaatgatgcggttgaagaagcatgtaaaagtggggtgggtgttattgccgagcctgggggaagcataagggatgctgatgcagtcgactgctgtaataagtatggagtttcgctcgttttcactaatgattgtcgtgtacggtggttagaaattttaagagttgtgttgatacttgattatattataggattgacagagttagataaggattgttcacgcagattggaccagataattgaaataactatccgcggtcgtggagttcatgtgtctgatcccggtcgatag

SEQ ID NO: 6284 - DNA, 2144 bp, Solanum lycopersicum
aaaggctataggtaagtgttgccactctcttctcctcttcatccaaaaatccaaattaaaacccagatagtctttttttaaaaccccccaaaaaagtgaacaaaaacaatgttatcggcctcttccgccgccaccacgccggccaccgccattgccgccaaagctttccgcactcaaattccgcagctccacaccatccgaacaagaactgatcattgtttcggcccacaacagttctcgaagacgtcgtataggttgattgttcatccagtgaaagctatggctgaaactgtagctactcctcagtcttctcccaagctgtcaacttcagggaggaagcaagcattgatatcactttcagataagacagacttggctaagcttggcaatgggctgcaggagttggggtacacaattgtttcaacgggaggcactgcatctgctttggaaggtgctggtgtgtctgtcaccaaagtggaagagctgactcgtttccctgaaatgcttgatggccgtgtaaaaactttgcatccaggcattcatggaggtatccttgctagaagagatcaggagcatcacatggaagctcttgaaaaacatgaaattggtacatttgatgttgtagtggtcaatttgtatcccttttatgccaaggtttcttcttcaagtggcatttcatttgaagatggaattgaaaacatcgatattggtggacctgccatgattagggctgctgcaaagaatcatagggatgttttggtcgtagttgattctgaagattacccagatcttttggagttccttcgtggagataatgatgatcaacaatttcgaaggaagttggcctggaaagcttttcaacatgttgcttcatatgattctgcagtttcagaatggctgtggaaacagactgttggagataagttccctcccagcctgacagtgccgctctctctaaaagaccaacttcgatatggtgaaaatcctcatcagaaggctgcagtttatgtggacaagtctctgtctgaggttaacgctggtggaattgcaactgttatccaacaccatggcaaggagatgtcatataacaactacctggacgctgatgcagcttggaattgtgtctgtgattttaatcaaccaacttgtgttgttgtgaagcatacaaatccttgtggagttgcatcacggaatgatatcattgaagcatataggctagctgtgaaagcagatccagttagtgcatttggtggtatagtagccttcaatgtcgaagttgatgaggctcttgcaaaggatattagagaatttagaagccccacagatggtgagactaggatgttttatgaaatagtagtcgcaccaaaatacacagagaagggtcttgaggttctccgtgggaagtctaagactttgagaatccttgaggcaagtaaaaacaacaagggcaagctttctctcagacaaattggtggtggttggttagcccaggattcagatgatttgaccccggaagatatccaattcaatgtcatgtctgacaaaactccacaagaaaatgagcttatcgatgcacagtttgcttggttatgtgtcaagcatgtcaagagcaatgccattgtaattgcaaagaacaattgtatgttaggaatggggagtggacaaccaaatcgtctagaaagtttgaggattgctatgaggaaagctggagatgaagtaaaaggagctgctttggcaagtgatgctttcttcccatttgcatggaatgatgctgttgaagaagcgtgtcaaagcggagtaagcgttattgcagaaccaggagggagcataagggacaaagatgcagtggagtgttgtaacaagtatggagtctcacttgttttcaccaacgtgaggcacttcaggcattagatgttttgtagggtattactaaactccttatttactatttttaccaaatgtttttgatctctaacattaatctttaatatttttgaggaattatcttttatctagtagttttgagcgtgtattataggaaaaatgttgttgtatcagaaattttacttttgatgctctaagtttattcaaactagagcaataggaatatctttctcaggctttatgtctgaacgtttttatag

SEQ ID NO: 6285 - DNA, 2144 bp, Solanum lycopersicum
aaaggctataggtaagtgttgccactctcttctcctcttcatccaaaaatccaaattaaaacccagatagtctttttttaaaaccccccaaaaaagtgaacaaaaacaatgttatcggcctcttccgccgccaccacgccggccaccgccattgccgccaaagctttccgcactcaaattccgcagctccacaccatccgaacaagaactgatcattgtttcggcccacaacagttctcgaagacgtcgtataggttgattgttcatccagtgaaagctatggctgaaactgtagctactcctcagtctgctcccaagctgtcaacttcagggaggaagcaagcattgatatcactttcagataagacagacttggctaagcttggcaatgggctgcaggagttggggtacacaattgtttcaacgggaggcactgcatctgctttggaaggtgctggtgtgtctgtcaccaaagtggaagagctgactcgtttccctgaaatgcttgatggccgtgtaaaaactttgcatccaggcattcatggaggtatccttgctagaagagatcaggagcatcacatggaagctcttgaaaaacatgaaattggtacatttgatgttgtagtggtcaatttgtatcccttttatgccaaggtttcttcttcaagtggcatttcatttgaagatggaattgaaaacatcgatattggtggacctgccatgattagggctgctgcaaagaatcatagggatgttttggtcgtagttgattctgaagattacccagatcttttggagttccttcgtggagataatgatgatcaacaatttcgaaggaagttggcctggaaagcttttcaacatgttgcttcatatgattctgcagtttcagaatggctgtggaaacagactgttggagataagttccctcccagcctgacagtgccgctctctctaaaagaccaacttcgatatggtgaaaatcctcatcagaaggctgcagtttatgtggacaagtctctgtctgaggttaacgctggtggaattgcaactgttatccaacaccatggcaaggagatgtcatataacaactacctggacgctgatgcagcttggaattgtgtctgtgattttaatcaaccaacttgtgttgttgtgaagcatacaaatccttgtggagttgcatcacggaatgatatcattgaagcatataggctagctgtgaaagcagatccagttagtgcatttggtggtatagtagccttcaatgtcgaagttgatgaggctcttgcaaaggatattagagaatttagaagccccacagatggtgagactaggatgttttatgaaatagtagtcgcaccaaaatacacagagaagggtcttgaggttctccgtgggaagtctaagactttgagaatccttgaggcaagtaaaaacaacaagggcaagctttctctcagacaaattggtggtggttggttagcccaggattcagatgatttgaccccggaagatatccaattcaatgtcatgtctgacaaaactccacaagaaaatgagcttatcgatgcacagtttgcttggttatgtgtcaagcatgtcaagagcaatgccattgtaattgcaaagaacaattgtatgttaggaatggggagtggacaaccaaatcgtctagaaagtttgaggattgctatgaggaaagctggagatgaagtaaaaggagctgctttggcaagtgatgctttcttcccatttgcatggaatgatgctgttgaagaagcgtgtcaaagcggagtaagcgttattgcagaaccaggagggagcataagggacaaagatgcagtggagtgttgtaacaagtatggagtctcacttgttttcaccaacgtgaggcacttcaggcattagatgttttgtagggtattactaaactccttatttactatttttaccaaatgtttttgatctctaacattaatctttgatatttttgaggaattatcttttatctagtagttttgagcgtgtattataggaaaaatgttgttgtatcagaaattttacttttgatgctctaagtttattcaaactagagcaataggaatatctttctcaggctttatgtctgaacgtttttatag

SEQ ID NO: 6286 - DNA, 1972 bp, Artemisia annua
accaccgccgccgccgtactccgccgtacatctccggcaacttcatctcaacttccgttcacatcatcccccctcttctccaccagcttctcatttcaacagattgaaggatattcggttcgattgaattgttatcgaaataaggccatggctgaaactgttgcttcttctgctggttcagtcacttctccatctggaagcaagaatgcgttaatttcattgtcggacaagaagaatttggaccttcttgcggccggacttcaagaattagggtacacaattgtgtccaccggaggaacagcatccgctcttgagaaagctggaatctctgtaacaaaagttgaagagcttaccaatttccctgaaatgcttgatggtcgtgtaaaaacattacatcccaatgtacatggcggcattctcgctagaagagaccaaagccatcacatggaagctttagagaaacacagtattggtacatttgaactggtcattgtaaatttatatcccttctatgcaaaagtttcttctgccaatggagttacatttgatgatggaattgagaacatcgacattggcggccctacaatgatcagagcggcagcaaagaaccacaaggatgtcttggttgtagttgattcagaagactatcctgtacttctagaattcctgaaaggaaacaaggatgaccaacaatttcgaagaaagctggcatggaaagctttccaacattgtgctgcttacgattctgcagtttctgaatggttgtggaagcagaccgaaggagataaattttcaccaagctttactgtgccactcactctcaagagttcacttcgctatggtgaaaatccccatcagaaggctgcattttacactgacagtagcttgtctgaagttaatggtggtggtattgctacagctattcaacaccatggaaaggaaatgtcatataataattatttggatgctgatgcagcttggaactgtgtttgtgagtttgaaaaaccaacatgtgttgttgtaaagcacacaaatccttgtggggtagcttcacgtgatgacctgattgaagcatataggttagctgtaaaagccgacccagtgagtgcatttggtggtattgtagccttcaacacagaagtcgatgaggctcttgcaaaggatatccgtgaattcagaagcccaacagacggtgaaacccggatgttctatgagattgtagttgctcctagctatagcgaaaagggtcttgagatccttcgtggaaagtcaaagactttaagaattcttgaagcaaagaaaaacagcagagggaaactctcacttagacaagtaggtggaggttggttagctcaggattcagatgatctaacaccagaagagattaaatttgatgtaaagtccaagaaggcaccagaagagagtgagcttagtgatgcaaagtttgcatggttgtgtgtgaaacacgtcaagagcaatgccattgtaatcgcaaagaacaactgtatgttaggtatgggaagtgggcagccaaatcgtgtggatagtttgagaatagctgtgaggaaagcaggggatgaggtcaaaggagctgctttggccagtgacgcctttttcccatttgcatggaacgatgcggttgaggaagcatgtcaaagtgggattggtgttattgctgagcccggtggtagtataagggacaacgatgcaattgactgctgtgacaaatataacgtttcattagtcttcactggtgtgaggcacttccgacactgagtatcaagagctaataattcatgtatcctaaattcataaaagcttttggcagttttggtgtttttcttgtataagagctggttttaaactccatgatgttctgaacattgtgaaatatgtaccatcataatgtcttgtaacctttctttgggagaattttctacttttttgtttgttgaaaaatcaagttaaaatt

SEQ ID NO: 6287 - DNA, 2348 bp, Aristolochia fimbriata
cggtctttgcatatttttcgctttctctacggaaatcgctttgtgggtccccggcttgacggcggcatcagtaccactgtgggttttaccggcgagaagcctacgagtgagagaatgtgagataggcgggcggcactgctgtgggtatcgcgcgaaaggggacaagcaggaaaaatgcaatcttttgccgtcgtctcaagcaccgctcaactttattctcgcgcagtcgcacccgctcgtcttcttccccattctctgctccattcgtgtccggcgtcgcaacttaaatctgtcgtctactttcgcgtttcttcgttctctactgggaaaggccctagcttggtgaaggccatggctgaagcggaaacggcagtcgtgactaatactccttcattaggaaaaaaacaagcattgatatcattatcagacaagcaggaccttgctttccttggcaagggacttcaggacttagggtattcaattgtttcaactggagggactgcatcagctttagaatcagctggagttgctgtaacaaaggtggaagaacttacatgctttcctgaaatgcttgatggtcgtgtaaaaacattacatcccaacatacatggaggtattcttgctcggagagatatggatcaccatatggaggctttaaaggaacatggcattgggacgtttgatgttgtggtggtcaacttatacccattctacgacaaagtttcttcaactagtggaatttcgtttgaggatggcattgagaatattgatattggtgggcctgctatgatcagagctgctgctaagaatcatcaagatgtcctaattgttgtggaccccaaagattatcctgcactcttggactttcttcaaggaaagataagtgatggtgaaaggttccggaggcaacttgcttggaaggctttccagcatgttgcatcatatgattctgctgtttctgaatggctctggaagcaatctggaggagagaggtttcctcctgccctaactgtccctttgtcattgaggagttctcttcgatatggtgaaaacccccaccagcaagctgcattttatgttgataaaagtcttgcagaagtaaatgctggcggtattgcaactgccatacaacaccatggaaaggaaatgtcttacaataattatctagatgctgatgctgcttggaactgtgtgtcagagttccagaaacccacttgtgttgttgtaaaacatacaaatccttgtggagttgcctcccgagatgatattcttgaagcttatagactggctgtaaaagctgatcctgtgagtgcctttggcggcatagtggccttcaatgtagaagtagatgaggaccttgcgaaagaaattcgagaatttcgcagtcctacagatggggaaacacgaatgttttatgagatagtggttgcacccaagtatacagagaaaggtcttgaggtcctccgcaaaaaatcaaaaaccttgcggattcttgaggcgaaaaagaacgccactggaaaactttcacttagacaggttggtgggggctggttgctccaggacacggatgatttagtaccacgaaacattgaatttaatgtagtctcagaaaagagtccaggagaaagcgagcttcatgacgcagagtttgcatggctttgtgttaagcatgtgaagagcaatgccattgtattagctaagaataattgtatgctagggatgggtagtgggcagccaaatcgtctggagagtctaagaatagctatgaagaaggcaggagaagaagctaaaggaacagctttggctagtgatgcctttttcccatttgcttggaatgatgcagtagaggaagcatgcaagagtggggtttcagtgattgcggagcctggtggtagtatcagagatggtgatgctgttgactgttgcaacaaatatggggtttctcttctctttaccaatgtgaggcacttcaggcactagaattttgtgtatcattgctctctattgcccacttctgcacttcaaagctgagattggtctgcaggttcagtagccatttcaggagggtaggtgaaaaataaaatgtaattaatgttaaagaggagtgatttggaatttttttgcggcaaataggaaaccatgtagcgggtgattaagttaaaaagtgctaattgagtctttcacaaaataaaaagaaattttgttatttccttctgaaattgtctttcaacttaattcttgccataccatatggtagctacttataccgactcatgaagtttagttctctaatctctatggtcagtatataattatctttataaaaatccttgttaaactcatggacg

SEQ ID NO: 6288 - DNA, 2347 bp, Solanum phureja
aaaggcaataggtaagtgctgcctcttctcctctccatccaaaattccaaattaaaacccagacataattttttttttttaaaattcccaaaaaagtgaataaaaacaatgctatcggcctcttccgccgccaccacgccggccaccgccattgccgccaaagctttccgcacccaaattccgcagctccacaccatccgaacaagaactgatcattatttcggcccacaacagttcgcgaagacatcgtataggttgattgttcatccagtgaaggccatgactgaaactgtagctacgcctcagtctgctcccaagttgtcaacttcagggaggaagcaagcattgatatcactttcagataagacagacttggctaagcttggcaatgggctgcaggagttggggtacacaattgtttcaacgggaggcactgcatccgctttggaatgtgctggggtgtctgtcaccaaagtggaagagctgacgcgtttccctgaaatgcttgatggccgtgtaaaaactttgcatccaggcattcatggaggtattcttgctagaagagatcaggagcatcacatggaagctcttgaaaagcatgaaattggtacatttgatgttgtagtggtcaacttgtatcccttttatgccaaggtttcttcttcaagtggaatttcatttgaggatggaattgaaaacatcgatattggtggacctgccatgattagagctgctgcaaagaatcatagggatgttttggtcgtagttgattctgaagattacccagatcttttggagttccttcgtggcgataatgatgaccaacaatttcgaaggaagttggcctggaaagcttttcaacatgttgcttcatatgattctgcagtttcagagtggctgtggaaacagactgttggagataagttccctcccagcctgacagtgccactctctcttaaagaccaacttcgatatggtgaaaaccctcatcagaaggctgcagtttatgttgacaagtctctgtctgaggttaacgctggtggaattgcaactgttatccaacaccatggcaaggagatgtcatataacaactatctggacaccgatgcagcttggaattgtgtctgtgattttaataaaccaacatgtgttgttgtgaagcatacaaatccttgtggagttgcatcacggaatgatatcattgaagcatataggctagctgtgaaagcagatccagtgagtgcatttggtggtatagtagccttcaatgtcgaagttgatgaggctcttgcaaaggatattcgagaatttagaagccctacagatggtgagactaggatgttttatgaaatagtagtcgcaccaaagtacacagagaagggtcttgaagttctccgtgggaagtctaagactttgagaatccttgaggcaagtaaaaacaacaagggaaaactttctcttaggcaaattggtggtggttggttagctcaggactcagatgatttgaccccggaagatatcccattcaatgtcatgtctgacaaaactccacaagaaaatgagcttaatgatgcacagtttgcttggttatgtgtcaagcatgtcaagagcaatgccatagtaattgcaaagaacaattgtatgttaggaatggggagtggacaaccaaatcgtctagagagtttgaggattgctatgaggaaagctggagatgaagtaaaaggagctgctttggcaagtgatgctttcttcccatttgcatggaatgatgctgttgaagaggcgtgtcaaagcggagtgagcgttattgcagaaccaggagggagtataagggacaaggatgcagtggagtgctgtaacaagtatggagtctcacttgttttcaccaacgtgagacacttcaggcattagatgtttggtagggcatcattaggcgcatcatctattatctttaccaagtttttttgatagctaacattcatctctgatagttttgaggaattctctctgatttaggagtatgagtgtatcataggtaaattgttccttgtatgggaatcgtacttgcttgtctagtaagttttcgaactacttgatgggctaagttatccaaactagagcaatagtaatgtcttcttcaggcttatagtctggtgaacgtttctgaagccacattttcagcccttcaatttcaacaactctcttgtaccatgctagattgaaatcatcatcgtttgtgaaatttatgaatacattgtacctagtgtcatgaactccaatcttcacagagtagaaattgagtttgtagttgaggtctacgcagtggcaagacctatcccagcaattg

SEQ ID NO: 6289 - DNA, 2314 bp, Tropaeolum majus
tccggactccaaataacaatacaagagatgttaggttctgtaagcataaccaccaccactacagccgtcacaccgaacctcaacactctccattccccgcggcctcttcttcatcaaagaatcgtgtcatcatcttctccttctcaggcttcaataggctccgttcagtatcactctacatccctacgctcggattgttgccttgtcagagccatggctcagtctcgagctgttttgagttcagagaatgaacaaaagtcatttgcttctggcaaaaagcaagtcctaatctctttgtcagataagaaggacttggattttcttggcaatggactccagggtttaggatactctattatttccacgggaggaacagctactgctttggaaaatgcgggggtgtctgtgactaaagtggagcagcttacttcttttccagaaatgcttgacggtcgcgtgaaaaccttacacccaaatattcacgggggcattcttgctagaagagaccagaagcatcacattgaagctcttgatgaacatggaattggtaccattgatatagtggtggtgaacttgtaccccttctatcaaaaagtaacctctggagcgatcagctttgaggatggaattgagaatattgatattggtggccctgctatgattagagctgctgcaaagaaccacaaggatgtcttggttgtggtggattcagaagactatcctgcgctgttggaatatcttaaaggaaaccaggaggatcaacagttccgcagaaagcttgcttggaaggcatttcaacatgttgcttcttatgattccgctgtttcggaatggctgtggaaacagactgcaggagaaaataattttcctcccagctttactgtcccacttactcaaaagagttcccttcgttatggtgaaaaccctcatcaaaaggctgcattttaccttgacaaaagtctttccgaagtcaatgctggtggaattgcaacatctattcaacaccatggaaaggagatgtcatataataattacctagatgctgacgctgcatggaactgtgtatcggagtttgaggaccctacatgtgttgttgtgaagcatacaaacccttgtggggtagcttcacgagataacattattgatgcttataggctagctgtgaaagcagatccagtgagtgcatttggagggatcgttgccttcaatgttgaaattgatgagactcttgctaaagatatccgagagtttagaagcccaacagatggtgaaactaggatgttttatgagatcgtggtagctcccagttatacaaagaaggggcttgagatcctacgtggtaaatcaaagaccctaaggattcttgaggcaaagaagaatgagaaggggaagctttcgctcagacaagttggtggcgggtggttggctcaggattccgatgacttaaccccagaagatattgagttcaatgccgtttccaacaaaactttaagtgacagtgaactttgtgatgctaagtttgcttggctatgtgtaaaacatgtcaagagcaacgccattgtaattgcaaagaacaattgcatgttgggtatgggtagcggacaaccaaatcgtttagaaagtttaagaatagcgatgagaaaagcaggggatgaagtcaaaggagctgctctcgccagtgatgcattcttcccatttgcttggaaagatgcagtggaggaagcatgtgaaagtgggattagctccattacagagcccggtggcagcatcagagatcaagatgccatagactgttgtaacaagtatggagtttccctgcttttcaccaaagtaaggcacttcaagcattgattgatttgcgaattatatgcactgaataacctcgttagagagattcgacttagtgctgttatgtcagcaccgggaagtttttatacgccataaattatttagtcaaagaggaatcattgctgtgtgatgaaggtgcgcttaagcacgcaatgtatgttgtgacatcagaattttatcttttcaagttatcaaaagattttgttaaggtatgttatgctgtgtacttggttttctgaacagatatggtatgtacgccagctttaagctaatgatatctgaacagatatggtatgtacaccagctttaagctaatgatcctcctagttaagtcattgttaggcgtggtccgttgcttttgttagattagttagctgacttcacattgagttttaaaaatgatgtttcagttgtattatcgtttgagcattaatgctttgatgagaggagtatttttgataaacct

SEQ ID NO: 6290 - DNA, 2580 bp, Amorphophallus konjac
cggccacctccaggcaaccccgcctccagccggcgctgtgagacgccgtcgttctccgtccgcggccacagcacagcgaacaggctcatcccccacgtcgctctcctgtgtcggtgccgccgtcgctctccagccatcgctgtggtcatcaacccaccgtcgtcgaggtcgcgttgcagtcgccacgcaaccgcaccggcagagctcgccctccaaaaccggaggcgaccgacgaaggacgcgacaaagcagccgctcgccgtgccttcaccctgcgcttgtccaaccggtggctcgcggctggccccagctaccccgcgaacggccttgttcgggcttggccctactcgccccagccgccccgcgaacggctctgttctccggcgggcttggccctccgccccagcctgcgtctcactcccatcacgtccctcctaaaactctcttcggttgcgacaagcagagtgcgcggaggcgagcagtggaagaagatgccgcagtcgctcctgtcttgtccaaccgccgccacgacctccgcaacctctttcgtcttcttgtacccccatcgccgttgttgccatcgcgcctcgctaagaagagctcttctcttgtcccgtgtctcgccgcggctgtgccccaacgcgaccggccaggccagagccatggccaccagcaccaatactcagaaggttggctcccctgtttcgtcaggttataaacaagcattgatttcattgtcagacaaaagagatttagcatttcttggcaacggtcttcaaagtttagggtatacaattgtttcaacaggtggcactgcatctgctttagaaacagctggagtttctgtcgtaaaggtagaagaagttactaattttccagaaatgcttgatggacgtgtgaaaaccttacatcctagcatccacggaggtattcttgctcgaagagaccatgagcaccatatggaagccctaaataggcacagaatcagaacttttgatgtcgtggtagtcaacttataccctttctatgagaaagtatcttctgccagtgatattacatttgaggatgggattgagaacattgacattgggggacctgctatgattcgagctgcagcaaagaatcataaagatgttctggttgttgttgatcacaaggactaccctgcactgttggaatttcttcaaggaaaacaggatcgtcaacacttccgtagagaacttgcatggaaggccttccaacatgttgctgcttatgattcagcagtttcagaatggctatggaaacagtcaggggaaggtgacaaattccccccaaactttactgtacctcttacaaagctatccacacttagatatggtgaaaatccccatcaaaaagctgcattttacgctgataaaagtctttctatagttaatgctggcggcattgctactgccatacaacatcatgggaaggagatgtcatataacaattatttagatgcagatgctgcttggaattgtgtctcagaatttaacagccccacctgtgtgatcgtgaagcatactaatccatgtggagtagcatcaaggacggatatccttgaagcatatagattggctgtaaaagcagatcccatcagtgcatttgggggaatagtagcatttaacacagaagtagatgaggaccttgcaagggaaatccgtgaattcagaagcccagcagatggtgaaacacgaatgttttatgaaatagttgttgcacccaagtacacagaaagaggtcttgaggtgcttcgtggcaaatcaaagactttaaggatccttgaagcaaagaaaagtgagaaaggtatgctctcacttagacaagtaggtgggggttggttagcccaggaatctgatgatttggtgccacaagatatcactttcaaagtggtttctgagaaggttccacaagaaaatgaacttcatgatgcagagtttgcttggttgtgcgttaagcacgtcaaaagcaacgccattgtgatagccaagaacaattgtatattaggaatgggaagtgggcaaccaaataggctggagagcttaaggattgcttttagaaaagctggagaagaggccagaggagctgcccttgccagtgatgccttctttccatttgcctggaaagatgcagttgaagaggcttgtgagaatggtattggggttattgcagaaccaggtgggagcattagagaccaagatgctattgactgctgcgataagtatggtgtttcgcttctcttcaccaatgtcagacacttcaggcactaaacttgatgaaggttttcttcacgtaaaaccatcctaaatcgtatcttttgaatgaatgattaggaaacatcccatgcagcccaaaggcaacctttgctgcaacgagtgtattgtttatcatgttcaacaataatatctcatgaacgttaaaataactgttctgctaaaagcaatatgtttgtctcttgtatccaagaaaaatcttgtaagctgttcaatctcaatgtttcttcaataataatttgtcgagctcttctatgtgtcagtggacatgatcagtgaggac

SEQ ID NO: 6291 - DNA, 3139 bp, Arabidopsis lyrata
gtttcaaaatcaaactactatgctcagttccgccgccaccgccaccgccacctccgtgagtgctcgctccggcgatattctttacggctattttcgcaagaaatccgtcgcgccttttcgttttgctcggcctgtctatcgtacgtcgctgcgtccgagtttcgttgcggttcgagccatggcggagtctcagactgctcagaggaatcagccgcaatcctcaggctcctctggaaaaaagcaagctttgatatctttatctgacaaaagagatttggcttctcttggcaacggtctgcaagaattgggatacactattgtttctactggaggaactgcctctacgttggagaatgccggagtctctgtgaccaaagtggagaagcttactcattttccagaaatggcaactctgcctctgttttttcttctcttaaagcttgatggccgtgtgaaaactttgcatccaaacattcacggtggtattcttgctagaagagatgtggagcatcatatggaagctcttaatgagcatgggattggtacatttgatgtggtggttgtcaatttgtatccgttctatgataaagttactgctccaggtgggatcagttttgaggatgggattgagaacatcgacattggtggtcctgctatgattagagcagctgctaagaaccacaaagacgttctcattgttgtcgattcagaggattatcaagctgttttggagtatctcaaaggaggacagagcgaccaacaattccgcagaaaacttgcgtggaaggcctttcagcatgttgctgcatatgattctgcggtttcagaatggctatggaagcagactgaaggaaaagagaagttccctcccagctttacagttccggttgaacttaagagctctcttcgttacggtgaaaatcctcatcaaaaagctgcattttatgttgataagagccttgctgaagtgaatgccggtggtatcgcaacagcgattcaacaccatggaaaggaaatgtcatacaacaactatcttgatgctgatgctgcgtggaactgtgtgtcggaatttgaaaacccaacatgtgtagtcgtgaagcatacaaatccttgtggtgtggcctctcgtgatgatattctggaggcttaccggctagctgtaaaagctgacccagttagcgcctttggtggcatcgtagctttcaatgttgaagttgacgaggttcttgcgagggaaatccgagagttcaggagcccaacagatggggaaactagaatgttttatgaaatcgtggttgctccaaagtatactgctaaaggtcttgaagtcctcaaagggaaatcgaaaactttgaggatccttgaagctaaaaagaatgagcaagggaaactatcgctcagacagattggtggcggctggttggctcaggagtcggacgatttaactccaaaagacatccgtttcaattgtgtatcagacaaaactccgactgaaagcgaacttgcggatgccaaatttgcctggctctgcgttaagcatgtcaagagcaatgccattgtgatagcaaagaacaattgtatgctggggatgggaagcggacagccaaaccgagtagagagtctgagaatagctttcaagaaagctggcgaggaagccaaaggagctgccttggccagtgacgcattcttcccattcgcttggaaagatgccgtggaagaagcgtgcgagaagggaataggagtgatagcagaacctggaggcagtattagagaccaagacgccattgattgctgtaaaaagtatggagtctctctgctcttcaccaacgttagacacttccgccattaaggacacatccctccagttttgctcttataacatccaagaggttctgaagaagaaaacccaccaaagtccaaacaaaacacaaagagtgggaaataaaaatgttgtaacattaatttgaattgcgttcgacttttatgtatgattagaacctgagagctgttcctacttataaatttgacacttttcacccaaaaatcacatctttctcaacacccagaaactgatgagatgtgtatataaaatattcatcaattctactcaaactggagtgagaaagtcgacgacagtgagcgagagagatcagagatggcgacagggaaagtggtggtggagaaagttggaggaagatctacggctacgagttgcttctctaagtatcctctcaagttcttacttcctagcaaggcagctcctgccggaactgacgttgtctggatttacagtatcacctacggtggcggcattgtctctggagattcgattttatgtgaattcactataggtgatggatgcactgcagtgattacaacacagtcttctactaaggtatacaaagcaattggatcaaagtgttctgaacaaacattggaagcgagaatcgggagtgaagctcttttggttgtgataccagatccagtgacttgtttctccactgcccggtactttcagaaacagatttttagattgctttcagactctaatctggtccttgtggattggatcacaagcggccgtcatgcaaatggcgaaaaatgggattttgagttttataagagcatcaacaatgtctacctggaagatgatcaccctttattccttgacacagtactactagagaagaggagcatccaaaccatagccgaacggatgcaagactatcacgccatagcaatggtcatacttttcggggcaaagctgaaggaaatccaaaagcaagtccaagaaaatgtgaaaaatatgatgtcggaacaattacagatcttatgttctcggagacacaagtctgagtcaagctctagtaatcgcttcatgaagccagagtttatagcttcctgcagcactttcggccctgagggaaagggagttgtgattagaatagcttcggattctacagagtctgtctacaatttcttgaagcaacaattggctgagcttgaaccacttcttggtcaagctccttatgcttgactcttatttcttcttcttttttgactttacccaaaccaaggtcaccacaatttaaatgaataaggaaataggaaacaaaagctcaaaattgtgagttgtctt

SEQ ID NO: 6292 - DNA, 1972 bp, Brachypodium distachyon
atggcggcggcgcagcctggcgcgtcgacggcaccgcaagcgaactccagcgcaacaggagtcaagcaagcactgatatcattgtcggataaaacagacttggcccatcttggaaacggtcttcaaagcttggggttttccatcatatccactggtggtactgcatcaagtctggaagcagctggagtgactgttacaaaagttgaacagattacacattttcctgaaatgcttgatggaagagtaaagacactgcaccccagtatacatggtggtattcttgcccgaagagaccaggaacatcatctgaaagcattgaacgagcatggcattgggacatttgatgtggttgtggtgaacttgtatccattctataataaggttacctccggtgcaatttcttttgaggatggtatcgaaaatattgatatcggtgggcctacattgatccgggctgcagcgaagaatcataaggatgttcttgtcgttgtggatcataatgattaccctgctctattggaatatctacaaggaaagcaacatgaccagcagttccgtaagatgctggcatggaaagctttccagcatgttgcttcttacgattcagccgtctcagaatggttgtggaagcagtcaaacaaaggagatatatttcccccaagccttactgtgcccctttcgctaaactctacacttcgttatggtgaaaaccctcatcaaaaggctgctttttatgttgacaagagtctttctgtatttaatgctggcggtattgcaacagcaattcagcaccatggaaaggaaatgtcatataacaactacttggacgccgatgctgcatggaactgtgtgtcagagtttgagaatcctacttgtgttgtggtcaagcacacgaatccgtgtggtgttgcgtcccgggcggatgttcttgaggcctacaggttggctgtaaaggcagatcctgtgagtgcatttggtgggattgtcgccttcaacaccacaatcgatgaggatctcgccagggaaattcgcgagtttagaagtcctacagacggcgagacgcggatgttctatgagattgtggttgcacctgggtacacggagaagggcctcgaggtcctgaaagggaaatcgaagacgctgaggatactagaggcgaagagaagcgggaaagggatgctgtcgctcagacaggtcggcggcggctggctagctcaggagtcggacgatctaacgcctgaagacatcgccttcacaaaggtttccgagagggctccgaccgacagcgagctctcggacgccaagttcgcctggctctgcgtgaagcacgtcaagagcaactccattgtgatcgccaagaacaactgcatgctgggcatgggtagcgggcagccaaacagggtggacagcctgaggatcgccttcaggaaagcaggggaagaggccaagggcgctgccctagctagcgacgccttcttcccattcgcctggaaggacgctgtggaggaggcgtgcgagaagggcatcggcgtgatcgcagagcccggcggcagcatgagggacaaggacgccgtcgactgctgcgacaagtacggcgtcgccctcctcttcaccggcgtccgacacttcaggcactgaaacctgaaagagagaactaaccaattggtcgacactcgcgcccaccattattggatcagtatggtggctagaagaacatgtctgagctttttctgtttgcaataaaacgcacgcaagcagggttgatcatcttgtctctgcaccaagagctaaagcccagctgccccagcagaaacaacaacgataatgtgccattgaaagcagctagaagctcgctcacagtgtaaaccaactgtttgagagaatctcaatgtacggtaacatgtctgagcttttgtgttgttggtgtgcgatctctggtctttttagtttgcaataaaacgcacgctggtgt

SEQ ID NO: 6293 - DNA, 2036 bp, Flaveria ramosissima
ctgaggttcagagctccgttcaccaccgtcacctcttcgaacccctgctatcgtccgtacgtctccggcgaccactttcaacttcccctcaactgattatcagttctccgattcactgacaaacaacaatttctgctttcaccagaatataaattgtacacgaagattgaattgctatcggagtaaggcaacggcggaagctgctgaaaccatggctgctgctaacgcatcttcttctgcaagcaagcatgctttgatttcgttatcagacaagaaggacttggatcttcttgccgctggacttcaggaattgggatatacaattgtgtcaactggaggaacagcatccgctttggaaaaagctggaatttctgtaacaaaagtagaagaactcactaagtttcctgaaatgcttgatggtcgggtaaaaactttacatcctaatgtacatggaggtattcttgccagaagagaccaaagccatcacatggaagctctagaaaagcacagtatcagtacattcgaactggtggtggttaatttatatcccttctatgaaaaagtcacttctagcaatggagttgcatttgatgatgggatcgagaacattgatatcggtggccctacaatgataagagctgcagcaaagaatcataaggatgtgttggtagttgttgattctcaagactaccctatgcttcttgaattcctcaaaggaaagaaggatgaccaacaatttagaaggaaacttgcatggaaagctttccaacatgtcgctgcgtatgattctgcagtttccgagtggctgtggaagcagactgaaggagataaatttccacctagctttacggtaccactttcattaaagagttcacttcgatatggagaaaatcctcatcagaaggctgcattttacactgacagcagcttgtcagaagttaatggtggtggtattgcaacagctatccaacaccatgggaaggagatgtcatataacaattatttagacgctgatgcagcttggaattgtgtttgtgaatttgaaaacccccacttgtgttgttgtaaagcatacaaacccttgtggggtagcttctcgtgatgatctaattgaagcatatagattagctgtgaaagccgatcccgtgagtgcatttggtggtatagtagcattcaacaaagaagtcgatgaggcacttgctaaggatatcagagaattcagaagcccaacagatggtgaaacccgaatgttttatgagattgttgttgctcccagttacaccgaaaagggtcttgaaatccttcgtggaaagtcaaaaacactgagaattcttgaagcaaagaaaaacagtagaggaaagttatcacttagacaagtaggcgggggttggttagcccaggattcagatgatttaacaccagaagaaatcaaattcgatgtagtttccacaaaagcaccagaacaaaacgagctaaatgatgccaagtttgcatggttgtgtgtgaaacacgttaagagcaatgccattgtaatcgcgaagaataactgtatgttaggaatgggaagtggacaaccaaatcgtgtggatagtttgagaatagctttgaagaaagctggagatgaggtcaaaggagctgctttggccagtgatgcatttttcccatttgcatggaaagatgcagttgaggaagcatgtgaaagtgggattggtgtgattgctgagcctggtggtagcataagagacggtgacgcgattgattgttgcaacaaatataatgtatcgcttttgtttaccggcgtgaggcatttccgacactaagactcgctcaaaagtagtgtcgtgttccgagagttttcaagtttgaggatttataacccggtgtttaatgtatactagaggttttttactcctatgtgtgattttaacttatgagatgtaccatcataatgagatcaaacctgaactcggtcataaggaaatcaaacgtggtagataaaaattaatgacaggagagttataacctgcttgctaaat

SEQ ID NO: 6294 - DNA, 1795 bp, Brassica napus
ttcaagagttgggatacactattgtttctactggaggaactgcttctactttggagaatgctggagtctctgtcaccaaagtcgagacgcttactcatttccctgaaatgcttgatggccgtgtgaagactttgcacccaaacattcacggtggtatcctcgctagaagagatgtggagcatcacatggaagctcttaatgagcatggcattggtacatttgatgtggtggttgtcaatttgtatccgttctacaacaaagtaactgctccaggtgggatcagttttgaggatgggattgagaacatcgacattggtggtcctgctatgatcagagcagctgctaagaaccacaaagatgtcctcattgtgtcgattcagaggattatcaagccgttttggagtatctcaaaggagggcagagtgaccaacagttccgcagaaaacttgcgtggaaggcctttcagcatgttgctgcttatgattccgccgtctcagaatggctatggaagcagaccgaaggaaaagagaagttccctcccagctttacagttcctctttcacttaaaagctcccttcgctacggtgaaaatcctcatcaaaaggctgccttttatgttgataagagccttgctgaagtcaacgctggtggtattgccacagccattcagcaccatggaaaggaaatgtcatacaacaactatcttgatgctgacgctgcgtggaactgtgtgtcagaattcgaaaacccgacatgtgtggtcgtgaagcacacaaatccttgtggtgttgcctcacgcgatgatattctcgaggcttaccgtttagctgtgaaagctgacccagttagcgcctttggtggcattgtagccttcaatgtcgaagtggacgaggttcttgctagagagctccgggagttcgaggagcccaacaggacggggaaactagaatgtttatgaaatcgtggttgctccaaagtacactgctaaaggtcttgaagttctcaaagggaagtcgaaaactctgaggatcctggaggcgaaaaagaatgaccaagggaagctgtctctcagacaagttggtggaggatggttagctcaagactcggatgatataactccagaagacatcagttttaaagccgtctcggataagactccaactgaaagcgagcttgcggatgccaaatttgcctggctttgtgttaagcatgtcaagagcaatgccattgtgatagcaaagaacaactgtatgctggggatgggaagtggacagccaaaccgagtagagagtttgagactagcttttaagaaagctggcgaggaagccaaaggagctgccttggccagtgacgccttcttcccatttgcttggaaagatgcggtagaagaggcgtgtgagaaaggaataggagcaatagcagagcctggaggtagtattagagaccaagacgccattgattgctgcaacaagtatggtgtctctctgctcttcaccaacgttagacatttccgccattgatgatgaatccaaaagagattttgaaagagtttgtgtctggggctctaggcaagaacaacacccactaaaataaaaagcaagagttgagaaatgttgtaactttaatatgaaagcgtttgactttgtgtatgattagcacctgagagatgtttcaacgaataaatttggcatttttctactcaaagatcatatttttatgaacacctggaagcaacatgatgagatgtgtatatatttagtcaactcaaattaaaacgagagagtcaacgacagtg

SEQ ID NO: 6295 - DNA, 2164 bp, Setaria italica
atgccactttatctcgtctcctctcccgccgccgccgccaagctcgccgccggcacgcgcgcgtaccctcgccgacgccgccagctcctgttcccagctcgccactgtctgggccgccgcggctccctgtcgtcgttgtcttcgtccgcggagcgctcggcggggcgcgcaatggatgctgcggaggccggcacgtcgacggcgccggaggcgagcttcagcgccacaggagtgaagcaagcactgatatcattgtccgataaaacagacctggccaatcttggaaatggtcttcagcgcttggggttttctattatttccactggtggcacagcatcaagcttggaagcagctggagttagtgttacaaaagtggaggaaattacacattttcctgaaatgctagatgggagagtcaaaacattgcaccccagtatacatggtggtattcttgcacgaagagaccagaagcatcatctgcaagcattgaacgaacatggcattgggacatttgatgtggttgtagtgaatttgtatccattctacaataaggtcacctcaagtgcaatatcttttgaggatggcattgaaaatattgatatcggtggacctacattgattcgagctgcagccaagaatcataaggatgttcttgtcgttgttgatcatgaagattatcctgctctattggaatatcttgaaggcaagcaagatgaccaggatttccgcaggaggcttgcatggaaagctttccaacatgttgcttcatacgattctgctgtttcagagtggttgtggaagcaatcaaataaaggagatacatttcctcctagctttactgtgcccctcacactgaagtctacacttagatatggtgaaaatccccatcaaaatgctgcattctatggtgacaagagtctttccctagtaaatgctggtggtattgcaacagcaatccagcaccatggaaaggaaatgtcctataacaattacttggacgcggatgctgcatggaactgtgtctcagagtttgagagcccaacttgtgttgtggttaagcacacaaatccgtgcggagtagcatccagacaggacatccttgaagcatacaggttggctgtgaaggcagatcctgtgagcgcattcggcggcatagtcgccttcaatacgacaatcaatgaggatctcgcaagggaaatccgcgagttcatgagccccacagatggcaagacacggatgttctacgagattgtcgtcgcacctaggtacacggagaaggggcttgagatcctgaaggggaaatcgaagatgctgaggatactggaggcgaagccaagcgggaaaggcatgctgtccctccggcaggtgagcggcggttggcttgctcaggagtccgacgacttgaccccggaagacatcaccttcacgaagatgtcggagagggccccagaggacagtgaactctcggatgcaaaatttgcctggctctgcgtcaagcatgtcaagagcaacgccatcgtgatcgcgaagaacaatcgcatgctgggcatgggcagtgggcagccgaacaggctggagagcctgaggatcgccttcaggaaggccggagaggaggccaagggagctgctcttgccagcgacgccttcttcccgtttgcttggaacgacgcggtggaggaggcgtgccagagcggcatcgcggtgatcgcggagcccggtggcagcatccgggaccaggacgccgtggactgctgcaacaagtatggggtgtccctcctattcaccggcgtcaggcacttcaggcactgaagaagcaggggcagagaggattctgactggaggcagcctgcaataaagctggtggtcctgattgagggcatgcttgggtagaagagatttgaattcaaatcttttgactttagttcgaaacttgcgccaaatcctgaaaaaaaataagaaagagtgtagtatactggataaaagcgccagtcaaggggtccgaagaagacgctatcgattcgtttctcctccactgatatgtaacagtttcttactgtacattttgtcacaggctgttggatgaaatgtttcttgcttggatgcgagatgctcgatcaggtcagtgatgtaatgggccaccggtagccaacaggcttctttgtgg

SEQ ID NO: 6296 - DNA, 2125 bp, Oryza sativa
agagggagagagatacgcgacaaaacaaatccgcccccgagaaaaggaggccacgaaattacgagaatgccactcaacctcgcctcctctcccgccgccgccgccgccgccaaggtctgcgccggcgtgcgcgcgtccccgcgccacctcctcccccgcgctcttgaccaccagagccgccgcgtcctcagcttgtcgtcctcgtcgtcggcggggcgtgcggcgggtgtgcgggccatggccgcggcggaggccggtgcgtcgacggcgacacaggctaagtcgagcggagtcaaacaagcactgatatcattgtcggataaaacagacttggcctatcttgggaatggccttcaagccttggggttttctattatttcgactggtggcacagcatcaagcctggaagcagctggagttaatgttacaaaagttgaacaaattacaaattttcctgaaatgcttgatggtagagttaaaacattgcaccccagtgtacatggtggtattcttgcaagaagagaccaggagcatcatcttaaggcattgaatgagcatggcattgggacatttgatgtggttgtggtgaacttgtatccattctataacaaggtcacctctggtgtaatttctttcgaggatggcattgaaaacattgatatcggtggacctacgatgatccgagcagcagctaagaatcataaggatgttcttgttatggtggatcatgaagattaccctgctctattagagtatctgcaaggaaaacaagatgaccagcaattccgcaagatgctagcatggaaagctttccaacatgtcgcttcttatgattcagctgtctcagaatggttgtggaagcaatcgaacaaaggagatgtattccccccgaacttcaccgtgcccctgtccctgaaatctacacttcgttatggtgaaaatcctcatcaaaaagctgccttctatggggacaagagtctttctgtagttaatgctggtggtattgcaacagcaattcagcaccatgggaaggaaatgtcttacaacaactacttagatgcggatgctgcatggaactgtgtatcagagtttgagagtcctacgtgtgttgtggttaagcacacaaatccatgtggagtagcatcccgacaggatattcttgaagcatacaggttggctgtaaagggagatcctgttagtgcatttggtgggatagttgctttcaatacgacaattgatgaggatcttgcaaaagaaatccgtgaattcaggagccctacagatggacagacgcgaatgttctacgagattgttgttgcacccggctatacagaaaagggtcttgagatcctcaaagggaaatcaaagacattgaggatactggaggcgaagagaagtggaaaagggatgctatcactcaggcaagtcagtggtggctggttggctcaagagtctgatgatctaacccctgaagatatcaccttcacaacagtgtccgagagagctcctcaagacagtgagctctctgatgccaaatttgcctggctttgtgtaaagcacgtaaagagtaacgccattgtgatagccaagaataactgcatgttaggcatgggaagtggccagccaaacagactggagagtctgagaattgctttcaggaaagcaggagaggaggccaaaggagctgctttggccagtgatgcattcttcccattcgcttggaacgacgccgtggaggaggcgtgccagaacggcatcggcgtgatcgcggagccgagcggcagcatgagggacggcgacgccgtcgactgctgcaacaagtacggcgtctccctcctcttcaccggcgtcaggcacttcaggcactgagctagctagcctcatgaaccttgatcttcctgcaaaaaaaggaaaaaaaacatgggcatgtcagatcgatcgctctttctgtatcacaagagcatgcagatcgaccagcgtttgatcaccttgagaaaaactcttgacggcttgtactaggctgcctgccactggtgtgacagaatttgatcagcttgacattttgcaataagattcatggtgataataagattaggatgtctcgtactcattctaaaattctcta

SEQ ID NO: 6297 - DNA, 2092 bp, Triphysaria pusilla
tgcacggaaataccgccattagggacggaggattgatttttactcgcctctgataaaaaagtagaatgctaccatttgccgccgccgccaccccagcttccactagcgtcgctgtaacatcttcacttatctgcgccgctcatccggcgcacactagcattagtcctcttcaccctagaagtgcctcttcttccaatcaattgttgtcggcaccgagtaagttaactgtgtttcgagtgaaagccatggcagaaactcattcaacttcgaagctagactctaagtcctcgcactctgggaagaggcaagctttgatttcattgtcagacaagaaagacttgaccttgctagccaatggactacaagaattagggttcacaattgtttccactggaggaacagcatctgctttggaaaagtgtggtgtgtctgtaaccaaggtcgaggaacttactcatttccctgaaatgcttgatggccgtgtaaagactttacatcctaatatacatggaggtattcttgcaagaagagatcaagcccatcacatcgaagcccttgaaaatcatggaattggtacatttgatgtggtagtggtgaacttatatcccttttatgatacggtgacctcttctactggagtttcttttgaggatggggtcgagaaaattgatattggtgggcctgccatgattagagctgccgcaaagaatcataaggacgttttggtcgtagtcgactccaacgactatccagcactcctagaatatcttcgaggaggacataatgatccgcagtttccaaggacactggcatggaaggcttttcagcatgttgcttcttatgattccgcagtttccgaatggctgtggaagcagaatggaggagataagtttcctcccggcctgacagtaaatttgtcccgcaagagtgaacttcggtatggtgaaaatcctcatcagaaagctgcattttatgccgataagtctcttgcagaggtcaatgccggtggcattgccaccgccatccaacaccacggaaaggagatgtcatttaataattatttagacgcagatgcagcttggaactgtgtgtgtgattttagtaagccgacatgtgttgttgtgaagcatacaaatccttgtggagtagcatcacgtaatgatattatcgaagcataccgtctggctgtgaaagcggacccagttagtgcctttggtggcattgtggccttcaatgttgaagttgatgaggtcctcgcaaaagatatcagagagtttagaagtccaacagatggcgagactcgaatgttctacgagattgttgttgctccaaagtacactgagaaggggcttgaagtgcttcgtgggaagtccaaaaccttgagaatcctcgaggcaactaaaaatagtaaaggaaagctctcgctaagacaagtgggtggtggatggctagctcaagaagccgatgatcttacaccagaagatatcaaattcaatgctgtctctgaaaaggcaccgcaagaaaatgagctccatgatgctgagttcgcatggacttgtgtaaagcacgtgaagagcaatgctattgttattgcaaagaacaattgtatgttaggcatgggaagtgggcaaccgaaccgtctcgagagttggaggatagcaatgaggaaagctggggatgaaattaagggagctgcactggcgagcgatgctttcttcccatttgcctggaatgatgctgttgaagaaatatgtaaaagtggagtcagtgtaattgctgagcctgggggaagcataagggactctgatgcgatcgattgctgcaacaagtatggagtttcacttgttctcaccaatgtcaggcactttaagcattaagagtccaaagaaagatattttctatcccggttttgtagtttaatttttatcttctcctctctcgtgccttggtgcaaagtgttttaggtgctctgacttcaatgtgaacgtttttgtagtctgcgaaaaatgttatttaaccgattgcaatcgagtgtaatggtctcagactcaggaatgtgctgtgacatttatgttgggtagatcgaatacat

SEQ ID NO: 6298 - DNA, 1761 bp, Flaveria ramosissima
ttgagttgctatcggtttaaggcgacgacggaagctgctgaaaccatggctgctgctaacgcatcttcttctgcaagcaagcatgctttgatttcgttatcagacaagaaagacttggatcttcttgccgctggacttcaggaattgggatatacaattgtgtcaactggaggaacagcatccgctttggaaaaagctggaatttctgtaacaaaagtagaagaactcactaagtttcctgaaatgcttgatggtcgggtaaaaactttacatcctaatgtacatggaggtattcttgccagaagagaccaaagccatcacatggaagctctagaaaagcacagtatcagtacatttgaactggtggtagttaatttatatcccttctatgaaaaagtcacttctagcaatggagttacatttgatgatgggatcgagaacattgatatcggtggccctacaatgataagagctgcagcaaagaatcataaggatgtgttggtagttgttgattctcaagactaccctatgcttcttgaattcctcaaaggaaagaaggatgaccaacaatttagaaggaaacttgcatggaaagctttccaacatgtcgctgcgtatgattctgcagtttccgagtggctgtggaagcagactgaaggagataaatttccacctagctttacggtaccactttcattaaagagttcacttcgatatggagaaaatcctcatcagaaggctgcattttacactgacagcagcttgtcagaagttaatggtggtggtattgcaacagctatccaacaccatgggaaggagatgtcatataacaattatttagacgctgatgcagcttggaattgtgtttgtgaatttgaaaaccccacttgtgttgttgtaaagcatacaaacccttgtggggtagcttctcgtgatgatctaattgaagcatatagattagctgtgaaagctgatcccgtgagtgcattcggtggtatagtagcattcaacaaagaagtcgatgaggcacttgctaaggatatcagagaattcagaagcccaacagatggtgaaacccgaatgttttatgagattgttgttgctcccagttacaccgaaaagggtcttgaaatccttcgtggaaagtcaaaaacactgagaattcttgaagcaaagaaaaacagtagaggaaagttatcacttagacaagtaggcgggggttggttagcccaggattcagatgatttaacaccagaagaaatcaaattcgatgtagtttccacaaaagcaccagaacaaaacgagctaaatgatgccaagtttgcatggttgtgtgtgaaacacgttaagagcaatgccattgtaatcgcgaagaataactgtatgttaggaatgggaagtggacaaccaaatcgtgtggatagtttgagaatagctttgaagaaagctggagatgaggtcaaaggagctgctttggccagtgatgcatttttcccatttgcatggaaagatgcagttgaggaagcatgtgaaagtgggattggtgtgattgctgagcctggtggtagcataagagacggtgacgcgattgattgttgcaacaaatatgatgtatcgcttttgtttactggtgtgaggctatttccgacactaaggcttgctcaaaagttgtgtcgtgttttgagtaattttcaagtttgaggtatttataacccggtgactaatgtatactagaggttctaactccatgtgtgtatttta

SEQ ID NO: 6299 - DNA, 2016 bp, Flaveria ramosissima
acctcctcaacccctgctatcgtccgtacgtctccggcgaccactttcaacttcccctcaactgattatcagttcgccgattctctgaaaaacaccaaattctgcttccagcagaatattaattacacacgacgattgaattgctatcggagtaaggcgacgacggaagctgctgaaaccatggctgctgctaacgcctctccatctgcaagcaagcatgctttgatttcgttatcagacaagaaggacttggatcttcttgccactggacttcaagaattgggatatacaattgtgtcaactggaggaactgcatctgctttggaaaaagctggaatttcggtaacaaaagtagaagaacttaccaagttccctgaaatgcttgatggtcgggtaaaaactttacatcccagtgtacatggaggcattcttgccagaagagatcaaagccatcacatggaagctctagaaaagcacagtatcagtacgtttgaattggtggtagttaatttatatccgttctatgaaaaagtcacttctagcaatggagttacatttgatgatgggatcgagaacattgatattggtggccctacaatgataagagctgcagcaaagaatcacaaggatgtgttggtagttgttgattctcaagactaccctttgcttcttgaatttctcaaaggaaacaaggatgaccaacaatttagaaggaaacttgcatggaaagctttccaacatgtcgctgcatatgattctgcagtttctgagtggttgtggaagcagactgaaggagataaattcccacctagctttacggtgccactttcattgaagagttcacttcgatatggagaaaatcctcatcagaaggctgcattttacactgacagcagcttgtcagaagttaatggtggtggtattgcaacagctattcaacaccatgggaaggagatgtcatataacaattatttggacgctgatgcagcttggaattgtgtttgtgaatttgaaaaccccacttgcgttgttgtaaagcatacaaacccttgtggggtggcttctcgtgatgatctaattgaagcatatagattagctgtgaaagccgatcccgtgagtgcatttggtggtatagtagcattcaacaaagaagtcgatgaggcacttgctaaggatatcagagaatttagaagcccaacagacggtgaaacccgaatgttttatgagattgttgttgctcccagttacaccaaaaagggtcttgaaatccttcgtggaaagtcaaagacactgagaattcttgaagcaaagaaaaacagtagaggaaaattatcacttaggcaagtaggcgggggttggttagcccaggattcagatgatttaacaccagaagaaatcaaatttgatgtagtttccacaaaagcaccagaacaaaacgagctagatgatgccaagtttgcatggttgtgtgtgaaacacgttaagagcaatgccattgtaatcgccaagaataactgtatgttaggaatgggaagtgggcaaccgaatcgtgtggatagtttgagaatagctttgaagaaagctggagatgaggtcaagggagctgctttggccagtgatgcatttttcccatttgcatggaaagatgcagtagaggaagcatgtgaaagtgggattggtgtgattgctgagccaggtggtagcataagagacggtgacgcgatcgattgttgcaacaaatataacgtttcgcttttgttcaccggcgtgaggcatttccgacactagggctcgctcagaagttgtgtcgtgttttgagaattttcaagtgattttttaacctggtgttttatgtatactagcggttctaaactccatgtgtgatttaacttatgaagatgtaccatcataatgagatcaaacctaactcagtcataaggaaatcaagggtgagataaagatttgatggcaggagaattataacctgcttatgcttagattcgttattcgttattc

SEQ ID NO: 6300 - DNA, 2066 bp, Triticum aestivum
gcaagcactgatatcactgtcggataaaacagacttggccaatcttggaaacggtcttgagagcttggggttttctatcatctccactggaggtacagcgtcaagcctggaagcagctggagtgaatgttacaaaagttgaacagattacacattttcctgaaatgcttgatggaagagtaaaaacattgcaccccagtatacatggtggtattcttgcccgaagagaccaggagcatcatcttaaagcattgaatgagcatggcatagggacatttgatgtggttgtggtgaatttgtatccattctatgataaggtcacctctggtacaattacttttgaggatggcattgaaaacattgatattggtgggcctacaatgatccgggctgcagcgaagaatcataaggatgttcttgttgttgtggatcatcatgattaccctgctctattgaaatatctacaagaaaatcaagtggacccacagttccgcaggatgctggcatggaaagctttccagcatgtggcttcttatgattcagccgtctcagagtggctgtggaagcaatcgagcggtggagatatatttcctccaagttttactgttcccctctcgatgaagtcgacacttcgttatggtgaaaatcctcatcaaaaggccgcattttatggtgacaggagtctttctctagtcaatgccggtggtattgcaacatcatttcagcaccatggaaaggaaatgtcttataacaattacttggatgctgatgctgcatggaattgtgtgtcagagtttgagaatcctacttgtgttgtggttaagcacaccaatccgtgcggtgttgcatcccggcaggatgttcttgaggcatacaggttggccgtaaaggcagatcctgtgagtgcatttggcggaatcgttgcattcaacaccacaattgacgaggatcttgcaaaggagattcgcgagtttagaagtcctacagatggcgagactcggatgttctatgagatcgtggtggcaccaggatacacagagaagggccttgaggtcctcaaaggtaaatcaaagacgttgaggatccttgaggcaaagagaagtgggaaaaacatgctgtcgctcaggcaggtcagtggtggttggctagctcaagaatctgacgatctaaccccagaagacatcaccttcacgacgggttctgagagagctccgacggacagtgagctctcggatgccaagttcgcctggctctgcgtgaagcacgtcaagagcaacgccattgtgattgccaaggacaactgcatgctgggcatggggagcgggcagccaaacagggtggacagcctgaggatcgccttcaggaaagcaggggaagctgccaagggagccgctctggccagcgatgccttcttcccattcgcttggaaggatgccgtggaggaggcgtgcgagaatggcatcggcacgatcgcgcagcctggcggcagcatgagggacaaggacgccgttgactgctgcaataagtacggcgtgtccctcctcttcaccggcgtccgccacttcaggcactgagcctaacctgagcacttaaggctatatcaccggtctatcggtagtttgtcgcaataagacagacgcaggtgattctgagtccaactaggattaattgtatgacggtggcgaaagcattttaccacgtacgcaagtgagttcgcctaggtgttcgtcacattgctgagccagcagcggctgggtaataacaaggtcggaaaaccaggggccatgtactagctaaagtaagcaaaaactgtgtttgtattcagacgtcgacatgaatccaacttgtgaggctgttctgatcttttcagatgccagcacgtgatcttggcttgaagatttgtgcttaccagcaaccttaagatgctggtttgtagaattaggccaattctgtggatggggaaagggtatcagatgcagcctgagtgtagcttggggagaaagagactgtatgatcgttttcttttgtccttctggaattcagatggatataacgaaatttagaagc

SEQ ID NO: 6301 - DNA, 2081 bp, Silene vulgaris
ttttcaaattcagcattcattccatttctccacctccgcctccttcagatgtctttggcgagtgtatcctgtagagctacttcgtctacctccattattaatcgctcctccttgcttcattctttcgcctcccggaatttcgcttctcaacaatcggttgtgccgtcgcctgtcattagagtcggttctttgtctctgaattcgcggtctaagcagtgtcgagttacagccatgtctggggggtccgataccatcgcatcagattcttcgtcgtcttcaggtttagggataaaaaaggcgttgctttcagtatccaataagactgatttggtaactcttgctaccggattggagagtctcgggtatacaattgtttcaactggagggactgcaacttctctagaaaaggcaggtgtatctgtgactaaagtggagaagctaacggagtttccggaaatgcttgatgggcgtgtgaagactttgcatccacgtatacatgggggaatccttgctaaaagggacttgaagcatcacatggaagctctggagcaacatggaatcggtgtttttgatgttgttgtagttaatttgtacccgttctatgataaagttacttcagccagtggcgttacatttgaagaaggtattgagaacattgacattggtggacctaccatgatcagagctgccgcaaagaaccataatgatgtcttggtggtggttgatccacaagactacactcccctcttggattatcttaaaggacagaaggatgaccagcagttccgccggaagcttgcttggaaggcatttcaacatgtggctgcatatgattcggcaatttcagagtggttatggaatcagaatggagaagacaagttccctcccagcttcactgtacctttgtcccttaaaagctctcttcgttatggagagaatccgcatcagaaggcagcattttatgttgataaaagtcttgctgaggttaatgctggtggtattgctacagctattcaacaccatggaaaggaaatgtcatataacaattacttagatgccgatgctgcgtggaattgtgtgtctgaatttgaggaccctacatgtgtggttgtgaagcatacaaacccctgtggagtagcctcccgtgatgatattctagaagcataccgactagctgtcaaaggggacccagttagtgcttttggtggtattgtagccttcaatgttgaagttgatgaggcccttgcaaaagaaattagggaatttagaagccctacagacggcgagactcgaatgttttacgaaatcgtggttgcccccaagtattcagaaaaagggctggaagttcttcgtggaaagtcaaagaccttgaggattctggaggcaaagaagaatgacaagggaaaactttctttgcgacaagttggtgggggttggttagctcaagagtctgatgatttgacgcctgagaatatcaacttcaaagttgtctctgagaaaaagccaacagaagaagagcttagtggggcacagtttgcgtggctttgtgtgaagcatgtaaagagcaatgccattgtgattgccaagaacaaatgtatgctgggcatgggcagtgggcagccaaaccgtgttgaaagcttgaggcttgctatgaagaaagcaggagaagaagtgaagggtgcagccttggcgagtgacgccttcttcccatttgcttggaacgatgcagtggaagaggcctgtcaaagtggtgtaagtgtgatagccgagcctggaggcagcattagagataaggatgctgtagattgttgcaacaaatatggcgtgtcactgcttttcactgaagtcaggcatttccgtcactgatctcgaagctagatcttcattttgcccgtatgagcaggccacaaggtaaaagtcagtcagttaaaggcaaggtgcccaagttttggcggctaataaattttaacctcgaactgttgtcagcacagtagagcaagtaaatggtattttcacaattgggaagccatttctctgtaatgtttagcattcatcccttgttctgagtctcatacactagg

SEQ ID NO: 6302 - DNA, 2063 bp, Valeriana officinalis
ccaagccgtctcacacccgactgaccttgccaagcgaccagctccaccacagtgatctcgccacccctcgccaccacttcgccacccttctccaccactttgccgccctctccactacttcgcaactgaattgtttttagtatcacgcttaaagcgacgaaaaatatgctggggttcgccaccacctctaagagttgcattccagtcaccgtttttcaccttcagaattcttctagaacctcttctttcatccaccagtcgtcagtgtcttcgacgtcgtttcgattgaactgctactcaatcaaggccatggccgagtcttccgaaaccctatctgtattgaagaaatcgactagttcttcttctgggagcaagcaggcactaatttcgttatcagacaaaaataatctggatttcctcggcaatgaacttcaaaaattaggatacaaaattgtctcaactggaggaacagctactttcttggaaaatagtggtgtttccgtaaccaaagtcgaagaaattacctcttttcctgaaatgttggatggtcgtgttaaaactttacaccctagcatacatggaggtatccttgccagacgagaccagaagcatcacatagatgctcttgataaacacggaatcggaacattcgatgtggtggttgtgaatttgtatccttttgttcaaaaagtttcgtcgacaaatgaaattacatttgatgatggaattgagaacatagatattggtggccctgccatgatcagagcggctgcaaagaatcacaaggacgtgttggttgtggttgactctgaagattacgaagaacttatatactttcttaaagaaaataaagaggatgaaatgtttaggcgaaagttggcttggaaggcttttcaacatgttgcttcatatgattctgccgtctctgaatggctttggaagcatacttcacaaggtaagtttcctccaagcttatcattgcctgtatctttaaagagttcgcttagatacggcgaaaaccctcatcaaaaagctgcattttatgttgacaaaagcctctcggaggtcaatgcaggcggtattgcaacagctattcaacaccatggaaaggagatgtcatataataactacttggatgctgatgcagcttggaattgcgtttgcgagtttagcaaacccacatgtgtagttgtgaagcatacaaatccatgtggtgtcgcttcacgttatgacatcatcgaagcctatagactggcagtaaaagcggatcctgtcagtgcttttggtggtattgtggccttcaacatagaagttgatgaggatcttgctagggatattagagaattcagaagcccaactgacggagaaaccagaatgttttatgagataattgttgctccaaattatacagaaaaagggttagaagttcttcgtggaaagtcaaagacattgagaatcctaaaagccactaaaaatagtaaaggaaaactctctttacgacaagttggtggtggctggctagcacaagattcagatgatttaacaccacaagatataaaatttaacgtagtttctagcaaatctcctctagaaaatgagcttcgtgatgccgaatttgcatggttatgcgtgaaacatgttaagagcaacgccattgtaattgcaaagaataattgtatgttaggtatgggaagtggacagccgaatcgcgttgagagtctgagaatagcattaaggaaagcaggagatgaggttaaaggagccgctttggctagtgatgccttctttcctttcgcgtggaaagatgcagtggaggaagcatgtgaaagcggaataggtgttattgcagagccaggtggcagcatcagagacaacgatgcaattgattgttgcaacaaatatggagtttcccttctcttcactaacgttaggcactttcggcattaacttgtgctttttcgcatgagatatttttcatgtgttttagacttttggttttgagtcccaatgtttttgaccagatgattctacgagttatgatgcgtgtgcgtcattaaggtaat

SEQ ID NO: 6303 - DNA, 3434 bp, Setaria italica
aatcccctccgtcccctcgcctcccccacacgaatccacccaccccgctccaccgccgccgccgccgccgccgccgccgcgatgttcgccggcgaggcgtcggagctccaggcgcggctggccgcggccgtgcacgcgctcaaccacgacgcgaaccccgcggcgcgcctcgccgccaaccagtggctcctcgcgctgcagcgctctccccaggggtgggcggtggccaccgccctcctggccgccccggacccgcccccgcccgccgacctcctcttcttcgccgcgcaaatgctccgccggaagatccagtcccccggccccgcgctccccggggccggcctggcgccgcagctgcttgacgcgctactccacgccgcgcagcggttctccgccgccccggccccgcgccagctgctcacgcagatctgcctggccctctccgcgctcgcgctccgcgccgagggcggcgtcgacgaccttttcgcgcggatgccactcctgccggcgcccgccgtgctggagctgctcacggtgctcccggaggaggcagcgcaggaccagggcggcgacacgggggtcgacgccgccgctcggtgccggttcacgcgcgaggtgcttgcccacgcgcccgccgttattgagttcctccactctcagtcagagaaggtgcccgccgacgacgacggggtgcccctccacgagcacaaccgcagaatccttcggtgcctactgagctgggttcgggtgggatgcttctcggagacgccagccaccacgcttgccacacacccacttctcactttcgcgttcaactcgctgcaggtgtccttttcgtttgatgtggccatagaggttatgactgagcttgtcagccagcaccaagagttacctgaggcctttctaagtaaaatgccttatataagggaagttcttcttctaccagctctagccaacagaagtgagaagatcattgctggtcttgcgtgtttgatgtgtgaagttggccaggcagcacctgctttggttgcagaagggggtagccaagcacttgctctcgccgatgcacttttgaggtgcactttggcacattttattcttggtattgatgtgaagacagccaaaagaaatgcggcacaagagttgtttttgcctgtgttttcttcactgctagatgctcttttatttcgtgctcagattgacactgatgagcgtggcactgatggagcaacttgtatgcctgatggactagcacagttcagaatgaatttggaggagcttcttgtagatatttgtttgcttctaggtgcccctgcatatataaacaagctcttttctcatggatgggacttctcaagccaatcagttccttggaaggaggtagaagttaggatgtatgcacttagcatggtatacaaatcatttggcgatgtcattggttcttactcaaagtggctatcgtcttgccaaagtaacattaaacctttactcctattttgcgcatcaggaatttcacaatctgtatcatcaaatgcttgctccttagccttgcgcaaactttgtgaggatgcttcttcattcatccacgaacctcagaaccttgaaattcttttctggattagtgagggcatggataaagggaacctgcggctagaggatgaggaagagatagttagtgcaattacgcatgttttgagttctgttcgtgataaagagttgaggaaaagttggctggctaggttactttattccagctactcagcagtggaaaagattattgacatagacagagatcactcactaaggcaaaatccagctacttatacacaatccttggaccttgctgtccgtggtctttacagaatgagtgctctctttggtcatttgtctacggcaataacatctggtctggtcgacgatgatataattttatgtcttcttggaatattttggccacttcttgaaaaacttttccgatcatctcatatggagaatgctagtttatctgcagctgtatgccgttctctttcttcagctatacattcttgtggacagcactttcatatcttgttacctaaagttctggagtgcttatctacaaatttcttactgtttcaaaggcatgactgcttcttgagaacagctgccaacgttattgaagaatttggtcacaaggaagaatatggggctttgtgtgttaggacttttgaaactcttagctctgcgtcctcaatatcaactcttaattcttcttatacgtgtgatcaagaaccagatctagttgaagcatatacctactttacatctatgtttatccgctgctgtccaaaggaagctattgttgcatctagctcgctgcttgagctatcatttcaaaaggcagctatatgttctacagcaatgcaccgaggagcagcacttgcatcaatgtcatatatatcatgttttcttgaggttgttcttgctgctgtgctagaatctccagagtgcatccctgacggatcacctggtgtggtcctaattcaaatcttggcacgctgtggtgaaggtttattgtctaatgtactttatgctctacttggtgtatcggctttatcaagggtgcataaatctgccacaatattgcaacaactggctgcaatgtgcagtttctgtgagagaacgacatggaaggctgttcttagttggagttctctttgtgggtggctacaatcaacggtgaagtcattgccctcagagtatctaaagcaaggggaagctgaaatgataattccgcagtggctgaaggtgcttgaggatgcaggttctgactatcttcacaggactggtgataatatcagaaatcatcaaggatacatgcaagggaagggtggtagaacacttaaacgcataatcagggattttgtggaaagccatcgaaatgccccaaccccctgcccttcatgatatgcggatgaaactgatttcatcagtcctgatagtggagtgcgcggtccgtgttgatcctagggtttgacctccatatacaaatctttaagtcggaaaatgggctacttgcttgttccaatgacctggtttggactttggggttttgtcttcctctgtatagcaagtcaccaaagggcaaaagtggagcaagttgtcaaaccagcctactcggaatgaaccgggaaccccatgggccaatgtgttcaatggtccttttcaaggttggaagtccaaagttttgcttctccatgggccatgaggggtatactggaacatttgggtatactggatgctttgagagaagacggagaggtgaatgcaataactgtatatatcattcttttgcgattagcaatgtacaaaacattcttctttgttcatactcaacttttgagctcacatgggcaaagttaatttcaaatgtatatatctgttacttcatcggc

SEQ ID NO: 6304 - DNA, 2700 bp, Zea mays
tcttcagctcatgaaatccagtacgacgattatcccacactattctcctagaagtacaagaatttttttcccaaaataaatgagagggaatgatgaagagaaatacattatcagttaatggacacttctctctcttttattttgaactaataactgttttagtgcggtagtgccatcctgtcagctcgcattcacacacactccccagtccccactcttgctatattggcctcgtctcgtctcgtctccgtttctggcaatccccatccccaaatctcccatggcttcttcccctccccagccactcacccgcaccgtcctcgccgctaccctgctcctcctcttgcacaatgccgccgccagagccgacggcgcgtcgccggcggtgaacccattcacggcgaaggcggcattcatccgatactggaaccgcaaggtgcccaacaaccgcccgcacccggccttcttcgtcgccaaactctccccgctcccggccgctgactccgcctccttcccatccgcgctgcccgacatccgcgccagcctacccgcgctctgcaccaaagccgcgctcctctgccccgggccggctactactgatgcggcgtcgctgacatcgggccgcaggggcgggggacctttcaagggctacaacaacgccaacttctccaactacggcaccggcggcgtagcggggaccgactcgttccagaagtactccccggacctcaacatcgccgccgacagcttccgccgctacggccgggactcgtcgggacgcgccgacagcttcacctcttacgaggccgacggcaacgtcgtgaccgccaacttcacctcctacgccggcggcgccacgggtggttcgggctccttcgccgcctacgccgccgagaccaacgtcccggactccaccttcaccaactacgacgccgccgccaacggccgcggccggagcttcgcgtcctactcccaggaggcgaaccatggggagaacggcttctccggctacggcaagaacggcaacggcgtgcgcgagacgttcaagtcctacggcaatgagtccaacgtgctggcctccggcttcgccaactacgggcagtccgccaacggcgccacggacaccttcacgggctacggcgtggaggggaacgtccctgagaacaggttccggagctacggcgccggcggcaacgctggcgtcgacaccttcaagaattaccgcgacgacggcaacgtcggcgacgacaggttcacctcctacgccaagggcgcaaacggcggcgcggcggagttccagagctacggcaactcggccaacccgggcagcaccatcttcaagggctacggcgagggcaccaaccccaaccaccacattgggttcaaggagtacgccggcgagaacaacaccttcaagggctatgccaagagcggtgtggacttcaaggggtaccacaacaccaccgtctccagctccaccgccgcggtgctgacggtgtcggcggaggcagcggcatcgatgcatcacgagcacctgaagtggtcgccggagcccgggaagttcttcagggagcgggagctcgtggccgggaaccgaatgccgatgccggacatcagggacaagatgccgcccagggcgttcctgcccagggccatcgccgcgaggataccgttcgagcccaacgccgtgtcggaggccttcgggctgcccctcgacacggcgctggggaaggccgtggcgtccacggtggcggagtgcgagcgcgcgccgagcaagggcgagacgaagcggtgcgcgacgtcggccgaggacgtggtggacttcgcggtggaggtgctgggcgacgacatcgtggtgcgcagcacggcgtccacggcgggcggcggcgggcgcgtccagctgggcgccgtggccggcgtggacggcggcagggtgacgcggtccgtgtcgtgccaccagagcctgttcccgtacctggtgtactactgccactccgtgcccaaggtgcgggtgtacgaggccgacatcctggccgccgatggctccggctccggcgagaagatcaaccgcggggtggccatctgccacctggacacgtccgactggagcccggcgcacggcgcgttcgtggcgctcggcggcaagcccggcgaggtggaggtgtgccactggatcttcgagggcgacatgacgtggacagtcgcggactgatggagtgagtgacgttcctctctgcctgcttgcaagagcacacgactaagaagaactactaagaagaattattttctccctctctctttctctctctcgcaaattattatttttgtccactcctttctcgatctaccttatatgacgaaggtggtaagaattggtccaggagaaaaaaaaaggtttggcgaacgatgagaatgttgtaaactgtaaatcttgggtaggggaatagctggcgatgtgattgccttggatcaaatcgctgctgttgttgtcatgatggtggtgcaaacaaagggagtttctgttattccaaaacaaaagcttggtgaaatttcatttcagcagtataaactgtaaagtgggtgtgcttcaagtacgccgtgtcattttcggtgtgtgtgtgtatgtatgtagcggatctcgcagaagcaaatagttccttccacggcctcatctcagaggaaaagcgagcagcttgttgt

SEQ ID NO: 6305 - DNA, 2252 bp, Setaria italica
aatccccatccccaaatctccaatggcttctcccaatccgcctccgccgcctcgcaccgtcctcctcctcctgctgctgctcctcttcccgcacaatgccgccgccgccgccgcgtccacggcggtgaacccgttcacggcgaaggcggccttcatccggtactggaaccgcaaggtgcccaacaaccgcccgcatccggccttcttcgtcgccaagctctctcccctcccggccgccgactccgcctccttcccctccgcgctgcccgacatccgcgcccgcctccccgcgctctgctcccgagccgggctcctctgcgccgggccggcgcggcgtcgctcgccgcggcggcggggacccgaggcgggggcccgttcaagggctacagcaacgccaacttctccaactacggcagcggcggcgacggcggggccgactcgttccggagctactccccggacctcaacatcgccgccgactccttccgccgctacgcgcgcgactcgtcggaccgcgccgaccgcttcgagtcctacgaggccgacggcaacgtcgtcaccgctaactttacctcctacgccggcggctctacgggcgggtcgggcaccttcgcctcctacgccgccgagacaaacgtcccggactccaccttcaccaactacgacgccgccgccaacggccgcggccgcggcttcgcgtcctacgcccaggaggccaaccacggggagaacggcttctccggctacggcaagaacggcaacggcgtgcgcgagaccttcacctcctacggcaacgagtccaacgtcatggcgtccgccttcgccaactacggcgagtccggcaacggcgccaccgacaccttctccagctacggcgtcgaggggaacgtccccgagaacacgttccggagctacggcgccggcgggaacgccggcgtcgacaccttcaagaagtaccgcgacgacgccaacgtcggcgacgacaggttctcctcctacgccaagggtgccaacggcggcggcgccgagttccagagctacggcaactcggccaacccggggagcaccacattcaagggctacggcgagggcaccaaccccaaccaccacatcggcttcaaggagtacgccggcgagaacaacaccttcaagggctacgccaagaccggcgtcgacttcaaggggtaccacaacacctccggctccaccgccgcgctcacggtgtcggcggaggcggcggcgtccatgcatcaccagcacctcaagtggtcgccggagcccggcaagttcttcagggagcgggagctcgtcgccggcaaccgcatgccaatgccggacatcagggacaaaatgccgccccgggcgttcctgccccgggacatcgccgccaagataccattcgatcccaacgccgtgtccgaggtgttcggggtgcccctcgacacggcgatggggaaagccgtggcgtccacggtggctgagtgccagcgcgcgcccagcaagggcgaaacgaagcggtgcgccacctcggcggaggacatcgtggacttcgctgtcgagatgctcggcaacgacgtcgtggtgcggagcacggcgtccacggccggcagcggcggggacatccggctcggcgccgtcacgggcgtggacggcggcaaggtgacccagtccgtgtcgtgccaccagagcctgttcccgtacctggtgtactactgccactcggtgcccaaggtgcgggtgtacgaggccgacataatgtccgccgcggccgacggtggctccggcgagaagatcaaccacggcgtggccatctgccacctcgacacgtcggactggagcccgacgcacggcgcgttcgtcgcgctcggcgggaagcccggcgaggtcgaggtgtgccactggatcttcgagggcgacatgacgtggacggttgcagactgaacaatcctcttcttgttcttgagggctaagaactagtaagaaggatcggcaattttttttttcttcactgctttctcatcaacctgccttaaggtggtaagaatttgtgcgatttgtgtaggagatcgaaaaagggttggtaagtcagtaatcagatgtaaactgtaaatcccgggaaatctttgggagggggaggtgtgggtgattcgattatcttgatcgaattgccttttgtcgcggtggtgaaaatcagaacaagatagttcttcaaaactaaaagcttggtcaaatttcagctaaaagtggtgggc

SEQ ID NO: 6306 - DNA, 2191 bp, Setaria italica
tgccctttgccatcctggaactcactcactcacatcctcactctcactctccttccctccctccccactcttgcttattaatccatccctcctcttctcttaatccccatccccaaatctccaatggcttctcccaatccgcctccgccgcctcgcaccgtcctcctcctcctgctgctgctcctcttcccgcacaatgccgccgccgccgccgcgtccacggcggtgaacccgttcacggcgaaggcggccttcatccggtactggaaccgcaaggtgcccaacaaccgcccgcatccggccttcttcgtcgccaagctctctcccctcccggccgccgactccgcctccttcccctccgcgctgcccgacatccgcgcccgcctccccgcgctctgctcccgagccgggctcctctgcgccgggccggcctcctccgccggcgccgacgccgacgcggcgtcgctcgccgcggcggcggggacccgaggcgggggcccgttcaagggctacagcaacgccaacttctccaactacggcagcggcggcgacggcggggccgactcgttccggagctactccccggacctcaacatcgccgccgactccttccgccgctacgcgcgcgactcgtcggaccgcgccgaccgcttcgagtcctacgaggccgacggcaacgtcgtcaccgctaactttacctcctacgccggcggctctacgggcgggtcgggcaccttcgcctcctacgccgccgagacaaacgtcccggactccaccttcaccaactacgacgccgccgccaacggccgcggccgcggcttcgcgtcctacgcccaggaggccaaccacggggagaacggcttctccggctacggcaagaacggcaacggcgtgcgcgagaccttcacctcctacggcaacgagtccaacgtcatggcgtccgccttcgccaactacggcgagtccggcaacggcgccaccgacaccttctccagctacggcgtcgaggggaacgtccccgagaacacgttccggagctacggcgccggcgggaacgccggcgtcgacaccttcaagaagtaccgcgacgacgccaacgtcggcgacgacaggttctcctcctacgccaagggtgccaacggcggcggcgccgagttccagagctacggcaactcggccaacccggggagcaccacattcaagggctacggcgagggcaccaaccccaaccaccacatcggcttcaaggagtacgccggcgagaacaacaccttcaagggctacgccaagaccggcgtcgacttcaaggggtaccacaacacctccggctccaccgccgcgctcacggtgtcggcggaggcggcggcgtccatgcatcaccagcacctcaagtggtcgccggagcccggcaagttcttcagggagcgggagctcgtcgccggcaaccgcatgccaatgccggacatcagggacaaaatgccgccccgggcgttcctgccccgggacatcgccgccaagataccattcgatcccaacgccgtgtccgaggtgttcggggtgcccctcgacacggcgatggggaaagccgtggcgtccacggtggctgagtgccagcgcgcgcccagcaagggcgaaacgaagcggtgcgccacctcggcggaggacatcgtggacttcgctgtcgagatgctcggcaacgacgtcgtggtgcggagcacggcgtccacggccggcagcggcggggacatccggctcggcgccgtcacgggcgtggacggcggcaaggtgacccagtccgtgtcgtgccaccagagcctgttcccgtacctggtgtactactgccactcggtgcccaaggtgcgggtgtacgaggccgacataatgtccgccgcggccgacggtggctccggcgagaagatcaaccacggcgtggccatctgccacctcgacacgtcggactggagcccgacgcacggcgcgttcgtcgcgctcggcgggaagcccggcgaggtcgaggtgtgccactggatcttcgagggcgacatgacgtggacggttgcagactgaacaatcctcttcttgttcttgagggctaagaactagtaagaaggatcggcaattttttttttcttcactgctttctcatcaacctgccttaaggtggtaagaatttgtgcgatttgtgtaggag

SEQ ID NO: 6307 - DNA, 2421 bp, Glycine max
tccgttacgtcatcgttttttgtcgctcgaacctgcaagcacactttagtccattctctcagcggtggagaattgaattcttgaattgaagcctttgtccctgtcaccgagattcaattcttctccatcattgaaatttgagacacaacttaactcaggggttaggatttgatgaatccaatgggaactagtaccgtaagcgacgaagaactcaaagagattgagaatctcggaagagaggacattgaagaggctccaattgtgcctgaggatgtgagcagaatagcaccatggataagacagattacacttcgggggctagtagctagcttcctgattgggataatttatagtgtgattgtgatgaagctgaacctcacaactgggttagtccccaatctcaatgtctcagctgctctccttggctttgtgctcattagagcttggactaaggttcttgcaaaggccaagattgtttcgactccgttcactagacaggagaacaccatcatccagacttgcgcggtcgcttgctatagcatcgcggtaggaggtggtttcggttcttatctcctgggtttgaataggaggacttatgagcaagcaggggttggcacagaggggaataatccgggtagtaccaaggagcctggaattggatggatgacagcctttctctttgtgaccagctttgttggattgttggcgttggttcccattcgaaagattatgataatagactacaaattaacttatccaagtggaactgctactgctgttcttattaacgggttccatactcctaaaggagatgtgatggccaagaagcaggttcatggtttcttgaaattcttctcagccagtttcctctgggctttctttcaatggttttattcgggtggagataactgtggatttgttcagtttcccacttttggattgaaagcatggaaaaactcattttattttgatttcagcatgacttatgtcggagcaggaatgatttgttcccatcttgtaaatttatcattgcttcttggtgctgtgatttcatggggcattatgtggcccttaatcaggggactaaaaggggaatggtttcctgcaagcataccagaaagtagcatgaagagtcttaatggttataaggtttttatttctattgctttgattcttggtgatgggctttacaattttgtcaaagtcctctatttcactgccacgaatattcatgccaccgtgaaaaggaagaaccccgaaacattttcagataaccagaaaccactccctcttgatgatcttagacggaatgaagtgtttgcaagagaaagcattcctatatggttggcatgtactggatacatattattctccatcgtttctatcattgtaatccctttgatgttcccacagttgaagtggtattacgtggtgtttgcctatcttttcgcaccctctcttggcttctgcaatgcttatggtgcaggtttaaccgacatgaacatggcctataactatgggaaagtggctctctttgtgctttcagccttggccggaaaaaatgatggtgtagttgctggacttgtggggtgtggcctgataaaatccattgtttcaatttcatctgatttgatgcatgatttcaagactggccatctcactttcacttcccctcgttcgatgcttctaagccaagcaattgggacagcaataggttgtgtagttgctcctctcacattcttccttttttacaaggcttttgatgtggggaacccagatggggactacaaggctccgtatgccatcatatatagaaacatggcaattcttggtgtggaaggcttttctgcccttccccatcattgcttgcagctttgttacggatttttcacatttgccatagcggccaacttggtcagagatcttggccccaaaaagattgggaaatggattccacttccaatggcaatggctgtccccttcctagttggtggttactttgccattgacatgtgcatgggtagtttggttgtgtttttgtggcacacacttaacagaaatgaggctggtttgatggtccctgcagttgcttctggtttgatttgtggagatggattatggattctcccttcatccattcttgctttgttgaaaattcgtcccccgatctgcatgagcttcctgtcagccagtgccagttagaacttagaagttcacaataacattcaaatatatagatagatgcagtcaacttagtacctacgttcattattatgggcataatgtcgtaggaggcttgcttattagcaatttcattcataaagattctgctcttagagaatcttgaacgacatgtaaatattttgacatacttgttgattagagaaagtaatcaatttgagcgcacattccatctctcta

SEQ ID NO: 6308 - DNA, 2068 bp, Cajanus cajan
aattattatttttcttctgcctcttgccttatttgttttcttgatgattgatcattcacccagggtcgaggatttgatgaatccaatgggtactagtgctataagcagcgaggaactgagagagattgagaatctgagcagagaggacattgaagaggctccggtagtgactgaggatgtgagcagaatagcaccatgggcaaggcagattacgattcggggactagtggctagtcttctgattggaataatctatagtgtgattgtgatgaagctcaacctcacaactgggttagtccccaatctcaatgtctcagttgctctccttggctttgtgttcattcgagcttggactacggttcttgcgaaggccaaaattgtttcaaccccatttactaaacaggagaataccataatccagacttgtgccgttgcttgctacagcatcgcggttggaggtggttttgggtcttatctcttgggcttaaataggaggacctatgatcaggcaggggttgatactgaggggaataatcctggtagtaccaaggagcctggaattggatggatgacagcctttctctttgtgaccagctttgttggcctgttggccttggtccccattagaaagattatgataatagactacaaattatcatatccaagtggaactgctactgctgttcttataaacgggttccatactcctaaaaaagatgcgatggccaagaagcaggttaatggtttcttgaaattcttctcagccagtttcctctgggctttctttcaatggttttacacgggtggagatagttgtgggtttgttcagtttcccacttttggattgaaagcatggaaaaactcattttatttcgatttcagcatgacttatgttggagcaggaatgatttgttcccatcttgtaaatttatcattgcttcttggtgctgtcatttcatggggtattatgtggcccttaatcaggggactaaaaggagaatggtttcccgcaagtataccagaaagtagcatgaaaagtcttaatggctataaggtttttatttccattgcattgattcttggcgacgggctttacaatttcgtcaaagtcctctatttcactgccacgaatatccacgccaccgtgaaaaagaagaacattaataaattttcagataaccagaaaccactccctcttgatgatcttagacggaatgaagtgtttgcaagagaaagcattcctatatggttggcaagtgctggctacatattattctctatcatatccatcattgtaatccctctgatgttccaccagttaaagtggtattacgtggtgtttgcctatcttttcgcaccatctctcggtttctgcaatgcttatggtgcaggcttaaccgacatgaacatggcctataactatgggaaagtggctctctttgtgcttgcagccttggctggaaaaagtgatggtgtagttgctggactcgtggggtgtggcctgattaaatccattgtttccatttcatctgatttgatgcatgatttcaagactggccatctaactttcacttccccacgttcaatgcttataagccaagccattgggacagcaataggttgtgtagtggctcctctcacgttcttccttttctacaaggcctttgatgttgggaatccaaatggggattacaaggctccatatgccatcatatatagaaacatggcaattcttggtgtggaaggcttctctgccctcccccaacattgcttgcagctttgttatggattctttgcatttgccatagcagccaacttggtcagagatcttgccccccaaaaggttgggaaatggattccactcccaatggcaatggctgtccctttcctagttggtggttactttgccattgacatgtgcatggggagtttggttgttttcatttggcacacactaaacacaaatgaggcacgtttgatggttcctgcagttgcttctggtttgatttgcggagatggattatggattctcccttcatccattctagctttgttaaaaattcgtccc

SEQ ID NO: 6309 - DNA, 2579 bp, Medicago truncatula
agagttttagtttaagccatcatcattgaatattaattctttttcctatttctcttaaactttttttcaatcacagtggtggaatctgtgaatccaatggatactagaagcaatgaagaagaaagagagattgagaatcatcacattgaagagggtcaagtggctatggatgaagagttgaatagaatagcaccatggaggaaacagataacagttagaggactaatagctagtcttataattggaataatttatagtgtgattgtgatgaaactcaatctcactactggattagtccctaatctcaatgtttctgctgctctacttggtttcgtgtttattcgaagttggactaagattctttcaaaagctaatattgtatcagctccattcacaagacaagagaatactatcattcaaacttgtgcagttgcttgctatagcatcgctgttggaggtggttttggatcttatctattggggttgaataggaggacttatgagcaagcagggattgatacaccagggaatactcctggtagtaccaaggagcctgcaattggttggatgacagcatttctatttgtgaccagttttgttggacttttagctttggtccccatcagaaagataatgattatagactacaaattaacttatccaagtggaactgctactgctgttctcattaatggattccatactcctaaaggagatgtgatggccaagaagcaggttcatggattcgtgaaattcttctcggcaagttttgtgtgggcattctttcagtggttcttcaccggtggagataattgtggatttgttcaatttcctacttttggattgcaagcatggaaaaactcattttacttcgatttcagtatgacttatgttggagcaggaatgatttgttctcatcttgttaatttatcattacttcttggtgctgtggtttcttggggcatcatgtggccattaatcaaaggactaaaaggagaatggttccctgctagtataccagaaagtagcatgaggagtctcaatggttataaggtttttatttccattgccttgattcttggtgatgggctttacaattttatcaaagttctctatttcactggcacaaatatccatgccaacatgaaaaagagggatcttaatacattctccagtaaccagaaaccattgcctcttgatgatctcagacgtaacgaaatgtttgcaagagaaaatattcctatatggttggcatgtacagggtacgtattgttttccatcgtctcaattgttgtaatcccgttgatgttccctcaggtgaagtggtatttcgtcctgtttgcgtatatttttgcaccctcgctcggcttctgcaatgcttatggtgctggattaactgatatgaacatggcctataactatggaaaagtggctctctttgtgcttgcagccttagctggaaaaagtgatggtgtagttgctggacttgtagggtgtggtttgattaaatctattgtttcaatttcatctgatttgatgcacgatttgaagactggccatctcactctgacttcaccgcgttcgatgcttgtaagccaagcaattggtacagcaataggttgtgttgttgctcctgtcacattcttccttttttataaggcttttgatgttggaaatccagatggtatttacaaggctccatatgctattatatatagaaacatggcaattttgggtgtggaaggcttttctgctcttccagatcattgcttgcaattgtgttgtggatttttcgcatttgctatagtggctaatttggtcagagatcttggcccacaacaagttgggaaatggattccacttccaatggctatggctgtgccttttttagttggtggctactttgccattgatatgtgtgtgggcagtttagttgtgtttgcatggcatatgctgaacaaaaaggaagctggtttgatggttcctgcagttgcttctggtttgatttgtggagatggattgtggattcttccttcatccattctcgctttgttaaaggttcgtcccccaatatgcatgagcttcttcccatctaggtagaatgttcggatttggatttggtgcagtaactgcgtcccaaggttatctatttcaaccgttcaatctcaaattaattgccgagataattttaagctgcttttgttattgcgcaatcaggaacatccaatctgagatcattcggtagagatagatatctgtgtaactgcatcttttgtttactgcagcaagtccaaagttcacattcagtgatataatattacttatagtgattagaggaattagatgtagttagattactctacctaaggtatttatggttataatgccataggatagctaggaggcttgcttattagttattatatatatatatatatacataaaatgtgcaagctttgtagtccagattaatatgtaaatccagcttatattccacaagaagaatgtgtacaaaaattgtaagcaaaaatactgtgacaaattttgacatatttgaataggatgaccaatttgagcac

SEQ ID NO: 6310 - DNA, 2016 bp, Prunus persica
gggcaaatggggagcacaaacaatgatgaaaacggagagattgagacctttgagagagaggatggagttgaagagaatggaggcgagccagaggatttgaacagaatcattccatggacaagacagatcacaattcggggacttgtggctagcatagtcataggcaccatttacagcgttatagtgatgaagttgaacctcacaactgggttggttcccaatctcaatgtctctgctgctcttctggcctttgtattcatccgcacatggactaagcttcttcagaaggctggaattgtatcaactcctttcacaaggcaggaaaataccattattcagacttgtgcagttgcatgttatagcattgcagttggaggaggttttgggtcttatctgttgggtctgaacaggaagacttatgagcaagcaggtgttgatactgaggggaacactcctaggagcaccaaagaacctcagattggttggatgactggtttcctctttgttagtagttttgttgggctgctggctttggttcctctcagaaagatcatgataatagactataagttaagttacccaagtggaactgctactgctgttcttatcaacgggttccatactccaaaaggagacaagatggctaagaagcaggttcacgggttcatgaaattcttctcgatgagtttcttgtggagtttctttcagtggttctattctggaggagaccaatgcggattcgctcagtttccaacatttggattggcagcgtggaaaaactcattttactttgatttcagtatgacttacataggagcgggaatgatctgttcgcatcttgtgaacttatctttgcttcttggtgccgtgctctcttggggaataatgtggccattaataaggggtctcaaaggagagtggttccctgcaactttatcagaaagtagtatgaagagtctaaacggctacaaggttttcatttccattgccctgatactaggagatgggctatacaattttctcaagatactatactttactggctcaagcatccacaccaaaatgaacaacaagaaccccaaaacagtttcaaataaccagaatcaggctcttgatgatcttcgacgaaatgaggtcttcataagagatagcattcccatttggatagcttgcctagggtacaccttgttctccatcatctccatcataattatcccgctcatgttccctcaactgaaatggtactatgtagtcgtagcctatattatcgcaccctctctaagcttctgcaatgcttatggtgcgggtttaactgacatgaacatggcctataactacgggaaagtggctctctttgtgcttgctgctgtggctgggaaaaatgatggtgttgttgcgggacttgtgggatgtggtctgatcaaatccatagtttctatctcttctgatctgatgcacgatttaaagactggacatctcacgcttacatctcctcgatcaatgcttttaagtcaggcgattgggacagctataggctgtgtggtagctcctctgacattctttctcttctacaaggcttttaatgttggtgacccggatggtgaatacaaagctccttatgccatcatttacagaaacatggcaattctaggtgttcaaggcttctctgccctgccccagcattgcttacagctgtgttatggtttttttgcatttgccgtagcagctaatttgctgagagatcttgctcctaagaaaattggtaaatgggttccacttccgatggcgatggctgttcctttcctagttggagcttactttgcaatcgatatgtgtgtggggagtttggctgtgttcgtgtggcacaaactaaaaaataacgaggcaggtttaatggttcccgcagttgcttctggtttgatttgtggagatggattgtggatcctcccttcatcaattcttgcattggccaagattcgtcctcccatctgcatgaacttcctcacaaccaagtag

SEQ ID NO: 6311 - DNA, 3055 bp, Theobroma cacao
ccttttggcttttgatacataccactctacttttaacattaattaacgtgaggggaccaaaagaaaagtggaaagagactaaaaaaaaaatactaacaacaatattgctattatattttattttgatggggatcaaaatttatgtccaaacaaacatatattgagatgtgtccgggtcaatggtggaaggttgagaaatgtactgcaaagcatgttttgtactactctgtagtacatgcaaagggtcttgaattactgctatattttctgttggggttggacccgttggtaacctgtggttactatgatataagaccaagcaatttaaactttgccaaattgcaaagtcttggatttgcttatcttgagataccctgttgaagattttggagtgatctcggctcaggtgcggtattcaatgccctggtgatattgcattgaattgaatttaagtaccgctttggctttttctggggcttgtggattgctcgtggtcctcttggggtgtttattactactcgatccattgaattgaaacactaaacttggatattaacggtttctttttccttgtgtttggagcgttttgcggttcaactcgaggagtgatacgcagaagtcaatacgatggcgaagaattagatgtaacaaatttgagcctgtctaagtctttttccgagggtctggtctttgctgaactccagcaaaagaggaaagcaagaagaagaaaaagctgctcactgagttacgcttgtaagaaccagattttatccatccaatgggaaccacgaacatggaagagatgaaggagattgagagagtggagagagaagatctagaagagaagaataccgagacagaggatttgaagagaattgcaccctggatgagacagataacaatacgagggcttattgctagcttccttattggtatcatatacagtgtgatagtcatgaagctcaacctcacaaccgggctagttcccaacctcaatgtctcggctgctcttcttgcctttgtacttgttaggtcgtggactaaactgcttcaaaaggctggatttgttgcaactccatttactcgacaagagaatactataattcaaacctgtgcggttgcttgttatagtattgctgttggaggtggttttggttcatatctgttgggtttaaacaggaagacatatgagcaagcaggcgttgattcagcaggcaataatccagggagcatcaaggaacctgggattggttggatgatcggttttctctttgtgagcagctttgttgggcttttggcattggttcctctaagaaagataatgataattgactacaaattgacttacccaagtggaactgctaccgctgttctgataaatgggtttcatacccctaagggagacaagatagctaagaagcaggtgcatgggtttctgaaattcttttcactcagtttcctctgggctttcttccaatggttctatgcaggtggagatagatgtggatttgctcagtttcctacatttggtttgaaagcgtggaaaaactcattttactttgatttcagtatgacttacataggagcaggaatgatctgttcacatcttgtaaacttatctttgctccttggagcggtgctttcctggggggtaatgtggccactaataggcgggctcaagggagagtggttcactgctactttgccagaaagcagcatgaagagtctaaatggttacaaggtatttatttctattgctctaatcctgggggatgggctctacaattttctgaagatactgtttttcactgccagaagcattcacgtcagagtgaaaaataacaacagcaaaacattttctgatagccagaagcagcatgtggatgttcttcagcgaaatgaactatttgtaagagagagcattcctatgtgggtagcatgtttaggatacacccttttttctatcatctccatcattgtgatacctctgatgttccctgaactaaagtggtattatgtagttgttgcttacattcttgcaccatctctaagcttctgcaatgcttatggtgctggtctgactgacattaacatggcctataattatggaaaagtagccctctttgtgctagctgccttgtctggaaaggaaaatggtgtggttgcaggactcgtgggctgtggtcttattaagtctattgtttctatctcttctgatttgatgcatgatttcaagactggtcatctaactctcacttctccaagatccatgctcctcagccaggcaattggaacagccattggctgtgttgtagctcctcttacattctttctattctataaagcttttgatgtggggaaccctgatagtgaatacaaagccccatatgccctcatttatcgaaatatggcaattcttggtgttcaaggcttctctgcccttccccagcattgtttgcagctctgctatgggttcttttccttcgccatagcagccaacttgttgagagattttactcccaagaatattgggaaatgggctccccttccaatggctatggctgtgcctttcctagttggtgcctattttgcaattgatatgtgtgtggggagcttggttgtgtttgcatggcacaagctaaacggaaagaaggcaggtttgatgattcctgctgttgcttctggcttgatatgcggagatgggttgtggcttcttccttcatccatccttgctttgtttaaggttcgtcctccgatctgcatgaacttcctggcaacaacatagactatgttatgaggacagagagaaagaaatagaccagagaggttttgttagttgcagttaggaaaaattaatcatagttgaaatgcaaaatggattaccgaccagaatagggttgatacacaactacacaagctgtgcaaaggcaaaattttagatatatgtatttaagctgctctaaagtagcactttgtacatgcctgaagtggcaggaaaaattagttagctgtgaggtatatcaaaaggttgtaataagaaatcagcttaggtgaa

SEQ ID NO: 6312 - DNA, 2826 bp, Gossypium hirsutum
gatgcggaattcaatgctctttgttgattttgatctttgcattgaattaaatttatttatcgttttggcctttcgcgaagcgtgtggttcgctcgtggtccttttagaggtgtttatttactgctgcctcgaccattgaactgaaatactcaaaacttagattttttggatattttcttcattgtatttggagctttctgcaggtcaactcgaggaaggacactcttaagttaatatgaaacaagtttgctgagctgaactttggcaagaagaagaacaagctgatcatcaagactagcaagccaagaaccagatttttattaaatggggaacatgaacatggaggagatgaaagaaattgaaagggttgagagagatgatttagaagagaggattgatgagcaagaagagttgaagagaattgcaccttggacgaaacagataacaattagaggactcattgctagccttcttattggtatcatatacagtgtgatagtgatgaagctcaatctcacaactgggctagttccgaaccttaatgtctcggccgctctgcttgcctttgtattggtcaggtcatggacaaagttgctgcaaaaggttggatttgtttcaactccattcactagacaagagaatactatcattcagacctctgcagttgcttgttatagtattgctgttggaggtggttttggatcttatctgttgggtttaaacaggaagacatatgaacaagcaggagttgatgccgtaggtaataatcctgggagcattaaggaacctgggatcggttggatgactgggtttctctttgtgagctgctttgttgggcttctggcattggttcctctaagaaagattatgataattgactacaaattagcttacccaagtggaactgctacagctgttttgattaatgggtttcatacccccaaaggagacaaaaatgctaagaagcaggttcatgggtttctgaaattcttttcatttagtttcctctgggctttcttccaatggttctatgcaggtggagattcatgtggattttctcagtttcccacatttggcttgaaagcctggaaaaactcattttactttgatttcagtatgacttacataggagcaggaatgatctgtccacatctagtaaacttatctttgctccttggtgcggtgctttcttggggagtaatgtggccactgatcggtgggctcaagggagagtggttccctgcaacattacctgaaagcagcatgaagagtctaaatggttacaaggtttttatttctattgctttgatcctgggggatggactctataattttctgaagatactgttcttcactgccagaaacattcacgctaaagtgaaaaatagcaaccgtaaaacatctcccgataaccagaaacagctcccagatgatcttcatcgaaatgaactattcaatagagagagcattcctatttgggtagcatgtgcaggatacacctttttttctgtcatttccgtcattgtaatccctcagatgttccccgagctgaaatggtattacgtagttgttgcttacattcttgcaccctctttgagcttctgcaatgcttatggtgctggtctgactgacatgaacatggcctataattacggaaaagtagccctcttcgtgcttgctgccttgtccggaaaggaaaatggtgtggttgctggactcgtgggctgtggtcttattaaatccattgtttcaatctcatctgatttgatgcatgatttcaagaccggtcacctaactctcacttctccaagatccatgcttctcagccaggctatagggacagccatcggctgcattgtagctcctcttacattctttctcttctataaagcttttgatctggggaaccctgatggtgaatacaaagccccatatgctctcatttatcgaaatatggcaattcttggtgttcaaggcttctctgcccttccccagtattgtttgcagctctgctatgggtttttttcctttgcgatagcagccaacttgttgagagattttactcccaagaatatcgggaaatggattccccttccaatggcaatggctgtgcctttccttgttggtgcttattttgcaattgatatgtgtgtggggagtttggctgttttcgcatggcacaagctaaatcgaaagaaggccagtttgatggttcctgctgtcgcttctggcttgatatgcggagatgggctgtggcttcttccttcatcaatccttgctttgtttaaggttcgtcctccaatctgcatgacattcttggcaacaacatagactatgttaataacacagagaaagataagagagttggcaggcctatttagttacattttacaaaaactaactttgttgtagttggaaacaaaaaaaaaaagaattctgaccagtatagtgttcgatagacgatagacaatctgtgtcttctagtaataggtaaaagacaacattttagatatgtatctatgctgttctaaagtaacacaccttatattatatgagcttgaagcctcaggaaaagagttagttcttatgcatatcagttgtaacaaaatccagcttagatgaagaataaagagctattcaataaagggttccgaattcaagcaaagcaactattctgttacttgtacctttgtgtattgtcattcagacaaattggttgtcttgttggatacagttttcttaaagttgttctaattgtcttgttcatacttcaaatatatggaaatctgtttgcttatatataaaaaagaaaaagtaccgactgcg

SEQ ID NO: 6313 - DNA, 2256 bp, Manihot esculenta
aatattttgatgaataatctaatggggactgtgcacatggaagaaacgaaagggattgagaaggagaattcggaagagatgggagatgagccagagtacacaagtagaattgctccgtggaataaacagatcacagttagaggggtcgtagctagcttagtaattggcatcatatacagtgtgatagtgatgaagctgaacctcaccacaggcctagtacccaatctgaatgtttctgctgctctactggcttttgtttttattagaacatggactaagcttcttcagaaggctggaattgtaaccaatccgttcactagacaagagaataccataattcaaacttgtgccgttgcttgttatagcattgctgttggaggtggttttgggtcttatcttctggcattgaataggaagacatatgagcaagctggagttgatacagaagggaatgctcctggcagcataaaggaacctgggattggctggatgactggtttcctctttgttagcagttttgttgggctgcttgcgttggttcctcttaggaagatcatgataatagattataaattaacttatccaagtggaaccgcaactgcggttctcatcaatggtttccatacttctaaaggagacaagcttgctaggaagcaggttcatgggttcatgaagttcttttcaataagcttcatctgggctttctttcagtggttttactctggtggagagagatgtggattttctcagttccctacatttggattgaaagcttggaaaaactcatttttctttgacttcagttctacttacgtaggagcaggaatgatctgttcccatcttgtgaatttgtctttgctacttggcgctgtactttcttggggaatcatgtggccactgataggagggaataaaggagattggtttcctgctactttaccagaaagcaatatgaagagtctaaatggttacaaggtctttatttctattgctctgatcctcggagacgggctctacaattttgtcaagatactatattttactgccaatagcatccgtgccagagcaaagactaacaattctagaacagatgagtcgaaacaagctccggatgatcttcggaggaatgaatttttcataagagaaactattccaatgtgggtagcatgtttagggtacactgcgttctccatcatttccatcattgtgatccctctcatgtttcctgagctaaagtggtactatgtagtggttgcctacattcttgcaccttctcttagcttctgcaatgcttatggtgctggtctaaccgacatgaatatggcgtataactatggaaaggtggcccttttcatacttgcagccatatctggaggaaataacggggttgtcgcaggacttgtgggatgtggcctgattaaatccattgtttcctattcttctgatttgatgcatgatttcaagactggtcatctaactcttacttctcctcggtcgatgcttcttagccaggtgattgggactgcaataggttgtgttgtagctcctcttacattctttctcttctacaaggcttttgatgtggggaatcctgatggagagtataaagctccatatggcctcatataccgaaacatggcgattcttggtgtcgaaggattctctgcccttccccagcattgcttgcagctttgttatggtttttttgccttcgctatcgcagccaatttggtaagagatctattcccaaaaaacattggcaaatggatccctctcccaatggctatggcagtacctttcttagtcggggcgaacttcgcaattgatatgtgtgtggggagtctggttgtgtttgcttggcacaagctaaacagcagaagagcaggtttgatgattcctgcagtggcctccggcttgatctgtggagatggtttatggattctcccctcatccatccttgcactggctaaaattcatcctccaatatgcatgagtttcaagtagaaatgcggttgagagctcgcaaaatctgtagcttttgaccaataaactttattataggcacaaatatagagaataattagagagcttccccttcttaagcagtaagttgcagggcacgttgaaatagtgtattgtatacaggaactagttagagcaatcaaaaaataaaaaataaaaatatatttcttatttgaaattggaaaacaataagatagaataaataaataaaatcatttgattttgttttttcaa

SEQ ID NO: 6314 - DNA, 2473 bp, Gossypium hirsutum
gaacatggaagagatgaaggagattgagggagttgagagacaagattcagaagagatgaacaatgaacaagaggagttgaagaggattgctccctggatgaaacagataaccattcgaggactggttgctagccttcttattgggatcatatacagtgtgatagtaatgaaactcaacctcacaacagggctagtacccaacctcaatgtctcggctgctcttcttgcctttgtatttattaggtcttggacgaagctgcttcaaaaggctggaattgtttcaactccatttacccgacaagagaataccataattcagacctgtgcggttgcttgttatagtattgctgttggaggtggttttgggtcttatctattgggtttaaacaggaagacatatgagcaagcaggcattggtacagaaggcaataatccttggagcatcaaggaacctgggattggttggatggttggtttctctttgtgagctgctttgttggtctcctggcattagttccactgagaaagatcatgataattgactacaagttgtcttatccaagtggaactgctactgctgttctcattaatggatttcatactcctaaaggagacaagatagctaagaagcaggttcatgggtttgtgaatttcttttcacttagtttcctctgggccttcttccagtggttttatgccggtggagataaatgcggatttgctcagtttcctacatttggtttgaaagcatggaaaaattcgttttactttgatttcagcatgacttacataggagcaggaatgatatgttcacatcttgtaaatttatctttgcttcttggggcagtgctttcttggggagtaatgtggccactcataggtgggctcaagggagagtggttccctgcaactttaccagaaagcagcatgaagagtctaaatggttacaaggttttcatttctattgctttaatcctaggcgacgggctctacaattttctgaagatactatttttgattgctagaggcattcataccaatgtgaaagttagaagccttaaaatattttcccatgagcagaagcagcaacagatcgatcttcaacgaaacgaactatttgtaagagagaacattccaatttgggtagcatgtgcagggtacaccattttttcaataatttccatcgttgtaatccctctaatgttccctgagctgaaatggtactatatagttgttgcttacatcctcgcaccctctctaagtttctgcaacgcttatggtgctggtctaactgacatgaacatggcctataattatggaaaagtagccctctttgtgcttgctgccatgtccggaaaggaaaatggtgtggttgctggacttgttggttgtggactgattaagtccattgtttctatctcttccgatttgatgcatgattttaagactggtcatttaactctcacttctccaagatccatgcttgtcagtcaggcaatcggaactgccattggctgcgttgtagctcctcttacattctttctcttctataaagctttcgatgtggggaaccctgatggtgaatataaagcaccatatgctctcatttatcgaaatatggcaattctaggcgtgcaaggcttctcggcactaccccaccactgtttgcagctctgctatgggttttttgcctttgccatagcagccaacttgttgagagattttagccccaaaaacattgggaaatgggttccacttccaatggcaatggccgtgcctttccttgtcggtgcttattttgctattgatatgtgtgtggggagtttggtcgtgtttgcatggcacaagctaaatggcaagaaggctgatttgatggttcctgctgttgcatccggcttgatctgcggagatggcttgtggcttcttccttcatctattcttgctttgtttaaggttcgtcctccaatctgcatgagcttcttcgcatcgacgtagacttatttccgaagacatatagaggtagaataaagacagaggctttgttagctacatttagcataaatcgaatgtagtagttggatatgcattcaacttattaccgaccagtatagtgtctgatacacaagctgtctttgagtgctaggtaaaaggcaacatttgagacacacacacacacacacaatcacacacgcatatatatagatctctaagctggtctaatttgacatgcaattatttgaggttgaagtggcaggaatagttaattttgatgtatgtcagtaagaaaaacaaaattgtaataagaagtcagtttaggtgaagaataaacatcaacatcccataaatgatttaggatatgtaaccttgctttctatttttagttgtattgctggataaaaggtttccttaaagctttactgttttcctacgaggatatcttctaatttagagaaacagcccaacttacttacaa

SEQ ID NO: 6315 - DNA, 2612 bp, Manihot esculenta
ggtttatatatcaaagtttggaattttcaagttcaatgtatcagctggttctttggctaccgaaaataatgtgcgaggctgttctgattatcgaaatatcatttggggtgtgctttttgttttggcatttaatgctactatcctgattaaattggaaggctcaataggtgcttgttttttttcctcttacagacaaggcagcttgtgggctaatgcagaaaacatattacccacgtttgctgctgattttgtaagttttttcacttttttccgcctgactggacgttcttggaaggtttgtttgtgcgggcaactttttagttgagatttctctttgacaaaatgttccaagttggaattttgtgatcatttcaatgttctgatatttcccaccaaagagaagaagaaaaccagcagcaaggagaataattaaaggaagaagattggatgaataatataatggggaatgtgaacgaggaagagatgagagaaattgagaaatttgagatggagaatttggaagagatgaggaatgagccagaggatatgagtagaattgctccatggactaaacagatcacaattagaggactcatagctagtttagcaattggcatcatatacagtgtgattgcaatgaagctaaacctcaccacaggactagtccctaatctgaacgtttctgctgctctactggcttttgtttttattagaacatggaccaagctccttcagaaggctggaatagtaaccagtccattcactcgacaagaaaataccataattcaaacttgtgctgttgcttgttatagtattgctgtcgcaggtggctttgcgtcttatcttctgggattgaacaggaagacgtatgagcaagctggggttgatacaaaagggaatactcctggcagcacaaaagaacctgggattggttggatgactggtttcctcttcgtaaccagttttgttggattgcttgccttggttcctctcaggaagattatgatactagattacaaattaacttatcctagtggaactgcaactgcggttctcatcaatgggttccatacttccaaaggagataagattgctaggaagcaggttcatgggttcattaagttcttttcaatcagcttcctgtgggctttctttcagtggttttacactggtggaggcaattgtggatttgctcaattcccaacatttggattgaaagcttggaaaaactcattttactttgatttcagtatgacatatgttggagcaggaatgatctgttcccatcttgtgaatttgtctttgctgcttggcgcgatactttcatggggaattatgtggccactaatagcagggcttaaaggagattggttccctgctactttacctgaaagcagtatgaggagtgtaaatggttacaaggtttttatttctattgctctgatcctaggagatgggctctacaattttctcaagatactgtatttcactgctagtagcatccgcaccagagctaagactggagatttgaaaacattatcagataagcagaatcaagatgatcttaggagaaatgaagttttcgtaagagagactattccaatttgggtagcatgtttaggatacaccgccttctccatcatttcaatcattgtgatccctatcatgtttcctgagctaaagtggtactacgtagttgttgcctacattcttgcaccctctctcagcttctgcaacgcttatggtgctggtctaactgacatgaatatggcttataactatggaaaggtggctctcttcgtacttgcagccttgacaggaggagacaacggtgttgtagcaggacttgttggctgtgggctgattaagtcaatagtttccatctcttctgatttgatgcatgatttcaagactggtcatctaactctcacttctcctcgttcgatgcttcttagccaggccattggtactgcaataggctgtgttgtagctccacttacattctttcttttctacaaggcttttgatgtggggaaccccaatggagagtacaaagctccatatgcactcatatacagaaacatggcgattcttggtgtccaaggtttttctgcccttccccagcattgcttgcagctttgttatgggtttttcgccttcgcgatttttgccaatttggtcagagatctatcccacaaaaaatttggcaaatggatacctctcccaatggctatggctgtgcctttcctcgtaggggcttacttcgcaatcgatatgtgcatggggagtctgattgtgtttgcatggcacaagctaaacagcaaaaaagcaggtctgatggttcctgctgtggcctctggcttgatctgtggagatggtttatggattcttccttcatccatccttgcattagctaagattcatcctccaatatgcatgagtttcagttagaaattctatctgagaccgaaatctgtagttgttattgcaggcacaaatcaagttaatgaaaagtaaaacaaatataaggatgattagagagttagggctttttaccatttcaagttgaaaaaaattttttttttttaaattttgatccataaaactttttt

SEQ ID NO: 6316 - DNA, 2608 bp, Citrus sinensis
agcacttcattcttcccacttctttattctttgaaacttccattttcataatcatacatgcccacccacctgtgacttggctctgagatgggagtcaacgagaaggatcaatgatttgtgaccaaccatgtgttcaaatgttaagttatgcgggttcattgaaacttgaaaggttcatgctgagtcaactcagagattgaagaagtgtttcgggcaagaaacaaataaagaagaacaactcatcaaggctgttaagaaatggggttcgatttcagattgtcgataggttaagctgggaacagagattttaataaatcaaaatggagagtaggtttggggaggaagaactgaaagagattgagaatgttagtcatcacgagaaagaggaattggatttggaagagatcaaagatcaaacagaggatgtaaagagaattccgccatggacaaatcatatcacaattcgtggtcttattgctagtgtagcgattggcatcatatacagcgtgatagtgatgaagctgaacctgactaccggcttagtccccaatctaaatgtttctgctgccctccttgcctttgtatttgtcaggacatggactaagttgctacataaggctggaattacggcaactccatttacacgacaagagaatactgtaattcagacatgtgcggttgcttgttacagcatcgctgttggaggtggttttgggtctaatctgttgggtttgaacaggaggacgtatcaccagtccggggttgacactccggggaacaatcctgatagcaccaaggaacctgagatcggttggatgattggtttcctctttgttaccagctttgttgggcttctagcactggtacctcttagaaagatcatgatcatcgactacaagttgagttatccaagtggaactgctactgcagttcttatcaatggatttcatactcctaaaggagacaagagagcaaagaagcaagtacatgggttcacgaaattcttttctcttagtttcctgtgggctttctttcagtggttctatgcaggaggagagcaatgcggatttgttcaatttcctacttttggactgaaagcttggaaaaattcattttactttgatttcagtatgacttatatcggtgcgggaatgatctgttcacatcttgtgaatttgtctttgcttcttggtgctgttctctcttggggaattatgtggccattgataaccgggcttaaaggcgattggtttccaaaaactttacctgaaagcagtatgaagagtctaaaatggtttacaaggttttcgtttctattgctcttatcctgggtgatggactctacaattttctcaggattctatactttactgccacaaacatccatgccagagctaagaaaagcaatctcaaaacagattcggataaccaggatcaagcacttgacaatcgtcaaagaaacgaaatatttattaaagagagcattccaatgtggacggcgtgtgtagggtacactgtcttctccattatttccatcattgtgatccctctcatgttccccaagctgaagtggtactatgttgttgttgcttacattctagcgccctctcttagcttttgtaatgcttatggtgctggtctaactgacatgaacatggcctataactatggaaaagtagccctctttgttcttgctgccttgtccgggaaagaaaatggcgtggttgctggacttgtgggttgtggtttgatcaaatccatcgtttccatctcttctgatttgatgcatgattttaagaccggtcatctcactctcacttcacccaggtcgatgcttgtgagtcaggccattgggactgccataggttgcgttgtagcccctcttacattctttctcttctacaaggcttttgatgttggtaacccagatggtgaatacaaagctccttatgctatcgtctaccgaaacatggcaattcttggtgttgagggcttctctgccctgcctcagcattgtttacagctctgttatgggttttttgcctttgccattgcggcaaacttactaagagatctttctcctaagaaaatagcaaaatggattccccttccaatggctatggctgttccattcctagttggtgcctattttgcaattgacatgtgtctcggaagcttggttgtgtttgcatggcacaagttgaatagcaagaatgcggatttaatgattcctgcagttgcttcaggcttgatttgtggagacggattatggatcctcccttcatcaattcttgctttggccaatgttcgtcctccaatctgcatgaagttcttggcatcctagtagaatttctttaagtggcgggaggcacagagagtcttagagtaagagagagcaaaaactgttgttgataacaaacaactagatcatagtaagatgaagttacaaagaaatagagaaagcacagcaactaaaataactgtactgaagctgccttaggattatgtatctttgcgagctgtagtgtcaatcaattaggaataatttatacaagcagttgtaaaatttactccttgtggttaataatatatgaattctgcgaaaaaa

SEQ ID NO: 6317 - DNA, 2268 bp, Malus domestica
accaaatggggaacaccaatggcgaaaacggagagatcgagacgtttgagacagagaatggacatgggattgaagagaatggatgtgagccacaggaggatttgaacagaatagtcccatggagaaggcagattacagtccggggactcgtagccagcgtaattattggggtaatttacagtgttatagtgatgaagttgaacctcaccactggtttggttcccaatctcaatgtttcggctgcacttctcgctttcgtgttcatccggtcatggactaagctgcttcaaaaggctggagttgtatcaactcccttcaccaggcaggagaatacaataattcaaacttgtgcagttgcgtgttatagcattgctgttggaggtggttttagttcgtatctgttgggtctaaaccgaaagacttacgagcaagttggggttaatactgaggggaacactcccgggagcaccaaggaaccagcgattggttggatgactggttttctatttgttagtagttttgttgggctgctggctttggttcctctcagaaagatcatgataatagactataaattagcatacccgagcggaactgctactgctgtccttattaacgggttccatactccaaagggtgacaagatggctaaacagcaggtccacatgttcatgaaattcttttcagctagtttcttgtggggtttctttcagtggttttattctggaggagagcaatgcggattcgctcagtttccaacatttggattgaccgcttggagaaattcattttactttgatttcagtatgacttatataggagcaggaatgatctgttctcatctcgtgaacttatctttgctcctcggcgccattctctcttggggagtaatgtggccattgataaggggtcttaagggagagtggtttcctgcaactttatcggaaagtagtatgaagagtctaaacggttacaaggttttcatttccatttccctgatactaggagacgggctgtacaattttctcaagatactatattttactggctcaaacatccacatgaaaatgatgaacaagaaccttaaaacagcttcaaataacaagaatgcaactgttgatgatcttcgacgaaatgaagtcttcataagggataacattcccgtttgggtagcgtgcgtagggtacaccttgttctctgtcatctccatcattatcatcccgcttatgtttcctcaactgaaatggtattatgtagtcgtagcctacctaattgcaccctctctaagcttctgcaatgcttatggtgcgggtctaactgacatgaacatggcttataactacgggaaagtggctctctttgtgcttgctgccgtagctgggaaaaacgatggtgttgttgctggacttgtaggctgtggtctgatcaaatcaatagtttctatctcctccgatctgatgcacgacttaaagactgctcatctcactctcacgtctcctcgatcaatgattttaagccaggctattggaacggccataggctgtgtggtagctcctcttacattttttctcttctacaaggcctttaacattggggatccagaaggtgaatacaaagccccttacgctatcatatacagaaacatggcaattctcggcgttgaaggcttctctgccctgccccagcattgcttgcagctgtgttatggttttttctcatttgccatagcaactaatctgctgagagatcttgctcctaagaaaatcgggaaatatgttccgcttccaatggcaatggctgtcccgttcctcgttggagcgtactttgcaattgatatgtgcatggggagtttggttgtgttcgtctggcacaagctgaataataacaaggcaagttcaatggttccggcagttgcttccggtttgatatgtggagacgggttgtggattctcccttcgtcgattcttgcattggccaagattcaacctcccatctgcatgaacttcttggcaaataagtagagctgagtttgcgccgtagactcgtagttgtgtttttcgagtacatataatttctgcaggtgcaatttcagcacagtataggggaattaatgataatagtttagttccctaatatgtaatttcaggtaatacataaagtaatgtagcattagtatagtagatgacggaacactatcctgatcagggcttaacccgcattttccatattgtatctgcattttcccctatgagattgcaccttcttctt

SEQ ID NO: 6318 - DNA, 2634 bp, Citrus clementina
ctttgaagtgaaggaataaaggttttaagcttagcacttcattcttcccacttctttattctttgaaacttccattttcataatcatacatgcccacccacctatgacttggctctgagatgggagtcaacgagaaggatcaatgatttgtgaccaaccatgtgttcaaatgttaagttatgcgggttcattgaaacttgaaaggttcatgctgagtcaactcagagattgaagaagtgtttcgggcaagaaacaaacaaagaagaacaactcatcaaggctattaagaaatggggttcgatttcagattgtcgataggttaagctgggaacagagattttgataaatcaaaatggagagtaggtacggggaggaagaactgaaagagattgagaatgttaatcatcacgtgaaagaggaattggatttggaagagatcaaagaccaaacagaggatgtaaagagaattccgccatggacaaatcatatcacaatccgtggtcttattgctagtgtagcgattggcatcatatacagtgtgatagtgatgaagctgaacctgactaccggcttagtccccaatctaaatgtttctgctgccctccttgcctttgtatttgtcaggacatggactaagttgctacataaggctggaattacggcaactccatttacacgacaagagaatactgtaattcagacatgtgcggttgcttgttacagcatcgctgttggaggtggttttgggtcttatctgttgggtttgaacaggaggacgtatcagcagtccggggttgacactccggggaacaatcctgatagcaccaaggaacctgagatcggttggatgattggtttcctctttgttaccagctttgttgggcttctagcactggtacctcttagaaagatcatgatcatcgactacaagttgagttatccaagtggaactgctactgcagttcttatcaatggatttcatactcctaaaggagacaagagagcaaagaagcaagtacatgggttcacaaaattcttttctcttagtttcctgtgggctttctttcagtggttctatgcaggaggagagcactgcggatttgttcaatttcctacgtttggactgaaagcttggaaaaattcattttactttgatttcagtatgacttatatcggtgcgggaatgatctgttcacatcttgtgaatttgtctttgcttcttggtgctgttctctcttggggaattatgtggccattgataaccgggcttaaaggcgattggtttccaaaaactttacctgaaagcagtatgaagagtctaaatggttacaaggttttcgtttctattgctcttatcctgggtgatggactctacaattttctcaggattctatactttactgccacaaacatccatgccagagctaagaaaagcaatctcaaaacagattcggataaccaggatcaagcacttgacaatcgtcaaagaaacgaaatatttattaaagagagcattccaatgtggacggcgtgtgtagggtacactgtcttctccattatttccatcattgtgatccctctcatgttccccaagctgaagtggtactatgttgttgttgcttacattctagcgccctctcttagcttttgtaatgcttatggtgctggtctaactgacatgaacatggcctataactatggaaaagtagccctctttgttcttgctgccttgtccgggaaagaaaatggcgtggttgctggacttgtgggttgtggtttgatcaaatccatcgtttccatctcttctgatttgatgcatgattttaagaccggtcatctcactctcacttcacccaggtcgatgcttgtgagtcaggccattgggactgccataggttgtgttgtagcccctcttacattctttctcttctacaaggcttttgatgttggtaacccagatggtgaatacaaagctccttatgctatcgtctaccgaaacatggcaattcttggtgttgagggcttctctgccctgcctcagcattgtttacagctctgttatgggttttttgcctttgccattgcggcaaacttactaagagatctttctcctaagaaaatagcaaaatggattccccttccaatggctatggctgttccattcctagttggtgcctattttgcaattgacatgtgtctcggaagcttggttgtgtttgcatggcacaagttgaatagcaagaatgcggatttaatgattcctgcagttgcttcaggcttgatttgtggagacggattatggatcctcccttcatcaattcttgctttggccaatgttcgtcctccaatctgcatgaagttcttggcatcctagtagaatttctttaagtggcgggaggcacagagagtcttagagtaagagagagcaaaaactgttgttgataacaaacaactagatcatagtaagatgaagttacaaagaaatagagaaagcacagcaactaaaataactgtactgaagctgctttaggattatgtatctttacgagctgtagtgtcaatcaattaggaataatttatacaagcagttgtaaaatttactccttgtggttaataatatatgaattctgcgaa

SEQ ID NO: 6319 - DNA, 2459 bp, Populus trichocarpa
tataagaagtttgggtttttgttctcttggctaggcatttattgctcttgattattgcattggaagaagcaatctttatgttttttgggcttttcttgaaggcctcgaatcaagtttgaaaccatatgctctcgcatctattcgtattgattgatggagacttgttagtagttgactgaggaagttggattcttcgggtgctttttgaagctgtggtcgaaagaagaagaggagcaagaaaaaggaggaggcttataagtgagaagattgtgatgaatatgaacatggaagaaatgaaagagattgagagggttgggggagagggcatggaagaagttagagatgagccagaggatatcaagaggattgctccgtggacgaaacagattacagttaggggaattgttgctagcatagcaattggaatcatatacagtgttatagtcatgaagctgaatctcaccactggtctagttccaaatctcaatgtctctgctgctcttcttgcatttgtgttcctcagaacatggactaagctcctctcaaaggctggaattgtaaccagtccctttacccgacaagagaataccatagttcaaacttgtgctgttgcttgttatagcattgctgttggaggtggttttggatcttatctactgggtttgaataggaagacatatgagcaagctggggttgatgcagaggggaatactcctgggagcactaaggaacctgggattggttggatgactggtttcctctttgtaagcagcttcgttgggctacttgctctagttcctctgcgaaagatcatgataatagattacaaattgagttatccaagtggaactgcaactgcagttctcatcaatgggttccacactcctacaggagacaagatggctaggaaacaggtgcatgggttcatgaagttcttttcattaagtttcctgtgggctttctttcagtggttctattctggtggagaaaaatgtggattttctcagttccctgcgttggggttgaaagcttggaaaaattcgttttacttcgatttcagcatgacttatattggtgcgggaatgatctgttcccatcttgtgaatttgtctttgcttctcggagcagtgctttcgtggggattaatgtggccgttgataggtgggcttaaaggagagtggttcccttcaactttatcagaaagtagtatgaagagtctaaatggctacaaggttttcatttctatttctctgatcctaggagatggcctctacaattttctcaagatactctatttcactgccaggagtatgcgtgctagagcaaaagctaacaaactcaaaacagaagacaaaaatcaagctcttgatgatcttcaaagaaatgaaatcttcttaagagagggcatccctctttgggtagcatgtttagggtacatcaccttctccatcattgccatcattgccatcccattcatgtttccggagctaaagtggtactatgtagttgttgcctacattctagctccctctcttagcttctgcaatgcttatggggctggtctaactgacatgaacatggcttacaattatggaaaggtggccctctttttactcgcagccttggcaggtaaaaacaacggtgtagttgcaggactggtgggctgtggcctgattaaatccattgtttccatctcttctgatttgatgcatgatttcaagactggtcatctcactctcacttctcctagatcaatgcttcttagccaggccattgggactgtcataggctgtgttgtagctccggtcacgttcttcctcttctacaaggcttttgatgtcggaaaccccgatggtgaatacaaagctccctatgccattatctatagaaacatggcaattcttggtgttgaaggcttctctgcccttccccagcactgcttgcagctttgctatggttttttcgcctttgctatactggccaacttgtcgagagatctttctcccaacaatattgggaaatatgttcctctcccaatggctatggcagtgcctttcctcgttggagcctacttcgcaattgatatgtgtgtggggagtttggttgtgttcgcttggcacaagctaaacagcagaaaggcaagcttgatggttcctgccgtggcctctggcttgatctgtggagatgggctgtggattcttccttcatcaatccttgctttagccaaaatccgtcctccgatctgcatgagcttcctggcaaccaactaaaactaatcaaacatgcagtattggttgcagaatcagacaagtatagctatgttggagaggtttccaattttaacaccagaagagcaaattttatagctaagctgctctgtagagtaataataatcctgtagtcaaatagcataatataaacagtttagctctaatagagttacttgagctgacaccaat

SEQ ID NO: 6320 - DNA, 2634 bp, Citrus sinensis
ctttgaagtgaaggaataaaggttttaagcttagcacttcattcttcccacttctttattctttgaaacttccattttcataatcatacatgcccacccacctatgacttggctctgagatgggagtcaacgagaaggatcaatgatttgtgaccaaccatgtgttcaaatgttaagttatgcgggttcattgaaacttgaaaggttcatgctgagtcaactcagagattgaagaagtgtttcgggcaagaaacaaataaagaagaacaactcatcaaggctgttaagaaatggggttcgatttcagattgtcgataggttaagctgggaacagagattttaataaatcaaaatggagagtaggtttggggaggaagaactgaaagagattgagaatgttagtcatcacgagaaagaggaattggatttggaagagatcaaagatcaaacagaggatgtaaagagaattccgccatggacaaatcatatcacaattcgtggtcttattgctagtgtagcgattggcatcatatacagcgtgatagtgatgaagctgaacctgactaccggcttagtccccaatctaaatgtttctgctgccctccttgcctttgtatttgtcaggacatggactaagttgctacataaggctggaattacggcaactccatttacacgacaagagaatactgtaattcagacatgtgcggttgcttgttacagcatcgctgttggaggtggttttgggtcttatctgttgggtttgaacaggaggacgtatcagcagtccggggttgacactccggggaacaatcctgatagcaccaaggaacctgagatcggttggatgattggtttcctctttgttaccagctttgttgggcttctagcactggtacctcttagaaagatcatgatcatcgactacaagttgagttatccaagtggaactgctactgcagttcttatcaatggatttcatactcctaaaggagacaagagagcaaagaagcaagtacatgggttcacaaaattcttttctcttagtttcctgtgggctttctttcagtggttctatgcaggaggagagcactgcggatttgttcaatttcctacgtttggactgaaagcttggaaaaattcgttcgtactcaatatgagtatgacttatatcggtgcgggaatgatctgttcacatcttgtgaatttgtctttgcttcttggtgctgttctctcttggggaattatgtggccattgataaccgggcttaaaggcgattggtttccaaaaactttacctgaaagcagtatgaagagtctaaatggttacaaggttttcatttctattgctcttatcctgggtgatggactctacaattttctcaggattctatactttactgccacaaacatccatgccagagctaagaaaagcaatctcaaaacagattcggataaccaggatcaagcacttgacaatcgtcaaagaaacgaaatatttattaaagagagcattccaatgtggacggcgtgtgtagggtacactgtcttctccattatttccatcattgtgatccctctcatgttccccaagctgaagtggtactatgttgttgttgcttacattctagcgccctctcttagcttttgtaatgcttatggtgctggtctaactgacatgaacatggcctataactatggaaaagtagccctctttgttcttgctgccttgtccgggaaagaaaatggcgtggttgctggacttgtgggttgtggtttgatcaaatccatcgtttccatctcttctgatttgatgcatgattttaagaccggtcatctcactctcacttcacccaggtcgatgcttgtgagtcaggccattgggactgccataggttgcgttgtagcccctcttacattctttctcttctacaaggcttttgatgttggtaacccagatggtgaatacaaagctccttatgctatcgtctaccgaaacatggcaattcttggtgttgagggcttctctgccctgcctcagcattgtttacagctctgttatgggttttttgcctttgccattgcggcaaacttactaagagatctttctcctaagaaaatagcaaaatggattccccttccaatggctatggctgttccattcctagttggtgcctattttgcaattgacatgtgtctcggaagcttggttgtgtttgcatggcacaagttgaatagcaagaatgcggatttaatgattcctgcagttgcttcaggcttgatttgtggagacggattatggatcctcccttcatcaattcttgctttggccaatgttcgtcctccaatctgcatgaagttcttggcatcctagtagaatttctttaagtggcgggaggcacagagagtcttagagtaagagagagcaaaaactgttgttgataacaaacaactagatcatagtaagatgaagttacaaagaaatagagaaagcacagcaactaaaataactgtactgaagctgccttaggattatgtatctttgcgagctgtagtgtcaatcaattaggaataatttatacaagcagttgtaaaatttactccttgtggttaataatatatgaattctgcgaa

SEQ ID NO: 6321 - DNA, 2708 bp, Ricinus communis
gggttggtgagaacaatgcttcttctacggtttatataaatttgggatttcttttggttgtgccatgtgaatttttatgctaataaacaaaagtgattatctgatcaaattgtaaataaaacccaattgggtatagctatgatcttgtattcaatgctatcctgattgcattgaaagactcaattcagaattgtcttctcttattttattcaagaatccgattgaagcttgtgagtctaatgctctttgttggtttttgcaagtcaacagactgtaattattgctcccatcaagcttttcctctctatgggagttcttacataattatttccatttgggtagtccgtaactgagattcttcatgaagggagtttttatcaaagctctgatccatccccatttaagctaaagagacttgaagggagaacttgatgaataatcaaacagggaatatgaatattgaaggaataaaagaaactgagaagcgtgagaaggacttggaagagttgaaaaatgaggcagaggatgttataggaattgctccatggtctaaacagatcacaattaggggggttatagctagcttagtcattggcatcatttacagtgtgatagtcatgaagctaaacctcaccacaggcctagtccctaatctcaacgtttctgctgcactgctggcttttgttttcattagaacatggactaagctccttcagaaggctggtattgtaaccagtcagtttactcgacaagagaatactataattcagacttgtgctgttgcttgttatagcattgctgttggaggtggttttggatcatatctgctgggattgaacaagaagacatatgagcaagctggggttgattcacaggggaatactcctaagagcacaaaagaacctggggttgcttggatgactggtttcctctttgtaagcagttttgttgggttgcttgcactggttcctcttagaaagatcatgataatagactacaagttgcagtatccaagtggaactgctactgctgttctcattaatggtttccatactccaaaaggagacaagattgctaggaagcaggttcatgggttcatgaagttcttttcaataagcttcttttgggctttctttcagtggttcttctctggtggagagaaatgcggattcgttcagtttccaacatttggcttgcaagcttggaaaaactcattttacttcgattttagtatgacttatgtcggtgcgggaatgatctgttcccatattgtgaatttgtctttacttcttggcgcagtactttcttggggagtcatgtggccactgataggtgaacttaaaggagattggttccctgccactttaccacaaagtagtatgaagagtctaaatggttacaaggtttttatttctattgccctgatcctaggagatggactctacaattttctcaagatactctatttcacagctactaacttcagtgccagagcaaagaagaacaatatcagaacactttcagataagcagaatcaagctcctgatgatcttcagagaaatgaaattttcattagagagacaatcccaatgtgggtagcctgtttagggtacataatattctccgtcatctccattatagtgatccctatcatgtttccagaactaaagtggtactttgtagtggttgcctatattcttgcaccatctcttagcttctgcaatgcttatggtgctggtctgactgatatgaatatggcgtataattatggaaaggtggccctcttcgtacttgcagctttggctggtaataacaatggtgttgttgctggacttgtggggtgtggcttgattaaatccattgtttccatctcctcagatttgatgcacgacttcaagactggtcacctgactctcacttctccccgttccatgctgctcagtcaagccattggaactgcaataggctgtgttgtagccccccttacattctttctcttctacaaggctttcgacgttgggaaccctgatggcgagtataaagctccctatgccatcatctatagaaatatggcaattcttggtgttgaaggcttctctgccctccctcagcattgcttacagctttgttatgggtttttttccttcgctattttggccaatttattgagagacctgtcccctaaaaatattggaagatggatccctcttccaatggctatggcagtgcctttcctagtaggagcatactttgctattgatatgagtgtggggagcttgattgtgtttgtatggcacaagctaaacaacagaaaagcaggtttgatgcttcctgcagtggcctctggcttgatctgtggggatgggctatggattctcccttcatccattcttgctttggccaaaattcatccaccaatctgtatgaatttcttggcaaccaagtagagctttcttcaacagcaaaacctatagttagttgataaataaaactgattgcatgcacaaagtgagttttgcaatgagcatatcaaatatatatatataggaaggaattattagaatgcttttcattttaagcagtagatataaatgcagcagcatgctaccgtagatgaacatcttgtatgagcacgagttggaggctatgttgcaatagtgcaatgtatacaaacgtagttcaatgaaaaaggcaaaatatttagatac

SEQ ID NO: 6322 - DNA, 3064 bp, Ricinus communis
ggttggctcacctcagtattccttaacaagatatcatgagtttaaattcttaaaattatatttattatgagattttaacgtttactgtattccggtacaaatatgaattgatcctgtattcaatatggtgtcaggagatgtaggtgaaaataaaagaaaaaaaaactagagggcataagtcaactgctaagggatcaataatacaggcctgacatgtgttcaaatgcgttgcatccatagttgaattgacttcattagtgtactgcaaattactacatagaacctgtactgcactcctttgtagaagtacatgcaaataagagactttcggccttcaatttttgctttattgggttggtgagaacaatgcttcttctacggtttatataaatttgggatttcttttggttgtgccatgtgaatttttatgctaataaacaaaagtgattatctgatcaaattgtaaataaaacccaattgggtatagctatgatcttgtattcaatgctatcctgattgcattgaaagactcaattcagaattgtcttctcttattttattcaagaatccgattgaagcttgtgagtctaatgctctttgttggtttttgcaagtcaacagactgtaattattgctcccatcaagcttttcctctctatgggagttcttacataattatttccatttgggtagtccgtaactgagattcttcatgaagggagtttttatcaaagctctgatccatccccatttaagctaaagagacttgaagggagaacttgatgaataatcaaacagggaatatgaatattgaaggaataaaagaaactgagaagcgtgagaaggacttggaagagttgaaaaatgaggcagaggatgttataggaattgctccatggtctaaacagatcacaattaggggggttatagctagcttagtcattggcatcatttacagtgtgatagtcatgaagctaaacctcaccacaggcctagtccctaatctcaacgtttctgctgcactgctggcttttgttttcattagaacatggactaagctccttcagaaggctggtattgtaaccagtcagtttactcgacaagagaatactataattcagacttgtgctgttgcttgttatagcattgctgttggaggtggttttggatcatatctgctgggattgaacaagaagacatatgagcaagctggggttgattcacaggggaatactcctaagagcacaaaagaacctggggttgcttggatgactggtttcctctttgtaagcagttttgttgggttgcttgcactggttcctcttagaaagatcatgataatagactacaagttgcagtatccaagtggaactgctactgctgttctcattaatggtttccatactccaaaaggagacaagattgctaggaagcaggttcatgggttcatgaagttcttttcaataagcttcttttgggctttctttcagtggttcttctctggtggagagaaatgcggattcgttcagtttccaacatttggcttgcaagcttggaaaaactcattttacttcgattttagtatgacttatgtcggtgcgggaatgatctgttcccatattgtgaatttgtctttacttcttggcgcagtactttcttggggagtcatgtggccactgataggtgaacttaaaggagattggttccctgccactttaccacaaagtagtatgaagagtctaaatggttacaaggtttttatttctattgccctgatcctaggagatggactctacaattttctcaagatactctatttcacagctactaacttcagtgccagagcaaagaagaacaatatcagaacactttcagataagcagaatcaagctcctgatgatcttcagagaaatgaaattttcattagagagacaatcccaatgtgggtagcctgtttagggtacataatattctccgtcatctccattatagtgatccctatcatgtttccagaactaaagtggtactttgtagtggttgcctatattcttgcaccatctcttagcttctgcaatgcttatggtgctggtctgactgatatgaatatggcgtataattatggaaaggtggccctcttcgtacttgcagctttggctggtaataacaatggtgttgttgctggacttgtggggtgtggcttgattaaatccattgtttccatctcctcagatttgatgcacgacttcaagactggtcacctgactctcacttctccccgttccatgctgctcagtcaagccattggaactgcaataggctgtgttgtagccccccttacattctttctcttctacaaggctttcgacgttgggaaccctgatggcgagtataaagctccctatgccatcatctatagaaatatggcaattcttggtgttgaaggcttctctgccctccctcagcattgcttacagctttgttatgggtttttttccttcgctattttggccaatttattgagagacctgtcccctaaaaatattggaagatggatccctcttccaatggctatggcagtgcctttcctagtaggagcatactttgctattgatatgagtgtggggagcttgattgtgtttgtatggcacaagctaaacaacagaaaagcaggtttgatgcttcctgcagtggcctctggcttgatctgtggggatgggctatggattctcccttcatccattcttgctttggccaaaattcatccaccaatctgtatgaatttcttggcaaccaagtagagctttcttcaacagcaaaacctatagttagttgataaataaaactgattgcatgcacaaagtgagttttgcaatgagcatatcaaatatatatatataggaaggaattattagaatgcttttcattttaagcagtagatataaatgcagcagcatgctaccgtagatgaacatcttgtatgagcacgagttggaggctatgttgcaatagtgcaatgtatacaaacgtagttcaatgaaaaaggcaaaatatttagatacttaaa

SEQ ID NO: 6323 - DNA, 2944 bp, Cannabis sativa
cacacttttagttgagctaaataattttacacaaattaaactaatttcagagaaataaaaataaataatatcttaatctttccattccatctctacccaccatcactttctctctctagagtaattagcaagagagagagagagagagtcaaccataagaattttcgcgctttctttcttcgcctaacatttgttcaaagaaaggtttattagttttagttggaaagttgtttaagtgtgtactacaacgcctattttgtactacaaaaaatttgtattgtagtacatgcaatgcaatatcatatgttaataattaacgcattattattattattattaatacattcataaatctctttatttttatttatttttctctcaaaatctagtcgtgtggtgtcgttgatttccaagtttaaaatcactcagactgacccttttggggatttggtctgtctctgtgtctgtgtgtgtgtgttgttggatgaacagaagaaaagtctataaatttatagatacccatttcgagttttgatcattttcagtcaagtttcgaagaaaataacaagattgagattttataatggagaatgggactaaacatatggaagggtcttcttcttcatcttcagagattgagaaatttgaaagagaggatatggaagaggttggacatgagccagaggatttgaacagaattgcaccatggacagaacagattactcttcgtggactggtggctagtatagtgattggaatcatttacagtgttatagtaatgaagctcaatctcaccactggtttggtcccaaatctcaatgtctcagctgctcttcttgcttttgtgttcataagaacatggactaagttgctcagcaaagctggaattatgtcatctcctttcactagacaagagaatactataatccaaacatgtgctgttgcatgttatagtatagctgttggaggtggatttgggtcttatctgttgggtttgaaccagaaaacttatgaacaagcaggaattgatactgtaggcaatactcctgggagtactaaagagcctggtattggttggatgactggttttctctttgttacttgttttgttgggctattggctttggtgcctcttagaaagattatgattatagactacaaactatcatatccaagtggaactgctactgctgttcttatcaatggttttcatacacctaaaggagacaaaaaggctaaaaaacaggttcatggattcatgagattcttctccattagtttcttgtggggtttctttcagtggttttattcaggtggagatcaatgtggatttaatcagttcccaatatttggatttaaagcttggaaaaactcattttactttgattttagtgccacatacgttggggcaggtatgatctgttcccatctagtgaacttgtctttgcttcttggtgctgtgctctcatggggtgtaatgtggcccttgataaggggtcttaaaggagagtggttccctcaaactttatcagaaagcagtatgaaaagtctaaatggttacaaggttttcatctccatagctttgatacttggagatgggctctataactttctcaagatactgtttttcacagccacaagcatccataccaaaatgaagaacaagaccctcaaaacatcttcaaataaacaagatgagacccttgatgatcttaaaagaaatgagttgtttgtaagagatagcattcctctttggatagcattcgttggttatggtttctttgccctcatttccatcataattatcccaataatgtttcctgagctcaaatggtactatgtggttgtagcctatgtgcttgctccttctctgagcttctgcaatgcttatggagccggtttaacagacatgaacatggcatataattatggtaaagtcgctctatttgttcttgctagtctggctggaaaagagaatggtgtggttgcagggcttgttggttgtggtttgatcaagtccattgtgtccatttcttctgatttgatgcacgatttcaagacgggccatctcactctcacatctcctcggtcaatgcttgtgagccaggctattggaacagcaataggctgtgtggctgcacccgtcacatttttcctcttctacaaggcctttgatgttgggaaccccgacggtgaatacaaagcaccatacgctataatctacagaaacatggcaattctcggtgttcaaggcttttctgcattgccacagcattgtttgcaactctgttatggcttctttgcattcgctataggagctaaccttgtgagagatctttcaccgaagcatatcagtaaatgggttccccttccaatggccatggctgttcctttcttggttggtgcttactttgcgattgacatgtgtgttggaagtttggttgttttcgtgtggcacaagatgaatgataagaacgccgctctgatgattcctgctgttgcttcgggtttgatctgtggagatggtttatggattctcccctcatcaatactcgctttggccaaggttcggccgccaatatgcatgcgcttcttgacatcaaactaaaaacagaattagaattgtacttaaaagtattagaatagcttatagcttattgtagcagttcaaatggttaggcatgtggtttgtttatacaaaggtctgagattcgagtctcttttcgatatctacatagttttgatgtagtagatgtcaagtagagtattgtaaagaggaagagaagagaagagagtactcaaaatgtaaactacattgtaatgagattaattaattagatcaataaaaccccacatcttattattgcttgttttcttttcatactgagtcaactcatacaattatacaaaacccatttgcatgaagaaaaatgatcatggatca

SEQ ID NO: 6324 - DNA, 1443 bp, Lotus japonicus
gggactacaatcagaattgaattgaatggctctgaagcttgtaaatctagggtttcacccattcacactcacaccaccatgttcttcttcaaaacctcgtcaatgtagcttcgtgtttcggtgttctcaagttgagcaaatatcaattgcagaatctgagtactcactcatcgaagccattcttggcacccaaggacgtggacgctcttcttctcccaaccagctaaatgctattgagcgtgctattcaagtcctggaacgcttagggggtgtgcctgatccgacaaattcaaatttaattgagggtcgctggcagctagttttcactacaagacccggaacagcgtcaccgattcagagaacctttgttggtgttgacttttttagtgtatttcaagagatttctcttcgaacaaatgatccacgagtaggcaatattgtgtcattttctgatgccattggtgagctcaaagtggaggcagcggcgtcaattgaagatggaaaaaggatcctttttaggtttgacagagctgccttttctttcaaatttcttccatttaaagttccatatccagttccatttaagctacttggcgatgaagcaaagggttggttagacacaacatatttgtcgcattccggaaaccttcgtatctcaaaaggaaataagggaaccacatttgtgttgcagaagcaaactgaaccaaggcagaggctattaacagcaatttcctcggggaagggtgttaaagaggcaatagatgaactcatttccctcaaaaagaatactggtgaagaaccagaactagaagagggcgagtggcagatgatatggaattcgcagagtgtgacagatagttggttagagaacgctgccaatggtctaatgggcaagcagattattgggaagaatggacaaataaagtttctggttgatatcttgcttggactgaagttctccatgactggaaattttgtaaaaatcggctccgacatgtacgaggtcaccatggatgatgcagctataattggtggcgcatttggactacccctacacatggacaacaagttcgtcttggagcttctgttcagtgaccaaaaggtgagaattagccggggatacaatgaagttcttttcgtacatattcgctcggattcattgagatgaactactaatttatactggttctgtatttaaccatctcctacaactacacttcattgcaaactaagagactttattattgttctggtggtcgccgtgacggagttggtgctgcttctcctcctcaaggggaatatttgaatatttattctaatactacaattaagcaaggacactatatgttatcaacaaatatagttgccatataatacgatctctctcttcgtttggatctttaacatatttcattctcattaaattaagtgagctttgaatgg

SEQ ID NO: 6325 - DNA, 1549 bp, Glycine max
atggctctgaaacttgtaaatctagggtttcactcatcgatcccgtgttctccgaggcccttgaaagatcggttcgtggttcggtgctctaaagtggaacaaatatcgtttactgaatctgaaaactcactcatcgaagcccttcttggcattcaaggacgcggacgttcttcttctcctcagcagctcaacgctgttgagcgtgctgttcaagtcctggaacgtttagggggtgtacctgatccgacaaactcaaatttgatcgagggtcgctggcagctaattttcaccacaagacctggaactgcatcgcccattcagtttctaacctttgtcggggttgtttttttagtgtatttcaagagatttatcttcgaacaaatgatccacgcgtatgcaatattgtgtcattttctgatgctattggtgagctcaaagtggagccaatgtaggactggagttttttccaatagtttttatacatctagcatgatggttgaagtcccatttatgtttgcacttattcatacagagaatttgatatcatatctctgtacatatattttgtcatctctgttcttccatctatcgaaaatttggtttgttcgatctatctaccctactccatatagttggataaaggcagcagcatcaattgaagatggaaaaagaatcctttttaggtttgacagagctgctttttcttttaaatttcttccatttaaagttccgtatccagttccatttaggctactgggagatgaagcaaagggttggttagacaccacatatttgtcgagttcaggaaaccttcatatctcaaaaggaaataagggaaccacatttgtgttacagaagcaaactgaacctaggcaaaggttattgacagctatttcctcagggaagggtattaaagaggcaatagatgaacttatttccttaaagcagaatattggccaagaaccagaactagaagacggtgagtggcagatgatgtggaattcacagactgtgacggatagttggatagagaatgctgtcaatgggctgatgggcaagcagattatcaggaagaatggaggaataaagtttctggttgatatcttgcttgggcttaagttctccatgagtggaaattttgtaaaaactggctccggagtgtatgacgttacaatggatgatgcagccataattggtggtccattcggatatcccctagaactgaaaaacaacttcatattggagcttctatacagtgacgagaagctcagagttagccggggaatcaataatgttattttcgtacatgttcgtacagatgcattgaggtgacctaatatatatgtgattgtttagaaagaatagaagaaatcgttgcgggtgaaaatttgtgatcaattgtgtacatggatgtactacttgttcagcttccagttcaagttggtttattcaatcttccatagtctttcaatctgagagaactgttcataaaaaatgatgtttcaaagaattatattctgcatttcgaggaattatattacaaaaacta

SEQ ID NO: 6326 - DNA, 2887 bp, Solanum phureja
attccacgatcttcgctccaccgtgaaaaatccgtctccggcgccaaatcatgtccggcaaatcccgcaactttcgccgtcgtggcggcgacgacggcgacgatgatgaaacctccgccaagaccaccaacggcaccgccgctaaacctacaaccaccgcttccgccaccaaacccaaaaagaaaagtctacttagtttcgccgacgacgaagattccgacgatactcccttcgttcggccttcctccaaaccctcatccgcttcttcacgaatcacgaaaccctcttcgtcatcttctgcgcacaagcttacttctggaaaagaccgaattacccctaaacctccttcattcacctccaatgtacaacctcaagctggtacttacaccaaggaagcgctccttgagctccagaagaacaccagaaccttagttggttctcgctctgcccaacccaaacccgagcccagacccgggcccgttgaaccagttatagtcttgaaagggcttgtgaaaccaccatttagtgtgactgctcaaactcagcaaaatgggcaagagagtgaagatgacgaaatggatgttgatcaatttggtggtactgttaataggttgggttcaatggcattggagaaggattcgaggaagaaggatgatgttgggtcagtaatacctgataagatgactattgatgcaatacgggctaagagggagaggctacgtcaagctcggcctgcggctcaggactttatagcattggatgaagggggtaatcatggtgaagctgagggtttgagtgacgaggagccggagtttcagcagagaattgggttctatggggagaagattggtagtgggagaaggggtgtgtttgaggattttgaggataaggcaatgcagaaagatggtggatttcgtagcgatgatgatgaggaagatgaggaggaaaaaatgtgggaggaagagcaggttagaaaggggttaggaaaaaggttggatgatgggtctaatagaggggtgatgagtagtgttgtaagcagtgcagctgcagttcagaatgttcagaaggcgaatttcggaagttcggctgtaggagctagtgtatattcctcagtacaaagtattgatgtttctgatggtcctactattggaggaggagtggttggaggcttgcccagtttggatgcattatcaatttctaagaaggccgaggttgctaagaaagccttgtatgagagtatgggaagactcaaagaatctcatggccgaactgtgacatcattgcataagactgaagaaaatttatctgcctcattgtcgaaagtcactacgctggaaaattctttgtctgctgctggtgagaagtacatgtttatgcaaaagcttcgcgactttgtttctgttatatgtgcacttttgcaggataaaggcccttacattgaggaacttgaagaccagatgcagaaacttcatgaagaacgagcagccgctatcttagaaaggagagctgctgataatgatgatgaaatgaaggaacttgaagctgctgtaagtgctgcaagacaagttctaagtagaggtgggagcaatgcagcaacaatagaagctgccacagctgctgctcagacttcaacagcagcaatgaggaaaggaggagacttacctatagagctagatgaatttggtagagataagaatctgcagaaacggatggatacaacaagaagggcagaggctcggaaacgaaggagagtgaaaaatgatgttaaaagaatgtcagctataaaatgtgatagctcttatcagaaaatagaaggagaatctagcaccgacgaaagtgactctgagagtacagcatatcaatcaaaccgtgatcaattgcttcaggtttccgagcagatttttggtgatgcacacgaggaatactctcaactgtctgtggttgttgaaaagtttgacagatggaagaaagattatgcctcaagctatcgtgatgcgtatatgtcacttagtatacctgttattttttcaccctatgtgagactagagcttctgaagtgggatccactgcatgaaaacacagattttatggatatgaactggcacaattctctattcagttatggaattcccccagaaggtgaagccgaaataagtgttgatgatactgatgtcaatcttattcctcagttggtggagaagcttgcaatacccattcttcataaccagttagctaattgctgggatatgcttagcaccagtgaaacagtgtgtgctgtctctgccatgcgattggtattgagatatggccccttttctggctcagccctcagcaatctgattgctgtacttcgtgatcgtctagctgatgctgtggctaatttgaaggtcccaacttgggacacccttgttatgagggctgtacctgatgcagcacgagttgctgcttataggtttggcatgtctattcgtttgatcaggaacatatgcttgttccatgagatttttgccatgcctgtcctggaagagctggttcttgatcaactcttaagtggaaagattcttcctcatcttcgaagcattcagtcaaacattcatgatgctgtaacaagaactgaaagagttgtcacttcactacacggtgtctgggctggccccaaagccacaggagacttcagtccaaagctacgaccattggtggattacttgctctcacttgccagggtgctcgaaaagaagcactcatcaagcagtggagagatagatacatctaaatttgctcgtcgattgaagaagatgcttgtagaactgaatcaatatgactatgccagggatatatcaagaaccttcaacatcaaggaggccttgtgatcttctttcgattttct

SEQ ID NO: 6327 - DNA, 1025 bp, Setaria italica
cgggaatgtcgcggatgtggtgctcggattcgatgacctggagccgtacatgaaaggcatggcaccttattttggatgcatagttggacgagttgcaaataggatcaaggatgggaagtttaccctaaacggagctgagtattcattgcctatcaacaatggacccaacagccttcatggtgggttgactggatttgacaaagtcatgtgggatgttgtagagcataaagatggcgaatgcccttcagtaacctttcagtatcacagcaaggatggggaagaaggctatccaggtgatgtaacagtcagagcaacatattctcttcctgaggccaccaccctaagacttgacatggaagccataccacatgataaagccactcctatcaacttggcacagcacacttactggaacctggcaggccataactctggtgacatcttaaatcatacaattcagatctgggggaagcacatcactccagttgacgaaaacacaattcccactggagagataatgcctgttgagggcactccttttgacttcacgacagagcacaagattggggagcgcatcaacgatgttcctggagggtatgatcataactatgtgctggactgtggggatgaaaaaaatggtgtgaagcgtgcagccaagctgagagacccatcaagctcgcgaactctgaacctctggaccgatgcacctggcatgcagttctatactgccaactatgtgactggcatcactggcaaagggggtgctgtttatgagaaacatgccggtgtatgcttggaaacccaagggtttcctaatgccatcaaccaaccaaacttcccctcagtggtcgtgcagcctggtgagaagtataagcacactatgttgtttgagttttcagcctgaatggagaggctgtgaacagcttatatgactgcacaacttgtagaatgaagataaatgagcagaagaataaggtgtagttagcacatcttcgatgattgtatctttcttgtcttgcaaccag

SEQ ID NO: 6328 - DNA, 1221 bp, Amorphophallus konjac
cttttggagagtgagtgatcgtgagtggactagtggagttgagagacaggcaaaaggtggaggatggcggccgagctgttcgagctgagtaacgggggcatcaccctgaaagttagcgactggggtgccaccatcacctccctcctcgtccccgatgcccagggaaatctcgccgatgtcgttcttggattcgacactctggagccttatctcaaaggcgcttcgccgtactttggatgcattgtcggccgtgtggccaacaggatcaaagacggcaagttcaccctcaatgggatcgagtactctttgcccatcaacaagccccccaacagcctacatggtggcaacaaggggtttgacaaggtgctgtggaaggttgtggaacacaacaaaggtgaaaagccagcgatcacctttgagtatcatagccgtgacggggaggaaggttaccctggcgatgttgttgtaaccgcaacttattccctcccttcacggacaacactgagacttgacatggaagccgtgccaaccaaggccacaccaatcagcttagcgcagcatacctactggaacttagcgggtcacaattccggcgatgtgctcgaccacagcgttcaaatatgggcatctcacgtaacccccgtggatgagaataccattccaacgggggaagtcatgcctgtgaacggtacgccgttcgatttcacaagtgaggagaagatagggagcagaatccatgaggttccagggggatacgaccacaattacgtgcttgggatgggtgaagagaagcttggcctgaagcatgcggctaaagtgaaggatcccaagagctcgagggtcctggatgtatggaccaatgcaccgggagtacagttttatacgggaaactatgtcaacggcatcgtgggtaagggtggtgcggcctatggcaagcatgcggggctatgcctggagacgcagggattcccgaatgccattaatcagccaaattttccatccgtcgttgtccaaccgggagagacacacaagcataccatgctgtttgaattctctgcggaatgatcccaacctacttccatgtctccgagttttggaataaaagagaagatgcaggatgatatatgtggtaatagcgtgtgaatcagttttcttgcaaacttatttgctatatatgatgatacttgtttctcgtatcctgtcgatacagtttaagataag

SEQ ID NO: 6329 - DNA, 863 bp, Lippia dulcis
aaggcgtatccgggttggatgttactttcactgcaacttacacgctacttccaagactacactgagactcgacatggaaggcattccagaaaacaagccaacaccaatcagcttggcccaacacacctattggaacttagctggtcacaactctggaaccattcttgatcacactattcaaatatgggccaatcacatcactcctgtggatgaaaacgtcaccccaactggtgaaatcaaacctgttaaagacaccccgtttgacttcacggctgaaaacaagatcgggagccgtatcaatgaggtgggaatagggtatgaccataactatgttcttgattgtggggacgagaagtcgggattgaaacatgctgcaaaactgaaagacccttccagctcgaggactctggatttgtggaccaacgcaccaggtctgcagttttacactgctaattacgtaaatggcattgttggcaaaggtggtgctgtttacaacaagcacagtgcttgctgtcttgagacacaaggatttcccaatgctgtcaaccaatcaaattttccttctgttgttgttcggccgggggagaagtataagcatagtatgttgtatgagttttctgctgagtaaggttctcgtatggtggcgtcattgtgtattagagtcgtgctaaaaataagagcggggagcagcttttggacggcagcttcttctttttctccgttgtttatgtttgtccattatctgtggaacatggataagcttacttgttgagcaatgttgttcattatcagttgtcattcttattactaggcaatggtgaatcgacagaaagatgatatcagaactggatttagttattata

SEQ ID NO: 6330 - DNA, 1251 bp, Eucalyptus grandis
cttcaaaatccccccctctctctcttgtcttcttcccagaagaagaagacgaaggaaaaaggaagaatctttatggcggatcaggccaggcaagcggagctcttcgagctcgacaatgggaccatgcgggtgaagatcgccaacctcggctgcaccatcgcctcgctctccgttccgggcaaagacgggaaactggctgatgtggttctgggtttcgactccgtcgagccgtatctgaaaggtgccgcgccgttcttcggctgcattgtggggcgggtcgcgaacaggataaaggagggcaagttcactctcgatggcgttgaacactccttgcccatcaacaagccccctaacagtcttcatggtgggcacaagggttttgataaggtgatatgggaggtagctgattataagaaaggcgagaatccttccattaccttcaaatatcacagtcatgatggggaagaaggttacccaggagatgttgctgtgacggctacttacacgctaacttctagtacaacaatgaggctcgacatggaagctgtgcctgaaaataaggccactcctattagcttggctcagcatacctactggaacttagccggtcacgattcaggaaacatactaaaccactccatccagatatgggctaatcacatcactcccgtggatcagaacacaatcccaacaggtgaaattatgcccgtcaaaggaacggcttttgatttcacgacggagaagaagattggcacttcaattcatgaggtgcctggtttaggttacgaccataactatgtgctggactgtggggaagagaagtcgggcctaaaacatgctgccaaactgaaggacccttcaagttctagggttcttgacttgtggaccaatgctccgggaatgcagttttacactggaaattacgttaatggagtagttggtaaaggcgatgcagcatatggcaagcactctggagtgtgtttggagacgcaaggatttccaaatgccatcaaccaaccaaactttccttctgttatcgttcgacctggtgagaagtacaagcattccatgcttttcgagttttcattagagtgaaacattgggaaggtttatgttaataagatgagttctgaacttgtttgcctttacctaagataaatgtcttgatggaaatgtgagacctccttgaagtaataaaaatggccaagtgctttcattgacattattctccgctttctagtggcatactcg

SEQ ID NO: 6331 - DNA, 1675 bp, Eutrema parvulum
acgttctagagagttccaatccacaaaacctcgaacaaaaaagcaaacccatttaggcataagagtccttctttcacagaacacagcagccacaacaacaacaacaaacatcgaaagaggggcctttttctctttctctctctctgatttctagggttttcgtaagaacggcgaaaagatgttcgggcgaggaccctcgaagaagagcgacaacactaagttctacgagatcttaggtgttcccaagaccgcagctccggaagatctcaagaaggcttacaaaaaagccgccatcaagaaccatcccgataagggtggagatcccgagaagttcaaagagctagctcaggcttatgaagttcttagtgacccggagaagcgagagatttatgaccagtatggagaggacgcactcaaggaaggaatgggtggtggaggaggtgggcatgacccatttgatatcttctcatcattctttggtgggagtccgtttggaggtgagtggtagcagccggggaaggaggcagaggcgtggtgaagatgttgttcatcccctgaaggtttcccttgaggacgtataccttggaacaacgaagaagctctcactttctaggaatgctctctgctcaaagtgtaatggaaagggttcaaaatctggagcctcgctgaaatgtggtgggtgtcagggtacaggtatgaaggtgacaatcaggcagcttggacctggaatgatccagcagatgcagcatgcttgtaacgaatgcaaaggcacgggtgagaccatcaacgatcgggacaggtgtccacaatgcaaaggagacaaggtcatccctgagaagaaggttcttgaagtgaatgtggagaaaggaatgcaacacagtcagaagatcacattcgaaggacaagcagatgaagcgcctgacaccgtaactggagatatagtgtttgtccttcagcagaaagagcatccaaagttcaagagaaagggagaagacctctttgtagagcacacactttctctgaccgaagctttatgtggctttcaatttatcctgacccacttggatggcagaaatcttctcattaaatctaatcccggggaggtcgtgaaacctgattcatacaaggcgataagcgatgaagggatgccgatataccagaggccattcatgaagggtaagctctacatccacttcacagtggagttcccggactctctaagccctgaccagaccaaagcgcttgaggctgttctgcctaagccttcaacaactcagctgagcgacatggagatagatgagtgcgaggagactacgctgcacgatgtcaacattgaggatgagatgagaaggaaagcacaagctcaaagagaagcttatgatgatgatgacgatgatgatgaccaccccggaggcgcgcagagggtgcaatgtgcccagcagtaagtgtatcccgtagagagagactgcccacatgggtttagctccaacatttgcctcttccttttcttatttcaagtgtattggagtcttatggtttagactttgcccacttcggtggagaaccaacttgcttgtcgtttcctctcttatttccggtattacaattttgtgtttttgatattgaatttgtagtaatttactatactcaagaagtattagttttgtgtcttaat

SEQ ID NO: 6332 - DNA, 1255 bp, Cleome spinosa
agaagttcaaagagctagctcaggcttatgaagttcttagtgacccggagaagcgtgagatctatgaccaatatggcgaggatgcgctcaaggaaggaatgggtggtccgggtggagggcatgatccatttgatatcttctcatccttctttggtggaggcccattcggaggtggtagcagccggggaaggagacaaaggcgtggtgaagatgtggttcatcctcttaaggtctccttagaggacctttatctcggaacaactaagaagctctcacttacgaggaatgctttgtgctccaagtgtaacggaaaaggttcaaagtctggagcttctatgaaatgtgctggctgtcaaggaacaggtatgaaagtcacgatcaggcagttgggacccggaatgattcagcagatgcagcatgcttgtaatgagtgcaagggcactggtgagaccataagcgacagggatcgttgtccacagtgcaagggagataaggttatccccgagaagaaagtgctcgaagttcatgtcgagaaaggaatgcaacacagccagaagatcaccttctccggtcaagcagatgaagctcctgacacggtaactggagatatagtgtttgtacttcagcagaaggagcatccgaggtttaagagaaagggagatgacctcttcgtggagcacaccctatctctaaccgaggctctctgtggcttccagttcgcgcagacccacttggatggcagacaacttctcatcaggtccaatcccggagaggttgtgaaacccgattcgtacaaggcgataaacgacgaggggatgccgatataccagaggccgttcatgaaggggaaactatacatccatttctcggtggaattccctgaatcgctctccccggatcaggcaaaggcgatagaagcggtgttgcctgggaggccatcgtcgagcaaaaagcagctgacggagatggagatagacgagtgcgaagagactactctccatgacgtcagtaacatggaggaagagatgaggaggaagcagcaggctcagagggaggcttacgatgatgacgacgacgacgatggcccacacggcgcccagcgtgtccaatgtgcccagcagtagaggctttatggagatggagatggtgtggtttcttcttagtggcgtgtttgttttaagggtccgagacattgaattctggcaacccttatagactcgaatagagtctaagtggtacttcttgatttctgttc

SEQ ID NO: 6333 - DNA, 1311 bp, Brassica napus
aactaagaaagaccgaccaatactaaaaaccgaactacccgaacgaagggtggagatacccgagaaagttacaaagagactagctcaggcttatgaagtttaagtgatccggagaagcgtgagatctacgatcagtatggagaggatgcactcaaggagggaatgggtggtggaggcggtgggcatgacccctttgatatcttctcgtccttcgtttggtggtggtggtggtagcccatttggaggtggcagcagccgtggaaggaggcagaggcgtggtgaagacgttgttcaccctctgaaggtttcactagaggatctttatctcggaacaacgaagaagctctcactttctaggaatgctttgtgttccaagtgtaacggaaagggttcaaagtctggagcttcatcgacatgtagtggatgtcaaggatctggaatgaaggtttcaatcaggcagcttggaccgggaatgattcagcagatgcagcacccttgtcatgattgcaaaggtacaggagagaccatcaatgaccgtgacaggtgtccacaatgcaaaggggataaggttgtctctgagaagaaggtgcttgaagtagctgttgaaaagggaatgcagcatagtcagaagatcacattcagtggacaagcagatgaagcgccggatacagtcactggagatatagtgttcgtcattcaacagaaagagcacccaaagttcaagagaaagggagatgatctctttgtcgagcacaccctctctcttacagaagctctctgtgggttccagtttgtcttgacccatttggacaaaagacagcttctcatcaaatccagtccgggagaggttgtgaagccagattcatacagggcgataaccgatgagggaatgcctatgcaccaaaggccgttcatgaagggcaagctttacatccacttcacggtcgacttccctgactcgttgagccctgaccagacaaaggccattgaagcggttttgccgaagccaaaggcggatctgagcgacatggaaatagacgaatgcgaggagacgacgctgcacgaagtgaacattgaggatgagatgagaaggaaggctcaagctcaaagagaggcttatgatgatgacgatgatgatgaagaaggcccaggtggtgctcagcgtgtgcaatgtgcccagcagtgatcaaacatgcgcacttgtagtgatattcagcacttgcgttttcttaaacttatatgtattatttttgggtctttgctataagacttttgcccgattctgttggaagaaacttgtcctaattcaat

SEQ ID NO: 6334 - DNA, 1072 bp, Brassica juncea
gcggggtaacggaaagggttcaaagtctggagcttcaatgacatgtggtggatgtcaaggttctggaatgaaggtttcgatcaggcagcttggacctggaatgattcagcagatgcagcatccttgtcatgattgcaaaggcacaggagagaccatcaatgatcgagacaggtgtccgcaatgcaaaggagagaaggttgtctctgagaagaaggtgcttgaagtagctgtcgaaaaggggatgcagcacagtcagaagatcacattcaggggacaagcagatgaagcgcctgatacagtcacgggggatatagtgttcgtcattcagcagaaggagcacccaaagtttacgagaaagggagatgatctctttgtggagcacaccctctctcttaccgaagccctctgtgggttccagtttgttttgactcatttggacaaaaggcagcttctcatcaaatccagtcccggggaggttgtgaagccagattcatacagggcgataagcgacgagggaatgccgatataccagaggccgttcatgaagggtaagctttacatccacttcacggttgagttccctgaatcgctgagcccggaccagacgaaggccattgaagcggttctgccaaagccaagggccgctctgagcgatatggaaatagatgagtgcgaggagacgacgcttcacgatgtgaacatggaggatgagatgagaaggaaggctcaagctcaaagagaggcttatgatgacgacgatgatgaagaaggcccaggcggtgctcagcgtgtgcaatgtgcccagcagtgatatcaacatggcaacttgtagtgatatcaaacatttgcgttttaaaactatatgtattatttttgcgttggaagaaactttgtcctaactcaattcttgtcactttcagaataaacttttctagttcttgagattctgtcctctctctaccaacattcgaaatctagctatggcttttggatatgaacttagttagagagaatgctctcttttttttttttgctttgaaaccgattacttcatgttacatataatatattc

SEQ ID NO: 6335 - DNA, 945 bp, Brassica rapa
tcgttgaaatgtggtgggtgtcaaggaaagggaatgaaggtctcgatcaggcagattggacctggaatgattcagcagatgcagcatgtttgtcaagactgcaagggtacaggacagaccaccaatgatcgtgacaggtgtccacaatgcaaaggagataaagttatccccgagaagaaggtgcttgatgtagctgttgaaaagggaatgcaaaacagtcagaagatcacattccgcggacaagctgatgaagcgcctgatacggtcactggagatatagtgtttgtcattcagcagaaggagcaccctaagttcaagagaaagggagatgatctctttgtggagcacactctctctctaaccgaggctctctgtggcttccagttcgtcttgacgcacttggacgcaagacagcttctcatcaaatccagccctggggaggttgtgaagccagattcatacaaggcgataagcgacgagggaatgccgattcaccagaggccgttcatgaagggcaagctttacatccacttcactgtcgagttcccggagtcgcttagccgagatcagacaaaggcctttgaagctgtcttaccaaagccggcaaagtcagctatgagcgacatggagatagacgagtgcgaagagacgacgctacatgaggtgaacattgaagctgagatgaaaaggaaggctcaagctaaaagagaggcttatgatgatgatgatgatgaagaaggcccaggcggtggtcatggtgttcaatgtgctcagcagtgatccaacatgcgcattttagtgctatccaacttttgcgttttttttttaattttctttatatgatttttggatcttcttataggctttgcgcaaattccttttattttttgaataaacttttctagtttttgagattttgtcctccccaccaacaattcagtgtgc

SEQ ID NO: 6336 - DNA, 968 bp, Raphanus sativus
ggcacgggtgagaccatcaacgatcgggataggtgtccacaatgcaaaggagacaaggtcgtccccgagaagaaggtgcttgaagtgaacgtggagaaaggaatgctacacagtcagaagatcactttcgaaggacaagctgatgaagcgcctgacactgtcactggggatatagtcttcgtcattcagcagaaagagcatccaaagttcaaaagaaagggagaagacctctttgttgagcacacactttctctcaccgaagctctttgtggcttttcatttgtccttacccacttggatggcagaaaccttctcatcaaatctaatcccggggaggtcgtgaaacctgattcatacaaggccatcagcgataagggaatgccgatataccagaggccattcatgaagggtaagctttacatccacttcaccgtggagttcccggactcgctgagccctgaccagaccaaagcgcttgaatctgttctgcctaagccttcgactactcagctgagcgacatggagatcgatgagtgcgaggaaactacgctacacgatgtcaacatcgaagatgagatgagaaggaaagcgcaagctcaaagggaggcttatgatgatgaagacgacgatgatgaccatcctggaggcgcgcaaagggtgcaatgtgctcagcagtaaccttagagagagagagactttggtcacatggtttttggttccttttcttattttcattgtattagagtcttatggagtttggtatggtttaagacttcgcccacttcggtgcaaaacctactttttcgttctcataaactgattccgtgttacaattttgtattttccattttaaatttgtagtaatctcaatatattgaagaagtattttgtgtctttatttctaaagctgttaactaatgaggtctgaaatgatttttgttaagagaagtgacaaaatggagatttca

SEQ ID NO: 6337 - DNA, 1157 bp, Amaranthus tuberculatus
tggaagtagcaggggaagaaggcaaagaaggggagaagatgtaattcatcccctcaaggtatcacttgaagatctctatagtggtacaacgaagaagctctccctctcgcgtaatgtaatatgctccaagtgcattggcaaaggttcaaaatcaggagcttcaatgaagtgtggtggctgtcaaggaactggtatgaaggtttctatcagacagcttggccctggaatgattcagcagatgcagcacccttgtaatgaatgtaagggtaccggtgagacgattaatgacaaggatcgatgccctcagtgcaagggtgagaaagttgtacaagagaagaaagttctagaagtagttgtcgagaagggtatgcaacatggccagaaaataaccttccctggagaggcagatgaggcgcctgataccgtcactggagatattgtctttgttctgcagctgaaagagcatcccagattcaagagaaagggtgaagatctcttctacgagtacactttgagcctcactgaagccctatgtggtttccgttttgtgttgaaccaccttgacggaaggcaacttcttatcaaatctaacccgggagaagttatcaagcctgatcaatttaaggcaattgatgatgagggtatgccgatctaccagaggccttttatgaaaggcaagctgtacatccacttcacagtggagttccccgactctctgaacccagatcaggttaaagcactggaagctattctgcctccaaaaccatcaatgacgctgacagacatggagttggacgagtgtgaggagactacattgcatgacgtcaacattgaagaagagatgaaaaggaagcaaactcaggctcagcacgaggcatacgatgaagacgacgacgagccatcaggagctcagagagtccaatgtgctcaacagtgatttcattgattttactgaaatgcatatatacaagtggttgttggctgtgtcattctcacagattgagcatgtttgttactagttactagcaataggtgtgttgaaaatagacttctgaaacatgtttgagactaatgttaaattttcaaaacgttggtatttttgacttgcgtctgaattttggtgcctgaatttcttgttatgtgctattttgccatta

SEQ ID NO: 6338 - DNA, 1216 bp, Plantago ovata
agtatggtgaggatgcactcaaggagggaatgggtggtggaggtggtggcatgcacgacccatttgacatattctcgtctttctttggtggcagtccatttggaggtggtggtagcagcaggggacgaaggcaaaggcggggtgaggatgtagtgcatccactgaaggtttcccttgaggatctttatcttggtagcaccaagaagctgtctctgtcacggaatgttctttgttctaagtgcagtggtaaagggtcaaaatcgggagcttcattgaaatgctcaggttgtcaaggaactggtatgaaggttactattaggcagcttgggcctggcatgattcagcaaatgcagcatgcttgcaatgaatgccgtggaactggagagactatcaatgacagagaccgttgcccacagtgcaaaggagagaaggtggtgcaggaaaagaaggtcctggaagtcaatgttgaaaagggcatgcagaatggacaaaagattacattccctggagaagctgatgaggcgcctgatactgttacgggagacatagtctttgtgctccagcagaaggagcaccccaagttcaagagaaagaatggcgaagatctttttgtagagcatactttgtcgctcactgaggctctatgcggatttcagttcatcttgacccatcttgatggaaggcagcttctaataaaatcagaagctggagaggttgtgaagcctaattcttataaggcagtcaatgatgaaggaatgccaaattaccagagaccattcatgaagggtaaactgtatattcatttcaacgtggagttcccagattctttgggtaaggatcaagttgaggccttggcgaagattcttcctgccaagcctcaatctaaattgactgacatggaggtagatgagtgcgaagagaccaccttgcatgatgtcaatattgaggatgagatgaggagaaaggcccaacagcaacaagaagcctatgacgaagatgatgaagatgacatgcacggaggagcccagagagtgcaatgtgctcagcagtgatgacctggatccggcgctttacgttcggtttattgtagtccctttataactagttacaattgcatctatctctaaactgcttgtgctgatcctccgatacagttttgtgtttattgtgagacttgatacagtttctactctgtttctatttcctttttgaggaa

SEQ ID NO: 6339 - DNA, 1145 bp, Raphanus sativus
  misc_feature (135)..(135): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (382)..(382): n is a, c, g, or t
  misc_feature (393)..(393): n is a, c, g, or t
  misc_feature (498)..(498): n is a, c, g, or t
  misc_feature (711)..(711): n is a, c, g, or t
  misc_feature (726)..(726): n is a, c, g, or t
  misc_feature (738)..(738): n is a, c, g, or t
  misc_feature (765)..(765): n is a, c, g, or t
  misc_feature (932)..(932): n is a, c, g, or t
  misc_feature (955)..(955): n is a, c, g, or t
  misc_feature (996)..(996): n is a, c, g, or t
  misc_feature (1012)..(1012): n is a, c, g, or t
  misc_feature (1018)..(1018): n is a, c, g, or t
  misc_feature (1023)..(1023): n is a, c, g, or t
  misc_feature (1025)..(1025): n is a, c, g, or t
  misc_feature (1039)..(1039): n is a, c, g, or t
  misc_feature (1101)..(1101): n is a, c, g, or t
  misc_feature (1123)..(1123): n is a, c, g, or t
  misc_feature (1127)..(1127): n is a, c, g, or t
ggaaggaggcagaggcgtggtgaagatgttgttcaccctctgaaagtctcccttgaggatctctaccttggaactaccaagaagctctctctttctaggaatgctctctgctctaagtgtaacggaaagggttcnaaatcaggagcctccatgaaatgtggtgggtgtcagggtacaggtatgaaggtgacaatgaggcagcttggacctggaatgatccagcagatgcagcatgcttgtaacgagtgcaaaggcacgggtgagaccatcaacgatcgggacaggtgtccacaatgcaaaggagacaaggtcgtccccgagaagaaggtgcttgaantnaangtggagaaaggaatgctacacagtcagaagatcactttcnaaggacaagcngatgaagcgcctgacactgtcactggggatatagtcttcgtcattcagcagaaagagcatccaaagttcaaaagaaagggagaagacctctttgttgagcacacnctttctctcaccgaagctctttgtggcttctcattcgtccttacccacttggatggcagaaaccttctcatcaaatctaatcccggggaggtcgtgaaacctgattcatacaaggccattagcgatgagggaatgccgatataccagaggccattcatgaagggtaagctctacatccacttcaccgtggagttcccggactcgctgagcccngaccagaccaaagcncttgaatctgtnctgcctaagccttcgactactcagctnagcgacatggagatcgatgagtgcgaggaaactacgctgcacgatgtcaacatcgaagatgagatgagaaggaaagcgcaagctcaaagggaggcttatgatgatgaagacgacgatgatgaccatcctggaggcgcgcaaagggtgcaatgtgctcagcagtaacnttagagagagagactttggtcanatggtttttggttccttttcttattttcagtgtattagagncttatggagtttggtntgtaanacttngnccacttcggtgganaacctacttgttttcgttctcataaactgattccgtgttacaattttgtattttccattttnaatttgtagtaatctcaatatnttgnagaagtattttgtgtctt

SEQ ID NO: 6340 - DNA, 2337 bp, Gossypium hirsutum
aaaaaacagaggtagagaattctagagccttctttattttctctaaatctcagtcatccattgaacaatctctcttataaattatatcccaaacccaaatcctttccctcaagcaatttgagtgattctttctttttcttgtggtctccaaagcatctctgttatatcggttattttctctcaagaactgacgaaaaaatccgaatagattaaaacttaagaaagatcaaaagatgttcggaagagcacctaagaagagtaataacaccaggtactatgagattctgggtgtttcgaagaacgcttcccaggatgatttgaagaaagcttataaaaaagccgccattaaaaaccatccagacaaaggcggtgatcctgaaaaatttaaagagttggctcaagcttatgaggtattgagcgatcctgagaaacgtgagatatatgatcagtatggtgaggatgcactcaaggaaggaatgggtggtggtgccggtgctcatgatccgtttgacatcttctcctccttctttggtggtagcccgtttggaggtggtagcagtcgaggtagaagacagagaaggggagaggatgtagtacatcctctgaaggtgtcactggaggacctttaccttgggacttcaaagaaactttctctttcccggaacgtgatatgctccaagtgcaatgggtaatattgttttttaattctttttcttttctatgtttggttttctgcattatttgtttatgtggaatgtgttatttatgacagcaagggttcaaaatctggagcttcaatgacgtgccctggttgccagggttctgggatgaaggtttcaatcaggcagcttggcccctccatgattcagcaaatgcaacatccttgcaatgaatgtaagggtactggggagacgatcaatgacaaggaccgctgccctcagtgcaagggtgaaaaggttgttcaagagaagaaagttttggaagtcattgtagagaagggtatgcagaatggacaaaagataacattccctggcgaagctgatgaagcgcctgagactgttactggggatatagtctttgtccttcagcagaaggaccatccgaagttcaagaggaagggagaagacctatttttggaacatacgttgtctcttactgaggcattgtgtggctttcaatttgttattacccatcttgacggtcgacaacttctaatcaagtcgaaccctggggaggttgtgaagcctgattcttgcaaggcaatcaatgatgaggggatgccattataccagaggccattcatgaagggtaaattgtacattcagttcactgttgaattccctgattcccttagccctgatcaggttaaggcacttgaggccatcctgcctccaaaaccaacctctcagttgagtgatatggagctagatgagtgtgaggagaccacgctctatgatgtgaacattgaagaggagatgaggaggaagcagcagcaggcagcgcaggaagcttatgaggaagatgaagatatgcatggcggtgcccagagggtgcagtgtgcccagcaatgatgatgaagcaaaaaagaagatatatggtttcaaaagtattctcgaggatacagaaagctggtttctctagtaatgtagagtggcaaagcatgtcttgctcaggtggtggatgagcggtgttattattgttagcctgagaagaactcgagtactaagtaaattttttttttatgtctctcttcgcgaaaggttcacatcttgtagtgtttcttgctggtaattggcaagtagttaataagggagataaagttccagcgaagacaatttgctttctttcctctcttatcaagaaaggttagaaggtaggcaatctgctacaatcggatatttacctgaataaaaagaaaaactaattgtctgaaaacagaggcttgtggaagcctcaactcacgatggaaatatattgcacagaaagtaccaattgacgtaaaacatggccaacactgagcctcagtttgtgcaggaaaaagtttgtaatcttctacaagaacatacaatcttgtaccaaatatgaccatacttcaacaacccttgctttgaataacttaaagccaaggaacaaacgcagaaaaccattttgggtcttttaagtactcacaatccaaatttcaattgctgaagctccttcccgggtatccaattcctccacattttgtaatttccagtcttggaacctctatggactaacccacaaacttctctacacgggaatcagcaaaccattcgtgaacttaaggttctgtggtttcttttagaacctgcgcgg

SEQ ID NO: 6341 - DNA, 1342 bp, Cajanus cajan
tcagtatggtgaggatgcgcttaaggaaggaatgggtggtggtggtggtggccatgatccgtttgacatcttttcgtccttctttggtggtggaagcccgtttggagcaggtggtcctagtcgaggtaggaggcagagacgtggagaagatgtggttcaccctctcaaggtctctttggaggatctttaccttggaatttctaagaagctctccctttccagaaatgtcatatgctccaagtgcagtggcaagggttccaaatctggggcttcaatgaagtgtgctggttgtcaaggaactggtatgaaggtttctatcagacatctcggtccgtccatgattcagcagatgcagcatgcttgcaatgaatgtaagggtactggagaaactatcaatgatagagaccgctgcccacagtgcaagggagagaaggttgtgcaggagaagaaagttcttgaggttcatgtggagaagggaatgcgagaacgggcagaagattacattccctggtgaagctgatgaagcgccggacacaattactggggatatagtctttgtgcttcagcagaaagaacaccccaaattcagaagaaagtctgaagacctttttgtggagcacaccttgtccctcactgaggccttatgtggcttccaatttgtgctgactcacttggatggtcgtcaacttcttataaagtcaaatcccggggaagttgtcaagcctgatgcatacaaggctatcaatgatgaggggatgcccatgtaccagagaccatttatgaaggggaagctgtacatccacttcactgtggaattccctgattttctgaatgctgatcaggttaaggccttggaagccgttctgccaccaaagccttcttcgcagttgacagacatggagctggacgagtgtgaggagacaacactacatgatgtgaatatggaggaggagactaggaggaagcagcagcaagcagctcaggaggcctatgacgaggatgatgatatgcctggtggtgcacagagggtacagtgcgctcagcagtaatcactcatttctgtgggagtattagaatcaggagttgatgatgaacatgataatgtggtgttccataaatctagtgtggactaaaagacgagtaacttttggtgggtgaacggtgtattgcattttattttcgaatctgacatcctatatactttagttttttttgttttgtttttttattaattattttaaacatctctattttgctatctcaattttattgcgttttcttgtgtgtctgtttgccaattaaacttgttaagattagaagaggatatccaaataatcttcca

SEQ ID NO: 6342 - DNA, 1138 bp, Vinca minor
tttaaggagctagctcatgcttatgaagtcttgagtgatccggagaaacgtgagatttatgatcaatatggtgaagatgcactcaaagaaggaatgggcagtggaggtggaatgcacgatccattcgacatcttccaatcattctttggaggaagcggatttggaggtggtagcagtaggggccgaaggcagaggcgtggcgaggatgtagttcatccattgaaggtctccttagaagacctgttcaacggggcgaccaagaagctatctctatctcggaatgttatctgttccaaatgtagtggcaaagggtcaaagtctggagcttcacacaagtgttctggttgccaaggtactggtatgaaagtttccattagacaacttggccctggtatgatccagcagatgcagcacccttgcaatgactgcaaaggaactggagagacaatcagcgacaaggatcgctgtcctcagtgtaaaggtgagaaggttgtaccagagaagaaagttttggaagttgtcgttgacaagggaatgcataatagccagaagatcactttccctggagaggccgatgaagcgccggacactgttacaggagatatcgtttttgtcctccagcagaaagagcatcctaagtttaagagaaagcacgatgaccttttcgtggagcataccctctcgcttactgaggccttgtgtggcttccagttcattttgacacacttggatggcagacagctacttattaaatcaaaacctggagaagtgatcaagcccgaccagtacaaggcaattgacgacgaaggaatgccggtgtatcagcgccccttcatgcgtggtaagctgtatattcactttacagtggaatttccagactctttgagccccgatcaggtgaaggcgttggagggaatccttccggcgagtgcacaatcacagctgacagacatggaactggacgagtgtgaagagactaccttgcatgatgtgaatatcgaagaggagatgaggaggaagcaagctcaggctcagcaggaggcttacgacgaggatgaagacatgcctgggggagctcaaagagtacagtgtgctcaacagtgacaaaagtgtttcggcaaaaatgaagcgaattttg

SEQ ID NO: 6343 - DNA, 1215 bp, Tragopogon dubius
tactgagggacccagagaagcgtgagatatatgatcagtatggtgaggatgccttgaaggaaggaatgggcggtggaggtggcggtcatgacccatttgacatcttccaatctttctttggtggtggtggcggtggtagcagcaggggacgaagacaaagaagaggagaagatgtgattcatcctctcaaagtctccctggaagatctctacaatggaacttccaaaaaactatccctctcacgtaacgtaatctgctccaagtgtaaagggaagggttcaaagtcaggtgcttcaatgaagtgtgcaggctgccaaggttccggaatgaaagtctccatcagacatctgggcccatcaatgatccaacaaatgcaacatccatgtaacgagtgcaaaggcacaggtgaaaccattaacgacaaggatcgctgcccacagtgcaagggtgataaagttgtacaagagaagaaggttctagaagtccatgtggaaaagggtatgcagaattcccaaaagatcacattccctggagaagctgacgaagcccctgacacggttacaggagacatagtgtttgtgttgcaacaaaaggagcaccctaagtttaagcgaaagggagacgacttattcgttgagcacacattgagcttaacggaggctctgtgtgggtttcagtttatattaactcatttggatagcagacagcttctcatcaaatctcaacctggggaggttgttaagcctgatcaatttaaggcgataaacgatgaagggatgccgatgtaccagaggccgtttatgagggggaagctgtacatccacttcacggtggagttcccggagtcgttgtcgccggagcagtgcaaggcgttggagggggtgctgccggctaagccagcgatgcagatgacagacatggagctcgatgagtgtgaggagacgactcttcatgatgtaaacatcgaagaggagatgaggaggaaacagcagcaggctcaacaagaggcttatgatgaagatgatgacatgcctggtggtgctcagagggtacaatgtgctcagcaatgagtgtggctgtgagatggaggtttttggcgaaaggacaataatgtcggatgttattttctttctttatactgctaaatttatgagacgttttaagatgtatggatgatatggttttaactcatttggaaaactggtttgagttgtt

SEQ ID NO: 6344 - DNA, 1159 bp, Eschscholzia californica
gaggagatcctgagaagtttaaggagctggcacaggcttatgaggtattgagtgacccagagaaacgtgagatttatgatcaatatggtgaagatgcactcaaggaaggaatgggtggaggtggtggtggtcacgacccctttgatatctttcaatcattcttcggcggaagtccctttggaggtggtggtggtagcagcagaggaaggaggcagatgagaggagaagatgttgtccattccctcaaggtatcactcgaagatctttacagtggcacttcaaagaagctctccctttcacgcaatgtcatctgctcaaaatgtagtggtaaaggatcaaaatctggcgcctcgatgaagtgttcaggttgccaaggatcgggtatgaaggtttcaatcaggcagcttggtccttcaatgatccagcagatgcaacacccttgcaatgagtgtaaggggactggggagaccattaacgacaaagatcggtgtcctcaatgcaaaggtgacaaagtcgtccaagagaagaaagttcttgaagtccatgttgaaaaggggatgcagaatgggcagaagattactttcccaggagaagccgacgaagcacccgataccgttactggagacatagtgtttgtgttatctcagaaagatcacccaaagttcaagagaaagggggaagatctgtttgtggagcacacattgtctctcactgaagctctgtgtggctttcagtttgtattgactcatttggatggaaggcagctcttgatcaagactaaccctggagaagtagtgaagcctgattctttcaaggcgataaacgacgagggtatgccgatatatcagaggcatttcatgaggggtaagctctacatacacttcacagtcgatttccctgattctctgacaccagagcagtgtaaggcactggaagctgtgttgcccgcaagaacagcgacagagctgacagacatggaggtggacgagtgcgaggagacaacattacatgatgtaaacattgaagaggagatgaagaggaaacaagcccaggcggctcaagaggcatacgatgaagacgaagatatgcatggtggtggtcaaagggttcaatgtgcccagcagtaagaaaagagggaatgggtcaccattatcatttt

SEQ ID NO: 6345 - DNA, 1129 bp, Fagopyrum esculentum
gggaaggggtcaaaatctggtgcatcaatgacatgtcctggctgtcaaggatctggtatgaaagtttctatcaggcagttgggtccttctatgattcaacagatgcaacatccttgcaatgactgtaagggtactggtgagaccatcaatgatcgagatcgctgcccacagtgtaagggtgagaaggttatgcaggagaagaaagttctcgaagtttttgtggagaaaggaatgcaaaatggacagaaagtcactttccctggtgaagcagatgaagcgccagatacagttactggtgatatagtgtttgttctacaacagaaggaacatccaaaatttaagcggaagggtgacgatctcttctatgaacatacattgtccctgactgagtcactttgtggttttcaattcgcattgacacacttggatggtagacaactgctcatcaagtctcatcctggagaagtcatcaagccagattcattcaagggaataaatgatgaagggatgccaatgtaccagaagccctttatgaaggggaagttatacatccacttcacagttgagtttccagacacactgagcctggaacaatgcaaggcattggaggctgctcttcctccccgaattccaacgcaactaactgacatggaattggatgagtgtgaggagacaactctacatgatgtcaatattgaagaggagatgcgcaggaaacaggcacaagcccaacaggaggcgtatgatgaagacgatgatgacatgcacggaggaggccctcaaagagtccagtgtgcccaacagtgataaagacttgacttcccattaatggtgggatcattgcaacaccgaggtgtttgttgacgtgcgagtatcgaatataagaacgctgattaacttcttgtgaggtagatctaaagtgatagcagtatttgtaagaattctcgtttgttcgactttgttgttttaagcaaggatgggattgttttgtttttttgaatttggctgaaatcctttgaaacggcaaggattgtgcaactatgtgcactcggttgaattcgttgcgaccttacaatttacagccgttttggtaccgcaactgtattactaattatggagtacggcggtg

SEQ ID NO: 6346 - DNA, 1142 bp, Ocimum basilicum
gcaccagtggcaatccatttggaggtggtggaagtagcagaggtacgaggcagagaaggggagaggatgttgttcatcctctcaaggtgtcattagaggatttatataatggaacatctaagaagctatctctgtcacgcaatgtgctctgccacaaatgcaaggggaaaggatcaaaatctggagcttcaatgaaatgttctgggtgtcaaggatctgggatgaaagtgtctattagacatcttggcccttctatgattcagcagatgcagcatccttgcaatgagtgcaagggtactggtgaaactatcaatgacaaggatcgctgtcctcagtgcaagggtgagaaggttgtgcaggaaaagaaggtattggaagtgattgtggagaagggtatgcagcatggacagaagatcacgttcccaggcgaagctgatgaagcgccggacactgtcactggagatattgtgtttgtacttcagcaaaaggaacaccctaagttcaagagaaagggtgaagatctgtttgttgaacatacattgacactgactgaagcactatgtggcttccaatttatactgactcatttggatggtcgccagctcctcataaaatctgaacgtggtgaagtgatcaagccagatcaatcaaaggcaatcaatgatgaaggcatgcccatgtaccagaggtcgttcatgaaaggcaaactgtacattcaattcaatgtggagttccctgattctttgagcccggatcaatgtaaagctctggaggctgtactgccaccgaggcctacaacaaaggtgacagacatggaactggatgaatgtgaagagacaacgctgcatgacgtaaatatggaagaggagatgcgaagaaagcagcaacaagctcaggaggcatacgatgaagacgatgatatgcccggaggtgctcagagagtgcagtgcgcgcaacagtaaggggttctctttggggatggatgtcttgtttgagccagtgatggaagcttactagttatggttttacaagttaggcaggtgagactgcattatgtttatggtggtttgctcatgtattagaatctatatattttgtcgacacaaatggtatttctatccttgataagaaaatattaaatt

SEQ ID NO: 6347 - DNA, 1394 bp, Cucurbita pepo
ggctcaaaaaggccgctatcaagaatcaccctgacaagggtggtgatccggagaagtttaaagagttggctcaggcttatgaggttcttagcgatcctgagaagcgagagatctatgatcagtatggtgaggacgcacttaaagaaggaatgggtggtggaggtggtcatgaccccttcgatatcttccaatccttctttggtggaagtccatttggtggtggtagcagcagaggccgacgccagagaaggggagaggatgttgtccatccccttaaggtctcccttgaggatctttaccttggaacttccaagaaactctctctgtcgcggaatgttatctgctcaaaatgcaatggcaagggatcaaaatcaggtgcttcaatgagctgttctagctgccaaggaactggaatgaaggtcacgattcggcaccttggcccgtcgatgatccagcaaatgcagcacccttgcaatgaatgcaagggcactggagaaacgatcagcgacaaggaccggtgttcgcaatgcaagggagagaaagttgttcaagagaagaaggttcttgaagttattgtggagaagggtatgcagaatggacagaaaattacattccctggagaagcagatgaagctcccgatactgtcactggagatatagtctttgttcttcagcaaaaggagcacccaagattcaagagaaagggagaggacttgtttgtggagcacacgttgtcgctcactgaagctctctgtggcttccagtttgctctcactcacttggatggcagacagcttctcatcaaaacaaatcctggagaagttgtaaagcctgattcattcaaggccatcaacgacgagggaatgccgatgtaccagaggccattcatgaaggggaagctctacatccatttcagtgtagatttccctgattccttgagcccagaacagattaaagctttggtagctgtcttgccaccaaagccatcatcccaactgaccgacatggagctggacgagtgcgaggagacaacaatgtatgatgtcaacatcgaagaggagatgcggcggaagcagcagcaagcacaggcggaggcctatgaggacgatgatgacatgcctggtggcgcacagcgcgtgcagtgtgcccagcagtgatcggattggatcggatccgatcctcttttgagctgaaatttaaccaaaccagagatcactaaatgttagggttgtttggggattgatggttgatgaactccaccttgttaatggcagtttttgtttggaatttctcatattccggatgccgttactgatacaatacataaatcaacgggtctgatatatgtgaacttctattttattatataattacaagtgctcttgtaattaccg

SEQ ID NO: 6348 - DNA, 1286 bp, Fagopyrum esculentum
ggggctggtagtagcagaggtcgaagacaaagaaggggagaggatgtgatccatcctttgaaggtttctttggaggatctctataatgggacgagtaagaagctttctctctcccgaaatgtgctctgctcaaagtgcaaggggaaggggtcaaaatctggtgcatcgatgacatgtcctggctgtcaaggatctggtatgaaagtttctatcaggcagttgggtccttctatgattcaacagatgcaacatccttgcaatgagtgtaagggtactggtgagaccatcaatgatcgagatcgctgcccacagtgtaagggtgagaaggttatgcaggagaagaaagttctcgaagttttcgtggagaagggaatgcaaaatggacagaaagtcactttccctggtgaagcagatgaagcgccagatacagttaccggtgatatagtgttcgttctacaacagaaggaacatccgaaattcaagcgtaagggtgacgatctgttctatgaacatacattgtccctgactgagtcactttgtggttttcaatttgcgttgacacacttggatggcagacaactgctcatcaagtcccatcccggagaagtcatcaagccagattcattcaagggaataaatgatgaagggatgccaatgtaccagaagccatttatgaaggggaagttatacatccacttcacagttgattttccggacacactgagcctggagcaatgcaaggcgcttgagtctgctcttcctgccagaactccaacgcaactaactgacatggagttagatgagtgtgaggaaacaactctacatgatgtcaatattgaagaggagatgcgcaggaagcaggcacaagcccaacaggaggcgtatgatgaagacgatgatgacatgcacggaggaggtcctcaaagagtccagtgtgctcaacagtgataaagactttacaacacccaggtgtttgttgacgcgctgagtatcgaatataagaacactgattaacttcttgtgaggtagatctaaagggatagcagtgcttgtaagaattcttgtgtttgttcagactttattgctttaaggatgggattgttttggttattttgaatttggctgaaatggcaagtatgctagtaagtggagatcaaatcagatgatttgtacgttgttttcagctgtctaggtattggaatgactagctcttatcaattatggagctgtttggatgctgttttttactcaagaacagatgagtcgaactaatcagcaaatagttg

SEQ ID NO: 6349 - DNA, 1162 bp, Phalaenopsis aphrodite
ttttggaggtggcgggaggcagtcgtggtcgcaggcagcggaggggagaggatgttgtccacccactcaaagtcacattggaagatctgtacaatggtacttcgagaaactttctttttcccggaatgtctttgctcgaaatgcaagggaagggatcgaaatcgggcgcttcaatgaagtgttctggttgtcagggtacaggtatgaaggtctcgattcgccagttgggtccatctatgatacaacaaatgcagcatccttgcaatgagtgcaaaggaactggggagaccatcaatgataaagatcgctgcccacagtgcaagggagagaaggttacccaggaaaagaaggttcttgatgttctagttgagaagggtatgcagaatgggcagaaaatcaccttccccggtgaggctgatgaggcgcctgattgtatcactggcgacatcgtatttgtcctgcaacaaaaggaccactctaagttcaaaagaaagggcgacgatctctttgtggagcacacactctccctaaccgaagctctttgtggcttccagttcatattaacccatctcgatggccggcagcttctcatcaaatcaaaccccggcgaagtcgtcaaacctgaccaattcaaggccatcaacgacgagggcatgccgatgtaccagaggccgttcatgaggggcaagatttacatccatttcaccgtcgagttccctgattctttgagtttggatcagtgcaaggctctcgaggcaatccttccctcacggggtcgtactcagctgacggacatggagctcgacgagtgcgaggagacaaccttgcacgacgtgaacatcgaggaggagatgaggaggaagcagcagagccaagctcaggaggcctacgatgaggacgaagacatgccaggcggtgctcagagagtgcagtgtgctcagcagtaaggtatatacttatattataccagtaaaagcgttatcagctgtgttgaatcttatgaaacgtatggttctctgttgtcttattacaagcctgatactagcataaaactggattgtttgcatgccttaggtgactggttatatgaaatcttttgctcatcaagaaaatatttgaattttattcagcctgaaataatgctgtttaatttgagatttat

SEQ ID NO: 6350 - DNA, 1234 bp, Fraxinus spp
agtatggtgaagatgcactcaaggaaggaatgggtggcggtggaggcatgcatgacccatttgacatcttctcttctttctttggtgggagtccgtttggaggtggtggtagcagtagaggacggaggcaaagaaggggagaggatgttgtacatccattgaaggtctctcttgaagatctgtatgttgggaccactaagaagctctccctgtcacgaaatgttctttgctcgaagtgtaatggaaagggatcaaaaatctggagcttcaatgaagtgctcagggtgtaaaggaactggtatgaaggttactgttaggcagcttggtccgggtatgatccagcaaatgcagcatgcttgcaatgaatgtaagggatccggagagactattaatgatagagatcgatgctcactgtgcaaaggtgaaaaagttgttcaggaaaagaaagttttggaagtacacgtagagaagggtatgcagaactcacagaaaattacattccctggagaagctgatgaagcgcctgacaccatcactggagacatagttttcatcctccagcagaaagagcatcctaaattcaagagaaagggtgatgacctctttgtggagcacacactttcgctcacagaagcattatgcggatttcagttcatcctctcccacttggatggcaggcaactccttatcaaatcacaacagggagaggttgtgaagcctgattctttcaaagccatcaatgatgaaggaatgccaatgtaccagaggccattcatgagaggtaaactgtacattcatttcacagtggactttccggattctttaagtccagatcaggtgaaggcccttgtggaagttctgcctccaaagcctcaatcacaactcacagacatggagttggacgaatgtgaggagactacattgcatgatgttaacattgaggaggagatgcgtaggaagcagactcagcaccaggaggcgtatgatgaggatgatgatatgcacggtggagcccagagggtgcaatgtgctcagcagtgatgagccatccaagaataattgtgttagtagggtgtgtgtttgatgtcgcttttgttgcttgataaaatcccctaattttataaacaatgagattactgattctatgcctatgaaacatgatttagtttgtgtacttctggtattgtacttcatgccatgtggcgttatgcttaaaatgatgagtttggcttta

SEQ ID NO: 6351 - DNA, 1661 bp, Cucumis sativus
ctgacggtcttggattttaattaagacggtttaacatgaagagcgataataccaaatattatgagattcttggagtctcgaagaatgcgtcgcaagacgatctaaagaagctctcagagataaatattgacctttttgaaaaatttccttttatgattcagttcaaggagttagcacaagcctacgaggtgctgagtgatccagagaaacgtgagatatatgatcaatatggcgaggatgccctcaaggaaggaatgggaggtggcggtggtcatgatccatttgacatattccagtctttctttggtggaagcccgtttggtggtggtggaagcagcagaggccgaaggcagagaaggggagaggatgttatccatcctctcaaggtctcgttggaagatctctacaacggtacttcaaagaagctctctctttcacgtaatgtaatttgctcaaagtgcaagggtaagggttctaaatctggtgcttcaatgaagtgtcctggctgtcaaggttctggtatgaaagtttccatcagacaccttggcccctctatgattcagcaaatgcagcatccttgcaatgaatgtaaaggaactggtgagaccatcaatgataaagatcgctgctcacaatgcaagggtgaaaaggttgttcaggagaaaaaagttttggaagttattgtggagaagggtatgcaaaatgcacaaaagattacattccctggtgaagcagatgaagcgcccgacactgttactggggacattgtctttgtcctacaacaaaaagagcaccccaagtttaagagaaagggcgatgacctctttgtagagcataccttgtctctcgtcgagtctctgtgtggtttccaatttattctgactcatttggatggccgacagctactcatcaaatcacttcccggtgaagtagtgaagcctgaccaattcaaggccataaacgatgagggtatgcctatgtaccagaggccattcatgaagggcaaactttacatccacttcagtgttgagttcccagactccttgaaccccgaacagtgcaaggcgctggagggcgttctgcctcccaggacctcagtgcagctctcagatatggaattggatgaatgtgaagagaccactctccacgatgtcaacattgaagaggagatgcgcaggaagcaagcacaagaggcatacgatgaagatgaggatatgcacggtggtgcacagagagtgcagtgtgctcaacaatgatctcgattaaactctgggggaggagtggagctaccgccataacacattgattgatgattaagacattatgaaaattttcagagaacaacaccaatgaaggaaatggatctaccaacaacagcacaacaccaccgggcagcagcagtcatatctcatatccaaattttctcaataaatagatgaattttattttctaattcagtcagtaggattacgaagtaagctttctggaatttttattttttttttcttttttattatgtgctatttttctagctttaccaagaattcaaaagattatgtattggagttgcagatataaataggattgattgggaaacagaaagatctttggttcttttctgtgaactgtggtttcaagtgaaaacttcccaagatttattc

SEQ ID NO: 6352 - DNA, 757 bp, Brassica juncea
ggaatgattcagcagatgcagcacccttgtcatgattgcaaaggtacaggagagaccatcaatgaccgtgacaggtgtccacagtgcaaaggagataaggttgtctctgagaagaaggtgcttgaagtagctgtggaaaagggaatgcagcatagtcagaagatcacattcagtggacaagcagatgaagcgcctgatacagtcactggagatatagtgttcgtcattcagcagaaggagcacccaaagttcaagagaaagggagatgatctctttgtcgagcacaccctctctcttacagaagctctctgtgggttccagtttgtgttgacctatttggacaaaaggcagcttctcatcaaatccagtccgggagaggttgtgaagccagattcatacagggcgataaccgatgagggaatgcctatgcaccaaaggccgttcatgaagggcaagctttacatccacttcacggtcgacttccctgactcgttgagccctgaccagacaaaggccattgaagcggttttgccgaagccaaaggcggatctgagcgacatggaaatagacgaatgcgaggagacaacgctgcacgaagtgaacattgaggatgagatgagaaggaaggctcaagctcaaagagaggcttatgatgatgacgatgatgatgaagaaggcccaggtggtgctcagcgtgtgcaatgtgcccagcagtgatatcaaacatgcgcacttgtagtgatgatattcagcattt

SEQ ID NO: 6353 - DNA, 1041 bp, Cleome spinosa
gggagaggatgtagttcacccactaaaggtttctttggaagatctctatctcagcacaaccaagaagctttccctctctaggaacgttttgtgctccaagtgtaagggaaagggatcgaagtctggagcatccatgaagtgttctggttgccagggttctggtatgaaggtcacgatcaggcagcttggaccgtctatgattcagcagatgcagcatgtgtgtaatgattgcaagggtaccggtgagatgatcagtgacaaggaccggtgctcacagtgcaaaggagagaaagtctccccagagaagaaagttctcgaagtttttgtggagaagggcatgcagaatggacagaaaatcacattccctggtgaagccgacgaagcacctgacaccataaccggagacattgtgttcatcctccagcagaaggagcatcctaagttcaagagaaagggagatgacctcttctatgaacacaccttatgcctcaccgaggcattgtgtggcttccagtttgtgctgactcatctcgatggccggcaactcctcatcaaatcgaaccctggcgaagttgtcaaacccgattcattcaaggctataaatgacgagggaatgccgatgtaccaaaggccgttcatgaaagggaagctatacatccacttcacggtcgaattcccggaaactctgaagccggaccaggtgaaagccctggagaaggtgttgccgccgaaaccgtcgacccaaatgtccgagatggagctggacgagtgcgaggagacgacgctccacgacgtgaatatcgaggaggagatgaggaggaagcaacagtcgcagcagcaagaggcttacgatgaagacgacgacgagcctcacggtgctcagagggtgcagtgtgctcagcagtgaaaaaaatatttgatatatgatgaagaaaaacaagtggacttttggttttataaggttttgatgacgatacgataagataaaatgctgtcacttggataagttttctaacggaaagagaaagtattagcggctag

SEQ ID NO: 6354 - DNA, 1010 bp, Flaveria ramosissima
gggagaagatgttgttcatcctctcaaagtttctctcgaggatctttataatggaacttccaagaaactctctctttcacgcaatgtaatctgctccaagtgtaagggcaagggttcaaagtcaggcgcttcaatgaaatgtgctggctgtcaaggttctggaatgaaagtttctatcagacatcttggcccatctatgatccagcaaatgcagcatccttgtaatgaatgcaagggaaccggagaaaccatcaatgataaggatcgatgcacccaatgcaagggtgagaaagtcgtgcaggagaagaaggtactggaagtgcatgtggagaagggtatgcagaatggacagaagattacattccctggagaggctgatgaagctcctgacactgttaccggagacattgtgtttgtgttgcaacaaaaggagcaccctaagtttaagcgaaagggtgatgacctttttgtggaacacacattgagcctaaccgaggccctatgtgggttccagtttatcttaacccatttggataaccgacagctcctcatcaaatctcaacctggggaggttgtcaagccagatcaattcaaggcaataaatgatgaaggaatgccaatgtaccagaggccgtttatgagggggaagctatatctccatttcactgtagaattcccagattcattgtcaccagagcagtgcaaggcgttggaggcggtgctgccacctaagccttcgatgcagatgacagacatggaactggatgaatgcgaagagacgactcttcatgatgtcaacatcgaagaggagatgagaaggaagcaacaagcagctcaagaagcttatgatgaagatgaagatatgcacggtggagcgcagagggttcaatgtgcacaacagtaattgaatcattgttaaggtttggtctgatctggtcatttatcaatcttaggttttggcaagacaataacgtcaactgtaattttacattttactgttatgtttgtcc

SEQ ID NO: 6355 - DNA, 1244 bp, Platanus occidentalis
tattgggaagttttcccttcagaatgaattaaagtagttcagcttctcgctgtaagcgggttgaaacttgcaactttgggatttatgtgtggttgcagttcaaggagttggcccaggcttatgaggttctgagcgacccagagaaacgtgaaatctatgatcagtatggagaggatgcgcttaaggaaggaatgggtggaggagcaggaggccatgacccgtttgacatcttccagtcgttctttggtggcagcccatttggaggtggtggaagcagcaggggacgaaggcagagaaggggagaagatgtgattcatcccttgaaagtatctctggaggatctgtacagtgggacatcaaagaagctttccctctccagaaatgtaatctgctccaagtgtaacggtaaagggtcaaaatctggtgcttccatgaagtgttctggatgtcaagggtctggcatgaaggtttcaataaggcaccttggcccctctatgatacagcagatgcaacacccttgcaatgagtgcaaaggcactggagagaccatcaacgacaaggaccgttgtcctcagtgcaaaggtgagaaggttgtacaggagaagaaggtgctggatgttattgttgaaaagggaatgcagaatgggcagaagattactttcccgggggaagctgatgaatcgccggacacaatcacaggggacattgtatttgttctacagcagaaggagcaccccaagttcaagaggaagatggacgatctctttgtggagcacactttgtccctcactgaggctctgtgtggatttcagttcatcttgacccatttggataacagacagctcctcatcaaatctaaccctggggaagtcgtcaaacctgatcaatacaaggcgatcaatgatgaaggtatgccaatttaccagaggcccttcatgaaggggaagctgtacattcatttcacagtggagttccctgattccttgagcatggagcagtgcaaggcacttgaggccgtgttaccaccgaggacatcgatgcagcttacagacatggaacttgatgagtgcgaggagacaacactgcatgatgtcaacatagaggaggagatgcgaaggaagcaggctcaggcccaagaggcctatgaagaagatgaggattcccatggtggtggacagagggtgcaatgtgcccaacaatgattgatggtataatgggtattaaaataacagaggagctgaatt

SEQ ID NO: 6356 - DNA, 923 bp, Ocimum basilicum
ctctggagcttctatgaagtgctcgggttgtcaaggaacgggtatgaaggtctcgatcaggcagcttggtcctggcatgattcagcaaatgcagcatgcttgcaatgaatgtaaaggaacgggagaaaccatcagtgataaagatcggtgcagccaatgcaagggtgagaaggtggttcaggagaagaaagtcttggaagtccatgtcgagaagggcatgcagaacgggcagaagatcaccttccccggagaggctgatgaagcgcctgatactgtgactggcgatatagtgtttgtgctccaacaaaaggagcacccaagattcaagaggaagggggatgacctcttcacggagcactcgttgtcgttggctgaagcattgtgcggcttccagtttgtgttgactcatctagatggaagacaactccttatcaaatctcaaccaggagaagtcgtgaagcctaattcgtacaaggcgatcaacgacgaaggaatgccgatgtatcagagacccttcatgaaaggcaaactctacctccacttcaacgtggatttccctgaatctctaagtccagatcaagttgctgccttggagaagatactccctccaaggccccaatcccagttgacggacatggagattgacgaatgtgaggagacaacgcttcacgacgtcaacatggaggaggaaatgaggaggaaggctgctcagcaacaggaagcatacgaggatgacgacgacatgcacgccggaggacaaagggttcaatgcgctcaacagtaatctgctaattagactccctaacttcgcctgttgaggaaatgatgtggaagaatatgatttcagaatttcttcgatgaaatgttggtcctgagctgctaaaattttgcttattgcctgtaatagtatgagtgacattgta

SEQ ID NO: 6357 - DNA, 1076 bp, Helianthus annuus
cggggtaaggcagggttcaagtccggtgcttcatgaaatgcgccggctgccaaggttctggaatgaaagtttctatcagacatcttgggccgtccatgatccagcaaatgcaacatccttgtaacgagtgcaagggtaccggagaaactatcaacgataaggatcgctgcacacagtgcaagggtgagaaagttgttcaggagaagaaggttctagaagtacatgtggagaaggggatgcaaaacgggcagaagattacgtttcctggagaggctgatgaagctcctgacacagttacgggtgatattgtgtttgtgttgcaacaaaaagagcaccctaagtttaagcgaaagggtgatgacctattttttgagcacacgttgagcttgaccgaagccctgtgcggtttccagtttgtgttaacgcatttggataacagaaagcttctcatcaaatctaaacctggagaagttgtgaagcctgatcaatttaaggcgataaatgatgaaggaatgccgatgtaccagaggccatttatgaaggggaagctgtacatccacttcactgtggccttccctgattcattatccccagaacagtgtaaggcgttagaggcagtgctgccgccaaaaccgtcaatggatatgacagatatggagctggacgaatgtgaggaaacgacgttgcatgatgtcaacattgaagaagagatgagaaggaagcaacaacaacatgctcaagaagcttatgatgaagacgaagacatgccgggtggcgctcagagggtacaatgtgcacaacagtagttgaatcagtttttgtatggtgtctgtcctattaagaatgtctttcgctgtgcgcttgttgcgtgttatgaaaagtagttctcaaatgtgttttgttatatttaatgataagtctagtatgatatatcgttgaaaattggcgtcttgatgtggtttgtgatgttaaaacagactttaagtgaatgctgtggtcctaaagtattgcgagtgtcctgtctactaagagatcacaaaatactttatcgaaccgatttgtacaattaggcttgg

SEQ ID NO: 6358 - DNA, 1190 bp, Ambrosia trifida
gacatcttccagtctttctttggtggtagtccttttggtggtggtggtagcagccggggacgaaggcaacgaaggggagaggatgttgttcatcccctcaaagtttctctcgaggatctttacaatggaacttccaagaaactatctctttcacgcaacgtaatctgctccaagtgtaaaggcaagggttcaaagtccggtgcttcaatgaaatgtgctggctgtcaaggttctggaatgaaagtttctatcagacatcttggaccatcgatgatccaacaaatgcagcatccttgtaacgaatgcaagggtaccggagaaaccattaacgacaaggatcgatgcacacagtgcaagggtgagaaagttgtgcaggagaaaaaggtactggaagtacacgttgagaagggcatgcagaatggacagaagatcacattccctggagaggctgatgaagctcctgacacagttactggtgatattgtgtttgtgttgcaacaaaaggagcatcctaagtttaagcgaaagggtgatgacatatttgttgagcatacattgagcttgacagaggccctatgtgggttccagtttatcctaactcatttggataacagacagcttctcatcaaatctcaacccggagaggttgtcaagcctgattcattcaaggcaataaacgatgaaggaatgccaatgtaccagaggccgttcatgagagggaagctgtacatccacttcaccgtagaatttcccgaatcattgtcgcctgagcagtgcaaggcattggaggcggttgctgccacccaagccttcaatgcagatgacagacatggaactggacgaatgtgaagagacgacccttcatgatgtcaacatcgaagaggagatgagaaggaagcagcaacaagcagctcaggaagcttatgatgaagacgaagacatgcatggtggagcccaaagagtacaatgtgcacaacagtaagtcagatcatggtctagatttggtcatctgatagacaataatgtcagttgtgtattttgtttttgtttttgtttcctatttaaatatggatactattaagtgtttaaagatagcgtgaatgatttaagacttggtttggttactatttattcttgatgagttggtttgagaattgagatagttgaatcctattatttgagatctttat

SEQ ID NO: 6359 - DNA, 1092 bp, Helianthus annuus
aacgaaggggagaagacgttgttcatcctctcaaagtctctcttgaggatctctataacggaacttccaagaagctctctctttcacgcaatgtaatctgctctaagtgtaaaggcaagggttcaaagtccggtgcttcaatgaaatgtgctggctgtcaaggttccggaatgaaggtttccatcagacatcttggaccgtctatgatccagcaaatgcagcatccttgtaatgaatgcaagggtaccggtgaaaccatcaacgacaaggatcgatgcacacagtgcaagggtgagaaagttgtccaggagaagaaggtacttgaagtacacgtcgagaagggcatgcagaatgggcaaaagattacattccccggagaggctgatgaagcacctgatacggttaccggtgatattgtgttcgtgttgcaacaaaaggagcaccctaagtttaagcgaaagggtgatgacatatttgtcgagcacacgttgagtttgacagaggccctgtgtgggttccagtttatcttaactcatttggataaccgacaacttcttatcaagtctcaacccggagaggttgtcaagccagattcattcaaggcaataaacgatgaaggaatgccgatgtaccagaggccgtttatgagggggaagctgtacatccacttcacggtggaattcccggagtcattgtcgccggagcagtgcaaggcattggaggcggtgctgccaccgaagccttcgatgcagatgacagacatggagctggacgaatgtgaggagacgactcttcacgatgtcaacatagaagaggagatgagaaggaagcagcaacaagcggctcaggaagcttatgatgaagatgaagacatgcatggtggagcccaaagagtacaatgtgcacaacagtaactccaataatggtctaggtttggtcatctgatagacaataatgtcagttgtgattttgtttctttcttttttgttttaaaatatgatgataccattaagtgtttaaagatagtgtgaatgatttgaaagactggttggtttggtcgctattacttataaagttctgcatttgatgagc

SEQ ID NO: 6360 - DNA, 1157 bp, Arnica chamissonis
tggtggtggcggtggcagcagcaggggacgaaggcaacgaaggggggaagatgttgttcatcctctcaaagtttctcttgaggatctgtataatggaacttccaaaaagctctctctttcacgtaatgtaatctgctccaagtgtaaaggcaagggttcaaagtcaggtgcttcaatgaaatgtgctggctgccaaggttcaggaatgaaagtttcaatcaggcatctgggaccatctatgatccagcagatgcaacatgcttgtaacgagtgcaagggtactggagaaaccatcaaagataaggatcgctgtgcacagtgcaagggtgagaaggttgtgcaggagaagaaggttctggaagtacatgtggagaagggcatgcaaaatggacagaagattacattccctggagaggctgatgaagctcctgacacggtcaccggtgatattgtgtttgtgctgcaacaaaaagagcaccctaagtttaagcgaaagggtgatgacatatttgttgagcacacactgagcttgacagaggccctgtgtgggttccagtttatcttgacccatttggataacagacagcttctcatcaaatctcaacctggagaggttgtgaagcctgatcaattcaaggcaataaatgatgaaggaatgccaatgtaccagaggccattcatgagggggaagctgtacatccacttcactgtggaattccctgattcgatttccccagaacagtgcaaggcgttggaggcggtgcttccacccaagccttcaatggagatgacagacatggagctggatgaatgtgaagagacgactcttcatgatgtgaacattgaagaagagatgagaaggaagcaacaagcaagctcatgaagcttatgatgaagatgaagacatgccaggtggagctcagagggtacaatgtgcacaacaataattggatcagattttgtttggtttgtctgttaaacggtgaaaggatggataatcaactcatattattattaacttatttttagatgccttcaaatgtgttgtttgttgatatttttgatgatgatttttgttttggttgtttcgtctgaatcatgcccacgtctcatcctaaaactttggttttattttggttggatccatcctcgcttga

SEQ ID NO: 6361 - DNA, 1196 bp, Cucurbita pepo
caaggtctccttggaagatctctataacggaagttcgaagaagctttctctttcgcgcaatgtaatttgctcgaagtgcaagggtaagggctcgaaatctggtgcttcaatgaaatgtcctggctaccaaggatctggtatgaaagtttccatcagacacctcggcccctctatgatccaacaaatgcagcatccttgtaatgaatgcaaggggactggtgaaaccattaacgataaagatcgttgctcacagtgcaagggtgaaaaggttgtacaggagaagaaagttttggaagtaattgtggagaagggtatgcaaaatggacagaagattacattccctggtgaagcggatgaagcgcctgacaccgttactggggatatcgttttcgtcctacaacaaaaagagcacccgaagtttaagagaaagggcgatgacctctttgtggagcataccttgtctctcgtcgagtctctttgtggttttcagtttattctgacacacttggatggccgccagcttctcatcaaatcccatcctggcgaagtagttaagcctgaccaattcaaggctataaacgatgagggtatgccaatgtaccagaggccattcatgaagggtaaactttacatccacttcagtgtcgacttcccagactccttgaaccctgaacaatgcaaggcactcgagggcgtgctgccacccagatcttcggtgcagctatcagatatggagttggatgaatgcgaagagaccactctccatgatgtcaacatcgaggaagagatgcgcaggaagcaggtacaagaggcatacgacgaagatgaagatatgcatggaggtgcccagagagtgcagtgtgcgcaacaatgattttgaatgttttcaggaggatgaatcggatctagcgcgcgaaccaccacccgccagtcatccaggttttctgaaaataatagatggattttatgttgattcagtcatagaattacgaagtaagtttcgcgttcgttttatgttctttcccctaaaatgtgttttctatctagcttatgaagcattcaaatattatgtattggagttgcagataaaataggattgggaaacagaacgatctgtggttcttttccaagtgccaagatttttctcttattttcacctttgcttgttgatgaacacctattttttgtgccttagg

SEQ ID NO: 6362 - DNA, 926 bp, Centaurea maculosa
  misc_feature (195)..(195): n is a, c, g, or t
  misc_feature (201)..(201): n is a, c, g, or t
  misc_feature (225)..(225): n is a, c, g, or t
  misc_feature (228)..(228): n is a, c, g, or t
tcaggtgcttcaatgaaatgtgctggatgtcaaggttctgggatgaaagtttctatcagacatcttgggccatctatgatccagcaaatgcagcatccttgcaatgagtgcaaaggtactggagaaaccatcaacgataaggatcgctgcccacagtgcaagggtgagaaagtggtgcaggagaagaaggtgctngaagtncatgtggagaagggtatgcagaanggncagaagatcacattccctggggaggctgatgaagctcctgacacagtaactggtgatattgtgtttgtgttgcaacaaaaagaacaccctaagttcaagcgaaagggtgatgacctatttgttgagcacacattgactctgacggaggcgctgtgtgggttccagtttatcctaacccatatggacaccagacagcttctcatcaaatcccaacctggagaggttgttaagcctgatcaattcaaggccataaacgatgaaggaatgcccatgtatcagaggccatttatgagggggaagttgtacatccacttcactgtggaattccccgactcattgtcaccggagcagtgcaaggcactggagggcgtgctgccggctaggccttcaatgcagatgacagacatggagctggatgaatgcgaggagacaactctgcatgatgtcaacattgaagaagagatgcgaaggaagcagcaagcagcccaagaagcgtatgacgaagatgaagacatgcatggtggagctcagagggtacaatgtgcgcaacaatgattgaaggtctgtttgatggaaaataattgatacttgctagttctaaatctgtatttggtatttttttacttatttgaaaaaaactgatttgatagcttcttcttcagtcttaatggcgttcactatacttgtttgtgtgacaa

SEQ ID NO: 6363 - DNA, 950 bp, Cichorium intybus
ggtgcttcaatgaaatgtgcaggctgtcaaggttccggaatgaaagtgtccatcagacatcttggcccatctatgatccaacaaatgcaacatccttgtaacgagtgcaagggcactggtgaaaccatcacgataaagaccgctgcccacagtgcaagggtgagaaagttgttcaagaaaagaaggttctagaagtccacgtggaaaagggcatgcagaattcccaaaagatcaccttccctggtgaagctgatgaagctcctgacacggttactggagatattgtgtttgtgttacaacaaaaggaacaccctaagtttaaacgaaagggtgatgacttatttgttgaacacacattgagtttaacggaagcactgtgtgggttccagtttattttaactcatttggacaacagacagcttctgattaaatctcaacctggagaggttgtgaagcctgatcaatttaaggcgataaatgatgaagggatgccgatgtaccagaggccatttatgagggggaagttgtacattcactttactgttgagtttccggaatctttgtctcctgaacagtgtaaggcattggagggggtgctgccagctaggccttcaatgcagatgacagatatggagttggatgaatgtgaggagacaactttgcatgatgtgaatattgaagaggagatgaggaggaaacagcagcaagctcaggaagcttatgatgaggatgaagatatgcatggtggtgcgcagagggttcaatgcgcacagcagtgattgttagctcgtttataggggtcctggcaagacaataatatcaggtgtaattttgtcatcttttttgtatagtgataaatgaagttttatcttaatatggtaattgttaagatatatggatgatttggtcttttggaacgttgatttatggaacttcttttaagctaaaaa

SEQ ID NO: 6364 - DNA, 1008 bp, Zingiber officinale
  misc_feature (858)..(858): n is a, c, g, or t
  misc_feature (965)..(965): n is a, c, g, or t
  misc_feature (968)..(968): n is a, c, g, or t
gcacgagggaacatccaaaaaactctctctttctcggaatgccatctgccaaaagtgcaatgggaagggttcaaagtctggtgcttcgatgaagtgctcgggctgtcaaggttcaggcatgaaggtttcaattcggcagttagggcctggcatgatccagcaaatgcagcacccttgcaacgagtgtaaggggacaggggagacgattaatgagaaggatcgctgttccaaatgtaaaggtgagaaggttgtgcaggagaagaaggtactggaggttgtggttgagaagggaatgcagaatggccagaagattaccttcccaggcgaggctgatgaagcacctgatactgtgaccggagatattgtgtttgtccttcaagagaaggaacaccccaagttcaagagaaagggagatgatctcttttttgaacacacactgtcacttaccgaagcactctgtggcttccattttgtcctgacacacttggataacaggcagttgcttatcaagtcacaccctggtgaagttgtgaaacctgaccaatttaaggcaataaacgacgaaggaatgcccatgtaccagaggcccttcatgaaggggaagctctacatccacttcactgtggaattccctgattcactgacacccgatcaatgtaaagcgctcgaggcagtgctcccgccgaagcctgtatcgaagatgactgacatggaacttgatgagtgcgaggaaacaacgttacatgatgttaatattgatgaagaaatgagaaggaagcaaactcaggaagcttacgatgaagatgaggacgcccatggaggtgcccagagagtgcagtgtgcgcaacaataagttcnctactgcagcttgctagtagatctaatcttgtgttttctgtttgctatttactcagtcgtgcaggagctccagactgttttagataaacttgctcttgatgtcttanatnaatttccattacattacattatttgacctacctattaacc

SEQ ID NO: 6365 - DNA, 791 bp, Brassica napus
atccacacacacattaccaaaagacgcactacagaaccattccattagaacacaacctgaaaagttgcaaaagatgtcattagcttcgccgattcaatgcatcagaattataaatccatcatcttcttcttcatcttctttgacgacttggtcgtctttgagattctcaacgagtaagccatgtgtattcatcatcagatgttctcaggcggaaggtcccttgagaaggccctctgctcctcctactctccgggagcctacacctccccaaaaacctgttactcctacgccgtcttcttcccctccaccaccgcagaaagctgtggctgttgacggtaagagcgtagtaacaaccgtggagtttcagaggcagaaagctaaagagcttcaggattactttaagcagaagaagcttgaagctgctggtcaaggcccttttggttcaccaaaaacgagatctccaatggaaggtgggctatgtttggttttgcggtggggatgctgacagagtatgcaacaggatcagaccttgtcgaccaagttaaaatccttctctccaatttcggcattctagacttggaataataataataataataataataataaaaagagtgttgttggtgtatatgatcctttctctgattccttatgttcaatcttcttctccttgtttattcttcctcctgtatatgcatcccctaaagatctttaatacagagggcccttttgttgttcaaccacttttatctttcaaatgttataataagtatgatctatggatctcgatt

SEQ ID NO: 6366 - DNA, 325 bp, Brassica juncea
cggggaacctgaaaattttcagacaactcgaaagttaaagaaagccattaaacggaagatgtcattagcttcgccgattcaatgcatcagaattataaatccatcttcttcttcttcatcttcttatttgacaactcggtcatctttgagattctcaacgagtaagccatgtgtattcatcatcagatgttctcaggctgaaggtccattgagaaggccctcggctcctcctactctccgggagccttcacctccgcaaaaacctgttcctcctacgccttcttcttctcctcctcctccacctccactgcagaaagctgtggct

SEQ ID NO: 6367 - DNA, 410 bp, Brassica juncea
ccaatgacatctttcgttaacagctcgacccatcaaacaattcttcaacccattaacgaaagatgtcattggcttcacctattcagtgtatcaggattcttaatccatcttcttcttcttccacaacttcgtcgtctttcagattctcaacgattaagccatgtgtcttcgtcatcagatgttctcaggcagaaggtccattgagaagaccctctgctcctcctactctccgcgagccttcacctccgcaaaagcctgttcctcctgtaccgtcttcttctcctcctccatccccgcccctgcagaaaacggtggctgttgatggtaagggtgtagttacggtggagtttcagagacagaaggccaaagagcttcaggaatactttaagcagaagaagcttgaagctgct

SEQ ID NO: 6368 - DNA, 859 bp, Arabidopsis thaliana
tttacccaagaaccaaaccgaatttcttttcaacaacactttacaaatactttggttaaccgacaaccaaataaaccggctctttccggtttggttaaccaaagtttcagctcttaaaaaaaaatctacccaatcatcattacttggttttagctttcaagtcaaacaacagttaaaactattacacgcgctttcaacgcgcgtgggatgattacgaaagtaccatttgcacataaccatgagacttggccatatcacatccacaaagacattaccaaaagacagaaccaaagcttcgaaaatcagacaattcaactaacaaaaaaatgtcagtagcttcaccgattcaatgtatcaggattctaaatccatcatcttcatcttcttcttcgacagcttcgtcgtcttttagattctcaacaacgactaagccatgtgtcttcatcatcagatgctctcagacagaaggtcctttaagaagaccatcggctcctcctactctccgggagcctcaaaaacctgttcctccatcacagccatcttcctctcctcctccttctccgccgccgcagaaagctgtagctgttgatgggaagagtgtaactacagtggagtttcagagacaaaaggctaaagagcttcaagagtactttaaacagaaaaagcttgaagctgctggtcaaggtcccttttttggtttccaacccaaaaatgagatctccaatggaaggtacttaagctatgatctcaattcttgtatttgattgatggatgctaataactcaaaaagttaatagatatagagagatttgtttgaattgcatttgaggtagctctggtattgaataaacaagttact

SEQ ID NO: 6369 - DNA, 542 bp, Brassica rapa
ccccgcgtccgtcttctcaagctgggttctgataaagacaaacgcaaagatgacaaagaagagaaagctaagaaagctagtgagcattaatgagtttctgaaaccagctgagggtgagaactactaccgaggaggaggccgtggtggtggtcgtggaaggggacgtggtggtcgtgaccgtggagttgtttctggtggtggatttgatggttaccgtagtgaagctgcgcctgccatcggagatactgctcagttcccatctcttgggggaaagtaagatccaaccttggacactcctgctgtctccttcagttttcctcatcatgactgaagtgtttcatgctgagtgtttgctggtctgttgttgtcaggtgtaaattgttagttgttgtcagtttttagagtttctgaaaacttatgcctgaccggtcttttttttttaacgtttggaacaataatacccttttctattttggttttaccacttagtctttatagttgtttgtgaaaagacagacagttctaatgttatatgctttggg

SEQ ID NO: 6370 - DNA, 857 bp, Brassica napus
tggacttcaaaagggaaggagctggtcgtggaaattggggaacaccaggagaagaagttcttgttgtggagactgaagaagttgctggtactgagattgagaagcctgctggtgatgaggttgctgctgatgctaagaaggagaacactgctgaagtcgaggagcagaaagagcctgaggataaggagatgactttggattagtatgagaaaatacttgaggagaagaaaaagtctcttcagtctcagaccacctctgagaggaaagttgatactaaagtgtttgaatcaatgcaacaactctcaaacaagaagtctaacgatgaaatcttcatcaagctgggttctgataaggacaaacgcaaagacgacaaagaagagaaggctaagaaggctgtgagcattaatgagtttctgaaaccagctgagggtgagaaccactaccgaggaggaggcagtggtggtggtcgtggaaggggacgtggtggtcgtgaccgtggaggtgtttctggtggtgtatttgatggttaccgtagtgaagctgcgcctgccatcggagatactgatcaattcccatctcttgggggcaagtaagatccaaccttggatactcctgcggtctccttcagttttcctcatcaagactgaagtgtttcatgctgagtgtttgctggtctgttgttgtcaggtgtaaattgttagttgttgtcagtttttagagtttctgcagacttatgcctgaccggttctttttgtttacgttgacatatactctttcttatttgtttactacttagttgtttattagttgttagtagaaagacagactagttgtaatgttatatgtctttagtaagt

SEQ ID NO: 6371 - DNA, 1324 bp, Raphanus sativus
  misc_feature (239)..(239): n is a, c, g, or t
  misc_feature (309)..(309): n is a, c, g, or t
  misc_feature (322)..(322): n is a, c, g, or t
  misc_feature (333)..(333): n is a, c, g, or t
  misc_feature (366)..(366): n is a, c, g, or t
  misc_feature (379)..(379): n is a, c, g, or t
  misc_feature (422)..(422): n is a, c, g, or t
atggcaactttgaacccttttgatctgttgggtgacgacgcggaggatccgagccagctcgccgtcgtctccatcgctgctgataagcccaaaaaatctgcacccgtttccgccgtgtctgctaagtcatctgctccgcctccgtcaaagcagcttcctcctccccaagctgtgagagaggttaggagtgatgctccacgtggcagtgaacgtggtggagagcgtggatttagccgtgntcgtggtggtggttacaaccgtgattttagaggcggtgatggtaacaatgggggatacagtaagccatcngaggaaggaggcntttcaaagccnttctatgagaaacgtagtgtacctggtgtatanggtggggggtggngctcgtggtggtcgacgcggtgaaactggtgaaggtgaacgtnctcctcgaagacatatgatcgtcgtagtggaactggcagagggggtgacttcaaaagggaaggagctggtcgtggaaattggggaacaccaggagaagaagttcttgttgtagagactgaagaagttgctggtgctgagactgagaagtctgctggtgatgaggttgctgctgatgctaagaaggagaacactgctgaagtggaggagcagaaagagcctgaggataaggaaatgactttggatgagtatgagaaaatactcgaggaaaagagaaaggcccttcaatctcagaccacatctgagaggaaagttgatactaaagtgtttgaatcaatgcaacaactctcaaacaagaagaagtctaacgatgaaatcttcatcaagttgggttcagataaggacaaacgtaaagatgacaaggaagagaaggctaagaaggctgtgagcattaatgagtttctgaaaccagctgagggtgagaactactaccgaggaggaggtcgtggtggtcgtggaaggggacgtggtggtcgtgaccgtggaggtgcttctggtggtggatttgatggttaccgtattgaagctgcgccttccattggagatactgctcagttcccatctcttgggggcaagtaagaaccatccatggaaactcgtgctgttttcttcaagactgaagtattccacgcgaagggtttggtgttgtcaggtgtaaattgttagttgttgtcagtttttactttttagagtttctgcaaacttatgcctgacctgtcttttttttttctaaacgtttgacataataccccttttcttttctttttttttggtttaccacttaagtctttatagttgtttgttgtttacttatttatgagaagacagacaagttctaatatca

SEQ ID NO: 6372 - DNA, 672 bp, Brassica juncea
aaaatactcgaggaaaagaaaaagtctcttcagtctcagaccacctctgagaggaaagttgatacgaaagtgtttgaatcaatgcaacaactctcaaacaagaagaagtctaacgatgaaatcttcatcaagttgggttcagacaaggacaaacgcaaagatgacaaagaagagaaggctaagaaggctgtgagcatcaatgagtttctgaaaccagcagagggtgagaactactaccgaggaggtcgtggtggcggccgtggacgtggtggtcgtgaccgtggaggtcgtgtttcaagtggcggatatggtggtagccgtagtgaagctgcgcctgccatagcggatactgctcagttcccatctctcgggggcaagtaaagatccatccatgaacacgctcgtgtgcgggtctccttcagttttcctcctctggttgaaatcaaaactgaatgaattcacgacgagggtttactgtttacctgtctgttgttgtcacttgtaaatttttagttgtcgtcagtttttttagattttctgcaaacttatgcctgactgttttttttttttaacttttgaaacatcactctcttttagtttaccacttagtcgttgttttgttgtttatgaaacttgtttcagacagacaagtctaataaatgttatctgttt

SEQ ID NO: 6373 - DNA, 336 bp, Brassica nigra
cttcatcaagttgggttcagacaaggacaaacgcaaagatgacaaagaagagaaggctaagaaggctgtgagcatcaatgagtttctgaaaccagcagagggtgagaactactaccgaggaggtcgtggtggcggccgtggacgtggtggtcgtgaccgtggaggtcgtgtttcaagtggcggatatggtggtagccgtagtgaagctgcgcctgccatagcggatactgctcagttcccatctctcgggggcaagtaaagatccatccatgaacacgctcctgtgcgggggtctccttcagttttcctcctctggttgaaatcaaaactgaatga

SEQ ID NO: 6374 - DNA, 1467 bp, Brassica napus
cggcaattctcagcttaaccacgttttgggcaaaaacacagatttaaccgacggtaaagaagccaagagctgaaaatcaggatgcgcaggtggatctgttgtgggctatatcaggtgattcagatttatcaaatgatgagcaacatctcaaaactcaatggcaacaacaacaacaacctgatgcagcaaaccaaaagctaaaaccacagcctgctacaaaacctgacgtccccaaagaagctcttcccattgaagtccctcccttgtctgtggaagaggtgaaagagaagacagacaattttggatcaaagtcactgattggcgagggatcttacggaagggtctattacgcaacgcttaacgatggtaaagcagtggctttgaagaaactcgatgttgcacctgaagctgaaacaaacgctgagttcttgagtcaggtttctatggtttcgagactgaaacatgataacctcatccaactagtcggttactgcgtcgacgaggacctccgtgttcttgcttacgagttcgcaacgatgggatcacttcacgacgttctacacggtaggaaaggagtgcaaggcgcgcagccaggtccgacgctagactggataacgagggtgaagatagccgtggaggcggctaggggattagagtaccttcacgagaaggttcagcctcctgtgatacacagagacgtgagatctagcaacgtgcttctctttgaagactatcaagcgaaaatcgctgattttaatctctcgaatcaggctcctgataacgctgctcgtcttcactctactagagtgttgggaacctttggctatcacgctccagaatatgctatgactggacagttgacgcagaagagtgacgtgtatagctttggggttgtactgcttgagcttttgactgggaggaagcctgtggatcacacgatgccacgtggccagcagagtcttgtaacttgggctacaccgagacttagtgaagacaaagtgaagcagtgtgttgatccaaagcttaaaggagagtatcctcctaaatcagttgctaagctagcagcggtggcagcgttgtgtgtgcaatacgaatctgagtttagaccgaatatgagtatagttgtgaaagctttgcagccgcttctcaaacctccagctccagcagccccagtacctgagccctgagtttgtgttacagagttggatacctttgttcatacgaagttagaaaatttctctggtttggggaagggaaacaaaaaatataatatttcatatctatgttgtttttctttatggggatgggattttactagttggcattttggtgtgtgacaggagagtacttaatagtttgcatttgtttatgtctggattggaaacaggctgttttgctttgctgctttgcttgtcgtggtggagaccactatgtaactgcattcttgctgttctatggtctgacgat

SEQ ID NO: 6375 - DNA, 1498 bp, Brassica napus
gcaaagcaaaaggctcctccttttccactctctcatctctacatagaagagacaatcgaaccctcggcaattctcagcttaaccacgttttgggcaaaacacacagatttgactgacggtaaagaagccaagagctgaaaatcaggatgcgcaggtggatctgttgtgggcgtatatcaggtgattcagatttatcaaatgatgagcaacatctcaaaactcaatggcaacaacaacaacaacctgatgcagcaaaccaaaagctaaaaccacagcctgctacaaaacctgacgtccccaaagaagctcttcccattgaagtccctcccttgtctgtagaagaggttaaagagaagacagacaattttggatcaaagtcactgattggcgagggatcttacggaagggtgtattacgcaacgctaaacgatggtaaagcagtagctttgaagaaacttgacgttgcacctgaagctgaaacaaacgctgagttcttgagtcaggtttctatggtttcgagactgaagcatgataacctcatccaactagtcggttactgcgtcgacgaggacctccgtgttcttgcttacgagttcgcaacgatgggatcacttcacgacgttctacacggtaggaaaggagtacaaggcgcgcagccaggtccgacgctcgactggataacgagggtgaagatagccgtcgaggcggctaggggattagagtaccttcacgagaaggttcagcctcctgtgatacatagagacgtgagatctagcaacgtgcttctctttgagactatcaggccaaaatcgctgattttaatctctcgaatcaggctcctgataacgctgctcgtcttcactctactagagtgttgggaacctttggctatcacgctccagaatatgctatgacgggacagttgacgcagaagagtgacgtgtatagctttggggttgtactgcttgagcttttgacagggaggaagcctgtggatcacacgatgccacgtggccagcagagtcttgtaacatgggctacaccgagactgagtgaagacaaagtgaagcagtgtgttgatccaaagctaaaaggagagtatcctcctaaatcagttgcaaagctagcagcggtggcagcgttgtgtgtgcagtacgaatctgagtttagaccgaatatgagtatagttgtgaaagctttgcagccacttctcaagcctccagctccagcagccccagtacctgaagcctgagtttgtgtcacagagttggatacctttgttcatacgaagttagaaaatttctctggtttggggaagggaaaacaaaaaatataatatttcatatctatgttgtttttctttatggggatgggattttactagttggcattttggtggtgacaggagagtacttaatagtttgcatttgtttatgtctggattggaaacaggctgttttgctttgctgctttgcttgtcgtggtggagaaccactat

SEQ ID NO: 6376 - DNA, 736 bp, Brassica juncea
ggtaggaagggagttcaaggtgcacagccaggtccaacgcttgactggataacgagggtgaagatagccgttgaggcagctaggggtttagaataccttcatgagaaggttcagcctcctgtcatacatagagacgtgagatctagcaatgtgcttctctttgaagactatcaggcaaaagttgctgattttaatctctcaaatcaagctcctgacaatgctgcacgtcttcactctacaagagtcttgggcacctttggctatcacgctccagaatatgctatgactggacagttgacacagaagagtgatgtgtatagctttggggttgtactccttgagcttttgacagggaggaaacctgtggatcatacaatgccacgtggccaacaaagtcttgtaacctgggctacaccgaggcttagtgaagacaaagtgaagcagtgtgttgatccaaagctaaaaggagaatatcctcctaaatcagtagctaagctagcagcggtggcagcattgtgcgtgcaatatgaatcagagtttagacccaatatgagtatagttgtgaaagctttgcagccacttctcaaaactccagcaccagtcccagtaacggaatcctgagttttgtgcaaccagagttggattcttttgttcatacgaagatagaatctttctctgatttggggaagaaaaactcaggattccgttactgggactggtgctgaagctttgcagc

SEQ ID NO: 6377 - DNA, 1525 bp, Brassica napus
tcgtctcgtctccacacaggagacaatcaaccctctggaaaaaagcaagagaagtctcagtgcaaacggaaactaaagaaactgtgaggattgatagttgaagaggagaacaagcatgcacaggtggatctgttgtgggcgtagttcaggagattcggatgtatctaatgatgagcaacatctgaaaactcatggcagcaatctgaggagcaatatataagccaaaaccacagctgttgcaaaacctgaggcgcccaaggaagctcttcccattgaagttcctctcttgtctgtggaggaggttaagaaagactgacactttggatcaaagtcactcattggtgagggttcttatgggagggtgtattacgcaactctaagtgatggtaaagcagttgcattgaagaaactcgatgttgcccctgaagctgaaacaaacaccgagttcttgagtcaggtttccacggtttcaagactgaagcatgagaatttcattcagctggtcggctattgtgttgatgagaacctccgtgttcttgcttatgagtttgcaacgatgggatcactgcacgacgttctacatggtaggaagggagttcaaggtgcacagccaggtccaacacttgactggataacgagggtgaagatcgccgttgaggcagctaggggcttagaataccttcatgagaaggttcagcctcctgtcatacatagagacgtgagatctagcaatgtgcttctctttgaagactatcaggcaaaagttgctgattttaatctctcaaatcaagctcctgacaatgctgcacgtcttcactctacaagagtcttgggcacctttggctatcacgctccagaatatgctatgactggacagttgacacagaagagtgatgtgtatagctttggggttgtactactagagcttttgacagggaggaaacctgtggatcatacaatgccacgtggccaacaaagtcttgtaacctgggctacaccgagactcagtgaagacaaagtgaagcagtgtgttgatccaaagctaaaaggagaatatccgcctaaatcagtagctaagctagcagcggtagcagcattgtgtgtgcaatatgaatcagagtttagaccgaatatgagtatagttgtgaaagctttgcagccacttctcaaaactccagcgccagtcccagtaacggaaccctgagtttgtgcaagagagttggattccttgttcatacaaagttagaatctttctttgatttggggaagaaaactaaaacacaaaaagtaaaagatcatatatttatttgaggggatggaaattattagtttgcattttggtgtgaaaggggacagatattttattttgcatgtgtcatgtccggatttgaaacaggcttctgtggctgtgcttgtcgtggaggagaacaatgatgtattgcatttgctgttctttgattttttctatatagataaaagggatcatttgaatatttgtatcgactctagtgacaactcttctaag

SEQ ID NO: 6378 - DNA, 875 bp, Brassica rapa
ggggtttagaataccttcatgagaaggttcagcctcctgtcatacatagagacgtgagatctagcaatgtgcttctctttgaagactatcaggcaaaagttgctgattttaatctctcaaatcaagctcctgacaatgctgcacgtcttcactctacaagagtcttgggcacctttggctatcacgctccagaatatgctatgactggacagttgacacagaagagtgatgtgtatagctttggggttgtactactagagcttttgacagggaggaaacctgtggatcatacaatgccacgtggccaacaaagtcttgtaacctgggctacaccgagactcagtgaagacaaagtgaagcagtgtgttgatccaaagctaaaaggagaatatcctcctaaatcagtagctaagctagcagcggtggcagcattgtgtgtgcaatatgaatcagagtttagaccgaatatgagtatagttgtgaaagctttgcagccacttctcaaaactccagcgccagtcccagtaacggaaccctgagtttgtgcaagagtgttggattccttgttcatacaaagttagaatctttctctgatttggggaagaaaactaaaacacaaaaaagtaaaagatcatatatttatttgaggggatggaaattattagtttgcattttggtgtgcaaggggacagatattttattttgcatgtgtcatgtccggatttgaaacaggctcctgtgtatgtgcttgtcgtggaggagaacaatgatgtattgcatttgctgttctttgatttttttctatatagataaaagggatcatttgaatatttgtattgactctagtgacaactcttttaaggtttgattcgacc

SEQ ID NO: 6379 - DNA, 948 bp, Thellungiella halophila
  misc_feature (390)..(390): n is a, c, g, or t
catggtaggaagggagttcaaggtgcacagccaggtccaacacttgactggataacgagggtgaaaatagccgttgaggcagctaggggtttagaataccttcatgagaaggttcagcctcctgtaatacacagagacataagatcgagcaatgtgcttctttttgaagactaccaagcaaaagttgctgattttaatctcccaaatcaagctcctgataatgctgctcgtcttcactctacaagagtcttgggcacctttggctatcatgctccagaatatgccatgactggacagttgacgcagaatagtgacgtatatagctttggggttgtacttttatagcttttgacagggaggaaacctgtggatcatacaatgccacgtggncaacaaagtcttgtaacctgggctacaccaagactcagtgaagataaagtgaagcagtgtgttgatccaaagctaaaaggagaatatcctcctaaatcagtagccaagctagcagcggtggcagcattgtgtgtgcaatacgaatctgaatttagaccgaatatgagtatagttgtgaaagctttgcagccacttctcaaagctccagcgccagcgccagcacctgaatcatgagtttgcactccttttagataccactggggcatctacagagttggattctttgttcatacaaatgagaatttgttcctctgatttgggaaagaagaaacagaaagtatgagatcatattttgtgttgttttttttaggggattatattattttttgtgttggcattttggtgtgaacggaggatattttgcatttgttatgtcagtattggaaacaggctttttgttttgcttggcgtggagaacaaatttgtattgcatttgctgttctttcgttttttatttccttatcgataataatttgagtattggttagactacatcat

SEQ ID NO: 6380 - DNA, 815 bp, Sarracenia psittacina
tcctgttgatgccgcgcgggggagttgggaggtatttagtcgacgcaggtcaactctataatacacagagatatcagatctagcaatgtgcttctattgaagagttaaggccaaatgcagatttaaccttcgatcaggctcctgatatggctgctcgccctcattctactcgattttgggaacattggttatcacgcaccagaatatgcaatgactggacaattgacacagaagagtgatgtatatagtttcggggtggttctgctagagcttttgactggccgtaaacctgttgatcatactatgcctcgtggacaacagtctctcgttacatgggccactccaaggctaagcgaagacaaagtcaagcaatgtgtagatccaaagctcaagggagagtatcctcccaaaggagtcgctaagttggcagctgtggccgcactttgcgtgcagtacgaggctgagttccggccaaatatgagcattgtagtcaaggctctccaaccccttctgaagcctccggcaccagctcctcctgaggcttgaatcgtatgaacgaatgttcaagtgttctagtgcactgtttggtttttgatttgtttgcaaatttccttgcgttattgactctgtatgtgcgtatatatatagatacatatatttttttctcatatttgttgttgtttttttttcctccagattggatacttaggcttttgtgtagctgcattgttaaatttgttactgatattgctctgtgatgctggagtcttctaaagtcatgaacggatagtgggatgctatagaacgagcattac

SEQ ID NO: 6381 - DNA, 1551 bp, Chelidonium majus
ctccaaaaaccctcctttataccagtcttcccggttttttcgatcgaacaacttcaacagaaaaccctagattcagaaaaccagggaaatgcgccttcacctggttctcttgaaataaaaaagagacaaaagatgcgtcgttggctttgttgtaattgtgaagtagaagaatcacgcaatccacatgaagatgaacctctgaaaagccccggagatcatgcagatggctacctacggaagccgcctgcttcagctaataccgatatgaaagtgccaccacctattgaagtgcctgccctgcctttggatgaagtgaaagaaaagactgacaattttgggtcaaagtctttaattggtgaaggatcatatggaagagtatattttgcaaccttagatagtgggagtgctgttgctataaagaagcttgatgttgcatctgaacccgagtccaatgttgagtttttgacccaggtgtcgatggtgtcaaaactgaaacatgacaatttggttgagttgcttggttactgtgtggaaggcagtcttcgtgtcttagcatatgagtttgcaactatgggatctctacatgacattttacacggtagaaaaggagtccaaggggcacaaccaggtcctgtgcttgactggatgcagcgtgtgagaattgctgttgatgctgctagaggattagagttcttgcatgagaagcttcaaccttcaataatacacagggacatcagatcaagcaatgtgcttctatttgaagacttcaaagccaaaattgcggacttcaacctttcaaatcaggctcctgacatggcagctcgtcttcattctactcgagttttgggaacatttggttatcatgcaccagagtatgccatgactggtcaattgacacaaaagagcgatgtgtatagcttcggtgttgttctcttggagcttcttaccggcaggaaacccgtggatcatactatgcctcgtgggcaacagagtctcgttacttgggctactccaagactgagtgaggacaaggtcaaacaatgtgtggatccaaagctaaagggagagtatccgccgaaaggagttgctaagttggctgctgtggcggcgttgtgtgtacagtacgaatcagagtttcgaccaaacatgagtattgttgtcaaggcactccaaccacttcttacccagaagcctccagctccagctccagctcctgagatataacaagggtgcccaaccggtcaatgtctatttttaattgcttgtttggatcactctgcgtattgtgaattgttttgattttgttcaccgcagattgatccccggctgagggtcgattttatatgtataattttctgtgttgcttcgagatttcgatgtgtaagaatgaatgattggattggatggatccatttgcaggactcttcccactgtgcgttgttttactttgcacccaaagtcagggatgatcattgacattgggctttagtttttgatggatgcatttgtttgctaagtctttgtattctaattttgagttttattgttttg

SEQ ID NO: 6382 - DNA, 1589 bp, Euonymus alatus
gtttgttgggttttgcttgattacaaagatttttgtattgcgtcttctttttgatccttgatttgttgggtttttttctcttatgatggaacgggaacatcatagacgcagtttgggggcacatgaaccatctccttgtgttttcgtacgtctggacaaaccaagtgctcaagacgacttatatctgaggaagagagtcaggatgcgtaagtggctgtgctgtacatgtcaagtagaagagtcttacccgtcaaatgaaaatgaacacctgaagagcccaaataatcgtacagatgggtatccaaaaggctcaaaggtgtcagctcctgtcaaacctgaagtgcaaaaggcagtacctcccattgaagtgcctgcattgtctttggaggaactgaaagaaaagactgagaattttggatcaaaggctttgattggtgaaggatcgtatggaagggtctattatgcaaacctaaataatggaaaagccgtagctgtaaaaaaacttgatgttgcatctgagccagaatcaaatgttgagttcttgactcaggtctccatggtctcaagatttaagcatgacaatcttgtggagttgcttggttactgtgttgaggggaatctccgcatgcttgcatatgagtttgcaacaatgggatctctacatgacatattgcatggtagaaagggagttcaaggggcacaacctggtccaacacttgattggatgcagcgtgtaagaatcgcagttgatgcagcaaaagggttggaatacttgcatgagaaggttcagccatcggttatacacagggacattagatctagcaatgttcttctctttgaagactttaaagccaagattgcagatttcaacctctcaaatcaggctccagatatggctgctcgtcttcattctactcgagttttgggaaccttcggttatcatgcacctgagtatgcaatgaccggacagctgacccagaagagtgatgtgtacagcttcggggtggttctgctggaacttctgactgggagaaaacctgttgaccataccatgcctcgtgggcaacagagtcttgttacctgggctactccaagactgagtgaagacaaagttaagcagtgtgtagatccaaagctaaagggagaatatcctcctagaggagttgccaagttggcagcggtggcagcactatgcgtgcagtatgaagctgagttccgtccaaatatgagcattgttgtcaaggctctgcagccgcttctgaagcctccggctcctgctccagcacccgagacttagtggctatattcagtttctgaattgtgttgggaactcaggaaattgtgcacagttcgatacgtctggccagcaatttcataatttctttctatatatatatttttaaatcttttcatatgtgagatcggatatgtaggattggattgggctgtttaatgttgccattgcctgtgttgtcccgcgatgtagtgatatactgatgtcttgagggattgggtttgttgcgaggtggttatatttctcaattgatctaacgttttcttaatgttcccctttctactaatatcaagtg

SEQ ID NO: 6383 - DNA, 1416 bp, Tripterygium wilfordii
acatgcaccatatcctcgtgtatttgtacgtctggagaaaccaagtgctcaagacaatttatatctgaggaagagagtcaggatgcgtaagtggctgtgctgtacatgtcaagtagaagagtcttatccgtcaaatgaaaatgaacacctgaagagcccaaataatcatacagatggatatccgaaaggctcaaaggtgtcagctcctgtcaaacctgaagtgcaaaaggcagtacctatcattgaagtgcctgcattgtctttggaggaactgaaagagaagactgagaattttggatcaaaggctttgattggtgaaggatcttatgggagggtgtattatgcaaacctcgataatggaaaagctgtagctgtaaaaaagcttgatgtttcatctgagccagaatcaaatgttgagttcttgactcaggtctccatggtctcgagattgaagaatgacaatattgtggagttgcttggttactgtgttgaggggaatctccgtgtgcttgcatacgagtttgcaagaatgggatctctacatgacatattgcatggtagaaagggagttcaaggggcacaaccgggtccaacacttgattggatgcatcgtgtaagaatcgcagttgatgcagcaagagggttggaatacttgcatgagaaggctcagccaccggttatacacagggacattagatcgagcaatgtgcttctctttgaagactttaaaggcaagattgcagatttcaacctttcaaatcagactcctgacatggctgctcgtcttcattccactcgagttttgggaacctttggttatcatgctccagagtatgcaatgaccggacagctgacccagaagagtgatgtgtacagctttggggtggttctgctggaacttctaactgggagaaaacctgttgatcataccatgcctcgtgggcaacagagtcttgttacctgggctactccaagactgagtgaagacaaagttaagcagtgtgtagatccaaagctaaagggagaatatcctcctaaaggagttgccaagttggcagctgtggcagcactatgcgtgcagtatgaagccgagttccggccaaatatgagcattgttgtcaaggctctgcaaccgctcctgaagcctcctgctccggctccgactccagcccccgagacttagtgcctgctatacgcggttactgaattgcgttgggatctcagtaaattgtgcagagtttgatacgtctggccagcgatttcatcagctctgtcatatatattttttaaatcttttcgtatatgatgtgagatgtttagaattggattggactgggctgtttaatgttgcagttgctggtgttgtaccaggatggatgtactcatgtcttgagtttaaaaattgagattgggatt

SEQ ID NO: 6384 - DNA, 975 bp, Cleome spinosa
aagctcctcccattgaggttcctgccttgtctttggacgagctgaaaggaaaagactgataattttggatcaaaagcattaattggtgagggatcttatggaagagtgtattatgcaaccataaatgatgggaaagttgttgctctgaagaaacttgatgtgtcaccagaagctgaaacagatgttgagtttttgagtcaggtttccatggtttcaagactgaagcatgagaatcttattcagctacttggttattgcgttgatgtgaatcttcgtgttcttgcatatgagtttgcaacgatgggatctctgcatgacatactacatggtaggaaaggagttcaaggggcacagccagggccaacacttgactggataacgagggtgagaatagccgttgaggcagctaggggtttggagtacttgcatgagaaggcacagtctcctgtaatacatagagatataagatctagcaatattcttctgtttgaagactttaaagcgaagattgctgattttaatctctcaaatcaagctcctgacaatgctgctcgtcttcactctactcgagtcttgggaacctttggttatcatgctccagagtatgctatgaccggacagttgactcagaagagtgatgtgtacagctttggggttgtacttctagaacttctgacggggaggaaacctgtagatcataccatgccacgtggccagcaaagtctcgtaacctgggctacaccaagactgagtgaagataaagtcaaacaatgtgttgatccaaagctaaaaggagaataccctcctaaagcagtcgctaagctagcggcagtggcagcactgtgcgtgcaatatgaagctgagttcagaccgaacatgagcatagtcgtcaaggctctccagccacttctgaaacctccagccccatctccagaatcttgagtgtgcaagtcctcaagtctctgctctgctcca

SEQ ID NO: 6385 - DNA, 1781 bp, Cucumis melo
attgccatttgccccgcgttttgctactctgtcatccgttcattgcgtttctctgaataactaccgaaaagccaaaaccgaagaacacccaacaaagccaaaagccaaacccactccgcaaattccaccctgtctttcccctttattcttccatttctcttcccgaagcccaggagaggcattaacccgaaggcgcatgcccctcctcctggttacttcgttcgtttgaagaatacaggttctaaagacgatctatatctaagtaaaagggatagaatgcgcaggtggctttgttgtacttgtcaagttgaagaggcctacccatcagcggaaagtgagcacctgaaaagcccacgaagttatggagatggtcacgttcaaaggaaagaggcagctcctgtcaaacctgaagcaccaaaaactccacctcccatagaagtgccagcattgtctctggaagaattgaaagaaaagactgacaactttgggtctaaggcactgattggtgaagggtcttatggtcgagtttattatgctagtttaaatgatgggaaagctgtggctgtgaagaagctggatgtttcttctgagcccgactccagtgttgactttttgactcaggtttctactgtctcaaggttgaaacatgaaaattttgttgagttgcatggatactgtgttgaaggaaatctccgtgtacttgcatatgaatttgcaactatgggttctctacatgacatattgcatggtagaaagggagtgcaaggcgcacagcctggtcctgttctcgattggatgcagagagtgagaattgctgttgatgccgctcgaggattggaatacttgcatgagaaggttcagccttctatcatacatagagatgttagatccagcaatgtgcttctcttcgaagatttcaaagcaaagattgcagactttaacctttcaaaccaggctcctgacatggctgctcggcttcactctactcgtgttttaggaacttttggctatcatgctccagagtatgcaatgacgggacaattgacacagaagagtgatgtctatagctttggagttgttctacttgagcttttgactgggaggaagcccgttgatcataccatgcctcgtggtcagcagagtcttgttacttgggctaccccaagactaagtgaagacaaagttaaacaatgtgttgatccaaggctgaagggtgaatatccccccaaaggagttgccaagctggccgctgtggcagctctgtgtgtgcagtacgaagccgagttcaggccaaacatgagcatcgtcgtcaaggctctccagccgcttctaaagccacctgcccctgctccggttgtggaaccttgaagtaaattgatatccgttttctccctctctgttgatatatatgtcagcgcctacattgcaatgtttgctttcatggtgaccatatagaattcataatattcattatttattccaattattattgttgttttttctttcttgaagaagatgcttgagtcatgtttggttggattgaaaataggttgctgcctttcttgtaagcaattcttcttgtgtagcctgttgttggtaatagccctcggttgttaaaaatgttttcccttcgttttttggagtcatcaagtgagaggactcggtgggagtgctgaatggtgtggtggaaaacgcatttggattatactttgctttccctcactcttttgatattaatggatatgggttggtttcttcggttgtcaaaaaaaaaaaaaaaa

SEQ ID NO: 6386 - DNA, 1815 bp, Tropaeolum majus
gacaacttagtttttattgttttagagagagaaagtaaaccaaaaaaaaaagaagagaaaaattccatttgctagattttccgcgttgcctctctgtctttctcctttttcttctctttctcttcgaatcaaaaccagaccattatcatcatcaaacaacaacaacaatcctcttctcccattcaaaagtacaaatcttgtttatctctctctctccttctctcccgctttgatcccatttcttcaatcgatcatattcacaaaacaattcaatctaattctttgagagaagaaagaaagagagagatagaaagttaaagtatttttgatagacgagagaaagagaaagagaggaaattcaggcttgcgctagacaccctctggttactgtgtaaagctgaataaaatacgattttaaatctggataagagaacgaagatgcgcaagtggctctgttgtacttgtcacgttgaagagtcatacccacccattgagaatgagcacctgaaaagccctagacgccaagcagaagatggacgtccacgagactcaaaagtggtggcacctgtaaaatctgaggtgcagaaggctcctccacctattgaagtgcctccattgtctttagatgaactgaaacagtacactgacaattttgggtcaaaggcattgattggtgaaggatcatatggaagagtgtattatgcaaactttaacaatgaaaaagctatggccgtcaagaagcttgatgtgtccgctgaaccagagtctaaccacgagtttttgacacaggtttccattgtttcaaaaatgaagcatgcaaatcttgttgagctgcttggatattgtgttgaaggaaacctccgtgtgctagcatacgagtttgcaacaatgggatccctacatgacattttacacggtagaaaaggagttcaaggagcacaaccaggtccgacacttgattggatgcagcgagtaagaattgcagtcgatgctgcaagggggttggaatatctgcatgagaaggttcaacctcccataatacacagggatgtgagatcgagcaatgttcttctatttgaagacttcaaagccaagattgcagattttaacctctcaaatcaggctcctgatatggctgctcgccttcattcaactagagtgttggggaccttcgggtatcatgctccagagtatgcaatgactggacagttgacgcaaaagagtgatgtgtatagctttggggttgtccttctagagcttcttactgggaggaaacctgttgaccacaccatgcctcgtggtcagcagagtctggttacgtgggctactccaaggctgagcgaagacaaagtgaaacaatgtgttgatccaaagctgaagggagaatatcctcccaaaggagttgctaagctggcagctgtagctgctttgtgtgtacagtatgaagccgagtttcgaccaaatatgagcatcgttgtgaaggcactgcagccgcttttgaagtcaccagccccagcagtagcgccagaatcttaaaagcaaagaaacaccgagttattactttataaagttgattgtttgttctttgcaacatttgcacagtttggtttatattggctgtggatttcaataggttttcttttttttcccaagtaaatcgtatgtgcagtgatgatgatattaaatgttgaaaaatataagtggaggggaggagagatggcttgatgctctcatgggtggatatatttgtaatccttttttttttatactcttttgaacgaccttctcatttctatactactacactgatttttt

SEQ ID NO: 6387 - DNA, 883 bp, Cajanus cajan
tgagaaagttcaaccagcgattatacacagagatatcagatcaagtaatgtgctgatctttgaagattacaaggctaagatagctgactttaacctttctaatcaggcccctgacatggctgcacgtcttcattcaactcgtgtattggggacttttggttatcatgctccagaatatgcaatgactgggcagttgactcaaaaaagtgatgtctatagttttggtgttgttcttcttgagcttcttacaggaagaaaacctgttgaccataccatgcctcgaggacagcagagtcttgtcacatgggctacaccaagattaagtgaagataaagtgaaacagtgtgtagacccaaaacttaagggagaatacccccctaaaggagttgctaagcttgcagctgttgcagcactgtgcgtgcagtatgaagctgagtttaggccaaatatgagcattgttgttaaagcactccaaccacttctgaagtctcctgctgctcctgcaccggaaagttgaagcaaataaattgaagttttaaactttggtttctgcatcttctgcacagttcgattcaattacctctggatttcatcaaatactgcagatatatctatctatatatttatttttgtttgagatttgatgtgtaggattggattggctcgtttctcgtcattgttaaattccattgtatttacagcattgcacttgttgtgctgagtctgctggcgtctatagagccataatgcaacaataggtttgggttgcgtggtgaatatttgtgcgggtaaatgttgtttgtcccttaacgttaatgcccccatattctttatttgtttcttgctatcaaactgagctgatactttggaaagacctatattt

SEQ ID NO: 6388 - DNA, 1255 bp, Cucurbita pepo
gtttttgactcaggtttctacagtatcaagatttgaaacatgaaaatctcgtggaattgcttggatattgtgtcgaaggaaatcttcgtgtattggcatatgaatatgcaaccatgggatctttgcatgatgtgttacatggaaggaagggagtacaaggagcacaacctggtccagtgctcgactggttgcagcgagtgagaattgcagttgatgcggccaaagggctagaatatttgcatgagaaggtccaaccggctattatacaccgggatatcaggtccagcaatgtgcttcttttcgaggattttaaagctaaggtagctgattttaacctctccaatcaagcccctgatatggcagcccgtcttcattcaactcgagttttgggaacttttggataccatgctcctgaatatgcaatgactggacagctaacacaaaagagcgatgtatacagctttggcgtagttctacttgagcttttgactggtaggaaacctgttgatcacacgatgccccgcggacaacaaagtttagtcacctgggctactccgaggctaagcgaggacaaagtgaagcaatgtgtagatccaagactgaagggagaataccctcctaaaggagttgcaaagttagcagctgtagctgcattgtgtgtgcagtatgaatccgaatttcgaccaaatatgagcatcgtcgtgaaagccctccagccacttttgaaaccccccgcacctaccggtccacctgccccagagtcttgatggaaatgcacatggttggtttcgtctcgaagtttgaattcttgcgaatgcttcaaatagtttctctcttatatgcagtgaaatttgactggataacttcatgcataccccttttatttcattgtgtaaatggcgagttcggatgtggagaattgtggtaccgggtttcgagcctcgggaggtcttaagaagagtgatgattgctggatgtgtgaagtatctgtttctgaataataatggaattccctccatttacactttcttctgtcttctcaaaactgcagagtgcagattcacacgaggcttataaggtcttttctttctcttgttatattttgttcttcaactctgatctaaacagaaacttgctttatggatttagctttatatcgaaatgaacttgagtcctatggggattgaattgaatgtgtatgtaaggaaaattttgtgtgtagttacaatttctaaaatgtgtatgagtatgtata

SEQ ID NO: 6389 - DNA, 1624 bp, Cannabis sativa
tcttgcaatatatttcataccatattgttgattgtgtttcctatctgtcgttagtgcatttgtcttaatggccgtacctgctgaactcattgagagcttctgttctgtgtatttgtagactattgtagggttcttttgtaatagaaacttctaactataagtcatattgaagtttttcatttctaaaaaactgagaaaaaaaaccttgaaagattctatgcatgtattccacacatattatacatctatatgtaagttaaacttctgaccagtctatcattgtttgtaatttgtttttcctctttactattttcttgtttgtttatcaatgtatgataactgggtcttttattttactgatggtaagggaaccaaaagggttcaagagtagcagctcctgtcaaacctgaagtacaaaaggcagcaccaccacctattgaggtggctgctttgtctctggaagaactcaaagagaagactgataattttggatccaaggcattgattggtgaaggatcctatggaagagtgtattatgcaagcctgaacaatgggaaagctgtggctgtaaagaaacttgatgtttcttctgaacctgagacaaatgttgaatttttgacccaggtttccatggtttctagattgaagcaggaaaatcttgttgagttgcttggttattgtgttgaaggaaatcttcgtgtacttgcatatgaatttgccaccatgggatctttacatgacatattgcatggtagaaagggagttcaaggtgcacaaccaggtccaacacttgattggatgcagcgagtgaggattgctgttgatgcagctagaggattggaatacttgcatgagaaggttcaaccttctataatacatagggatatcagatctagcaatgtgcttctctttgaagacttcaaagccaaggttgcagatttcaacctttcaaatcaggcccctgacatggctgctcgtcttcattctactcgagttttgggaaccttcggttatcatgcaccagagtacgcaatgacaggacaattgacacagaaaagtgatgtgtacagctttggagtggttcttcttgagcttttaactgggaggaagcctgttgatcataccatgcctcgtggacagcagagtcttgttacttgggctactccaaggttgagtgaagacaaagtcaaacaatgtgtagatccaaagctgaagggagaatatcctcccaaaggggttgcaaagttggcagctgtggcagcattgtgtgttcagtatgaagccgagttccggccaaatatgagcattgttgtgaaggcacttcaaccgctcctgaagccaccggccccagctccagatgcttcataaacagagcaggggtatagctagtaggaagaggagctaatgcattggagcaaaaaatacttaactactccagctacaacacaggggcaatggtcaatatttttttaaaaaattaaagtaaatattgaagataaatatagtgtgtggaatcatagtagtaacttttatagttgttaagtattggagtaatttttagtagtaagtggccaaaaataatgtggatgagggagaaaataaaatattatattttggaatgatg

SEQ ID NO: 6390 - DNA, 899 bp, Brassica napus
gtcaggtttccatggtttcaagactgaagcatgagaatttcattcagctggtcggctattgtgtcgatgagaacctccgtgttcttgcttatgagtttgcaacaatgggatcactgcacgacgttctacatggtaggaagggagtacaaggtgcacagccaggtccaacgcttgactggataacgagggtgaagatcgccgttgaggcagctaggggtttagaataccttcacgagaaggttcagcctcctgtcattcatagagacgtgagatctagcaatgtgcttctttttgtaagactatcaagcaaaagttgctgatttcaatctctcaaatcaagctcctgacaatgctgcacgtcttcattctacaagagtcttgggcacctttggctatcacgctccagaatatgcaatgactggacagttgacacagaagagtgatgtgtatagcttgggggtggtactactagagctttggacagggaggaaaccggtggatcatacaatgccacgtggccaacaaagtcttgtaacctgggcgtacaccgagactcagtgaagacaaagtgaagcagtgtgttgatccaaagctaaaaggagaatatcctcctaaatcagtagctaagctagcagcggtggcagcattgtgtgtgcaatatgaatcagagtttagaccgaatatgagtatagttgtgaaagctttgcagccacttctcaaaactccagcgccagtcccagtaacggaaccctgagtttgtgcaagagagttggattccttgttcatacaaagttagaatctttttctgatttggggaagaaaactaaaacacaaaaagtaaaagatcatatatttatttgagggggatggaaatttttagtttgcattttggtgtgaag

SEQ ID NO: 6391 - DNA, 1767 bp, Euonymus alatus
cctctctgtctttggtttttctcgcctttacaattccatccagaaaggcaaacgcagcgaaggaagctcgagaaaagaaaaacacctaattgtctcttcaacaaacataccaggtccctaataaagagagacaagaagagcaggcacgtgcaccagcgcctcgtgtttttgtacgtcttgagaaaccaagtgcccgagacgatttatatgtaaggaagagagccaggatgcgtaagtggctgtgctgtacaagtcaagtagaagaatcttacccgaaaaatgaaaatcaacacctgaggagccgaaataatcatacagacgggtatccgaaaggctcaaaggtgccagctcctgtcaaacctgaagtgcaaaaggcagtacctctcattgaagtgcctgcattgtctttggaggagctgaaagagaagactgagaattttggatcaaaggctttgattggtgaaggatcatatgggagggtgtattatgcaaacctaaacaatggaaaagctgtagctgtaaaaaagcttgatgtttcatctgagccagaatcaaatgttgagttcttgagtcaggtctctatggtctcgagattgaagcatgacaatcttgtggagttgcttggttactgtgttgaggggaatctccgaatgcttgcatatgagtttgcaagaatgggatctctacatgacatattgcatggtagaaagggagttcaaggggcacaaccaggtccaacacttgattggatacagcgtgtaagaatcgcagttgatgcagcaagaggtttggaatacttgcatgagaaggttcagccacttgttatacacagggacattagatcaagcaatgtgctcgtctttgaagactttaaagccaagattgcagatttcaacctttcaaatcaggctcctgatatggcttctcgtcttcattctactcgagttttgggaacctttggttatcacgctccagagtatgcaatgacggggcagctgactcagaagagtgatgtgtacagcttcggggtggttctgctggaacttctaactgggagaaaacctgttgatcataccatgcctcgtgggcaacagagtcttgttacatgggctaccccaagactgagtgaagacaaagttaagcagtgtgtagatccaaagctaaagggagaatatcctcctaaaggagttgccaagttggcagcggtggcagcgctatgcgtgcagtatgaagccgaattccgtccaaatatgagcattgttgtcaaggctctgcaaccgcttctgaagcctccggcactggcaccgcctccggctccctgagacttggttactgacttactgaattgtgttgggatctcaggaaattgtacacagtttgatacgtctggccagcaatttcgtcagttatattttaacaaatcttttggtatatgagatgggatgtttaggattggtttggggtgtttaatgttggtgttgctggggttatatttgtcaaatggattaatgttttctttaacgttggcctttccactgatcaagtggacattctacaataaattattgtctctctgccctgcccccctcacacagataaatgccattttccgagtgctgttttatttattaaattctatttgttaattattattttaaatttgtaatttctttcgtacattaatttagaattcattttattcttgatttcgtatttttgtaatttatttctttaaacatattatcgcgtagtgtgacagatactctc

SEQ ID NO: 6392 - DNA, 850 bp, Euonymus alatus
ggatgcagcgtgtaagaatcgcagttgatgcagcaaaagggttggaatacttgcatgagaaggttcagccatcggttatacacagggacattagatctagcaatgttcttctctttgaagactttaaagccaagattgcagatttcaacctctcaaatcaggctcctgatatggctgctcgtcttcattctactcgagttttgggaaccttcggttatcatgcacctgagtatgcaatgaccggacagctgacccagaagagtgatgtgtacagcttcggggtggttctgctggaacttctgactgggagaaaacctgttgaccataccatgcctcgtgggcaacagagtcttgttacctgggctactccaagactgagtgaagacaaagttaagcagtgtgtagatccaaagctaaagggagaatatcctcctagaggagttgccaagttggcagcggtggcagcactatgcgtgcagtatgaagctgagttccgtccaaatatgagcattgttgtcaaggctctgcagccgcttctgaagtctccggctccagctccagcacccgagacttagtggctatattcagttactgaattgtgttgggaactcaggaaattaatttcatcatttctttctatatatatttttaaatcttttcatatgtgagatcggatatgtaggattggattgggctgtttaatgttgccattgcctgtgttgtcccgcgatgtagtgatatactgatgtcttgagggattgggtttgttgcgaggtggttatatttctcaattgatctaacgttttcttaatgttcccctttctattaatgtcaagtgaaccttgtgaat

SEQ ID NO: 6393 - DNA, 1551 bp, Flaveria ramosissima
ttcaagctatctctctctttccatttttctttgctatttctctgtgttctccaatgtccaatgttctggaaaccatcaagaacacaaaaccctaaatcaagaaaccaaacgattcagttcaaggggtggggatcagcaggaagaacaataagattatgaggtggttttgttgtacttgtcaagtcgaagagcctaacccatcaaatgacaatgaacctgtgaagaatccctcagattacttggatgtgcaccaaaagggtccaaaaggacctcctatcaagtctgaagtgcaaaaagcagtgccaccaattgaagtgccagcactttcattggacgaactgaaagaaaaaactgatgattttggttcaacggcactaattggtgaaggttcatatggaagagtctattttgcaaccttggaaaatggaaaaaccgtggctgtgaaaaaacttgatgtttctactgaggttgaatcgaatgacgagttcttgactcaggtctccatgttctcgaatctgaagcacgaaaatcttattgagttgctcggttactgtgttgaaggagacgttcgtgttctagcttatgaatttgcaaccatgggatctttacatgacattctgcatggtaggaaaggtgtgcaaggagcacaaccggggcccgtgcttgactggacacaacgggtaaagattgctgttgatgcagcaaggggattggaatatttgcatgagaaggttcaaccatctataatacatagagatataaggtctagcaatgtgctactgtttgaagacttaaaagccaagattgcggattttaatctttcaaatcagtcaccagacatggctgctcgtttgcattctactcgtgttcttggcacctttggctatcatgcaccagaatatgcaatgacgggacagttaacacagaagagtgacgtttatagctttggtgttgttcttcttgagcttttaaccggcaggaagcctgttgatcacacaatgccacgtggacaacagagtcttgtcacttgggctactccaagactaagtgaagacaaggttaaacaatgtgtagatccaaagctcaagggagagtatcctcctaaagcagttgcaaagttagcagctgtggcggcattatgtgtgcagtatgagtctgagtttaggcctaacatgagtattgtggtgaaggccctccaaccactcctgaaggcttctgcaccaccaccaccaccggaagaggagtaggctgcaataaacaagtattggatatgtgatcggtcatcaacataacttaaaattctgtagttacaccagaaaacaagcatggtcgtgttcatatgtagattctgcctccagccacctctttacaaacactcacgctgcgcgatgcacacaaatatatattgttttatccatttgattcttgcatttgagaaatacttatgcaaatatctgttctgtttgttctgtttttaaaaaaagatgaggatagagtggaactgattttgtggtgatatgttgtttgaggttttttgcttgttctagtttc

SEQ ID NO: 6394 - DNA, 989 bp, Sarracenia psittacina
aatgttgagtttctaactcaggtttccatggtttcaagactgaaacatgagaatgttattgagttgcttggttactgtgtagaaggaaatatccgtgtgttagcatataagtatgcaaccatgggatctctgcatgacattttgcatggtagaaaaggagtagaaggagcgcagccaggccctgttctgaactggatgcagcgggtgaggattgctgttgatactgcaaggggattggagtatttgcatgagaaggttcagccttctataatacacagagacatccgatctagcaatgtgcttctttttgaaaactatgcggccaaaattgcagattttaacctttcaaatcaggctcctgacatggctgctcgccttcattctactcgtgttttaggaacgtttggttatcatgcaccagaatatgcaatgactggacaattgacacagaagagtgatgtatatagtttcggggtggttctgctcgagcttttgactggccgtaaacctgttgatcatactatgcctcgcggacaacagtctctcgttacatgggccactccaaggctaggcgaagacaaagtcaagcaatgtgtagatccaaaagctcaagggagagtatcctcccaaaggagtcgctaagttggcagctgtggccgcactgtgcgtgcagtacgaggctgagttccggccaaatatgagcattgtagtcaaggctctccaaccccttctgaagcctacggcgccagctcctcctgaggcttgaatcgtatgaacgaatgttcaagtgttctagtgcactgtttggttttgatttgttcgcaaatttccttgcgttattgactctgttattgactctgtatgtgcgtatatatatagatacatatatatattttttctcatatttgtttttttttccctccagattggatacttaggcttttgtgtagctgcattgttaaatttgttactgatattgctctgtgatg

SEQ ID NO: 6395 - DNA, 1726 bp, Trigonella foenum-graecum
tttttgggctttgtttgggtgttctgcatttcaccgaatccgatttggcttattttggattcgtgtttaatttcttctttttctcttccatctcttttgatggaccaccgttcagactttcaccatcgtcattctcatttggcacaggctactcctcctgagtactttgttcagctggggaactcggcttacaaagacgatttatatttgaggaagagaacaaggatgcgtcgttggttatgctgcacttgtcaggtggaagagtcttatccatcacatgaaaatgaacacctgaaaagcccaaggagtttcggagatggcaacccaaaaggctcaagggtggcagctcccatcaaacctgaaacacaaaaggcaccaccacctatcgaagttccagcattatccttggatgagctgaaggaaaaaactgacaactttggatcaaaggcattgattggtgaagggtcgtatgggagggtgtattatgcaacattaaacaatggaaaggctgtggctgtgaaaaagcttgatgtttcttctgaacccgaatcaaataatgagtttctgactcaggtttccatggtctcaagattgaagaatgaaaattttgttgagttgcatggatactgtgttgaaggaaatcttcgtgtacttgcatatgagtttgctactatgggttctcttcatgacattttgcatggtagaaagggagttcaaggggcacaaccagggccaactcttaactggatgcagcgagttagaattgcggttgatgcagcaaggggattagaatttttgcatgagaaagttcaaccatcaattatacacagggatatcaggtcaagcaatgtgctcatctttgaagattacagagctaagatagctgattttaacctctctaatcaggcccctgacatggctgcacgccttcattctactcgtgtattgggaacctttggatatcatgctccagaatatgccatgactgggcagttgactcaaaaaagcgatgtctatagttttggcgttgttcttcttgagctccttactggtaggaaacccgttgatcataccatgcctcgaggacaacaaagtcttgtcacatgggctaccccaagattaagtgaagataaagtgaaacaatgcgtggacccaaaactgaaaggagaatatcccccaaaaggagttgctaagcttgcagctgtagcagcgctgtgtgtgcagtatgaagctgagtttaggcccaatatgagcattgttgttaaagcactccaaccacttctgaaggctcccgctcctgcaccagaaacttgaagcagatggattgaagtttaaaagcttttctttagtttctgcatcttctgcacagtttgagtcggatattatcaaatactgcaaataatattatataacatatatttttatttttgtttgagattggatctgtaggattggattgtctggtttcatgtcattgttaaattcctgtacttctggtattgcacttcagtgcagacgattatagagccatactgcaacaatgggtctgggttgcgtggtggatatgagtttgatatatgttgtttgtcactcaacgctaatcaatccccccatattctttgtttcttgactgagctgatgatacttggattgaaagacctatatttgttggacctctttgtttgtctgttcttttctattattcgttactgggttatttagtatg

SEQ ID NO: 6396 - DNA, 1772 bp, Citrullus lanatus
gccattgccatttgccccgcgtttgcttctctgtcatccgttcattgcgtttgctccgaataactaccgaaaagccaaaaccgaagaagacccaacaaagccaaagccaaacccaccccgcaaattccaccctgtcttttcctttattcttccatttctcttcccgaagcccaggagaggcattaaccagaaggcgcatgcccctcctcctggttacttcgtacgtttgaggaatacaggatctaaagacgatctatatctaagtaaaagggatagaatgcgcaggtggctttgttgtacttgtcaagttgaagaggcctacccatcagcagaaagtgagcacctgaaaagcccacgaagttatggagatggtcaccatcaaaggagctcaaaagaggcaactcctgtcaaatctgaaccaccaaaaactccacctcccatagaagtgccagcgttgtctctggaagaactgaaagaaaagactgacaactttgggtccaaggcactgattggtgaaggatcttatggtcgagtttattatgctagtttaaatgatgggaaagctgtggcagtaaagaagctggatgtttcctctgagcctgactcgagtgttgactttttgactcaggtttctacagtctcaaggttgaaacatgaaaattttgttgagttgcatggatattgtgttgaaggaaatttccgtgtacttgcatatgaatttgcaactatgggttctctacatgacatattacatggtagaaagggagtgcaaggggcacagcctggtccggtgcttgattggatgcagcgtgtgagaattgctgttgatgcagctcgagggttggaatacttgcatgagaaggttcaaccttctatcatacatagagatgttagatccagcaatgtgcttctctttgaagacttcaaagcaaagatagcagactttaacctttcaaaccaggctcctgacatggctgctcgacttcattctactcgagtcttaggaacatttggctatcatgctcctgagtatgcaatgactggacaattgacacaaaagagtgatgtctatagcttcggagttgttctacttgagcttttgaccgggcggaaacctgttgatcacaccatgcctcgtgggcagcagagtcttgttacttgggctactccaagactaagtgaagacaaagtcaaacaatgtgttgatccaaggctgaagggcgaatatccccccaaaggagttgccaagctggctgctgtggcagctctgtgtgtgcagtatgaagccgagttcaggccaaacatgagcatcgtcgtcaaggctctccagccgcttctaaagccacctgcccctgctccggctgccgaaccttgaagtaaattgatctcagtttttcttcctcactgttgttgatatatgtcagcgcctacattgcaaagtttgctttcatggtgaccatatagaattcataatattcattatttattccaattattattgctgttttttcttgaagatcctcgggtcatgtttggttggattgaaagtaggttgcttttcttgtaagcaattcttcttgtgtagcctgttggttggtatagccctcggttgttaaaaaatgtctttcccctttcgattttggagtcatgaagtgagactcagtgggagtgctgcacggtgtggtggaaaacacatatggactattgtttgctttccctcactcttttgatattaatggatatgggttggttttttcagttggcatgaaaaa

SEQ ID NO: 6397 - DNA, 1903 bp, Theobroma cacao
gttcttgacttttattggagctttgaccctttttcagcttgtttcctgtcctggcatcaggcaaatttggttgcaacctttttctgcatagatatttgtttcgattatcatagtttaattttacaatgcgattgttggattatgaataaatgtcttctgcaattgtgcaggcacatgcacctcgtcctagctactttgttcgactagaaaatactgacgatttgtatttgaagaaaagaacaaggatgcgtcggtggctttgctgttcctgtcaggtagaggagaattaccaatcacatgaaaatgagctcttgaagagccccaagcatcatacagatgggcatcaaaaaaactcaaaggtggcagctcccgccaaacttgaagtgcaaaaatcagcaccacctattgaggtccctgcattatcattggaagaattgaaagaaaagactgataattttggatcaaaggctttgattggtgagggttcctatggaagagtttattatgcaaacttgaacaatggaaaagctgtggctgtgaaaaagcttgatgtttcctctgagcctgaatcaaatgtggaatttttgacccaggtttcgatggtttcaagattgaagcatgacaatcttgtcgaattgcaaggttactgtgttgaaggaaatctccgcgtgcttgcgtatgagtttgcgacgatgggatcactacatgacatattgcatggaaggaagggagttcagggggcgcaaccaggtccagtgcttgactggatgcagcgggtaagaattgcagttgatgctgcaaggggcttggaatacttgcatgagaaggttcaaccctctgttattcacagagatattagatctagcaatgtgcttctcttcgaagacttcaaagcaaagattgcagattttaatctctcaaaccaggctcctgacatggctgctcgccttcattctactcgagttttggggacctttggctatcatgctccagagtatgcaatgactggacagttgacccagaagagtgatgtgtatagttttggggttgtccttcttgagcttctgactgggaggaaacctgttgaccacacaatgcctcgtggacagcagagtcttgttacttgggctactccaagactgagtgaagacaaagttaaacaatgtgtagatccaaaactgaagggagaatatcctcccaaaggagttgctaagctggcagctgtggcagcattgtgtgtgcagtatgaagctgagttccgtccaaacatgagcattgttgttaaggccctccaaccactgttgaaggctccagctccagctccagctccagcaccagagacttaaaagcagatgactccagtttcttcaccttttatcgaaatttctgcagcctatacacagtttggtttcatttgactggcagatttcagcagatcactaaatattatatttcttctttccaatttttcatatatgacatggatgtcaaggattgggttggactgttaaaatgtcactgatatgatctgtctttcgctggtttggacgcgggtgttgatgctttgtttgagttgtagtcataaatttgatcaagggattgggttgtgtggtggatataagtgttaccgagtattgtttgcttcctattgctttttgtgctgcgcaaatgattttatttgtacgtatattttctactgggcacaatgaattaaaccaagtgcaagtatgcgatttgttgttggttagcttatgcttcatcgtccccaggcctactgcctaaccttctgcaaaaagtttgatttcgaattcttatcatttggcaacgactacacattcattcccatatcagctttgcttgtaatctgttctgttatacactaacataaaaattatgagattaa

SEQ ID NO: 6398 - DNA, 840 bp, Manihot esculenta
aacttagataatgggaaagctgtggcagtaaaaaaacttgatgttgcatctgagcaagagtcaaatattgaatttttgactcaggtttccatggtgtccaaattgaagaatgagaatgtggttgagttgcttggttactgtgttgaaggaaatcttcgggtgcttgcctatgagtttgcaacaatgggatctctacatgacatattgcatggtagaaagggagttcaaggggcacaaccgggtcctactcttgattggatgcagcgtgtgagaattgcagttgatgcggcaaggggattggaatatttgcatgagaaggtacaaccggctataatacacagagatatcagatcaagcaatgtgcttctatttgaggacttcaaagccaagattgcagattttaatctttcaaatcaggctcctgacatggctgctcgccttcattctactcgtgttttgggaacctttggttatcatgctccagaatatgcgatgactggacaattgacacagaagagtgatgtttatagttttggggtggttctcctggaacttttaactgggaggaaacctgttgatcacacaatgccgcgtggacagcagtcccttgtcacttgggcaactccaagactgagtgaggacaaagttaagcaatgtgtggatccaaagttgaagggagagtatcctcctaaaggagtggccaagctggcagctgtggctgcattatgcgtgcaatatgaagctgagttcaggccaaatatgagcatcgttgtgaaggcactccaaccgcttttgaaggctccagctccggctccagctcctcctcctcctgagagctaa

SEQ ID NO: 6399 - DNA, 1715 bp, Ricinus communis
aaactgggtctttccctttcattcatttcattttcactttcttttggttttttttttttcctgattctctctttctttagttgtattttggaatttagggtttgaattctctattttcttgatttgtttgtgatcttgaatttcttattcctggaatttaatgggagatgattatcatcagcataaatttggggcacatgcgccttctcctggttactttgtactggagaaaccaaaatctgtagacgatttatctttaaggaagagagacaagatgcggaggtggctctgttgcacctgtcaggtagaggagtcatatccctctcgtgagaatgatcacctaaggagcccaaaacactatgcagatggcaaccctgtgaaaggctcgaaggtgtcagctccggtcagatctgaagtgcagaaggaagcaccacctattgaagtacctgcattatctttggaagaactgaaagagaagactgacaattttggttcaaaggcattgattggtgaaggatcatatggaagagtttattatgccaacttagacaacgggaaagctgtggcagtaaaaaaacttgatgttgcatctgagcaagagtcaaatgttgaatttttgactcaggtttccatggtgtccagattgaagcatgataatgttgtggagttgctcggttactgtgttgaaggaaatctccgagtgcttgcatatgaatttgcgactatgggatcactccatgatatattgcatggtagaaagggagttcaaggagcacaaccaggtcccacacttgattggatgcagcgtgtaaaaattgcggttgatgcagcaagggggttggaatacttgcatgagaaggtgcaacctgctataatacacagagatatcagatcaagcaatgtgcttctatttgaagacttcaaagccaagattgcagattttaacctttcaaatcaggctcctgacatggctgctcgtcttcattctactcgtgttttgggaacctttggttatcatgctccagagtatgcaatgactggacaattaacacagaagagtgatgtttatagttttggggttgttcttctagaacttctaactgggaggaaacctgttgatcataccatgccacgtgggcagcagagtcttgtcacttgggctactccgagactgagcgaggacaaagtcaaacaatgcgtggatccaaagttgaagggagagtatccccctaaagcagtggccaagcttgcagccgtggctgcattatgcgtgcaatatgaggctgaattccgaccgaatatgagcattgttgttaaggcactccaaccccttttgaaggctccagctccagctccagctcctcctcttccagagacctagaagcaaagaaacagtttctctagttgggaagaattacaacttgtgcacagtttgattactttgcttgcggatttgttcggttaacactatattttttgattgttagtaaatgggattggatgtgtaggttggaatttggcttatttaacatcactgattatctccatgtctgttggttgctgctggtaggctgctgatgcttcttttttttttttttgagtcataaaaagatcaatgttggggaatggattatgcggcagaatatgttattattgtttgatttcaatggatataccctttgtgctcaatggaaatggtgttataatatttataa

SEQ ID NO: 6400 - DNA, 1756 bp, Ricinus communis
aaactgggtctttccctttcattcatttcattttcactttcttttggttttttttttttcctgattctctctttctttagttgtattttggaatttagggtttgaattctctattttcttgatttgtttgtgatcttgaatttcttattcctggaatttaatgggagatgattatcatcagcataaatttggggcacatgcgccttctcctggttactttgtactggagaaaccaaaatctgtagacgatttatctttaaggaagagagacaagatgcggaggtggctctgttgcacctgtcaggtagaggagtcatatccctctcgtgagaatgatcacctaaggagcccaaaacactatgcagatggcaaccctgtgaaaggctcgaaggtgtcagctccggtcagatctgaagtgcagaaggaagcaccacctattgaagtacctgcattatctttggaagaactgaaagagaagactgacaattttggttcaaaggcattgattggtgaaggatcatatggaagagtttattatgccaacttagacaacgggaaagctgtggcagtaaaaaaacttgatgttgcatctgagcaagagtcaaatgttgaatttttgactcaggtttccatggtgtccagattgaagcatgataatgttgtggagttgctcggttactgtgttgaaggaaatctccgagtgcttgcatatgaatttgcgactatgggatcactccatgatatattgcatggtagaaagggagttcaaggagcacaaccaggtcccacacttgattggatgcagcgtgtaaaaattgcggttgatgcagcaagggggttggaatacttgcatgagaaggtgcaacctgctataatacacagagatatcagatcaagcaatgtgcttctatttgaagacttcaaagccaagattgcagattttaacctttcaaatcaggctcctgacatggctgctcgtcttcattctactcgtgttttgggaacctttggttatcatgctccagagtatgcaatgactggacaattaacacagaagagtgatgtttatagttttggggttgttcttctagaacttctaactgggaggaaacctgttgatcataccatgccacgtgggcagcagagtcttgtcacttgggctactccgagactgagcgaggacaaagtcaaacaatgcgtggatccaaagttgaagggagagtatccccctaaagcagtggccaagcttgcagccgtggctgcattatgcgtgcaatatgaggctgaattccgaccgaatatgagcattgttgttaaggcactccaaccccttttgaaggctccagctccagctccagctcctcctcttccagagacctagaagcaaagaaacagtttctctagttgggaagaattacaacttgtgcacagtttgattactttgcttgcggatttgttcggttaacactatattttttgattgttagtaaatgggattggatgtgtaggttggaatttggcttatttaacatcactgattatctccatgtctgttggttgctgctggtaggctgctgatgcttcttttttttttttttgagtcataaaaagatcaatgttggggaatggattatgcggcagaatatgttattattgtttgatttcaatggatataccctttgtgctcaatggaaatggtgttataatatttataaataatgttgggtctcacattatatgtgctccaaaattaggt

SEQ ID NO: 6401 - DNA, 1455 bp, Castanea mollissima
taagtaacgtaactaaaaacgaacaaataactaataagactggagagacaagacagagagagagagagagagagacagagaaacaaaaggcacatgcacctcctcctggttactttgttcgtctggataccactagtgctcaagacagtctagatctgaggaagagagtcagaatgcgtaggtggctctgttgtacttgtcaagcagaggaggcttaccaatcaaccgaaaatgagcgtttgaagagccccaaaaattatgcagatgggcacctaaaagcctctagggtggcagctcctgtcaaacctgaagtgcaaaagccagcaccaccaattgaagtgcctgcattgtctctggatgaactgaaagaaaagactgataattttggatcaaaggccttgattggtgaaggctcatatggaagagtatattttgcaaacttgagtaatggaaaagctgtggcagtgaaaaagcttgatgtttcatctgagcccgacacagattctgattttttgacacaggtttccgtggtttcaagattgaagcacgataatcttgttgagctccttggttactgtgtggagggaaatcttcgtgtgcttgcatatgagtttgcaaccatgggatctttacatgacatattgcatggtaggaagggagttcaaggggcacaacctggtccgacacttgactggatgcagcgggttagaattgcagttgatgcagcaaggggattggaatatttacacgagaaggttcaaccctccataatacacagggatatcagatctagcaatgtgcttctctttgaagacttcaaagccaaggttgcagattttaacctttcaaatcaggctccagacaatgctgctcgcctccattctactcgagttttgggaacctttggttatcatgctccagagtatgcaatgactggacagttgactcagaagagtgatgtgtacagctttggggttgttcttcttgagcttctgactgggaggaaacctgttgatcataccatgcctcgtggacaacagagtcttgtgacttgggctactccaaggttgagtgaagacaaagttaaacagtgtgtggatcccaaactgaagggagaatatcctcctaaaggagttgctaagttggcagctgtggcagcattgtgcgtgcagtatgaagctgagttccggccaaatatgagcattgttgtcaaggctctccagccacttctgaagccgattgccccagctccagaaacttgaacaaatcgattcagttttttcccttgtgttggaattttctgcctgtgcacagtttggtttcatatgttttctgatttcatcaaattctatatttatcttcttcttttttttctttttataatttctcgtatatgagatcggatgtgtaggattggacttgccccttcatgccattactaactgctgtctgttg

SEQ ID NO: 6402 - DNA, 1494 bp, Cucumis sativus
ttgccatttgccccgcgttttgctactctgtcatccgttcattgcgtttctccgaataactaccgaaaacccaaaaccgaagaacacccaacaaagccaaaagccaaacccattccgcaaattccaccctgtctttccccctttattcttccatttctcttcccggagcccaggagaggcattaacctgaaggcgcatgcccctcctcctggttacttcgttcgtttgaagaatacaggttctaaagacgatctatatctaagtaaaaaggatagaatgcgcaggtggctttgttgtacttgtcaaattgaagaggcctacccatcagcggaaagtgagcacctgaaaagcccacgaagttatggagatggtcacgttcaaagaaaagaggcagctactttcaaatctgaagcaccaaaaactcctcctcccatagaagtgccagcgttgtctctggaagaactgaaagaaaagactgacaactttgggtctaaggcactgattggtgaagggtcttatggtcgagtttattatgctagtttaaatgatgggaaagctgtggctgtgaagaagctggatgtttcttccgagcccgactccagtgttgactttttgacgcaggtttctactgtctcaaggttgaaacatgaaaattttgttgagttgcacggatattgtgttgaaggaaatctccgtgtacttgcatatgaatttgcaactatgggttctctacatgacatattgcatggtagaaagggagtgcaaggagcacagcctggtcctgttctcgattggatgcagagagtgagaattgctgttgatgcagctcgaggattggaatacttgcatgagaaggttcagccttctatcatacatagagatgttagatccagcaatgtgcttctcttcgaagatttcaaagcaaagattgcagactttaacctttcaaaccaggctcctgacatggctgctcggcttcactctactcgtgttttaggaacttttggctatcatgctccagagtatgcaatgacgggacaattgacacagaagagtgatgtctatagctttggagtcgttctacttgaacttttgaccgggaggaagccggttgatcataccatgcctcgcggtcagcagagtcttgttacttgggctaccccaagactaagtgaagacaaagtcaaacaatgtgttgatccaaggctgaagggtgaatatccccccaaaggagttgccaagctggccgctgtggcagctctgtgtgtgcagtacgaagccgagttcaggccaaacatgagcatcgttgtcaaggctctccagccacttctaaagccacctgcccctgctccggccgtggaaccttgaagtaaattgatctcagttttcttcctcactgttgatatatgtgtcagcgcctacattgcaatgtttgctttcatggtgaccgtatagaattcataatattcattatttattccaattattattgtt

SEQ ID NO: 6403 - DNA, 1582 bp, Actinidia deliciosa
  misc_feature (1349)..(1349): n is a, c, g, or t
  misc_feature (1397)..(1397): n is a, c, g, or t
  misc_feature (1444)..(1444): n is a, c, g, or t
  misc_feature (1487)..(1487): n is a, c, g, or t
  misc_feature (1491)..(1491): n is a, c, g, or t
  misc_feature (1541)..(1541): n is a, c, g, or t
gatagataaatataaaaagctctctctctctctcgttcgttgccttcctgtatgcttacctgtctcgcctttttcgttgcgcctctcgttttcgaacattttatacaatacggccttcaaaccctaaaaaagattcaagagagagaaagatcaggcacatgcacctcctcctggttactttgtacgtctgcagagaacaagtgctgaggacgatctttatttgagaaagaaggcaaggatgcgtaggtggttgtgttgcacttgtcaagtagaagagtcctacccatcaactgaccatgagcctttcaaaagcccgaggaaccatggggatgggcattataaagggtcaaaggcatcggctcctgtcaaagctgaagctcaaaagacagtcccgcctattgacgttccagcactccccttggatgagctgaaagaaaaaactgacaattttggatccaaggcattgattggtgagggatcctatggaagagtgtactatgcaaacttgaataacgggaaagctgtggccgttaaaaagatggatgtttcggctgagcctgagtcaaatgtggactttttgacccaggtttccatggtttcaaaactgaagcatgaaaatcttgttgagttgcttagttactgtgtagaaggcaacttccgtgtcttggcatatgagtttgcaaccatgggctctctgcatgacattttgcatggcagaaagggtgtccaaggagctcaaccaggccctgttctggactggattcaacgggtgagaattgctgttgatgctgcaaggggactggagtatttgcatgagaaggttcaaccttctgtaatccacagagatatcagatcgagtaatgtcctcctgtttgaagacttcaaggctaaagttgcagattttaacctttcgaatcaggctcctgacatggctgctcgccttcattctactcgcgttttaggaacgtttggttatcacgcaccagaatatgcaatgactggacaattgacacagaagagcgacgtgtatagctttggggtggttctgcttgagcttctgactggccgcaaacctgtggatcatactatgcctcgtggacaacagagtcttgttacttgggccactccaagactgagtgaagacaaggtcaaacagtgcgtagatccaaagctcaagggagagtaccctccaaaaggagttgccaagctggctgctgtagcagcgttatgtgtgcagtacgaggctgagttccgtccaaatatgagcattgttgtcaaggctctccaaccacttctgaaggctcctgcaccggctcctgagatttgaagtaaataagttcacttcctcntattggaacttccggcatattctgcacagtttggttttcacttttcgncgaattccgtacttgactatatgcatatatatttttttcattttttncccttggcattggagattggatgtgtaggcttggattggcccntgtnatgtccccggtttgttaacctgttgcttgttattgctttgcgattgctgntgtcttctgaagttatggatatatgtgctggattatctgtt

SEQ ID NO: 6404 - DNA, 2115 bp, Quercus alba
tcgggggtaaaaaggaaaaaacagagagccaccccgcgttgcctctctgtctttttcctctttacataagtttttggttttctttctctcccaaaagtcctaacactcgtaaccaaaagataaaaacaacttctctctctgctgttgttgttgttgttgctgctgttgttgttgttttctaaaaacgcaatctatagctggagagacaaagacacagagagagacagagacagagagagaaacaaaaaaaggcacatgcgcctcctcctggttactttgttcgactggataccactagtgctcaagagagtctagatttgaggaagagagtcagaatgcgtaggtggctctgttgtacttgtcaatcagaggaggcttaccaatcaaccgaaaatgagcgtttgaagagccccaaaaattatgcagatgggcacctaaaagcctctagggtggcagctcctgtcaaacctgaagtgcaaaagccagcaccaacaattgaagtgcctgcattgtctctggatgaactgaaagaaaagactgataattttggatcaaaggccttgattggtgaaggttcatatggaagagtatattttgcaaacttgagtaatggaaaagctgtggcagttaaaaagcttgatgtttcatctgagcccgacacagattctgattttttgacacaggtttccgtggtttcaagattgaagcacgaaaatcttgttgagctccttggttactgtgtggagggaaatcttcgtgtgcttgcatatgagtttgcaaccatgggatctttacatgacatattgcacggtaggaagggagttcaaggggcacaacctggtccgacacttgactggatgcagcgggttagaattgcagttgatgcagcaaggggattggaatatttacacgagaaggttcaaccctccataatacacagggatatcagatctagcaatgtgcttctctttgaagacttcaaagccaaggttgcagattttaacctttcaaatcaggctccagacaatgctgctcgcctccattctactcgagttttgggaacctttggttatcatgctccagagtatgcaatgactggacagttgactcagaagagtgatgtgtacagctttggggttgttcttcttgagcttctgactgggaggaaacctgttgatcataccatgcctcgtggacaacagagtcttgtgacttgggctactccaaggttgagtgaagacaaagttaaacagtgtgtggatccaaaactgaagggagaatatcctcctaaaggagttgctaagttggcagctgtggcagcattgtgcgtgcagtatgaagctgagttccggccaaatatgagcattgttgtcaaggctctccagccacttctgaagccgattgccccagctccagaaacttgaacaaatcgattcagttttttcccttgtgttggaattttctgcctgtgcacagtttggtttcatttgttttctgatttcatcaaattctatatttatcttttttttttctttttataatttctcgtatatgagattggatgtgtaggattggacttgttccttcgtgccattactaactgctgtctgttgctggtatgcacctgggttttgaagtctatgtagtcataaattgactatggggttgggtgtggaagatgtgtttctcactggatattattagctgcctgttcatatttgtggtataaatgggctctccttgcaagtatttgttatcctatacaggaatatggttggagtctaggctcgattccagttgaactattcatattaacagtctttgcttatttctcacttctatatcttgactacaagaacacattggatctgaaatgtatgtttaaaaaatgaaccagttgctagtgtcagaacgcccggtgcaaatagctaccaaaatgtgctctaaagcataattaatgtagagcagttatatatgtataaacgaatcctatattcctatgtgatggtttaagagcctcatttagcagttatatatgcttataagttactgtccctgagactttctcttgaacatgatttatgtaagcacgtgaaccgaggcaggtcttagcag

SEQ ID NO: 6405 - DNA, 1641 bp, Arachis hypogaea
ctttgcaacaatcgaaaccattacacactaaaacaagccaacaaaccctagcaacaacattatcaatcttactctcacaaccatttgcaaccatctattcggtttagttgaggcacatgcttctcctcctggttactttgtccgctttgagaattcaaattccaaagacgattcatatttgaggaagaggacagggacagggatgcgtcggtggctgtgttgcacgtgtcaggtagaagagtcttacccatcgcatgaaagcgagcacctgaaaagcccaaggaattatggagatggcaaccaaaaaggttcaaaggcgtcagctcccgtcaaatcagaaccacataaggcaccaccgcctattgaggttccggcattatctttagaggagctgaaggagaagactgagaattttggatcaaaggcattgattggtgaaggatcatatggaagagtgtattatgcaaccttaaacgatgggaaaacagtggctgtggaaaagcttgatgtttcatctgaacctgaaacaaataatgagcttttgacccaggtttctatggtttcaaggctgaagaacgataattttgttgagctgcaagggtattgtgttgaaggaaatcttcggttacttgcatacgagtatgctactatgggctctcttcatgacatattgcacggtagaaagggaggttcaaggggcacaaccagggccaactcttgattggatacagcgagttagaattgcagttgacgcagcaaggggattagaatattgcatgagaaagttcaacccgctattatacacagagatatcagatcaagcaatgtgctcatctttgaagattttaaggctaagatagctgattttaacctttcaaatcaggcccctgacatggctgcacgccttcattctactcgagtgttgggaacttttggttatcatgctccagagtatgcaatgactggccagttgactcaaaaaagtgatgtctacagttttggcgttgttcttctagaacttcttactggaagaaaacctgttgatcataccatgccccgcggacagcaaagtcttgttacatgggctaccccaagattaagtgaagataaagttaaacaatgtgttgacccaaaactgaaaggagattatccccctaaaggagttgccaagcttgcagccgttgcggccctgtgcgtgcaatatgaagccgagtttaggccaaatatgagcattgttgttaaagcactccaaccacttctcaagactcctgctcctgctgcgcctgaaagttgaaccaaacgaacacaagtttttttaactctttgaagtttgattcaattatcctcagatttcatcgaatgctgcaaatatataaatattatttatatatatatacacttttaatttttgtatgagattggatgtgtaggattggatttgcttgtttccttttcattgttaaactccgtgtatttctggcatcgcacttgttgctgctgactgctatatagagccataagcctggttacgatgggtttgggtttgtgtagtgtggctaaacttcgttgcgtaaccatagacctctcatattctttctgaaaatggcctatgtaattaaaatgtgtggctgattttaatgc

SEQ ID NO: 6406 - DNA, 1855 bp, Citrullus lanatus
tttgagaaattcagaataaaaagttgagagagaaaaggaagagagagagaaagaagagagagctgtcagctcggcgtcggcatttgcttctctgtcattcccttttttttgcttttcttcttttgcttcgctttgaatccaaatccaaagactcaaaatccccaaaaaaaccgaaaaaaaccccatcaattcccatctgtatttgcgttgtttttcgtttcttcctctaattcaccaactacaggcttatgcccctcctcttgattacgtattacatccagaaaacagaagtcctgaggataatcaatatagaaggaagaaagtgaggatgcgcaagtggctttgttgtttttttcaagttgaagagactaatcaatcaactgaaaatgaacacctgaaaggccccagtaatttcggagatggtcacctaaatgactcaaaagcgccagctcctgttaaagctgaggcacagaaagcagcactaccaattgaagtgcctgcactctcccttgaagaactgaaagaaaagactgataattttgggtccaaagccttgattggagaaggttcttatggtagagtttactatgcaaccttaaataatgggaaaaatgtggctgtaaagaagctggacgtttcatctgagcctgacagtaacgttgagtttttgactcaggtttctacagtatcaagattgaaacatgaaaatcttgtcgaattgcttgggtattgtgttgaaggaaatcttcgtgtattggcttatgaatatgcaaccatgggatctttgcatgatgtgttacatggaaggaagggagtacaaggagcacaacctggtccagtgcttgactggatgcagcgagtgagaattgcagttgattcagccaaaggactggaatacttgcatgagaaggtccaacctgctattatacaccgagatatcaggtccagcaatgtgctactcttcgaggattttaaagctaaggtagctgatttcaacctctccaaccaagcccctgatatggctgcccgtcttcattcaactcgagttttgggaacttttggttaccatgctccagaatacgcaatgactggacagttgacgcaaaaaagtgatgtatacagctttggtgtagttcttcttgagcttttgactggtaggaaacctgttgatcacacgatgccccgcggacagcaaagtttagtcacctgggctactccaaggctaagcgaggacaaagtgaagcaatgtgtagatccaagactaaagggagaataccctcctaaaggagttgcaaagctagcagctgtggccgcattgtgcgtgcagtatgaagccgagttccgaccaaatatgagcatcgttgtgaaagcccttcaacctcttttgaagccccccgcacctaccggtccacctgcaccagagtcttgacgggcaatgtacattgtttcatccccctgagtttgaattcttggacatgcttcagatagtttatctcttatatgcagcgatatttggtcggataactttatgcatatcccttttatttcatcgtgtaaatggtgagtttggatgcggtagaattgcggtacgggggttcaagtgtcgagaggtttcaagaagagtgatgatagctggattgtgtgtagaagtatctgtttctgaataataatggagtttccccccccccgacactttcttctgccttctcaaaactgcaaagtgcagatttagctaaggcttattagttctttttattctcttgttatattttgttcaactctgatccaaacaaaaacttgctttattggatttcacttgtatcaaaatgaactgagccccatggggattgccatt

SEQ ID NO: 6407 - DNA, 1114 bp, Persea americana
gagttcttgacccaggtttcaatagtgtcaaggctgaagcatgaaaaccttgtcgagttgctaggttactgtgtggaaggaaatgaacgtgtcttaggatatgagtttgcaaccatgggttctttgcatgacattttgcatggtagaaaaggagtccaaggtgcacaacccggccctactcttgactggatgcaaagagtgagaattgctgtcgatggagcaaagggattggagtatctgcatgagaaggttcaaccttctgtaatacacagggatgtcagatcaagcaatgttctcttatttgaggacttcagagctaaaattgcagattttaacatttcaaatcaggctcctgacatggctgcccgtctccattctacccgagttttggggaccttcggttatcatgccccagagtatgccatgactggtcagttgacacagaaaagtgatgtctacagtttcggggttgttcttctggagctactgaccggcaggaaacctgtggatcatacaatgcctcgtgggcagcagagtcttgttacttgggcaactccaagactaagtgaggataaggttaagcagtgtgtagatccaaagttaaagggggagtatccaccaaaaggagttgctaagctggctgctgtagcggcattgtgcgtgcaatatgaatctgaattccggcctaacatgagcatcgttgtgaaggcactccaaccactactcacccagaagccacctgctccaaagcccgatcctgctcctgagacctaaactgccatatcagcactcaagcatcggcgaattgacatttgaacttacttggtggtttcactttccagatggtttcctggttggcattgcattgttttttcactgcttacaagaacgatagataagtggcttttggtttggcaaatgcttttccaatctcttacgtgcattcatgattgaccaagcagcagacaaaacggtgtggtgctgaagtggggaagtggtcagagttttaagaatggcatgaaagttgggaataaaggcttttctggtggatattgcccgtgtattttccgtgttctctcatgttgatgtcaactccacgtgtttcatatctatt

SEQ ID NO: 6408 - DNA, 1653 bp, Cucumis melo
gcttcgccttgaatcgaaatccaaaatactcaaaatccttccagagaaaaagaaaaagaaaaaaccccatccattctcatctgtttctttgttgttctttcgcttcttcctctaattcatccagcccataaccatctacaggcttatgcccctcctcttggttacttattacatccagataacaatactgaggattatcaatatcgaaggaagaaagtgaggatgcgcaagtggctttgttgtttttgtcaagttgaagagactaatcaatcaactgaaaatgaacacctgaaaaaccccagtaatttcggagatggtcacctaagggactcaaaagtgccagctcttgtaaaagctgaggcacagaaggcagcactaccaattgaagtgcctacgctctccctggaagaactgaaagaaaaaactgataatttcgggtccaaagcgttgattggagaaggttcttatggtagagtttattatgcaaccttgaataatgggaaaaatgtggctgtaaagaagcttgatgtttcttctgagcctgacagtaacgttgagtttttgactcaggtttctacagtatcaagattgaaacatgaaaatcttgttgaattgcttgggtattgtgttgaaggaaatcttcgtgtcttggcttacgaatatgcaaccatgggatctttgcatgatgtcttacatggaaggaagggagtacaaggagcacaacctggtccagtgcttgattggatgcagcgggtgagaattgcagttgattcagccaaagggctggagtacttgcatgaaaaggtccaacctgcaattatacaccgagatatcaggtccagcaatgtgctactcttcgaggattttaaagctaaggtagctgattttaacctctccaaccaagcccctgatatggccgcccgtcttcattcaactcgagttttgggaactttcggttaccatgctccagaatacgcaatgactggacagttgactcaaaagagtgatgtatatagctttggtgtagttctacttgagcttttgactggtaggaaacctgtcgatcacacgatgcctcgcggacagcaaagtttagtcacctgggctactccaaggctaagcgaggacaaagtaaaacaatgtgtagatccgagacttaagggagaataccctcctaaaggagttgcaaagctagcagctgtggccgcattgtgcgtgcagtatgaagctgagttccgaccaaatatgagcatcgttgtgaaggccctccaacctctattgaagccccccgcacctacaggtccccctgcaccagagtcttgacggcaatgtgtacatggtttcatcacccctccgagtttgaattcttgcaaatgcgtcaaatagtttctctctaatatgcagcaacgatatttggttggttaactatatgcatatcccttttatttcattgtataaatggtgagtttggatgcggtagcattgcggtatggggttccgagtgtctggatgtgtgaagaagtatctgtttctgaataataatgatggagttttccccccattgacattttattctgccttctcaaaactgcagagtgcagatttacctgaggctaattaagtctttttattctcttaaaaaaaaaaccaaaa

SEQ ID NO: 6409 - DNA, 1800 bp, Citrus clementina
ctgtcatatgatattgatcttccgaaaattttcatttctatttctcaaaagcaaagcaaataaaagcaaaaacgcccacctgtctatcattttttaaaaaaaaaaaaaatcaatataaatcaaccaatcaaaaacaaacccccgcacaaaccctaaagtttttttttttgaataaattttaaaaaaggggtaaattcttatttggcaaagagagaaagaaagagagagagagtaatcaggcacatgcaccttctccaggttactttgtacgattggataaaggtcctgaagacgatctctatttgaagaagagagtaaagatgcgtcgctggctctgttgtacttgtcaagtagaggagtcttatccatctcatgaaaatgagcgcctgaaaagcccaaagaattatccagatgggcaccacaaaaaggtcccagctccggtgaaacctgaagtgcagaaggcagcaccacctattgaagtgcctgcattgcctttggatgagctaaaagaaaagacggacaattttggatcaaaggcattgattggtgagggatcgtatggaagggtgtattatgcaaacttagaaaatggcaaagcagtggctgttaagaagcttgatgtttcctctgagcccgagtcaaatgttgaatttttgactcaggtttcagttgtttcaagattgaagcatgaaaatcttgtcgagttgctcggttattgtgttgaaggaaatctccgtgttcttgcttatgaatttgctacaatgggatctcttcatgacatattgcatggcagaaaaggagttcagggagcacaaccaggtccagtgcttgactggatgacacgggttagaatcgcagttgatgcagcaaggggtttggagtacttgcatgagaaggttcaaccttcaataatacacagagatatcagatctagcaatgtccttctcttcgaagatttcaaagcaaagattgcagattttaacctttcaaatcaggcccctgatatggcagctcgccttcattctactcgagttttgggaacctttggttatcacgctccagaatatgcaatgacgggacaattgacccagaaaagtgacgtgtatagctttggggttgtccttctagagctccttactgggaggaaacctgttgatcacaccatgcctcgtggacaacagagtcttgttacctgggctactccaagattgagtgaagacaaagttaagcaatgtgtagacccaaagcttaagggtgaatatccacccaaaggagttgctaagttggctgcagtagcagcattatgtgtgcagtatgaagcggaattccggccaaatatgagcattgttgtcaaggctcttcaacctcttctgaaatctccccctccagcagccccagtttcagagacttaaaaggcaaaagaatttagttccgctgctagcttgaagtttcttgcagcttggttacagtttgtttcatatgcctccatatttctgcaaatcacttttatatatatatatttttttaatttttcgtatatgagatttgatttcgtataagagagcagatttttaggattggatttgtaccgaagtgtcgtcgatacttaaaatgtctgcaactggtatgacaccatggtactgtcggccttgggtttttaagttaacaattggattgggttgtgtggtggatatatttgttctgagtatttgtttgatttcttttctctctggactcaacttatattgtttatttgatttgattttattattttttaaagaaacttattgtttatcaaaa

SEQ ID NO: 6410 - DNA, 998 bp, Linum usitatissimum
tggcgggaaatctcagagtgcttgcttatgagtttgcaactatgggatcgcttcatgacatattgcacggccgaaagggagttcagggggctcaacctggtccagtgctggactggatgcagcgagtcagaattgcagttgatgcagcaaggggtttggaatatttgcatgagaaggttcagccttccataatacaccgagatgtcagatcgagcaatgtgcttctattcgaggatttcaaagccaaaattgcagatttcaacctatcaaatcaggcccctgacatggctgcacgactgcattctactcgtgttctgggaacttttggttatcatgctccagagtatgcaatgactggacaattgacacagaagagtgatgtttacagctttggggtggttctcctagaacttctcactggaaggaaaccagtcgaccacaccatgccccgggggcaacaaagtttagtcacctgggctactccaaggttaagtgaagacaaagtgaagcaatgcgtggacccaaagctgaaaggagaatatccacctaagggagtcgccaagttggctgcagtagcagcgttgtgcgtgcaatacgaatcggagtttcggccaaacatgagcatagttgtgaaggctctgcagccattgctgaagtctcaagtgccagctgctgctgccccagaatcctgaagagaaagggaaagaaagatgaggaatgaatttacaatgggttgtatttgattgttcttggtccatgtagagaatcaaactggggaggtgttgtagatttgggaattggaggagctggttttgagttgctggtgtggaacctttttttttctcaggcatataagagtgaagaatttggattggttttgggcagaagatgctctgctggtttgttatatttgatatcagtgttccttaactgtctgctagctaaaagtgatttgtgacaacaatgcatggttttcagaaccgcatctttgaatcgcc

SEQ ID NO: 6411 - DNA, 852 bp, Citrus sinensis
gcatatgtttttgtcccgctattttgtatcaggtttcagttgtttcaagattgaagcatgaaaatcttgtcgagttgctcggttattgtgttgaaggaaatctccgtgttcttgcttatgaatttgctacaatgggatctcttcatgacatattgcatggcagaaaaggagttcagggagcacaaccaggtccagtgcttgactggatgacacgggttagaatcgcagttgatgcagcaaggggtttggagtacttgcatgagaaggttcaaccttcaataatacacagagatatcagatctagcaatgtccttctcttcgaagatttcaaagcaaagattgcagattttaacctttcaaatcaggcccctgatatggcagctcgccttcattctactcgagttttgggaacctttggttatcacgctccagaatatgcgatgacgggacaattgacccagaaaagtgacgtgtatagctttggggttgtccttctagagctccttactgggaggaaacctgttgatcacaccatgcctcgtggacaacagagtcttgttacctgggctactccaagattgagtgaagacaaagttaagcaatgtgtagacccaaagcttaagggtgaatatccacccaaaggagttgctaagttggctgcagtagcagcattatgtgtgcagtatgaagcggaattccggccaaatatgagcattgttgtcaaggctcttcaacctcttctgaaatctccccctccagcagccccagtttcagagacttaaaaggcaaaagaatttagttccgctgctagcttgaagtttcttgcagcttggttacagtttgtttcatatg

SEQ ID NO: 6412 - DNA, 1715 bp, Citrus sinensis
atttgatcttccaaaaattttcatttctatttctcaaaagcaaagcaaagcaaataaaagcaaaaacacccacctgtctatcatttaaaaaaaaaaaaaatcaatataaatcaaccaatcaaaaacaaacccccgcacaaaccctaaagttttttttttgaataaattttaaaaaaggggtaaattcttatttagcaacgagagaaagaaagagagagagtaatcaggcacatgcaccttctccaggttactttgtacgattggataaaggtcctgaagacgatctctatttgaagaagagagtaaagatgcgtcgctggctctgttgtacttgtcaagtagaggagtcttatccatctcatgaaaatgagcgcctgaaaagcccaaagaattatccagatgggcaccacaaaaaggtcccagctccggtgaaacctgaagtgcagaaggcagcaccacctattgaagtgcctgcattgcctttggatgaactgaaagaaaagacggacaattttggatcaaaggcattgattggtgagggatcgtatggaagggtgtattatgcaaacttagaaaatggcaaagcagtggctgttaaaaagcttgatgtttcctctgagcccgagtcaaatgttgaatttttgactcaggtttcagttgtttcaagattgaagcatgaaaatcttgtcgagttgctcggttattgtgttgaaggaaatctccgtgttcttgcttatgaatttgctacaatgggatctcttcatgacatattgcatggcagaaaaggagttcagggagcacaaccaggtccagtgcttgactggatgacacgggttagaatcgcagttgatgcagcaaggggtttggagtacttgcatgagaaggttcaaccttcaataatacacagagatatcagatctagcaatgtccttctcttcgaagatttcaaagcaaagattgcagattttaacctttcaaatcaggcccctgatatggcagctcgccttcattctactcgagttttgggaacctttggttatcacgctccagaatatgcgatgacgggacaattgacccagaaaagtgacgtgtatagctttggggttgtccttctagagctccttactgggaggaaacctgttgatcacaccatgcctcgtggacaacagagtcttgttacctgggctactccaagattgagtgaagacaaagttaagcaatgtgtagacccaaagcttaagggtgaatatccacccaaaggagttgctaagttggctgcagtagcagcattatgtgtgcagtatgaagcggaattccggccaaatatgagcattgttgtcaaggctcttcaacctcttctgaaatctccccctccagcagccccagtttcagagacttaaaaggcaaaagaatttagttccgctgctagcttgaagtttcttgcagcttggttacagtttgtttcatatgcctccatatttctgcaaatcacttatatatatacatatattttttaatttttcgtatatgagatttgatttcgtataagagagcagatttttaggattggatttgtaccgaagtgtcgtcgatacttaaaatgtctgcaactggtatgacaccatggtactgtcggccttgggtttttaagttaacaattggattgggttgtgtggtggatatatttgttctgagtatttgtttgatttcttttc

SEQ ID NO: 6413 - DNA, 1428 bp, Ambrosia trifida
tgtaatcgctcattgcttatctgtcttttccccaatttctaaacaaatccctaaagaacacaatacaacacaacacaggcatacttgctcccacttggatactttatacgtttgggtaaaccaagggctgacgacggtttaattttgaggaagagagataggatgcggaggtggttttgttgtacttgtcaagtcgaagaatcttacccctcaaatgacaatggcttggtaaaaaaccacaatgatcatgttaatggacagcaaaaggacagagtacaaccgaaagaaaaatttgatgcaacaaaaagaagtgccaacaatcgaagtacctgcactttcgcttgatgaactgaaagaaaaaaccgagaactttggatcaaaggcattgattggtgaaggttcatatggaagggtatattttgcaaatttagataatggaaaaagcgtggctgtgaaaaagcttgatgtctctaccgaggctgaatctgataacgagtttttgactcaggtttcaatggtctccaaactgaagcacgaaaactttgttgagttgtgcggttactgtgtggaaggaaatacacgtgttttggcttatgaattcgcaaccatgggatctctgcatgacatattacatggcaggaagggcgtgcaaggagcacaaccagggcccgtgcttgattggatgcaaagagtaaggattgctgttgatgcagcaaagggacttgattatttgcatgaaaaggtccaaccttcaataattcacagagatattaggtctagcaatgtgctattgtttgaggatctgagagccaagattgccgattttaatctttcgaatcaagctcctgatatggctgctcgtttgcattctactcgtgttttgggcacttttggctatcatgcaccagaatatgcgatgacgggacagctgacacaaaaaagtgacgtgtatagctttggggttgttttgcttgagcttctaactggtcggaaacctgttgaccacacaatgccacgtggacagcaaagccttgtcacttgggctacacctaggctaagtgaagacaaggttaaacaatgtgttgatccaaggctcaagggagagtaccctccaaaagctgttgcaaagctggcggctgtggcggctttatgcgtgcagtacgagtctgagtttaggcctaatatgagcattgttgtgaaagctcttcaaccgctgttgagggctcctgcacctgcagctccagaagtataataatgtaaaaagcatgaagaaaaataagcgaacttgtgaccgttgttttcctctgcagctttataatcgtgaccgtagattttagttgtattgaggcatatatatatatttttgtttgagaatatggatgtgtgcttatgatcagattggtctgttatatatctttggcttgtcaa

SEQ ID NO: 6414 - DNA, 1421 bp, Ambrosia trifida
ccctaaacacacaattcaacacaacacaacacaggcatacttgctcccacttggatactttatacgtttgggtaaaccaagggctgacgacggtttaattttgaggaagagagataggatgcggaggtggttttgttgtacttgtcaagtcgaagaatcctacccctcgaatgacaatggcttggtaaaaaaccacaatgatcatgttaatggacaacaaaaggacagagtacaaccgaaagaaaaatttgatgcacaaaaagaagtgccaacaatcgaagtacctgcactttcgcttgatgaactgaaagaaaaaaccgagaactttggatcaaaggcattgattggtgaaggttcatatggaagggtatattttgcaaatttagataatggaaaaagtgtggctgtgaaaaagcttgatgtctctaccgaggctgaatccgataacgagtttttgactcaggtttcaatggtctccatactgaagcacgaaaactttgttgagttgtgcggttactgtgtggaaggaaatacacgtgttttggcttatgaatttgcaaccatgggatctctacatgacatattacatggcaggaagggcgtgcaaggagcacaaccggggcccgtgcttgattggatgcaaagagtaaggattgctgttgatgcagcaaagggacttgattatttgcatgaaaaggtccaaccttcgataattcacagagatattaggtctagcaatgtgctactgtttgaggatctgagagccaagattgccgattttaatctttcaaatcaagctcctgatatggctgctcgtttgcattctactcgtgttttgggcacttttggctatcatgcaccagaatatgcaatgactggacagctgacacaaaaaagtgacgtgtatagctttggggttgttttgcttgagcttttaactggtcggaaacctgttgaccacacaatgccacgtggacaacaaagccttgtcacttgggctacacctaggctaagtgaagacaaggttaaacaatgtgttgatccaaggctcaagggagagtaccctccaaaagctgttgcaaagctggcggctgtggcggctttatgcgtgcagtacgagtctgagttcaggcctaatatgagcattgttgtgaaagctcttcaaccgctgttgagggctcctgcaccagcagctccagaagtataatagtaaaaagcatgaagaaaaataagcgaacttgtgaccgttgttttcctctgcagctttatgatcgtgaccgtagattttagttgtattgaggcatatatatatatatatattttgtttgagaatatggatgtgtgcttatgatcagattggtctgttatatatctttggcttgtcaagatttgttcatttatttaaacctgcttattgtcaa

SEQ ID NO: 6415 - DNA, 1598 bp, Ambrosia trifida
ataactctgtaccttgctttttgcttacctgtctgcaaaacattactgacacaaagcccttgatcaagaacatccaagacacagttcaaagggtacagaagctcaggcttatgcacttaaaacgatttacatttcaggaagaatactaagatggggtggttttgttgtacatgtctggtcgaagagtcgaacccaacaaatgacaatgaacccgtaaaggatcaaccagattacttggatggacaccaaaagggtccgaaagaacctcctgtcaaatctgcagtgcaaaaagcagtgctgccaatggaagtgccagcactttctttggaagaactgaaagaaaaaaccgatgattttggatcgaaggcactaattggtgaaggttcatatggaagagtctattttgcaaccttagataatggaaaaagcgtagctgtgaaaaaactcgatgtttctactgaggttgaatcaaatgacgagttcttgactcaggtctccatgttctcgaatctgaagcacgaaaatcttattgagctgcttggttactatgttgaaggtgacattcgtgttctggcttatgaatttgcaaccatgggatctctacatgacattttgcatggtagaaaaggtgtgcaaggagcgcaaccgggacctgtgcttgattggacgcaacgggtgaagattgctgttgacgcagcaagggggttggaatacttgcatgagaaggttcagccgtctataatacatagagatataaggtctagcaatgtgctattattcgaagatttaaaagccaagattgcagattttaatctttcaaatcagtcaccagacatggctgctcgtttgcattctactcgtgttcttggcacctttggttatcatgcaccagaatatgcaatgacgggacaattaacacagaagagtgatgtttatagctttggcgttgttcttcttgagcttttaaccggcaggaagcctgttgatcacacaatgccacgtggacaacagagtcttgtcacttgggctacaccaaggctaagtgaagacaaggttaaacaatgtgtcgatcccaagcttaaaggagagtatcccccaaaagcagttgcaaagttggcagctgtggcggcattatgtgtgcagtacgagtccgagtttaggcctaacatgagcattgtggtgaaggctcttcaaccactcctgaagacttctgcaccaccaccaccaccaccaccggaagaggagtaggccgctaaattagtcttggtgattggtcatccgtgtaacgtgaaattctgtacttccaccagcaaacagcatggtcgtgttcatatgtagattctgcctccagccacctctatacaacgctcgcgtgcgtgcacacacatttatagtgttttattgatttaatacttgcatttgagaaacacttttgcagctgcctgttttgtttgttctggtttaagaatgtggatatggtgggattggttttgtggtgaatttttatattgcattgagtttttgcttctgtttaagatctttgatatttgtaatggttctgtaatactgttgattaatatgaaatgatttgtcttcaa

SEQ ID NO: 6416 - DNA, 1570 bp, Flaveria ramosissima
ctgtttccctgtgttacttgaatgtccaatgttacataaaacatacatgaacacaaagccctaactcaagaaacccaattattcagttcaagggtgaggatcagcaggaagaagaataagattatgaggtggttttgttgtacttgtcaagtcgaagagcctaacccatctaatgacaatgaacctgtgaagaatcctccagattacttggatgggcaccaaaagggtccaaaaggacctcctattaaatctgaagtgcaaaaggcagtgccaccaattgaagtgccagcactttcattggatgaactgaaagaaaaaactgatgattttggttcatcggcactaattggtgaaggttcatatggacgagtctattttgcaaccttggataatggaaaaactgtggctgtgaaaaaacttgatgtttctactgaggttgaatcgaatgacgagttcttgactcaggtctccatgttctcgaatctgaagcacgaaaatcttattgagttgctcggttactgtgttgaaggagacgttcgtgttctggcttatgaatttgcaaccatgggatctttacatgacattctgcatggtaggaaaggtgtgcaaggagcacaaccggggcccgtgcttgactggacacaacgggtaaagattgctgttgatgcagcaaggggattggagtatttgcatgagaaggttcaaccatctataatacatagagatataaggtctagcaatgtgctactgtttgaagatttaaaagccaagattgcggattttaatctttcaaatcagtcaccagacatggctgctcgtttgcattctactcgtgttcttggcacctttggctatcatgcaccagaatatgcaatgacgggacagttaacacagaagagtgatgtttatagctttggggttgttcttcttgagcttttaactggcaggaagcctgttgatcacacaatgccacgtggacaacagagtcttgtcacttgggctactccaagactaagtgaagacaaagttaaacaatgtgtcgatccaaagctcaagggagagtatcctccaaaagcagttgcaaagttagcagctgtggcggcattatgcgtgcagtatgagtctgagtttaggcctaacatgagcattgtagtgaaggccctccaaccactcctgaaggcttctgcaccaccaccaccagaagaggagtaggctgcgataaacgagtcttgatgatcggtcatcaacgtaacttaaaattctgtagttacaccagaaaacaagcatggtcgtgttcatatgtagattctgcctacagctacctctttacaaacacttgcgtacgcgcgcacacaaatatatattgttttatccatttgattcttgcatttgagaagtacttatgcaaatgtctgttctgtttgttctgtttttaagaaagatgaggatagagtggaatttggttttgtggtgatctgttaatggcttgaggttttttgcttgttcagtttctgcttctcttaaagatattgatacatgtaatgattctgttgatttttataaaaagtag

SEQ ID NO: 6417 - DNA, 1331 bp, Flaveria ramosissima
taggtggtttgttgtacttgtcaagtcgaagacgcctaacccgtacaaatagacaatacgaacctgtagaagaatccctcagattacttggatgtgcaccaaaagggtccaaaaggaacctccctatcaagtctgaagtgcaaaaagcagtgccaccaattgaagtgccagcactttcattggacgaactgaaagaaaaaactgatgattttggttcaacggcactaattggtgaaggttcatatggaagagtctattttgcgaccttggaaaatgggaaaaccgtggctgtgaaaaaacttgatgtttctactgaggttgaatcaaatgacgagttcttgactcaggtctccatgttctcgaatctgaagcatgaaaatcttattgagttgctcggttactgtgttgaaggagacgttcgtgttctggcttatgaatttgcaaccatgggatctttacatgacattctgcatggtaggaaaggtgtgcaaggagcacaaccagggcccgtgcttgactggactcagcgggtaaagattgctgttgatgcagcaaggggattggaatatttgcatgagaaggttcaaccatctataatacatagagatataaggtctagcaatgtgctactgtttgaagacttaaaagccaagattgcggattttaatctttcaaatcagtcaccagacatggctgctcgtttgcattctactcgtgttcttggcacctttggctatcatgcaccagaatatgcaatgacgggacagttaacacagaagagtgatgtttatagctttggggttgttcttcttgagcttttaactggcaggaagcctgttgatcacacaatgccacgtggacaacagagtcttgtcacttgggctactccaagactaagtgaagacaaagttaaacaatgtgtcgatccaaagctcaagggagagtatcctccaaaagcagttgcaaagttagcagctgtggcggcattatgcgtgcagtatgagtctgagtttaggcctaacatgagcattgtagtgaaggccctccaaccactcctgaaggcttctgcaccaccaccgccggaagaggagtaggctgcaataaacgagtccaggtgatcggtcatcaacgtaacttataatcctgtagttacaccagaaaacaagcatggtcgtgttcatatgtagattctgcctccagccacctctttataaacactcgcgtgcgcacacacaaatatatactgtttatccatttcattcttgcatttgagaaatacttatgcaaatatctgttctgtttgttctgtttttaagaaagatgatgataga

SEQ ID NO: 6418 - DNA, 1326 bp, Utricularia gibba
cgtaaaagagaaaaccgaacaacttttaggtttctaaaagaccttaattaggtgaagggtcgatatgggcgagtgtactttgcacaactagagaatggcaaagaagtagccattaaaaaacttgatgtttcatctgagcctgacacaaatacacagtttttgacccaggtttcaatggtctcaagattgaggcatgaaaatcttgttgaattgcttggatactgtgtggatggcaatattcgtgttttggcttatgagtttgcaaccatggggtctctgcatgatattctgcatggtaggaaaggagttcaaggagcacagccaggacctgtacttgactggatgcaacgggttaggattgctgttgatgcagcaagaggcctcgaatatttgcacgagaaggttcagccttcgataatccatagggatatcagatctagcaatgtacttctatttgaggactacaaagccaaggttgcagattttaatatttccaatcaggctcctgatatggctgctcgtcttcattctaccagagttttaggaactttcggctatcacgcaccagagtatgcaatgacaggacagctgactcagaagagtgatgtttatagttttggggtcgttttgcttgagcttctaacaggacgcaagccggtcgatcacaccatgcctcgcggacagcaaagtctagtgacctgggccactccacggctgagtgaggacaaggtgaagcaatgtgttgatccaaagctcaagggagagtatccacctagaggggttgccaagctggctgcagtcgcggcattatgcgtacaatatgaatccgagttccgcccgaacatgagcatcgttgtgaaggctctgcagcctctgctgaggccaactgcacctgccccagaggcatagaatccatgagggatggatactggtctgattctgcaggtatacatactgcactgttatgcaatgactggagctcatgtttactggtttgctttgttggtattttttttgtgggttgcagccataagtcgtctgtattggtgtgtttctatgcattctctatggttctgtgggttgatatgtctgcgtgtgttgtgctgctgctgcgtaccttgacaccacttcggtgctttagacgggtctctagtctccactctccactgattgatttattggaattctgtctacaatttaccagtggaatgaatgactctatgcacatttagaaagccattggtgaatggtgaccagtgtatttgaattcattattttaaaatccattgattctgtgtcatgaaattaaaaaaaaaaaaaaaacac

SEQ ID NO: 6419 - DNA, 1224 bp, Manihot esculenta
atggcggacgactgtcatcagcggaattttggggcacatgcacgttctcctggttaccatatattgggtggtagaaaaggttctctagacgatttggttttgaggaagaaagaaaagatgcgcaggtggctttgttgtacctgtcaagcagaagaagcatacccatcacatgagaatgagcacctgagaagcccaaagaaccatacagaagggaacaaccctatgaagggctcaaaggtttcagccccagtcagagctgaagtacagaaggaagcacctccaattgatgtgcctgcattgtctttagatgaattgaaagagaagactgacaattttggttcaaaggcattaataggtgaaggatcatacggaagagtctattatgctaacttggataatgggaaagctgtggcggtaaaaaaacttgatgttgcatctgagcaagagtcaaatgttgaatttttaactcaggtttccatggtttcaagactgaagcatgaacatgttgttgagttgctgggttactgtgtggatggaaatattcgagtgcttacttatgagtttgcaacaatgggatctctccatgacatattacatggtagaaagggagttcaaggggctcaaccaggtcccacgcttgactggatgcagcgtgtgagaattgcagttgatgcagcaagggggttggaatacttgcatgagaaagtacaacctcctataatacacagagatatcagatcaagcaatgtgcttctatttgaggacttcaaagcaaagattgcagattttaacctttcaaatcaggctcctgatatggctgctcgccttcattctactcgtgttttgggcacctttggttatcatgctccagagtatgcaatgactgggcaattgacacagaagagtgatgtttatagcttcggagtggttcttctggaacttttgactgggaggaaacctgttgatcatacgatgccacgaggacagcagagtctcgtcacttgggctactccaagactaagtgaagacaaagttaagcaatgcgttgatccaaagctgaagggagagtatcctccaaaaggagtggccaagcttgcagctgtggctgcattgtgtgtgcaatatgaagctgagttcaggccaaatatgagcatagttgttaaggcactccaaccgcttttgaaggccccagctgctgctcctcctcctcctgcagagagctaa

SEQ ID NO: 6420 - DNA, 1740 bp, Gossypium hirsutum
ttttttcctctctattgtctctctttagaacaatcctttcatccaaaaacccaatacaactgttaacaaaccctagaaagaggaagataaagtttcttccaacgattaaagagagaaaatagaggggaaatccaggcacatgcacctagtagaggctacttcgatcaactagaaaatacagacgatttgtatttgaagaaacgatcaaggatgcgtcgttggctttgctgttcctgtcaagcagaggagagttaccaagcacacgaaaacgagcacttgaaagcccccaaggatcatacagatggaaatcatagaaactcaagggtggcagctcctgtcaaacctgaagtgcaaaaatcaccaccacctatcgaagttcctgcactatcgttggaagaattgaaagagaaaacggacaattttggatcaaaggctttgatcggtgagggttcttacggaagagtttattatgctagcttgaacaatggaaaagctgtggctgtgaaaaagcttgatgtttccactgagtccgagtcgaatgtggagtttttgacccaggtttccatggtttcaagattgaagcatgacaattttgtcgagttgcaaggttactgtgttgaaggaaatctccgtgtgcttgcttacgagtttgcaacaatgggttcacttcatgacatattgcatggaaggaagggagttcaaggggcacaacctggtccggttcttgactggatgcagagggtaagaattgcggttgatgcggcaaggggcttggaatatttgcacgagaaggttcaaccttcgattatccacagagatatcagatctagcaatgtccttctttttgaagacttcaaagcgaagattgcagattttaacctctcaaaccaggctcccgacatggctgctcgtcttcattctactcgtgttttgggaaccttcggctatcatgcacctgagtatgcaatgaccgggcagttgacacagaagagtgatgtttacagtttcggggttgtccttttagagcttcttacggggaggaaacctgttgaccacacaatgcctcgtggacagcagagtctcgttacctgggctactccaagactgagcgaagataaagtcaaacaatgcgtagatccaaaactgaagggagagtatcctcccaaagcagttgctaagttggcagctgtggcggcattatgcgtgcagtatgaatctgagttccgtccaaacatgagcatcgtcgtcaaggctctccaaccgctgttgaaggctccagtgccagtaccagcgctggagacttaaaacagcagaggaatccaagtttcttcgccatttatcgaaatttcatcaacttttgatagtttggtttcgtaatcaaaatacagattttcatctgatcactaaatattaattatatacgtttttctattccttcctatataacattcaagtgtaggattgggtttggtctgtttagtatctgtcagttgccgggttttttcggactcgtaatgtcatgttttttcggatgtagtcgtaaaattgaccgagggattgggttgtgactgagggattgggtcgtgtcggtgagtatagtttggtttgtatcatttttttcgttttcttcgtcgtggttcgtaaatttgtatgaatattttcgcttagaatgattggaactaatcgaagcgtttgtagcatgtggtttgttgatgaaaaaagaaaaaagtaccgactgcg

SEQ ID NO: 6421 - DNA, 1857 bp, Vitis vinifera
ggaagacacagaaatccacaaaagaagaattccaaaaacagctcccacatccaccgccccttccaatgctttattgttttttagagagagaaaattcccccaaaacgatgtgtgagagaagagagagggacagatagactccattggcttcttcctttttgccaatctgtcttctcctcttccttcttctccaccaccacaaaccctaaccctatttccagtttctcccccaattcatcatttgccaggcatatgctcctcctcctggctacttcgtattggagaataacagtactctagaggatatttctgtgactaaaagaggcaggatgcggaggtggctctgttgtacttgtcacgtggaagagccttaccagtcaaatgaaagcgagctcttgaaaagccccaggaaccacacagatggaaacccaaaaggctcaaaggtgtcagctcctgttagaagtgaagtgcaaaagacagcaccccctattgaagtacctgaattgtctctggaagaactaaaggaaaagactgacaattttggatcaaaggcattgattggggaaggatcctatggaagagtatattacgccagcttgaataatggaaaagctgtggctgtaaaaaaacttgatgtttcatctgagcctgagacccctgtcgaatttttaactcaggtttccatggtttcaagattgaagcacgaaaatctggttgagttgcttggttattgtgtggacggaaacctccgtgtgttggcatacgagtttgcaaccatgggatctctgcacgacattttgcatggcagaaagggagtccagggggcacaaccaggtcctgtgcttgactggatgcaacgggtgagaattgctgttgatgcagctcggggattggagtatctccatgaaaaggttcaaccttccataatacatagagatatcagatctagcaatgtgctcctatttgaagactttaaagccaagattgcagattttaatctttcaaatcaggctcctgacatggctgctcgccttcattctactcgagtcctggggacctttggctatcatgcaccagagtatgcaatgactggacaattgactcagaagagtgatgtgtatagttttggagttgttctgttagagcttctaactgggagaaaacctgttgatcataccatgcctcgtggacaacaaagtctggtcacctgggctactccaagactgagtgaagacaaagttaaacaatgtgtagatcccaaactaaagggagaatatcctccgaaaggagttgctaagctggcagctgtggcagcattatgtgttcagtacgaagctgagttccggccaaatatgagcatcgttgtgaaggctctccaaccgcttttaaaggctgctgccccagctcctgaggtttaagggggaaaaaatagaatggcatctctccttgtgtttgaatttctgggcatcttgcacagtttggtttgatcttcttcatcttgcaggcgaatttcttccggtcaatggatatatatatttttttatttttcggatttgagaatggatgtgtagggagttggattgtggcccatttcatgtagcgctaaattctgtctcatgctggtaatttcaacatggtgtgctctaaaagtcttttgttgattcacatatttgacaatggggattgggttgtgtgttgttggagaagtatcgccaaaacttggtatttgtttgctttctcttctttttcttttatctcacaataatagttccaaaatgagtctttccaagggaaattgaattctgaaaaatcacatgtttagttgagttaataaaacaagttattagaagcagtttt

SEQ ID NO: 6422 - DNA, 1738 bp, Vitis vinifera
ctttattgttttttagagagagaaaattcccccaaaacgatgtgtgagagaagagagagggacagatagactccattggcttcttcctttttgccaatctgtcttctcctcttccttcttctccaccaccacaaaccctaaccctatttccagtttctcccccaattcatcatttgccaggcatatgctcctcctcctggctacttcgtattggagaataacagtactctagaggatatttctgtgactaaaagaggcaggatgcggaggtggctctgttgtacttgtcacgtggaagagccttaccagtcaaatgaaagcgagctcttgaaaagccccaggaaccacacagatggaaacccaaaaggctcaaaggtgtcagctcctgttagaagtgaagtgcaaaagacagcaccccctattgaagtacctgaattgtctctggaagaactaaaggaaaagactgacaattttggatcaaaggcattgattggggaaggatcctatggaagagtatattacgccagcttgaataatggaaaagctgtggctgtaaaaaaacttgatgtttcatctgagcctgagacccctgtcgaatttttaactcaggtttccatggtttcaagattgaagcacgaaaatctggttgagttgcttggttattgtgtggacggaaacctccgtgtgttggcatacgagtttgcaaccatgggatctctgcacgacattttgcatggcagaaagggagtccagggggcacaaccaggtcctgtgcttgactggatgcaacgggtgagaattgctgttgatgcagctcggggattggagtatctccatgaaaaggttcaaccttccataatacatagagatatcagatctagcaatgtgctcctatttgaagactttaaagccaagattgcagattttaatctttcaaatcaggctcctgacatggctgctcgccttcattctactcgagtcctggggacctttggctatcatgcaccagagtatgcaatgactggacaattgactcagaagagtgatgtgtatagttttggagttgttctgttagagcttctaactgggagaaaacctgttgatcataccatgcctcgtggacaacaaagtctggtcacctgggctactccaagactgagtgaagacaaagttaaacaatgtgtagatcccaaactaaagggagaatatcctccgaaaggagttgctaagctggcagctgtggcagcattatgtgttcagtacgaagctgagttccggccaaatatgagcatcgttgtgaaggctctccaaccgcttttaaaggctgctgccccagctcctgaggtttaagggggaaaaaatataatggcatctctccttgtgtttgaatttctgggcatcttgcacagtttggtttgatcttcttcatcttgcaggcgaatttcttccggtcaatggatatatatatttttttatttttcggatttgagaatggatgtgtagggagttggattgtggcccatttcatgtagcgctaaattctgtctcatgctggtaatttcaacatggtgtgctctaaaagtcttttgttgattcacatatttgacaatggggattgggttgtgtgttgttggagaagtatcgccaaaacttggtatttgtttgctttctcttctttttcttttatctcacaataatagttccaaaatgagtctttccaagggaaattgaattctga

SEQ ID NO: 6423 - DNA, 797 bp, Ipomoea nil
tcctgatatggctgccaggcttcattctactcgagttctgggaacatttggttatcatgcaccagagtatgcaatgactggtcagttgacgcagaagagtgatgtatatagctttggggtggttttgcttgaacttttgactggaaggaaacctgtagaccataccatgcctcgtggacagcagtcacttgtgacatgggccactcctaggttgagtgaagataaagtgaaacaatgtgtagatccaaaactcaaaggagaatatcctccaaaaggagtagcaaagctggctgctgttgcagcattgtgtgtacagtatgaggcagagttccgtccaaatatgaccatcgttgtgaaggcccttcagccactcttgaagtcttctgcccctgctccagaatccccagaaatataatcctaaaataccatttattgcttggtctgagggaatttctacaacctattgcacagtttagtcgtttgcaggagaattgcatctagtatttaaaagttaatatttgttttcgtttttcttcaaataagagattgcagttgctggtttaattcctttgggttcactttgtcgcggtactagattgttactgaggttttccaagtcattaatcaattacggatgagccgtgagattggtttgctgtggttgtttccttcagtattgacattgttactgagaaccgagatgttctaaggtattaatcatttatcaacgagctgtgagaggtgatattcccttctagaactctgatgtatattttgtaaaattattttgagtttat

SEQ ID NO: 6424 - DNA, 1788 bp, Populus trichocarpa
attaatataataactaaaaaaaagcagaaaaattccctgccttccttcgctttcttcctctccgctttgcctatctgtctctctccccttctctctctccgccactctcttctcttataagcaaacaacaaatctctctatctgtctctctccgaagaatataaacctaacgagtttccaaacccttaaaaacacacgagtacaggcacatgcgccatctcctgggcgctttgtgcgattggagagaacacaaggtggtggtggtggtgaagggggtggagacgagttatttccaaggaaaagagacaagatgcgtcggtggctttgttgtacctgtcaggtagaggagtcgtacccaccatatgagagcgagcgcttaagaagcccgagaaactacggagatgggtatcctaaaggctcaaaagtagcagctcctgtcaaagctgaattacagaaggaagcaccacctattgaagtgcctgcattgtctttggaagaactgaaagagaagactgacaatttcgggtcgaaagcattgattggtgaaggttcctatggaagagtttattatgcaagcttagaaaatggaaaagctgtggctgtaaaaaaacttgatgttgcaagtgagccggagacaaattttgaatttttgactcaggtttccatggtctcaaggttgaagaatgaaaatgttgtggagttgctcgggtactgtgtagaaggaaatctccgagtgcttgcatatgagtttgcaacaatgggatccctacatgacatattgcatggtagaaagggagttcaaggtgcacagccaggaccagtgcttgactggattcagcgagtgaaaattgcagttgatgcagcaaggggtttggaatacttgcatgagaagctacaaccagctataatacacagagatatcagatcaagcaatgtgctcctctttgaagacttcaaagcgaagattgcagattttaacctttcaaatcaggctcctgacatggctgctcgccttcattcaactcgagttttaggaacctttggttatcatgctcctgagtatgcaatgactggacaattgacacagaagagcgatgtttacagttttggagtagttctcctagagcttcttactgggaggaaacctgttgatcacaccatgccacgtgggcaacagagtcttgttacttgggctactccaagactgagtgaagacaaagttaaacaatgtgtagatccaaagctgaagggggaatacccccctaaaggagttgccaagatggcagccgtggcagcattatgtgtgcagtatgaatctgagttccggccaaatatgagcattgttgtcaaggctctccaacctcttttgaagtcagttgctcctgctgctccagagacctaaaccaaagaagtcagtttctcgtgttggaatttctgcaacttgcacagtttggtttcatttgcatgtggatttctgcggacaattctatatatatatttttttaatttttaatatatgagatctggtgtgtaggtttgggttgtcctctttaggggcattgattttctgtctatttcttgctggtatttcaggctgctgattttttttttccagtcataaattgaccctaaagaggccttgagtcttatgtagggattgttgtttgctttcaaacgatccttttgtgatcattaacaaatgttgttcataatttactgaaactttatgtcaatattgttctgctggaatccggcccttttcatttctttcatatttgcttggcgcca

SEQ ID NO: 6425 - DNA, 647 bp, Senecio madagascariensis
tggatcccccgggctgcaggctactcgagtcctcggtacctttggctatcatgcaccagaatatgcgatgactggacagctaacgcaaaagagtgacgtgtatagctttggtgttgttcttcttgagcttttaactggtaggaagcctgttgatcacacaatgccccgtggacagcagagtctagtcacttgggctacgccaagactaagcgaagacaaggttaaacaatgtgtcgatccaaaactcaagggagagtatcctccaaaagcagttgcaaagttggcggccgtagcagcgttatgtgtgcagtacgagtccgagtttaggccaaacatgactattgtggttaaggctcttcaaccacttctcaaggcttctgcaccagcagtaccagtggatgcggaggtataggaggcaactaatgagttgcgacttccgtcagaatataattctgctgttccatcagaaaacaaacatgggtgtgttcatctgtagattctgcccctgacccacctttatatatacgcatatatttatacaagaaagaattttatcgatttgattcctgcattttaaaaataccccttgctgccgactgttttgtttgatcggcttttatgttgtgaaaattggttttgtgtacatg

SEQ ID NO: 6426 - DNA, 1612 bp, Helianthus annuus
aggaccacaacagacaacacacgaactttcaactctctctctctctctctcacacatttttgctgctgcttacctgtgttacaacctgcaaaacattaccaacacaaagccctaaatcaagaaaaccaattacacaatttaaagtgtgaagaagcccaggcgcatgtgcctaaaacggtttaccttttgaaataataagatgcttaggtggtgttgttgtacttgtgaagtccaagagtctaacccgtcaaacgagaatgaacccataaaggattccacggattacttagatgggcaccaacaggatctgaaaggaccgcctatcaaagctggagcgccaaaggcggtgccaccaatacaagtgccggcactttcattggaagaactgaaagagaaaaccgatgatttcggatcaacggcgctaatcggtgaaggttcatatggaagagtctattttgcaaccttaaataatggaaaaagcgtagctgtgaaaaaacttgatgtttctactgaggttgaatcaaatgacgagttcttgactcaggtctccatgttctcgaatctgaagcacgaaaaccttatcgagttgcttggttactatgttgaaggagacgttcgtgttctagcttatgaatttgcaaccatgggatctctacatgacattttgcatggtaggaaaggggtgcaaggagcacaaccggggcccgtgctcgattggacgcaacgggtgaagattgctgttgatgccgcaagggggttggaatacttgcatgagaaggttcaaccgtctataatacatagagatataaggtctagcaatgtgctattgtttgaagacttaaaagccaagatcgcagattttaatctttcgaatcagtcaccggacatggctgctcgtttgcattctactcgtgttcttggcacctttggctatcatgcaccagaatatgcaatgacgggacagttaacacagaagagtgatgtttatagctttggcgttgttcttcttgagcttttaaccggcaggaagcctgttgatcacacaatgccacgtggacaacaaagtctcgtcacttgggctactccaaggctaagtgaagacaaggttaaacaatgtgtagatccaaagctcaagggagagtatcctccaaaagcggttgcaaagttggcagctgtggcggcattatgtgtgcagtacgagtccgagtttaggcctaacatgagcattgtggtgaaggcccttcaaccacttctgaagacttctgcaccgccaccaccaccaccggaagaggagtaggcggcaataaattggtcttggtgatcgggtaattgtcacgtgaaattctgtacttccaccagcaaacagcatggttgtgttcatatgtagattctgcctccagccacctctatacaacgcttgcgtacgtccacacacacatagtgttttatccatttgattcttgcatttgagaaatacttttttgcagctgtctgttttgtttgttcggtttttaagaatgtggatatggtggaatttggttgtggtgatttgttgttatattgcatgaggttttctgcttcttttcaagatcttgatatttgtaatggtttt

SEQ ID NO: 6427 - DNA, 1593 bp, Helianthus annuus
cggggaccgcgtttttgcattgatgtcaatttaaaccgctattctttctctctctaaaactctcctctttgtaatcgctcgttacttatctgtcttttccccaaattctccatcatcaacaagccctaaatcaacaacccaacacagggatacgtgccgccacctggatactttatacgtttggtgaaactaagggctcaagacgatttaactttgacgaagagcgataggatgcggaggtggttgtgttgcacttgtcaagtcgaagaatcttacccttcgaacgacaatggcgtggtaaaaagccacaatgatcatgttgatggacagcaaaaggacagatcacaaccgaaagaaaaattcgatgcgcaaaaagaagtaccaacaatcgaagtgcctgcactttcgctcgatgaactgaaagaaaaaaccgagaattttggatcaaaggcgttgattggtgaaggttcatacggaagggtttattttgcagaattaaataatggtaaaagtgtggctgtgaaaaagcttgatgtctctaccgaggctgaatccaataacgagtttttgagtcaggtttcaatggtctcaaaactgaagcacgaaaactttgtcgagctgtgcggttattgtgtggaaggtaacacacgtgttttggcttatgaatttgcaacaatgggatctctacatgacatattacacggaagaaagggtgtgcaaggagcacaaccggggcctgtgttagattggatgcaaagagtacggattgccgtcgatgcggcaaagggacttgattatttgcatgaaaaggtccaaccttcgataattcatagggatattaggtctagcaacgtgctattatttgaggatcttagagccaagattgccgattttaatatttcaaatcaagctcccgatatggctgctcgtttgcattctactcgtgttttgggcacttttggctatcatgcaccggaatatgcaatgacgggacagctgacgcaaaaaagtgacgtgtatagctttggggtagttttgcttgagcttttaactggtcggaaacccgttgatcacacaatgccacgtggacaacaaagccttgtcacttgggcgacacctaggctaagcgaagacaaggttaaacaatgtgttgatccgaggctcaagggagagtaccctccgaaagcagtcgcaaagctggcggctgtggcggccttatgcgtgcaatatgagtctgagtttaggcctaatatgagcattgtcgtgaaagctcttcaaccgctgttgagggctcctgcaccagccgcgccagaagtataatgtaaaaagcatgaagaaaaataagcgaacttgttgtgaccgttgatctcctctgcagctttatgatcgtgaccgtagattctagttttatccaggcatatatatgtttttgtttgagaatatggatgggtgcctatgttcaaagtggtctgtattatatatctttggtttgtcaagatttgtttaataatttaaacctggttattgtctctacacatttgttttctttctatttctgcttgctaaaaaacaccaactttgtttaacgaaaaa

SEQ ID NO: 6428 - DNA, 1465 bp, Ambrosia trifida
caggaagagtactaagatggggtggttttgttgtacatgtctgttcgaagagtctaaccacaaatgacaatgaacctaaggatcaccagattacttggatggacaccaaaagggtccgaaagaacctcctgtcaaatctgcagtgcaaaaagtagtgccgccaatggaagtgccggcactttcattggaagaactgaaagaaaaaaccgatgattttggatcgaaggcactaattggtgaaggttcatatggacgagtctattttgcaaccttagataatggaaaaagcgtagctgtgaaaaactcgatgtttctactgaggttgaatcaaatgatgagttcttgactcaggtctccatgttctcgaatctgaagcatgaaaatcttatcgagctgcttggttactatgttgaaggagacattcgtgttctggcttatgaatttgcaaccatgggatctctacatgacattttgcatggtagaaaaggtgtgcaaggagcacaaccggggcccgtgcttgattggacgcaacgggtgaagattgctgttgatgcagcaagggggttggaatacttgcatgagaaggttcaaccgtctataatacatagagatataaggtctagcaatgtgctattattcgaagatttaaaagccaagattgcagattttaatctttcaaatcagtcaccagacatggctgctcgtttgcattctactcgtgttcttggcacctttggctatcatgcaccagaatatgcaatgacgggacaactaactcagaagagtgatgtttatagctttggcgttgttcttcttgagcttttaaccggcaggaagcctgttgatcacacaatgccgcgtggacaacagagtcttgtcacttgggctactccaaggctaagtgaagacaaggttaaacaatgtgtagatccaaagcttaaaggagagtatcccccaaaagcagttgcaaagttggcagctgtggcggcattatgtgtgcagtacgagtccgagtttaggcccaacatgagcattgtggtgaaggctcttcaaccactcctgaagacttctgcaccaccaccaccaccaccaccaccggaagaggagtaggccgctaaattagtcttggtgattggtcatccgtgtaacgtgaaattctgtacttccaccagcaaacagcatggtcgtgttcatatgtagattctgcctccagccacctctatacaacgctcgcgtgcgtgcacacacatttatagtgttttatccatttaagacttgcatttaagaaatactttgcagctgcctgtttgtttgttgtggttttaagaatgtggatatggtgggatttggtttgtggtgaatttttatattgcattgagtttttgcatcttttcaagatctttgatatttgtaatggttctgtaatgtaatactgttcattaatatgaaatgatttgtctttcaa

SEQ ID NO: 6429 - DNA, 839 bp, Linum usitatissimum
tggtccggtgctggactggatacagcgagtcagaattgcagttgatgctgcaaggggtttggaatacttgcatgagaaggttcagccttctataatacacagagatgtcagatcaagcaatgtgcttctatttgaggatttcaaagctaagattgcagatttcaacctatcgaaccaggcccctgacatggctgcacgcctgcattctactcgcgttctagggactttcggttatcatgctccagagtatgcaatgactggacaattgacacagaagagtgatgtttacagcttcggggtggttctcctcgaacttctcactggaaggaaaccagtcgatcataccatgccccgaggtcaacaaagtttagtcacctgggctactccaagattaagtgaagacaaagtgaagcaatgtgtggacccgaagctgaaaggagagtacccacctaaaggagtcgccaagttggcagcagtggcggcattgtgcgtgcagtacgaatcagagtttcggccaaacatgagcatcgttgtgaaggctttgcagccactgctaaaatctcaagtcccttctgccgttgctgctgccccagaatcctgaaaggagaaagatagaagggaatggaaggtaagctgaaggatgtgcctaaaggaatatgtggggtgatgtgtaataatgttgtggaacccgttgcagagtttgtcgtttgatgtgctataaaggaatttactatgagatgggctgtatttgattgttcttgatctatgtagagaatcaaattggtatgttgtttgtagatttgggaaaatggaggagctggttttggttgctggtgttc

SEQ ID NO: 6430 - DNA, 804 bp, Linum usitatissimum
gcagttgatgcagcaaggggtttggaatatttgcatgagaaagttcagccttccataatacacagagatgtcagatcgagcaatgtgcttctatttgaggatttcaaagccaagattgcagattttaacctatcaaatcaggcccctgacatggccgcacgtctgcattctactcgcgttctggggactttcggttatcatgctccagagtacgcaatgactggacaattgacacagaagagtgatgtttacagcttcggggtggttctcctcgaacttctcactggaaggaaaccagtcgatcataccatgccccgaggtcaacaaagtttagtcacctgggctactccaagattaagtgaagacaaagtgaagcaatgtgtggacccaaagctgaaaggagagtacccacctaaaggagtcgccaagttggcagctgtggcggcattgtgcgtgcagtacgaatcagagtttcggccaaacatgagcatcgttgtgaaggctttgcagccactgctaaaatctcaagtcccttctgctgttgctgctgccccagaatcctgaaaggagaagatagaagggaatgaaatggtaagctgaaggatgtgcctaaaggaatgtgtggggtgttgtgtaataatgttgtggaacccgttgcagagtttgtcgtttgatgtgctataaaggaatttactatgagatgggctgtatttgattgttcttgatctatgtagagaatcaaattggtatttgttgtttgtagatttgggaaaatggaggagctggttttggttgttggtgttc

SEQ ID NO: 6431 - DNA, 1625 bp, Tropaeolum majus
cggccggggatctatttccttcgaaagcacagcgctgcagagcataaacaacaacaaaccctttcgaagtccccacctatctctctctctcttttctctctttaccccaacccatctgaagaacctcaatttttttgttttgaaagaaatttaaacccttaagagtgtagaacgaaggcacatgaacccccacctggttactttttacggttggataaaccaagggccgaagacgatttgtatttgaataagaaatcaaagatgcgtaagtggttctgttgcacttgtcaagttgaagagtcgtacccatcaattgaaaacgagcacctcaaaagcccaaggaatcatgctgatggatatcaaagaggctcaaaggtggcggcacctctaaaacctgaagctccgaagacacctccacctattgaagtgccggcattgtctttggatgagctgaaagagaaaacagacaattttgggtcaaaggcattgatcggggaaggatcttatggaagagtgtattatgcaaacctaaacgacgacaaagccgtggctgttaagaagcttgatgttgcggccgaaccagagacaaacgtagagtttttgacgcaggtgtccatggtttctagattgaagcatgataatcttgttgagttgcttggttattgcgttgaaggaaaccttcgtgtgcttgcatacgagtttgcaacaatgggatctttacacgacattttgcatggtagaaagggcgttcaaggggcgcaacccggtccaacgctcgattggatgcagcgagtcagaattgcagttgatgcagctagagggttggaatacctgcacgaaaaagttcaatctcctataatacacagggatatcagatccagcaacgttcttctgtttgaagattttaaagcaaagattgcagattttaacctctcaaatcaagctcctgatatggctgctcgccttcattctacaagagtgttaggaacctttggttatcatgctccagagtatgcaatgaccggacagttgacgcagaagagtgacgtgtacagcttcggtgttgtcctactagagcttctgacagggagaaaacctgttgatcatacaatgcctcgtggccagcagagtctcgttacttgggctacaccaaggctgagcgaagacaaagttaagcaatgcgttgatccaaagctgaagggagaatatcctcctaaaggagttgctaagctggctgctgtagctgctttgtgtgtgcaatatgaagctgagtttcgaccaaatatgagcatcgtcgtgaaggcactccaaccacttttgaaggctccagcccaagcaccagtcgttgcggcaccagagacatgaaagaagcaaataaaccaaaagttggttggtttatttaatttttcgtttttcgattaaaaatttggcattgaatgtaaggtgtggtgagacgtggagagttgaaatatgactgttgtgagttgttgttgcctacgttgtggttattggttcttgagcgttgtcgtttgaagtcttgtattgatatttgtaacttcgtgttcgtcttttttgtactctctgagttcgggtctcttgttctatattgaagtggatgttttcgc

SEQ ID NO: 6432 - DNA, 1674 bp, Cucumis sativus
cttttgttcttttgcttcgccttgaatcgaaatccaaaatactcaaaatccttcgagaaaaaaaggaaaacaaacaaacaaacaaaccccatccattctcatctgttttttttgttgttctttcgcttcttcgtctaattcatccaccccataaaccatctacaggcttatgctcctccttttggttacttattacatccagataacaatactgaggattatcaatatcgaaggaagaaagtgaggatgcgcaagtggctttgttgtttttgtcaagttgaagagactaatcaatcaactgaaaatgaacacctgaaaagccccagtaattttggagatggtcatctaagggcctcaaaagtgccagctgttgttaaagctgaggcacagaaggcagcactaccaattgaagtgcctacactctccctggaagaactgaaagaaaagactgataatttcgggtccaaagcgttgattggagaaggttcttatggtagagtttattatgcaaccttgaataatgggaaaaatgtggctgtaaagaagcttgatgtttcatctgagcctgacagtaacgttgagtttttgactcaggtttctacagtatcaagattgaaacatgaaaatcttgttgaattgcttgggtattgtgttgaaggaaatatccgtgtcttggcttacgaatatgcaaccatgggatctttgcatgatgtcttacatggaaggaagggagtacaaggagcccaacctggtccagtgcttgattggatgcagcgggtgagaattgcagttgattcagccaaagggctggagtacttgcatgagaaggtccaacctgcaattatacaccgagatatcaggtccagcaatgtgctactctttgaggattttaaagctaaggtagctgattttaatctctccaaccaagcccctgatatggctgcccgtcttcattcaactcgagttttgggaacttttggttaccatgctccagaatacgcaatgactggacagttgactcaaaagagtgatgtatacagcttcggtgtagttctacttgagcttttgaccggtagggaaacctgtcgatcacacgatgcctcgcggacagcaaagtttagtcacctgggctactccaaggctaagcgaggacaaagtaaagcaatgtgtagatccaagacttaagggagaataccctcctaaaggagttgcaaagctagcagctgtggccacattgtgcgtgcagtatgaagctgagttccgaccaaatatgagcatcgttgtgaaggccctccaacctctattgaagccccccgcacctacaggcccccctgcaccagagtcttgacggcgatgtacatggtttcattcaccctctgagtttgaattcttgcaaatgcgtcaaatagttttactctaatatgcagcaacgatatttggtcgggtaacattatgcatatcccttttatttcattgtgtaaatgcctagtttggatgcgttagaattgcggtacggggttccgagtgtctggatgtgtgaagtatctgtttttgaataataatgatggagttatccccccaattgacattttattctgccttctcaaaactgcagagtgcagatttacctgaggctaaattaagtctttttttctcctcttatatttttgttct

SEQ ID NO: 6433 - DNA, 1424 bp, Ambrosia trifida
ttctcatacacccaatttaactaaacaaagccctaaatcaataacacagggacacgtgccacctggatacttcagacgtttggggaaacaaagggctcaagacgatttgatattgaggaagagagataggatgcggaggtggttgtgttgtacctgtcaagtcgaagaatctcatccctcaaatgacaatggattgatgaaaagccatagtgaccatgttgatgggcaccaaaaggacaaagtaccacctcctgccaaatttgatgcacaaaaaccagtgccaacaatcgaagtgccttcactgtcacttgatgaactgaaagaaaaaaccgagaactttggatcaaaagcattgatcggtgaaggttcatatggaagagtttactttgcaactttaaataatggtaaaagtgtggctgtcaaaaagcttgatgtttctaccgaggctgaatcagataacgagtttttgactcaggttgccatggtctcaacattgaagcacgaaaatcttgttgagttgtgtggttattgcgtggacggaaatacacgtgtcttggcttatgaatttgcaaccatgggatctctacatgacatattacacggcaggaagggtgttcaaggcgcacaaccggggcccgtgcttgattggatgcaacgggtaaagattgctgttgatgcagcaaagggactggattatttgcatgaaaaggtccagccttcaataattcacagagatgttaggtctagcaatgtgttactatttgaggatttaagagccaagattgctgatttcaatctttcaaatcaagcacccgatatggctgcacgtttgcattctactcgtgtcttgggaacttttggctatcatgcgccagaatatgcaatgaccggacagttgacgcaaaagagtgatgtgtatagcttcggggttgttctgcttgaacttctaactggtcggaaacccgttgatcacacaatgcctcgtggacaacaaagccttgtcacttgggctacaccaaggctgagtgaagacaaggtgaaacaatgtgttgacccaaggctcaagggagagtatcctccaaaagcggttgcaaagttggcggcggtggcagctttatgtgtgcaatatgaggctgagtttaggcctaatatgagcattgttgtgaaagctcttcaaccactcttgagggctcctgcaccagcagctccagaagtataatgtaatcaactaaccaaacgagtttgtgactgttgatttgcatatgcaccagctttatgaccgtagatttttacttgatcgaggcatataatagtgttatctttgcatttatattttttggtttgagaacgtgggtgattggtctgttgcatatgtttggtttgtcaagatttgttcaataatgattacatgtttctatggtgat

SEQ ID NO: 6434 - DNA, 1294 bp, Ambrosia trifida
aatcgctcattgcttatctgtcttttccccaatttctaaacaaatccctaaacacacaacacaggcatacttgctcccatttggatactttatacgtttgggtaaaccaagggctgacgacggtttaattttgaggaagagagataggatgcggaggtggttgtgttgtacttgtcaagtcgaagaatcttacccctcgaatgacaatggcttggtaaaaaatccacaatgatcatgttaatggacagcaaaaggacagagtacaaccgaaagaaaaatttgacgcacaaaaagaagtgccaacaatcgaagtacctgcactttcgcttgatgaactgaaagaaaaaaccgagaactttggatcaaaggcattgattggtgaaggctcatatggaagggtatattttgcaaatttagataatggaaaaagcgtggctgtgaaaaagcttgatgtctctaccgaggctgaatctgataacgagtttttgactcaggtttcgatggtctctaaactgaagcacgaaaactttgttgagttgtgcggttactgtgtggaaggaaatacacgtgttttggcttatgaattcgcaaccatgggatctctacatgacatattacacggtaggaagggcgtgcaaggagcacaaccggggcccgtgcttgattggatgcaaagagtaaggattgctgttgatgcagcaaagggacttgattatttgcatgaaaaggtccaaccttcgataattcacagagatattaggtctagcaatgtgctattgtttgaggatctgagagccaagattgccgattttaatctttcaaatcaagctcctgatatggctgctcgtttgcattctactcgtgttttgggcacttttggctatcatgcaccagaatatgcgatgacgggacagctgacacaaaaaaagtgacgtgtatagctttggggttgtttttgcttgagcttttaactggtcggaaacctgttgaccacacaatgccacgtggacagcaaagccttgtcacttgggctacacctaggctaagtgaagacaaggttaaacaatgtgttgatccaaggctcaagggagagtaccctccaaaagctgttgcaaagctggcggctgcggcagctttatgcgtgcagtacgagtctgagtttaggcctaatatgagcattgttgtgaaagctcttcaaccgctgttgagggctcctgcaccagcagctccagaagtataataatgtaaaaagcatgaaagaaaaataagacgaacttgtgtaccgttgttttcc

SEQ ID NO: 6435 - DNA, 1438 bp, Arnica chamissonis
cagttttctggttataatttcaacactgtaatggttaccagtcgtcattttcgtggtttagtgggatacgtgccccggcctggatactttatatgtttggggaaaccaagggctaaagacgatttaattctgaggaagagagataggatgcggaggtggttgtgttgtacatgtcaagtagaagaatcttaccatacaaacgacaatggcttggtaaaaagccacagtgataatgttgatggacaacaaaaggacaaagtaccacctcctgtcaaatttgattcacaaaaagcagtgccaacaatcgaagtgcctgcactttcacttgacgaactgaaagaaaaaaccgagaattttgggtcgaagtcactgattggtgaaggttcatatggaagggtttattttgcagatttaaataatggtaaaagtgtggctgtgaaaaagcttgatgtttctacggaggctgaatccaataacgagtttttgactcaggtttcgatggtctctaatctaaagcacgagaattttgttgagctgtgcggttactgcgtggaaggaaatacacgtgttttggcttatgaatttgcaaccatgggatctctacatgacatattacacggcaggaagggtgtgcaaggagcacaaccaggccccgtgcttgattggatgcaaagagtaaggattgctgttgatgcagcaaagggacttgattatctgcatgaaaaggtccaaccttcgataattcacagagatataaggtctagcaatgtgctattatttgaggatctaagagccaagattgccgattttaatctttcaaatcaagctcctgatatggctgctcgtttgcattcgactcgtgttttgggtacttttggctatcatgcaccagaatatgcaatgactggacagctgacacaaaaaagtgacgtgtatagctttggggttgttttgcttgagcttctaactggtcggaaacctgttgatcacacaatgccacgtggacaacaaagccttgtcacttgggctacacctaggctaagtgaagacaaggttaaacaatgtgttgatccaaggctcaagggagagtaccctccaaaagcagtcgcaaagctggcggctgtggcggctttatgtgtgcaatatgagtctgagtttaggcctaatatgagcattgttgtgaaagctctgcaaccactgttgagggctcctgcaccaacaactccagaagtataatgtaataaacaagaacaataaacgaatttgtgacagttgatttcctccgcagctttatgatcgttaccatagattttggtttgattaaggcatatatattttgattttgctttgagaatatgaatgtgtgcttatgttcagattggtctgttatacatcttttgtttgtcaagatttgttcaataattgaaacctgcttttt

SEQ ID NO: 6436 - DNA, 1383 bp, Arnica chamissonis
ccaaaagtgacaacacaagacagggacacgtgccgcctggatactttagacgtttggggaaaccaagggctcaagacgatttaatattgaggaagagagataggatgcggaggtggctgtgttgtacttgtcaagtggaagaatcttatccctcaaatgaaaatggcctgataaaaagccacagtgatcatggtgatgggcagcaaaaggacaaagtaccacctcctgtcaaatttgatgcacaaaaagcagtgccaacaattgaagtgccagcactttcacttgatgaactgaaagaaaaaaccgagaattttggatcaaaagcattgatcggtgaaggttcatatggaagagtttatttcgccaatttaaataatggtaaaagcgtggctgtcaaaaagcttgatgtttctactgaggctgaatcagataacgagtttctgactcaggtttccatggtctcaacactgaagcatgataattttgttgagctttgtggttactgtgtggaaggaaatacacgtgtcttggcttatgaatttgcaaccatgggatctctacatgacatattgcatggcaggaagggtgtgcagggagcacaaccggggcctgtgcttgattggatgcagcgggtaaagattgctgttgatgcagcaaagggactggattatttgcatgaaaaggtccagccttcaataattcacagagatattaggtctagcaatgtgctgttatttgaggatttaagagccaagattgctgatttcaatctttcaaatcaagcacccgatatggctgcgcgtttgcattctactcgtgttttgggaacttttggctatcatgcaccagaatatgccatgacgggacagttgacacaaaaaagtgatgtctatagcttcggggtcgttctgcttgagcttctaactggtcggaaacctgttgatcacacaatgccacgtggtcaacaaagccttgtcacttgggctacaccaaggctgagtgaagacaaggtgaagcaatgtgttgatccaaggctcaagggagagtaccctccaaaagcagttgcaaagctggcggccgtggcagctttatgtgtgcaatatgagtctgagtttaggcctaatatgagcattgttgtgaaagctctccaaccgctgttgagggctcctgcaccaacagctccagaagtataatgtagatgactgagaacgaacgaattttcgactgttgatttgcatctgcagcagctttatgaccgtaggtttttggttttgattgaggcatataatagtgttgcatttatattttttgtttgagaacatgatgcgtgcttatgttcagattggtatgttacctatctttggtttgtcaagattcattcga

SEQ ID NO: 6437 - DNA, 1505 bp, Cirsium arvense
gaactaactacgagaagagatcgagtatttaaacacaccctttatctctctctctctctctctctcaatcatatctctctgcacctttcttgcttacctgtgttccctaatattcaatcacccaaaaaacataattaacacaaaaccctaaaatcaagaaagccaacgaaacagttcaaggcgacagaaaaatcaggtgcatgcaccttctggatgctttgtgcatgtggggtaaaaaagagctgaaaacggtcttattttttaggaactaaaataggatgcggaggtggttgtgctgtacttgtcaagttgaagaatctgcaccatcaaatgacaatgaattcgttaagaattcatcggatcatggggatggacaccaaaagggttcgaaaggatctcctatcaaatctgaagtgcaaaaagcagtgccaccaatggaagtgcctgcacttccattggaagaactgaaagaaaaaactgacgattttggatcaaaggcactcattggtgaaggttcatatggaagagtttattttgcaaccttaaataatggaaaaaatgtggctgtgaaaaaacttgatgtttctactgaagctgaatcggataatgagttcttgacacaggtttccatgttctcaacgctaaagcatgagaatcttatcgagttgttcggttactgtgtcgaaggaaatgtacgtgtcctggcttatgaatttgcaacaatgggatctctacacgacattttgcatggtaggaagggtgtgcaaggagcacaaccagggccggttcttgattggatgcaacgagtaaagattgctgtggatgcagcaaggggactcgagtacttacatgagaaagcccaaccgtctataatacacagagatataaggtcgagcaatgtgctcttatttgaagacttgaaagccaagattgccgactttaacctttcgaatcagtcaccagatatggccgctcgtttgcattctactagagtcttgggcaccttcggctatcatgcaccagaatatgcaatgactggacagctaacacagaagagtgacgtttatagctttggggttgttctgcttgagcttctaacaggccggaaacctgttgatcacaccatgcctcggggacagcagagtcttgtcacttgggctactccaaggctaagtgaagacaaggttaaacaatgtgttgatccaaaactcaagggagaatatccttcaaaagcagttgcaaagttggcagctgtggcagcattgtgtgtgcaatatgagtctgaattcaggcctaatatgagcattgtggtgaaggctcttcagccacttctcaaggcttcttctgcaccagcaccagcatcagctgaggtggtgtagaaaccaagacaaagcatgggtgtgttcatctgtagattctatctccatctctatctatacaacacacacacacacacacatctatatatatatcatgcatatagcgtttgattcttgcgttttgag

SEQ ID NO: 6438 - DNA, 1523 bp, Flaveria ramosissima
gtgcaaacaaaactaaattattgaaatgttttgattccgcgtttttgcattgatggcaatttaaacccctctctctttctctttgtaatcgctcattgcttatctgtctttccccaatttctccatcatctaatctcaacaacacaataaaaacaaagccctaattcaagaatccaaaactcacaacccaacacaccacaccacaggaatacttgccttcacctggatactttatacgtttggggaaaccaagggctcaagacgatttgattttgaggaagagggataggatgcggaggtggttgtgttgtacttgtcaagttgaagaatcttacccttcaaatgacaatggctttgtaaaaagccacaatgatcatattgatgggcaccagaaggacaaagtaccacctccggccaaatttgatacacaaaaagcagtgccaacaattgaagtgcctgcactttcacttgacgaattgaaagagaaaaccgagaattttggatcaaaggcactgatcggtgaaggttcatatggaagggtttattttgcaaatctagataatggtaaaagtgtggctgtgaaaaagcttgatgtttctacggaggctgaatcagataatgaatttttgactcaggtttccatggtctctaaactgaagcatgaaaattttgttgagctgtgtggctactgtgtggaagggaatacacgtgttttggcttatgaatttgcaaccatggggtctctacatgacatattacacggcaggaagggtgtgcaaggagcacaacctggtcccgtgcttgattggatgcaaagagtaaggattgctgttgatgcagcaaagggacttgagtatttacatgaaaagttccaaccttcgataattcacagagatattaggtctagcaacgtgctattatttgaagatttaagagccaagattgcggattttaatctttctaatcaagctcctgatatggctgctcgtttgcattctactcgtgttttgggtacttttggctatcatgcaccagaatatgcaatgactggacagctgacacaaaaaagtgatgtgtatagctttggggttgttttgcttgagcttctgactggtcggaaacctgttgatcacacaatgccacgtggacaacaaagtcttgtcacttgggctacacctaggctaagcgaagacaaggttaaacaatgtgttgatccaaggctcaagggagagtaccctccaaaagcagtggcaaagctggcggctgtggcagctttatgtgtgcaatacgagtccgagttcaggcctaatatgagcattgttgtgaaagctcttcaaccactgttgagggctcctgcaccaacagctccagaagtatgatgtaaaaaccaagaagaaaataatcaaattcgtgagccgttgatttcctgcagctgctttatgaccgtagattttcgtttaatcgaggcatatatatattttggttttggtttgagaatattgttatgtgcttatgttcagatt

SEQ ID NO: 6439 - DNA, 1417 bp, Flaveria ramosissima
ttgcttatctgtctttccccaatttctccatcatctcaacaacacaacacaacacaataaaaacaaagccctaattcaagaatccaaaactcacaacacaccacaggaatacttgcctccacctggatactttatacgtttggggaaaccaagggctcaagacgatttgattttgaggaagagggataggatgcggaggtggttgtgttgtacttgtcaagtcgaagaatcttacccttcaaatggcaatggctttgtaaaaagccacaatgatcatattgatgggcaccagaaggacaaagtaccacctccggccaaatttgatacacaaaaagcagtgccaacaattgaagtgcctgcactttcacttgatgaattgaaagaaaaaccgagaattttggatcaaaggcactgatcggtgaaggttcatatggaagggtttattttgcaaatttagataatggtaaaagtgtggctgtgaaaaagcttgatgtttctacggaggctgaatcagataacgaatttttgactcaggtttccatggtctctaaactgaagcacgaaaattttgttgagctgtgcggctactgtgtggaagggaatacacgtgttttggcttatgaatttgcaaccatgggatctctacatgacatattacacggcaggaagggtgtgcaaggagcacaacctggtcccgtgcttgattggatgcaaagagtaaggattgctgttgatgcagcaaagggacttgagtatttacatgaaaaggtccaaccttcgataattcacagagatattaggtctagcaacgtgctattatttgaagatttaagagccaagattgcggatttcaatctttctaatcaagctcctgatatggctgctcgtttgcattctactcgtgttttgggtacttttggctatcatgcaccagaatacgcaatgactggacagctgacacaaaaaagtgacgtgtatagctttggggttgttttgcttgagcttctgactggtcggaaacctgttgatcacacaatgccacgtggacaacaaagccttgtcacttgggctacacctaggctaagtgaagacaaggttaaacaatgtgttgatccaaggctcaagggagagtaccctccaaaagcagtggcaaagctggcggctgtggcggctttatgtgtgcaatacgagtccgagttcaggcctaatatgagcattgttgtgaaagctcttcaaccactgttgagggctcctgcaccaacagctccagaagtataatgtaaaaaccaagaagaaaataaacaaattcgcgagccgttgacttcctgcagctttatgaccgtagattttcgtttaatcgaggcatatatatattttggtttgagaatattgttatttgcttatgttcagattggtc

SEQ ID NO: 6440 - DNA, 1572 bp, Lippia dulcis
ttctcagtagacggagtcgcgcacacgcagagaaataaaggctcaggcacctcctcctggttactttgtacgcttggagaacaagagtgctgaagacaaaatctatctgacaaagagaacaaggatgcgtaggtggctgtgctgcacctgtcaagtagaggaatcctaccaaccccatgaaaatgagcacctcaagagtccaagaaatcaggctgagggtatccagagaggctctaaggcatcagctcctgtgaagcctgaggtgcagcagaaggcagtacctcctattgaggtgccttcgctctctcttgaggaactgaaagagaaaacggataattttgggtccaaggcattaattggtgaagggtcatatggaagagtatactttgcacaattgaacagcggagatgaggttgccgtcaagaagcttgatgtgtcatctgagcctgattcaaatgttgagttcttgacgcaggtttccatggtgtcaagattgaagcacgaaaatcttgttgaactacttggttattgtgtagatggcaatctgcgtgtcttggcctatgagtttgcgacaatgggatctttacatgacattttacatggaaggaaaggagtgcaaggtgcacagcccggtcctgtacttgactggatgcaacgagtaagaattgcagttgatgctgcaagggggctggaatatttacatgagaaggttcagccttcaataattcatagagatatcagatctagcaacgtacttctgtttgaagactacaaagcaaagatcgcggattttaacctatcaaatcaggctcctgacatggctgctcgccttcactctactcgagttctaggaacatttggttatcatgcgccagagtatgcaatgacaggacaactgactcagaagagtgatgtttatagctttggggttgttctgcttgagcttctgactggaaggaaacctgttgatcataccatgcctcgtggacagcagtctcttgttacttgggccactcccagactgagtgaggacaaagtcaaacaatgtgtcgacccaaagcttaagggagaatatccgccgaaaggggttgccaagctagcagctgtagcagctttgtgtgtgcagtatgaagctgaattccgcccaaatatgagcattgttgtcaaggcactgcaacctctcttgaagtcgactgttcctgctcctgagaattagtactgatattatgttcatttggtcatggtgtttggttttgtgaggttttgcacagtttgcgtgccttttccatgaattgcaattatcgcatttttcttactattttctgttccctgggtatgaaatgttggattggtgcgccgtgatttcatttctttgtcagtgttgatgccctacgagtcatgaattggcataaaggattgcgtattttgcttcgacataagggttatgcgttccgttcttaaacagagtgatttacttctgttttttattgcttgagttgatgatttgtattgttgtcattgaatgtacaagattacaagttattcatgccattcaatttagcatggtgacga

SEQ ID NO: 6441 - DNA, 621 bp, Scabiosa columbaria
cacgagaaggtccaaccttccattatacatcgagatataagatccagcaatgtcttattgtttgaagactttaaggccaagattgctgattttaacctttctaaccaagctcctgacatggctgctcgccttcattctacccgtgtccttggcacgtttggttatcatgcacctgagtatgcgatgactggacagttgacacagaagagtgacgtgtatagctttggcgtggttctacttgaacttctgaccggtaggaaaccagttgatcacacaatgcctcgtggacagcagagtcttgtcacttgggcaactccaaggctaagcgaagacaaagttaaacaatgtgtggatcccaagcttaaagtttatccaccaaaagcggttgcaaagatggcggctgtggcagcattgtgcgtgcaatacgagtcagagtttaggccaaacatgagcattgttgtcaaagcccttcaaccacttctaaaagctcctgcaccaccacctcctgaggctgaggcttagtagttatcagtcatatttgaaactaaacttgctatgcataatttgtgcgtaatttgcggttattttgcttgttcatgagtcgtgcacctgcgtatctaa

SEQ ID NO: 6442 - DNA, 867 bp, Thalictrum flavum
gagttagaattgctgtggaagctgcaaggggattggagtatctgcatgaagattcaaccatctataatacatagggacatcagatcaagcaatgtgcttcggtttgaacgattttaaagccaaaatagcagactttaatctattaaatcaggctcctgatatggcagctcgtttgcattctactcgagttttgggtacctttggctatcatgcacctgagtacgcaatgactggacaattgacacaaaagagtgacgtatatagttttggtgttgttcttttggagcttctgacaggaaggaaacctgttgatcacactatgcctcgtgggcagcagagtcttgtcacttgggcaacaccaaggctgagtgaggacaaggtgaaacagtgtgtggatccaaagctaaagggagattatccaccaaaaggagttgctaagctagctgctgtggccgcactgtgcgtgcagtatgaatctgagttcaggccgaacatgagcatcgtcgtcaaggctctccaaccattacttaatcagaaacctcctgccccagctcctgagacatgaatggatgtgtaaatgatgtcatcataccacatgtttgcactttgtgcatggtttgctttttccctgcagatttggtcctcaatcatataatatacttttattgttgcattgtgattggatgagccattacaggtgtttgaattctgtttgtttgtggctttatggtggtagtcacaaatccaaactgttgtcggattgggttgtggtggatgcatttcctcaatattgtttttacaaacttgttatttttccttatttattggtgttcatacaaaaccaggattctggataatataattgct

SEQ ID NO: 6443 - DNA, 1708 bp, Aquilegia formosa
ctctccaaaaaaagaagaaaacaagagagagaataaaacctctctctctctctctctctctcttttcttgaaaactagtttgttgtgtttttcccggtttttgcgaattccaacccaacaggcttctctcgaagacccattcaagcaaaccaggcaaatgctcctcctcatgttttatctgatataaggaagagggacaagatgcgtcggtggctttgttgtacttgtcatgttgaggagtcttaccatccagctgaagatgaacccttgaaaagcccaaggaatcatgctgatgcgtatcagaaaggatcaaagcttactcctgttaatgctgaagcacacaaagtaccaccaactgtagaagttcctgatctgcctttggatgaactgaaagagaaaactgataattttgggtcaaagtcattaattggtgaaggttcttatgggagagtatactatgcaaatcttgacagtggcaaagctgtggcaataaagaagctagatgtttcatctgagacagattccaattacgaatttttgtcccaggtctcaatggtgtctaggttgaagcatgacaatcttgttgagttgcttggttactgtgtcgaaggcaatattcgcgtcttagcatatgagtttgcaaccatgggctcgctacatgatattttgcatggtaggaaaggagttcaaggtgcacaaccaggtcctgtgcttgactggatgcagcgagtgagaatcgcagttgaggcagcaaggggattggagtatctgcatgagagaattcaaccatctataatacatagggacatcagatcaagcaatgtacttctgtttgaagatttcaaagccaaaatagcagactttaatctattaaatcaggctcctgatatggcggctcgtttgcattctactcgagttttgggtaccttcggctatcatgcgcctgagtacgcaatgactggccaattgacgcaaaagagtgacgtatatagttttggtgttgttcttttggagcttctgacgggaaggaaaccagttgatcacactatgcctcgtggacagcagagtcttgtcacttgggcaactccaagactgagtgaggacaaggtgaaacagtgtgtggatccaaagctgaagggagactatccaccaaaaggagttgctaagctagctgctgtggctgcattgtgcgtgcagtatgaatctgagttcaggccaaacatgagcatcgtcgtcaaggctctccaaccgttacttaatcagaagcctcctgccccagctcctgagacatgagatgatgtgtaaatgatgtcatcatattacatgtttcgctttgtgaatggtttgctttttttctgcagatttggtcttcaatcatataatatacttttattgttgcattgtgattggatggagccattacaggtctttgattgttctgtttgttggattgggttgtggtggatgcatttcctcaatatttttaaggacttgttattttcccccatttattggtgttcatacataaccgggattctgaataatatgtttgcattatggaagatatatatattattcatatgagttgtatcagttctaatgaaaattaaggaaaatgggattcttgggtaccataaacatgattatagacttatggtatgataccgttgggtgaattgtgtttggacttgatcaagattagttgctg

SEQ ID NO: 6444 - DNA, 1590 bp, Artemisia annua
tctttatattaaaaaaaaaaaacccccaaaatcaagaaaacccccaatttgacaacacaagacagggcgcgcctcctcctggatactttcgacgtttggggaaacaaagggctcaagacgatctaattttgaggaagagagataggatgcggaggtggttgtgttgtacttgtcaagttgaagagtcttacccctcaaacgacaatggcttggtaaaaagccatagtggtggtcatgctgatggactgcataacaccaaagtacaaccttctgtcaaggttgatccgaacaaagcagtgccaacaatagaagtgcctgcactttcacttgatgaactgaaagaaaaaaccgagaattttggatcaaaggcattgatcggtgaaggttcatacggaagggtttattttgcaaacttgaataatggaaaaagtgtggctgtgaaaaagctcgatgtttctactgaagctgaatcaaataacgagtttttaactcaggttgccatggtctcaacgctgaagcacgacaatcttgttgagttatgcggttactgtgtcgaaggaaatacccgtgttttggcttatgaatttgcaaccatgggatctctacatgacatattgcacggtaggaagggtgtgcaaggagcacaacctggacccgttcttgattggatgcagcgagtaaagattgctgttgatgcagcaaagggactcgattatttgcacgagaaggtccaaccatcgataattcacagagatattaggtctagcaatgtgctattgtttgaggatttgagagccaagattgccgatttcaacctttcaaatcaggctccagatatggcagctcgcttgcattctactcgtgttttgggaacttttggctaccatgcaccagagtatgcaatgactggacagctgacacaaaaaagtgacgtgtatagctttggggttgtgctgcttgaacttctaaccgggcggaaacctgttgatcacacaatgccacgtggacagcagagtcttgtcacttgggctacaccaaggctaagcgaagacaaggttaaacaatgtgttgacccaagactaaagggagagtaccctcccaaagcagttgcaaagctggcggctgtggcagctttgtgtgtgcagtatgaggcagaatttaggccaaatatgagcatcgtggtgaaggcgcttcaaccactattgcgggctcctgcaccagctgctgctccagaagtgtaatgtaaagaacaacaaaacagaactgagtttcagtgaacgtttgattgtgtctgcagctttgcgactgtagattttggtttgattgaggcatataaataggttttatctttgcattatattttttggtttgagaacatcggatgtgcacttatgttgggattggcatgttacatatctttcagtttgtcgtgaataatgaaacatggtttttatggtgatatatttgcaacttttaagtgattttaatgtttctagtggatatatttattgtagtatattggaatgtaacattttatatatacaattgtacatgtaatgatttaattgaattcctgaaggttgttgaggt

SEQ ID NO: 6445 - DNA, 1212 bp, Artemisia annua
gggagtacctgcactttcgttggaagaactgaaagaaaaaactgaggattttgggtcaaaggcactaattggtgaaggttcatatggaagagtctattttgcaactttaaacaatggaaaaactgttgctgtgaaaaagcttgatgtctctaccgaggctgaatcaaacaacgagttcttaacacaggtctccatgttctcaaacctgaagaatgacaatcttattgagttgctcggttactgtgttgaaggagatgtccgtgtcttggcttatgaatttgcaaccatgggatctctacatgacattttgcatgggaggaagggtgtgcaaggagcacagccaggccctgttcttgattggatgcaacgggtaagaattgctgttgatgcagcaaggggactggagtacttgcatgagaaggctcaaccttcgataatacacagagatattaggtctagcaatgtgctcttatttgaagacttgaaagccaagattgccgacttcaatctttctaatcaatcaccagacatggctgctcgtttacattctactcgtgtcctcggcacctttggctatcatgcaccagaatatgcaatgacgggacagctaacacagaagagtgacgtgtatagctttggtgttgttcttctcgagcttttaactggcagaaagcctgttgatcacactatgccacgtggacagcagagtcttgtcacttgggctactcctaggctaagcgaagacaaggttaagcaatgtgttgatccaaagcttaagggagagtatcctccaaaagcggtggcaaagttggcagctgtggcagcgttatgtgtgcagtatgagtctgagtttaggcccaacatgagcattgtcgtgaaggctcttcaaccacttttgaaggctactgtaccagtgccagcgccggcggaggcagaggtggaggcggaaatttgacaaatgcgtgttggttattggtcatagtgtaacgggaaattctgcagttgcaccgaaaaacaagcatgggagtgctcatctgtagattccgcctccggccacctatatatacatttatacaactatttacatataacccattttatatattgcatttgagaaatactattgggccgcctgatttttatttgtctggacagagtggaatttgattttgtggtgatttgtcatatcaaatgaggttttctgcttactaa

SEQ ID NO: 6446 - DNA, 1552 bp, Tragopogon dubius
acctgtgttccctaatattcaatcaccggcaaatcataatcaacacaaaaccctaaatcgagaaagccaacggacacagttcaagcagacaaaaagaaaggcgcatgttcttcattctggataatttatacgtgtggggaattaaagagttgaggagggtcgactttaaggaagaaaaataggatgcggaggtggttgtgttgtacttgtcaagttgaagagtcttacccatcaaatcgcaatgaacccgtaaagaatcccactgattacacagatgggcatcaaaagggttcaaaaggatctcctattaaacctgaagtccaaaaagcagcgccacctattgaagtgcctgaactttcattagaagaactaaaagaaaaaaccgatgattttggatcaaaggcattaattggtgaaggttcatatggaagggtttattttgcaaccttaaataacggaaaaaccgtggctgttaaaaaacttgatgtttctaccgaagccgaatcaaataatgactttttgtctcaggtttccatgttctcaacattgaagaatgacaatttgattgagttgcttggttattgtgtggaaggaaatgtccgtgttcttgcttatgaatttgcaaccatgggatctctacatgacattctacatggcaggaaaggggtgcaaggagcacaaccagggccagttcttgattggatgcaacgtgtaaagattgctgtagatgcagcaagggggctcgagtacttgcatgagaagacccaaccatcaataattcacagagatattaggtcaagcaatgtgcttttatttgaagacttgaaagccaaaattgccgattttaacctttcaaatcagtcacctgacatggctgctcgtttgcattctactcgtgtcttgggcacctttggctatcatgcaccagaatatgcagtgactggacagttaacacagaagagtgacgtgtatagctttggagttgttcttcttgagcttttaactggtcggaagcctgttgatcacacaatgccacgtggacaacagagtcttgtcacttgggcaactccaagactaagtgaagacaaggttaaacaatgtatagatccaaagctcaagggagagtatcctccaaaagcagttgcaaagttggcagctgtggcggcattatgtgtacagtacgagtctgaatttaggccaaatatgagcattgtggtgaaggctcttcaaccacttctgaaggcttctgcaccagcagcagcacccgaggtcttaacggaatgagtcatgaaaaatttcattggaaaacaagcatgggtgtgttcatctgtagattctgcttttggttatatatacacacatataatatatacgtatagcgttttatccatatgattcttgcatttgatggggggtttcaagaataatggggatagatttgattttggttttgtggggattcgttatgttacatgaggttttctgcttgcttttgatcttgtattgattttgatttattgttatgagatgaaagagttggtatttctaacct

SEQ ID NO: 6447 - DNA, 1784 bp, Populus trichocarpa
aacagaaaataattatttgctttattcttctttccgcgttgcctatctgtctttctctctctcccaaatataaacccaagaagaaatttccaaaccctaaaaaaaaaacacacacgcatacagacaggcacatgcaacatctcctgggtactttgcacgatttgagagaacaggtggtggcgaagaggaattatttctgaagaaaagaggcaagatgcgtcggtggctctgctgtacctgtcaggtagaggagtcttaccaagaacatgagaatgagcgcatcagaagcacggggaactttggtgatgggtatcctaaaggctcaaaagtatcagctcctgccaaagcagaagtacagaaggaagcaccacctgttgaagtgcccgtgttgtctttggaagaactgaaagaaaagacagataatttcgggtcaaaggcattgattggtgaaggttcctatggaagagtttattatgcaaacttagaaaatggaaaagctgtggccataaagaaacttgatgttgcaagcgagccagagacaaatgttgaatttttgacccaggtttccatggtgtcaagattgaaacatgaaaattttgtggagttactcggttactgtgtagaaggaaatcttcgagtgcttgcatatgagttcgcaacaatgggatccctccatgacatattgcatggtaggaagggagttcaaggtgcacagccaggaccagttcttgattggatgcagcgagtgagaattgctgtcgatgcagcaaggggaatggaatacttgcatgagaaggtacaacctgctgtaatacacagagatgtcagatcaagcaatgtgcttctgtttgaagacttcaaagccaagatcgcagattttaacctttcaaatcaggctcctgacatggctgctcgccttcattcaactcgagttttaggaacctttggttatcatgctcctgagtatgcaatgactggacaattgacacagaagagtgatgtttacagttttggagtagttctcctagagcttcttactgggaggaaacctgttgatcataccatgccacgcggacagcagagtcttgttacatgggctacaccaagactgagtgaagacaaagttaaacaatgtgtagatccaaagctgaaaggagaatatccccctaaaggagttgccaagctggcagctgtggcagcgttatgtgtgcagtatgaagctgagttccggccaaatatgagcattgttgtcaaggctctccaaccacttctgaaggctcccgctgtcgctgtcgctcctgctcctgctccagagacctaaaccaaagaaatcagtttcttgtgttggaatttctgcaacttgcacagtctggtttcatgcggatttctgctgacaactctatatgtttttaaaatttttaatatatgagatcggatgtgtaggtttggggtgtgctgtttagtgctactggtaagaattctgtctgttgcttgctggtatcgctccgggctgctgataaaaaaaaaatgttgattactgtttgctttcaaacgattcttttgtgctcattaacaaatgttgttcataatttactgaaaccttgcggcaatgcccttctgctgggctgcagcccttttcattcctttctcttctcctagcctgggctatactgtacatgttctattggaggcgaggcttcttgacttgagctgaatttgtttttttattcattcctccattgatgacttttttgaattatggaatggttttcttgcttccagaa

SEQ ID NO: 6448 - DNA, 1501 bp, Cucurbita pepo
aggagaggctctaaccagaaggcgcatgcccctcctcctggttacttcatacgtttgaacaatactggatcaaaagacgatttatatctaagtaaaagggatagaatgcgcaggtggctttgttgtgcttgtcaagttgaagaaccctacccatcagcggaaagtgagcacctaaaaagcccaggaagttatggagatggtggtcaccaaaaggtctcaaaagagccagcttctcacaaatctgaagcaccaaaagctccacctcccatagatgttccagcgttgtctctggaagaattgaaagaaagactgacaacttcgggtccaaggcattgattggtgaagggtcttacggtcgagtttattatgctagattaagcgatgggaaactgtggcagtaagaagctggtgtttcctccgagcctgactcgagtgtcgacttttgactcaggtttctacagtctcaaggttgaaacatgaaaattttgttgagttgcacggatactgcgttgaaggaaatctccgtgttcttgcatatgagtttgcaactatgggttctctacatgacgtattacacggtagaaagggagtgcaaggggcacagcctggtccagtgcttgattggatgcaacgtgtgagaatcgctgtcgatgcagctagaggattggagtacttgcatgagaaggttcaaccttctatcatacatagagatgttagatccagcaatgtgcttctttttgaagagtacaaacaaagattgcagactttaacctttctaaccaagctccggacatggctgcacgacttcattctactcgagttttaggaacttttggctaccatgctccagagtatgctatgacaggacaattgacacaaaagagcgatgtctacagctttggagtcgttctactcgagcttttgactgggaggaaacccgttgatcacaccatgcctcgcgggcagcagagtcttgttacttgggctactccaaggctaagtgaagacaaagttaaacaatgtgttgatccaaagctgaagggtgaatatccacctaaaggagtcgccaagctggctgctgtggcagcactgtgtgtgcaatatgaagccgagttcaggccgaacatgagcattgtcgtcaaggctctccagccgcttctaagccacctacggctatgcctgcatcgtctcctgaaccttgaagtaaattgatatcgattttcttcctcactgttgatatatgtcagcctacattgcaaagtttggttcatggtgatcataaagaattcatatattcattatttgttccaattattattgttgttttcccttgaagatcctcgagtcatgtttagccctcagttctaaatgtttttcctatttcgtttttggagtatgagactgtgggagtggatgctatgggggaaacactacgtatgattattatttactttccccctcgctcttttgatatcaatggatatgggttggtcttttcagc

SEQ ID NO: 6449 - DNA, 823 bp, Cucurbita pepo
tcaagcccctgatatggcagcccgtcttcattcaactcgagttttgggaacttttggttaccatgctccagagtatgcaatgtctggacagttgacacagaagagtgatgtatacagctttggtgtagttctacttgagcttttgactggtaggaaacctgtcgatcacacgatgccccgcggacagcaaagtttagttacctgggctaccccaaggctaagcgaggacaaagtgaagcaatgtgtagatccaagactaaagggagaataccctcctaaaggcattgcgaagctagcagcggtggctgcattgtgtgtacagtacgaatctgagttccgaccaaatatgagcatagttgtgaaagccctccaacctcttttgaagccccccgcacctaccggtccccctgcgcctgtgtcttgatggcaatgtacatggtttcatccccccgagtttgaattctgctttgaatagtttctctcttatatgcctacgatatttggtcgggatagctttacgcatatcccttttatttgcttgtgtaaatggtgagcttggatgtggtagaccggtttcagagtcttgggagacttctaagaagagtgatggtagctgaatgtgtggagaattgtctgtttctgaatattaatggaggcccctcattgacacactctgccttctcaaaactgtagagtgcagattcacctgaggctattaggtctttcttttatattattttgttcttacaactctgatactaaaactaaaaacttgtctttgtaagtatttcacttaatataacaaaatagaaataggaaccta

SEQ ID NO: 6450 - DNA, 1006 bp, Momordica charantia
tgtctctggatgtaacttgaaagaaatgactgataattttggatccaaagcattgattggtgaaggttcttatggtagagtttactatgcaaatttgaataatggaaaaaatgtgactgtaaaaaagcttgatgtttcatctgagcctgacagtaacatcgagtttttgactcaggtttctactgtatcaagattgaaacatgaaaatcttgtcgaattgctcgggtattgtgttgaaggaaatcttcgggtgttggcatatgaattcgcaaccatgggatctttgcatgatgtgttacatggcaggaagggagtacaaggagcacagcccggtccggtgctcgactggatccagagagtgagaattgcggttgatgcagccagagggctggaatacttgcatgagaaggttcaacctccgattatacaccgagatatcaggtccagtaatgtacttctcttcgaggattttaaagcaaaggtagctgattttaacctctccaatcaagcgcctgatatggcagcccgtcttcactcaactcgggttttgggaacttttggttatcacgctccagaatacgcaatgactggacagctgacacagaaaagcgatgtatacagctttggtgtggttctacttgagcttttgacgggtaggaaacccgtcgatcacacgatgccccgtggacagcaaagtttagtcacctgggctactccaaggctaagtgaggacaaagtcaagcagtgtgtagatccaagactaaagggggaataccctcctaaaggagttgcaaagctagcagccgtggccgctttgtgcgtgcagtatgaagctgagttccgaccaaatatgagcatcgtcgtgaaagctctccagcctcttctgaagcccgtcactcctgccggtcctcctgcacctcagtcttgatggcaatgtacatggttcccacccccgagttcaaattcttcttgtgtatgcttcgaatagttttactatcctcgtatg

SEQ ID NO: 6451 - DNA, 1761 bp, Gossypium hirsutum
acccttcaaaaatcatcaagactcttgccaatttctgttactctgtacatctctctgtctctgtttcttactaaatccttcttcacaaaatcgaaaaaatagaaaaagaaaaaactaacaacaaattctagaacagaaggagtgctgatttttcaacaattaaaaagttagagagaagaaaagccagggacaggcacctcctcctggctactttgttcgactagaaaattccgacaatttgtatttgaagaaacgaacaagaatgcgtcgatggctttgctgttcgtgtctggttgaggatacttaccaatcacatgaaaatgagcacttgaggagccccaactataatacagaagggaatcaaaagaactcaaaggcggcagcccctcccaaggccgaagtgcaaaaatcagcaccacctatcgaagtgcctgcattatcattggaagaattgaaagaaaagactgacaatttcggatcaaaggctttgattggtgagggttcatatggaagagtttattatgcaaacttggacaatggaaaagctgttgctgtgaaaaagcttgactcctccgatgctgaatcaaatgtcgagtttttgacccaggtttcaatggtttcaggattaaagcatgacaattttgtcgagttgcaaggttactgtgttgaaggaaatctccgcgtgcttgcatatgagtttgctacaatgggatcactacatgacgtattgcatggaaggaagggagttcaaggggcacaaccaggtcccgtgcttgactggatgcaacgggtaagaattgcagttgatgcagcaaggggcttggaatacttgcatgagaaggttcaaccctctattatacaccgagatatcagatctagcaatgtccttctctttgaagatttcaaagcgaaaattgccgattttaacctctcaaaccagtctcctgacatggctgctcgtcttcattctactcgagttttggggacctttggctatcatgctccagagtatgcaatgactggacagttgacacagaagagtgatgtctacagttttggggttgtccttctagagcttttgaccgggaggaaacctgtcgaccacacaatgccgcgtggacagcaaagtctcgttacctgggctactccaagactgagtgaagataaagttaaagaatgtgtggatccaaacctgaagggagagtatcctcctaaaggagttgccaagttggcggctgtagctgcattgtgtgtacagtacgaagctgagttccgtcccaacatgggcatcgttgttaaggctctccaaccattattgaaggctcgctccagtaccagcaccagcacccgagtcttaaaactcagatgagcccggtttcttcaccttttatcgaaattccagtaacctatacacagtttttagtatccttggtctgcggatttcatcagatcactaaatattttattcgtatttctttccaacttttcaaatacgacattgacgtgtagggttgagttcgactgtcgctagtttccggacccctgatgctgaagtttttcgagttgaatgagggatttgggttgtatggcgaatataaatgttacatgagtatagtttgcttggattttgtgcttttgtgatgtttaagttaatacatatgtaaatcttttatgtaaaaatgtttgattttgtgagttggattacatgtctgatatatttggctcaaccattctttaaggttaattaatattattcatagt

SEQ ID NO: 6452 - DNA, 1686 bp, Prunus persica
cctttcacatacaacaaaccaacccaacctctcagctttctctcacccccccaaaagcaacagcctaagccctttcaaatcctacctgtcccttcacctcacaaaccctaaaagagaaagagagagagaagcgaagaagaagagagagaaacagagacagaaagagaaacggaggcacatgcccctccccctggtttctttgtacggttggagaatacaagtactgacgacgatttatatttgaggaagaaagtcaggatgcgcaagtggctctgttgtacttgtcacgtcgaagagtcttatccatcaaacgaaaatgaacacctgaagagcccgaagcattatacagatgggaaccaaaagggcaataaggtgtcagctcctgtaaaatctgacgtacagaaggccccaccacctattgaagtgcctccattgtctttggaggagctgaaagagaagactgacaatttcggatctaagtcattgattggtgaaggatcatatggaagagtatattatgcaagcttgaatgatggtaaagctgtggccgtgaagaagcttgacgttgcatctgagcctgagtcaaatggcgagtttttgacccaggtttccatggtttcgagattgaagcacgaaaatcttgttgagttgcttggttactgtgtggacggaagtttgcgcgtgcttgcttatgagtttgcgaccatgggatctctacacgacatattacatggtagaaagggagttcaaggggctcaaccaggtcccacactagactggttgcagcgggttagaattgcagttgatgcggctaggggattggaatacttgcatgagaaggttcaacctgctattatacacagagatataagatctagtaatgtgcttctctttgaagatttcaaagccaagattgcagattttaatctatcaaatcaggctcctgatatggctgctcgtcttcattccactcgagttttgggaacgtttggctatcatgccccagagtatgcaatgactggtcaattgacacagaagagtgatgtgtacagctttggtgtggttcttctagaacttctgactgggaggaaacctgtcgatcatacaatgccacgtggacagcagagtcttgttacttgggctactccaagattgagtgaagacaaagttaaacaatgtgtagatccaaagctaaagggagattatcctgctaaaggagtcgcaaagctggccgctgtggcagcattgtgtgtgcaatatgaagctgaattccggccaaatatgagcattgttgtcaaggctcttcaaccacttctgaagctgccaccaccacaagctccggagccttgaagtttccttctgttggaatttctgcgtccctgaaacattctgctttcaaattgcctgctgatttcatcataaactttctatatatatatatttttctttcgtttttcgtatatgatattggatgtgtaggattggattggccagtttcatgtcattgctgagttctgtatgttgctggaactatcccggtgtctaattttttagttatgaattgacttggggattgggttgtgaggtggatatatttttctctgaatactgtttgctttctttggcttctgtatcattgaatgaagtctatcgcgcatgttttgtaatggaaaatcaaactctgca

SEQ ID NO: 6453 - DNA, 1504 bp, Ambrosia trifida
tctgattatctgtctttccccaatttctcatacacccaattaaactaaacaaagccctaaatcaataacacagggacacgtgccacctggatacttcagacgtttggggaaacaaagggctcaagacgatttgatattgaggaagagagataggatgcggaggtggttgtgttgttcctgtcaagtcgaagaatcttatccctcaaatgacaatggattgacgaaaagccatagtgaccatgttgatgggcaccaaagggacaaagtaccacctcctgccaaatttgatgcacaaaaaccagtgccaacaatcgaagtgcctgcactttcacttgatgaactgaaagaaaaaaccgagaactttggatcaaaagcattgatcggtgaaggttcatatggaagagtttattttgcaactttaaataatggtaaaagtgtggctgtcaaaaagcttgatgtttctaccgaggctgaatcagataacgagtttttgactcaggttgccatggtctcaacattgaagcacgaaaatcttgttgagctgtgtggttattgtgttgacggaaatacacgtgtcttggcttatgaatttgcaaccatgggatctctacatgacatattgcatggcaggaagggtgtgcaaggcgcacaaccggggcccgtgcttgattggatgcaacgggtaaagattgctgttgatgcagcaaggggactggattatttgcatgaaaaggtccaaccttcaataattcacagagatgttaggtctagcaatgtgctactatttgaggatttaagagccaagattgcggatttcaacctttcaaatcaagcacccgatatggctgctcgtttgcattctactcgtgtcttgggaacttttggctatcatgcgccagagtatgcaatgaccggacagttgacgcaaaagagtgatgtgtatagcttcggggttgttctgcttgaacttctaactggccggaaacccgttgatcacacaatgcctcgtggacaacaaagcctcgtcacttgggctacaccaaggctgagtgaagacaaggtgaaacaatgtgttgacccaaggctcaagggagagtaccctccaaaagcggttgcaaagctggcggcggtggcagctttatgtgtgcaatatgaggctgagtttaggcctaatatgagcattgttgtgaaagctcttcaaccactcttgagggctcctgcaccagtagctccagaggtgtaatgtaatcaatgaaccaaacgagtttgactgttcatttgcatccgcagcagctttatgaccgtagattttggttgatcgaggcatataatagtgttgttatctttgcatttatatatttttttggtttgagaacatggatgcgtgcttattatgctcagattggtctgttacatatccttggtttgtcataatttgttcaataatgaatacaagtttatgtggtgaactggcgaactgcaatcagtttaaagtgatttagca

SEQ ID NO: 6454 - DNA, 854 bp, Brassica napus
cgtatgagtttggtctacgatgggatctttacatgatgttctacacggaggaaaggtgtgcaaggagcgcagccaggtccagctcttgattggatccaacgggtgagaatagcagttgatgcggctaagggacttgagtatctacatgagaaggttcagcctgcggtgatacatagagatgttcggtctagcaatgtgcttctctttgaagagtttaaagccaagattgctgattttaatttgtcgaatcagtctcctgatatggctgctcgtcttcattccactagagttttgggaacgtttggttaccatgcaccagagtatgcgatgactggtcagctgacgcagaagagtgatgtttatagttttggtgtggtgcttttggagctcttgactggtagaaagcctgttgatcatacgatgcctcgtggccaacaaagtcttgtcacttgggccactccaaggctgagtgaagacaaagtgaagcaatgtgttgatccgaaactcaaaggagagtatcctcctaaagctgttgcaaagcttgcggctgttgcagccttgtgtgtgcaatacgaatcagagtttaggccgaacatgagcattgtggttaaagctctacaacctttgttgaggtcagcaacaccagcagctgctccatcccaggaaatttaattcttctatgttataatgggagattggtttctgtttcatatgttgccataccatgcatacatattcataccaaacaaatatattttcaatacttcttatatgtattacggttataagtagtgtgttggtgcctcttgacaattgtttggtggagtcatttgattcttataattctatttatt

SEQ ID NO: 6455 - DNA, 1719 bp, Distylium racemosum
tgattaaatatttgtttttacccatcgcggtatagaaatccggcaccggaaatatatctgtggagagggtcggtcgttctttttttttttccgggcgtttggtctcggtggcggcgatccttgccgtggtgactaagctagagctgggtgtcttcgttcaggaaaaacactatgaggcggtggctttgctgtacctgttcagtggatgctgcacctgaacagcctgatactcaatacttgaatacaatgaaggcccctgcaaatggaaaccagggagattctaaggcaactgacggagcaaagagtggtgctccacaaaaggtgcctcctattgaagcctctgctttgttgctggaagaattaaaggaagcaacagataactttggtccgaaggctttgattggggaagggtcctatggaagagtatactatgcaactctaagcaatggttctgctgcagcaattaagaaattggatgtcagcagtcaaccagaggcaaactcagaatttttagcacaggtttcaatggtatcaaggctgaagcatgaaaatgtagttgagctcgtgggctattgtgttgagggaaatattcgtgtattggcttatgagtttgcaacaatgggctctttacatgacattttacatggacgtaaaggagtgcaaggtgcccaaccgggtcccattctggattggatgcaacgggtgaaaattgctgtgggtgcagcaaagggtcttgaatatcttcatgagaaagctcagcctcatattattcatcgagatattagatctagcaacgtttactttttgatgactttaaagcaaaaattgctgatttcaatctttctaatcaagctcctgatatggctgctcgccttcattcaacacgtgtgctgggaacatttggctatcatgcaccagagtatgctatgactggacaactgactcagaagagtgatgtgtatagctttggggtggttcttcttgaactcctgacaggtagaaagcctgttgaccacacaatgcctcggggacaacaaagtcttgttacttgggccaccccaagattgagtgaagataaagtaaagcagtgtgtagatccaaagctgaaaggagaatatcctcccaaggctgtagctaagttggcagctgttgcagcattgtgtgtgcagtatgaggcagatttccgtcccaacatgagtatagttgtaaaagcccttcagccactgctcaatccaaggccaccagtacctgtatctgaagctcagagttgatgaccatccataatacagtcctgtatatgttgagttttgttcaggttaatttagattgatgcggtggagtgtatagggactgtgcctgtgcctgcagagatcacagttctattttaaagcagaaatagtatttgcacatccaggttttgttaatgggtcagaagatctgtttctaaattctttcttaacatagctattctttggttccttgtaaaaaaaatctggttgtactgtaagcttgacatctttcagtcagttacaaggaacagattatttgtttgctttacttgcaagaactcatatttttgtttgcagttctaggattgctttttgatcccgcggaggaggtatttgtagttttgtcttttattttcttttcatgtatagaatatgtatatggatttgagagttggggacttcacaattataattattatgaatttgtgta

SEQ ID NO: 6456 - DNA, 1619 bp, Euphorbia peplus
aaggggaaaggaagaagatagaataagaaaacaatacagttattcccaaaattcattctcttctttccgcgttgcttatctgtctttctttcttcatcttcttcttcatcatcttcttcttgtttctaaaccatcaatctaatctaatctctcttattatatggtttgtttgtaattttggacccttcctatttccagagaggctcggcaggcacatgcgactccccctggttattatgcccttgataaacctactgctgtagacgatatatctttgagaaagagagacaagatgcgtaagtggctctgttgcacctgccaagtggaagaaacataccctacacgagagaatgaacacctaagaagcccaaagcattatacagatggaaaccctacaaagagctcaaagtttcaggctccagttagaactgaagtgcagaaggaagcccctccaatcgaagtcgctgcattgtcagtggaagaactaaaagagaagaccgacaattttggttcaaaggcattgattggtgaagggtcctatgggagagtatattatgccaacttagacaatggaagagctgtagcagtaaaaaaacttgatgttgcatccgagccagaaacaaatgttgaatttttgactcaggtttctatggtttcaaggttgaagaatgaaaacgttgtcgaattgcttggttactgtgttgaaggaaatcttcgagtgcttgcatatgaatttgcaactatggggtctcttcatgatatcttgcatgggagaaaaggagttcaaggtgcacagccagggcctacacttgattggatgcagcgcgttagaatcgctgtagatgcagcaagagggttggaatacttgcacgagaaggtacaaccggctataatacacagagatatcagatcaagcaatgtgcttctatttgaagagttcaaagctaaggttgcagatttcaacctttcaaatcaggctcctgatatggctgctcggcttcactcaactcgtgttttgggaacttttggttatcatgctccagagtatgcaatgactgggcaattaacacaaaagagtgatgtatatagttttggggttgttcttctggaacttctgacaggcaggaaacctgtcgatcacaccatgcctaggggacagcagagtctcgttacatgggctactccgagactaagtgaagacaaagttaaacaatgtgtggatccaaagttgaagggagagtatcctcctaaaggagtggccaagctcgcagcagtggcagcattgtgtgtgcaatatgaagctgaattccggccaaacatgagcattgttgtgaaggcacttcaaccactattgaagcccccatctaatgcagcagcagcagcagcagcagctgctgcttcagagacctaagcgaatgaacgaacaaatgaaaatgggttcatggagttgggaattatagaagttgtgcacagtttgattactttacagtttaaaaatgcggatttattgagttatatattttttgattgttagtaagtatatgggatcagatcttctataggctggctgagattgtgcgtatttaacgtcacggatattgtgtctgttggcttgcttt

SEQ ID NO: 6457 - DNA, 1273 bp, Silene vulgaris
tttcacaaggcttaacggagattcaaaagacgatctgcatttgagaaagccgacttcaaggatgcggaaatggctctgctgtacctgcaatgtagaagagtcttatccatcaaatgaggagccctttcaaagcccaaggaacaatatagaaagaacctccaaaaatacgaaagtagcggctcccgttaaggaagaagttcaaaagacagcaccaacaattgaagtacctgccttgtctttggacgagcttaaggaaaaaactgataattttggttccaagtcattaataggtgaaggttcctatggaagagtgtattatgctacgatggaaagtggtaaggcagtggctgtaaaaaagcttgatgtttcccaagagccagcagagtccaatgttgaatttttgacgcaggtttctaaagtttcgactttgaagcatgaaaattttgttgagctgcaaggttattgtgttgaaggaaatatgcgggtattagcttacgaatttgctacaatgggatccttgcatgacattttgcatggcaggaaaggcgtgcaaggtgcacaaccgggcccggtacttgattggatgcagcgagtgaggattgcagtggatgctgcaaagggtttggaataccttcacgagaaggttcaacctcctattatccacagagacatcagatctagtaatgtgctcttgttcgaggacttcagggctaaaattgctgatttcaacctttcaaatcaagctcctgatatggctgctcgtcttcattctactagggttttgggtacctttggctatcatgcacctgagtatgccatgactggacaattgatgcaaaagagtgatgtgtacagttttggtgtcgttcttctggaacttctaactggccgtaaacccgtggatcacaccatgccccgtggtcaacaaagtcttgtgacatgggcaactccaagattgagcgaggacaaagtcaagcagtgcgttgaccccaggctgaaggattaccctgcaaaaggagttgctaagttggcggcagttgcagccctttgtgtccaatatgaatctgagttcaggccgaatatgagcatcgtagttaaagcactacaaccgttgctgaagacaccggctcctgcgccggagagctgaggaagcggttcatgttgaactcctcaaatagtgtgttgaacgtttatctcaaactgtactattcatggccatatataaatctgattttttaatttgtttgcaattatgcggtttggaatcttggct

SEQ ID NO: 6458 - DNA, 1567 bp, Eutrema halophilum
gaattctttgggtttctcacctttctccagaacctcgatcccctttcgtctcttcctccttctcatttgtttgtctgccaaatttcttaaattgattccatccgtctctctgttttttctttttttccggtgattgtttgtttgtaattctcgttttgggtatgtatccgatggactctgattatcatcgtcgtggtctggtggcgaacgatcgttcaccaggctactttgttcggctggataaaccgagagctgtagacgatctttatataggcaagagagagaagatgcgtaggtggttgtgctgtgcttgccacgtcgaagaaccttaccattcttctgaaaatgaacacctcagaagccctaagcaccataatgattatgggctcaacaaaaaaccacaggttgctgtgaagcctgatgctttaaaggagcctccatctattgatgtgcctgcattgtcattggatgagctgaaagagaagactgataattttggatcaaaggcattgatcggtgagggatcatacggaagagcctactatgcaactttgaaagatgggaaggctgtggcagtgaagaagcttgataattcagctgagcctgaatcaaatgttgagttcttgactcaggtctcgagggtttcgaagctgaagcatgataattttgttgagctcttcggttactgcgttgaagggagtttccgtattcttgcgtatgagtttgccacaatgggatctttacacgacatcttacacgggaggaaaggagtccaaggagctcaaccaggtccaacgcttgattggatccaacgagttagaatcgcagttgatgcggctcgagggcttgagtatttacatgagaaagctcagcctggggtaatacacagggatattcgatctagcaatgtgcttctctttgaagacttcaaagccaagattgctgattttaatctatcgaatcaatctcctgatatggctgctcgtcttcattccaccagagttttgggaacctttggttaccacgcaccagagtatgcgatgactggtcaactgacacagaagagtgatgtttatagttttggtgtagtgcttttggagctcttgactggtagaaaaccagttgatcatacaatgccccgtggccaacaaagtcttgtcacttgggccactccaaggctgagtgaagacaaagtgaagcaatgtgttgatcctaaactcaaaggagaatatcctcctaaagcggttgcaaagcttgcggcagtagcggcgttgtgtgtgcaatacgaatcagagtttaggccgaacatgagcattgtggtaaaagctctacaaccattgttgaggtcatcaacagcagcagctgttccatctcaggaaacttgattcttctgtgtaataatatttataataactatgggagattggtttctgttgcatgtgttgccgtatcatataatttgtgttttaaatattctttttgttggggctttttttttcagttgggatgtatatgtttatttcaaggtgatgagtagtgatttggtgcgttttttcaattgtttggt

SEQ ID NO: 6459 - DNA, 1555 bp, Eutrema parvulum
tatctctctgtccttagctcaaagcttttctgtccaaaaaattcaattccccacgtctgtttcttctctctaactaacaaaacagacaataaaaaccaacatttgtatacatacatactcattatacgatttctcaccaagaaaaagagagagaagctttaatttgcaggcaaacgaccgttcaccaggctactttgttcggctggataaaccgagagctgtcgacgatctttatataggcaagagagaaaagatgcgtaggtggttgtgctgcgcttgccacgtcgaagaaccttaccattcttctgaaaatgagcacctgagaagccctaagcgccataatgattacgggcacaataaaaaaccacaggttgctgtgaagcctgatgctttaaaggagcctccatctatcgatgtgcctgcactatcattggatgagctgaaagaaaagactgataattttggttcaaaggcattgatcggtgaaggatcatatggaagagcctactatgcaaccttgaaagatggcaaggctgtggcggtcaagaagcttgataactcagctgaacctgaatcaaatgttgagttcttgactcaggtctcgagggtctcgaagctgcagcatgataattttattcagctgttaggttactgtgttgaagggaatcttcgtattcttgcttatgagtttgccacaatgggatctttacacgacatcttacacgggagaaaaggagtccagggagcacaaccaggtccaacgcttgattggatccaacgggtcagaatcgcagttgatgcagctagaggacttgaatatttacatgagaaagttcaacctgcggtaatacacagagatattcgatctagcaatgtgcttctgtttgaagacttcaaagccaagattgctgattttaatctatcgaatcaatctcctgatatggctgctcgtcttcattccaccagagttttgggaaccttcggttaccatgcaccagagtatgcgatgactggtcaactgacacagaagagtgatgtttacagttttggtgtggtgcttttggagcttttgactggtagaaaacccgttgatcatacgatgcctcgtggtcaacaaagtcttgtcacttgggccactccaaggctgagtgaagacaaagtgaagcaatgtgttgatccaaaactcaaaggagaatatcctcctaaagcagttgcaaagctcgcggctgttgcagcgttgtgtgtgcaatacgaatcagagtttaggccgaacatgagcattgtggtaaaagctctacaacctttgttgaggtcatcaacaccagcagctcttccatcccaggaaacttgattcttctatgtaataatgggagattggtttctgtttcatgtcatacaaatatgttcttcagagtctttttgttgaggcttatttcttcttctattcttctatgttcattaaaatgattagagtgatttggtgcgtcttgacgattgtttggtggagtcgttcgattcttataaacgtattgtaattatttgtgtcgtttttttc

SEQ ID NO: 6460 - DNA, 1484 bp, Valeriana officinalis
tttggagtagaagaagaatcatcaaatcgattttcctgattttcgatcattcgatccattcatcactagttagccctagctacagatttacgttcaacgaacacattccaaattcgaaaaaaaaacaggcgcatgctcctaagcctggttacttggtacaactagaaaatagaagagccgaagacgatctttacttgaggaacagtgcaaggatgcggaagtggttgtgctgtacctgtcaagtagaggaatcctacccattgcatggaaccgaacttctcaaaagtccgaggaataaaatagatgggaaccacaaaggttcaaaaggatctgctccaatcagaccagatgtgcaaagagcaccaccgcctattgaagttccttctattctccttgatgaactgaaagagaaaacagaaaattttggatcaaaagcgttgatcggtgaaggatcatacgggagagtttattatgcgaccttaagcaatgaaaaagctgttgctgttaaaaagcttgatgtcgcatctgagcctgaatcaaattttgattttttgtctcaggtatccacggtttcaaggctaaagcatggaaatcttgttgagttgcttggatattgtgtagaaggaaatcttcgtgtgcttgcttatgaatttgcaaccatgggatctcttcatgatattttgcatggtaggaaaggagtgcagggagcacagccaggtccagttcttgactggatgcagagggtaagaattgcagtcgatgcagctagaggcctagaatatttgcacgagaaagttcaacctcctgtaattcacagagatataagatccagtaatgttctcttgttcgaagattttaaggccaagattgctgattttaacgtttcaaaccaagctcctgacatggctgctcgccttcattctactcgtgtacttggaacttttggttatcatgcacccgagtatgcgatgacgggacaattaacacaaaaaagtgatgtttatagctttggtgtggttctacttgaacttctgaccggtaggaaacctgttgatcataccatgcctcgtggacagcagagtcttgtcacttgggctactccaaggctaagtgaggacaaggttaaacaatgtgtagatacaaagcttaaactgtatccgccaaaagcagtcgcaaagatggcggctgttgcagcattgtgtgtgcaatacgagtcagagtttaggccaaacatgagcattgtggtcaaggctcttcaaccgcttctcaaggctccggctccacctcccgagcccgagactttgtgattctttataaatactccttttacgatttggccagatttgttttcttgtgttggggttgtttgattgcttttattgtgtgctttggtcatcaatacatctatccaaatccttgaatgaattgtgtttcctagtaaaacagttttatcgttaatgattagtaagctagtgttgtttcat

SEQ ID NO: 6461 - DNA, 1786 bp, Arabidopsis lyrata
ctaaatttgggataaaaatgtctattcttgatcatttcctctctgtatctctctgcttttgacaccttctcttagctgttttcatcttttatctctgtttttaaaatcttttgcctctttcaaagggtttcgagttgttttgagttctttgggtttcccaaatttctccacgagctcgacccctttcgtatcttccttctcattttttttgccaaattcattcgatccgtctttcactatgtatccgatggattctgactatcatcgtcgtggtctggtggcgaacgatcgttcaccagctcactttgttagactggataaaccgagagccgtagacgatctctatataggcaagagagaaaagatgcgtaggtggttgtgctgtgcttgccacgttgaagaaccttaccattcttctgaaaatgaacacctcagaagccctaagcaccacaatgattttgggcatcacactagaaaaccacaggcagctgtgaagcctgatgctttgaaggagcctccatctattgatgtgcctgcattgtcattggatgagctgaaagaaaagaccgataattttggatcaaaggcattgattggtgaaggatcttacggaagagcctactatgcaaccttgaaagatgggaaagctgtggcggtgaagaagcttgataattcagctgaacctgaatcaaatgttgagttcttgactcaggtctcgagggtttccaagctgaagcacgataattttgttgagctcttcggttattgtgttgaagggaacttccgcattcttgcttatgagtttgccactatgggatctttacacgacatcttacacgggaggaaaggagtccaaggagcacaaccaggtccgacgcttgattggatccaacgggtcagaatagcagttgatgcagctagaggacttgagtatttacatgagaaagttcaacctgcggtaatacacagagatattcgatctagcaatgtgcttctctttgaagactttaaagccaagatcgctgattttaatctatcgaatcaatctcctgatatggctgctcgtcttcattctaccagagttttgggaaccttcggttaccatgcaccagagtatgctatgactggtcaactgacacagaagagtgatgtttatagttttggtgtcgtgttattggagctcttgactggtaggaaacctgttgatcatacgatgcctcgtggtcagcaaagtcttgtcacttgggctactccgaggctaagtgaagacaaagtgaagcaatgtgttgacccaaaactgaaaggagaatatcctcctaaagctgttgcaaagctcgcggcagtagcagcgttgtgtgtgcagtatgaatcagagtttaggccgaacatgagcattgtggtaaaagctcttcaaccattgttgaggtcatcaacagcagcagctgttccagtccaggaaacctgattcttctgtgccataatgataatggaagattggtttctgtttcaattgttgccataccgtataaatgtgttcttaaagagagtctttttgtctgaggcttttcttcagttgggatgtatatgtttttattaaggtgatgagtagtgatttggtgtgtcttttcaaatgtttggtggagtctgtttctttcttcttataacaatctattctatatctggttttgtttttttttgggctttttgctctttcttcttaacataatactaattataagttttttcatatacaatcttgaaaggaattttcatcagttattgattc

SEQ ID NO: 6462 - DNA, 1794 bp, Arabidopsis thaliana
taactaaatttgggataaaaattgtctattcttgatcattcctctctgtatctctctgcttttgacaccttctcttagctgttttttcatcttttatctctgtttttaaaatcttttggctctttcgaagggtttcgagtccttttgagttctttgggcttcctcccaaatttctccacgagctcgacccctttcgtatcttccttctcatttttttgccaaatttattcgatccgtctttcactatgtatccgatggattctgattaccatcgccgtggtctggtggcaaacgatcgttcaccagctcagtttgttaggctggataaaccgagagccgtagacgatctctatataggcaagagagaaaagatgcgtaggtggttgtgctgtgcttgccacgttgaagaaccttaccattcttctgaaaatgaacacctcagaagccctaagcaccacaatgattttgggcatcacactagaaaaccacaggcggctgtgaagcctgatgctttgaaggagcctccatctattgatgtgcctgcattgtcattggatgagttgaaagaaaagaccgataactttggatcaaagtcattgattggtgaaggatcttacggcagagcctattatgcaaccttgaaagatggaaaggctgtcgcggtgaagaagcttgacaatgcagcggaacctgaatcaaatgttgagttcttgactcaggtctctagggtttccaagctgaagcacgataattttgttgagctcttcggttattgtgttgaagggaatttccgcattcttgcgtatgagtttgctactatgggatctttacatgacatcttacacgggaggaaaggagtccaaggagcacaaccaggtcctacgcttgactggatccaacgggtcagaatagcagttgatgcagctagaggacttgagtatttgcatgagaaagttcaacctgcagtaatacacagagatattcgatctagcaatgtgcttctctttgaagattttaaagccaagatcgctgattttaatctatcgaaccaatctcctgatatggctgctcgtcttcattctaccagagttttgggaaccttcggttaccacgcaccagagtatgcgatgactggtcaactgacacagaagagtgatgtttatagttttggtgtggtgcttttggagctcttgactggtaggaaacccgtcgatcatacgatgcctcgtggtcaacaaagtcttgttacttgggctactccaaggctaagtgaagacaaagtgaagcaatgtgttgatccaaaactaaagggagaatatcctcctaaagctgttgcaaagctcgctgcagtagcagcattgtgtgtgcaatatgaatcagagtttaggccaaacatgagcattgtggtaaaagctcttcaaccattgttgaggtcatcaacagcagcagctgtaccagtccaggaagcctgattcttctgtgcaatagcaacaatggaagattgggttcggtttcagttgttgccataccgtataaatgtgttcttaaagagagtctttttgtcgaggcttttcttcagttgggatgtatatgttttattaaggtgatgagtagtgatttggtgtgtcttttcaaatgctttgtggagtctgtttttccttataaaaatttattctaaatctggtttgtattttgggggtcttctttgctctttcttcattaacagaatactaattataagcttttcatatacaaaccttgaaaggaattttcatcagttactaattcgatttc

SEQ ID NO: 6463 - DNA, 766 bp, Brassica juncea
gtcgaggcagctaggggtttggagtaccttcacgagaagtcacagcctgctgtaatccatagagatataagatccagcaacgttcttcttttcgaagactacaaggccaagattgctgatttcaatctctcgaaccaagcgcctgataacgctgctcgtcttcactcaacaagagtcttgggaacttttggttatcatgctccagaatatgcaatgactggacagttgactcagaagagtgatgtgtacagctttggggttgtgcttctagagcttctgacagggaggaaaccggtggatcataccatgcctcgtggtcaacaaagtcttgtaacttgggcgacaccaagactcagtgaagataaagtcaagcaatgcattgatccgaagctaaaagcggattaccctcctaaagcagttgctaagctagcagcagtggcagcattgtgtgtgcaatatgaatctgagtttagaccaaatatgagcatagttgtgaaggcgctgcagcctctcctcaaacttgcagctccagctccctctccaccagaatcttgaaacttttttctttcatttgcaaactatcagactctgtaaccaagtgccgttaccaatatctgaatgtggttagtttttggagtgatcaactataaaagatgatattatgtttcatttgcacacagttttgttgtgctagaagaagagagattatgtgagtgggagagataacaaagacttttgactatttaataataatgaccattattgc

SEQ ID NO: 6464 - DNA, 849 bp, Brassica juncea
gggatctttacatgatgttttacacgggaggaaaggagttcaaggagcgcagccaggtccagctcttgattggatccaacgggtgagaatagcagttgatgcggctaagggacttgagtatttacatgagaaggttcagcctgcggtgatacatagagatgttcggtctagcaatgtgcttctctttgaagagtttaaagccaagattgctgattttaatttgtcgaatcagtctcctgatatggctgctcgtcttcattccactagagttttgggaacgtttggttaccatgcaccagagtatgctatgactggtcagctgactcagaagagtgatgtttatagttttggtgtggtgcttttggagctcttgacgggtagaaagcctgttgatcatacaatgcctcgtggccaacaaagtcttgtcacttgggccactccaaggctgagtgaagacaaagtgaagcaatgtgttgatcccaaactcaaaggagagtatcctcctaaagctgttgcaaagcttgcggctgttgcagccttgtgtgtgcaatacgaatcagagtttaggccgaacatgagcattgtggttaaagctctacaacctttgttgaggtcagcaacaccagcagctgctccatcccaggaaatttaattcttctatgttataatgggagattggtttctgtttcatatgttgccataccatgcatacatattcataccaaacaaatatattctcaatacttcttatatgtattacggttataagtagtgtgttggtgcctcttgacaattgtttggtggagtcatttgattcttataattctatttattcgtgatttttcattt

SEQ ID NO: 6465 - DNA, 1402 bp, Brassica napus
tatggattcagattatcatcaccgtggtctggcggcgaacgatacttcaccaggctactttgttcggcttgataaaccaagagctgtagacgatctttacataggtaagagagggaagatgcgtaggtggttgtgctgcgtttgccacgtcgaagagccttaccattctcctgaaaatgagcatctgagaagccctaaggactataatgataaggataagaaaccacaggctgctgtgaagcctgatgtgttaaaggagcctccagctattgatgtccctgcgttgtcattggacgagctgaaagagaagactgataactttggatcaaaggtgttgatcggtgaaggctcatacggaagagcttactacgcaactttggaagatggcaaagccgtggcgatcaagaagcttgataacgcagctgagcctgaatcgaactttgagttcttgactcaggtctcgagggtctctaagctgcggaatgagaatttcgttcagctgtttggttactgtgttgaagggaaccttcgtatacttgcgtatgagtttgctacgatgggatctttacatgatgttctacacgggaggaaaggtgtgcaaggagcgcagccaggtccagctcttgattggatccaacgggtgagaatagcagttgatgcggctaagggacttgagtatctacatgagaaggttcagcctgcggtgatacatagagatgttcggtctagcaatgtgcttctctttgaagagtttaaagccaagattgctgattttaatttgtcgaatcagtctcctgatatggctgctcgtcttcattccactagagttttgggaacgtttggttaccatgcaccagagtatgctatgactggtcagctgacgcagaagagtgatgtttatagttttggtgtggtgcttttggagctcttgactggtagaaagcctgttgatcatacaatgcctcgtggccaacaaagtcttgtcacttgggccactccaaggctgagtgaagacaaagtgaagcaatgtgttgatccgaaactcaaaggagagtatcctcctaaagctgttgcaaagcttgcggctgttgcagccttgtgtgtgcaatacgaatcagagtttaggccgaacatgagcattgtggttaaagctctacaacctttgttgaggtcagcaacaccagcagctgctccatcccaggaaatttaattcttctatgttataatgggagattggtttcggtttcatatgttgccataccatgcaaacatattcataccaaacaaatatattttcaatacttcttatatgtattacggttataagtagtgtgttggtgcctcttgacaattgtttggtggagtcatttgattcttataattctatttattcgtgagtttt

SEQ ID NO: 6466 - DNA, 1545 bp, Cichorium intybus
ggacccccattatttctctctctaacgacccgtttctttctctctcctcctctttgtaatcgctccttgcttatctgtctttccacaacttctcgatcatctgaaaaacacaataaaaacaaagccctaattcaagaaaacccaaagtgacaacaccaaagggatacaaaagacaggcacacgccccacctcctggaaattttttacgtttggggaaaccaagggctcaagacgatctaattttgaggaagcgagataggatgcgcaggtggttgtgttgtacttgtcaagtcgaagaatcttacccatcaaatgaaaatggattcgtaaaaaaccacaatgatcacactgatgggcaacataaggactcaaaactaccacctcctgtgaaacatgaagcacaaaaaacagtaccaacaattgaagttccttcactttcactcgatgaattgaaagaaaaaaccgagaattttggatcaaaagcattgattggtgaaggttcatatggaagggtttactttgcaaacttaaataatggaaaaagcgtggctgtcaaaaagcttgatgtttctccagaggctgaatcaaataccgagtttttgactcaggtgtcaatggtgtcaacactgaagcatgacaactttgttgagttatgtggttactgtgttgagggaaataatcgtgtcttggcttatgagtttgcaacaatgggatctttacatgacatattgcacggtaggaagggtgtacaaggagcacaaccaggacctgtgcttgattggatgcaacgggtaaggattgcagttgatgcagcaaagggacttgagtacttacatgaaaaagttcaaccttcaataattcacagagatattaggtcaagtaatgtgctactttttgaagatttgagagccaaaattgcagactttaacctttcaaatcaagctccagatatggctgctagattgcattcaacccgtgttttgggaacttttggctatcatgcaccagaatatgcaatgactggacaattgacacaaaaaagtgacgtgtatagctttggagttgttttacttgagcttcttactggtcggaagcctgttgaccacacaatgccacgtggacaacagagtcttgtcacttgggctacaccaaggctaagtgaagacaaagtcaaacaatgtgttgacccgaggctcaagggagagtaccctccaaaagcagttgcaaagctggcggctgttgctgcgttatgtgtgcagtatgagagtgagtttaggccgaatatgagcattgttgtgaaagcgcttcaaccactgttgagggccccaccacctgctgctgaagggtaataatgtcaattgtcaatcacaaaaatggattgtgttttggtgacagttggaggggttggttttatacgcatatataatagtgttttctttggatttatattttttggtttgagtaaacggattgggattggcttgttacatatctttggtttgtcaagattatttgtttaataatgggaaaacatggtttgatggt

SEQ ID NO: 6467 - DNA, 543 bp, Cycas rumphii
tggatccaaagatcaagctcctgacatggctgctcgccttcattcaacacgtgtgctaggaacttttggctatcacgctccagagtatgctatgactggtcagttgactcagaagagtgatgtgtatagctttggggtggttctacttgagcttctaacaggcagaaagcctgtggaccacacaatgcctcggggacaacagagtcttgttacttgggcaactccaaggttgagtgaagataaagtaaagcagtgtgtagatccaaagttgaagggagaatatcctccgaaatccgttgctaagttagctgctgttgcagcattgtgtgtgcagtatgaggcagatttccgtcccaacatgagcatcgttgttaaagcccttcagccgttgctcaatccaaagccagctcttgcatctgaaactcagacgtgatgatcatttttgttttggtcttttctgctgtttctaagtttttggtcagggttggtttataatcattccatggggtactaggttggtgatgcttgtgcagttcaggtttc

SEQ ID NO: 6468 - DNA, 1410 bp, Lactuca sativa
tcggcattatggcccgaatgcggggggagagagaaagaatgctaacgaatcgaactactctgagaacagatagggaactgtaggggagaccaatttaaattcgtgcttatctgtgtttcctaatattcaatcaccggaaaacataatcaacacaaaaccctaaatcgaggaagccaacgacacagttcaagcccacagaaacgacaggccacgtcagcatattgataagtgtgtggaaagtcaaatttaaggaagaaaaataggatgcggaggtggttgtgttgcacttgtcaagttgaagagtcttattcatcaaatcacaatgatcccataaagaatcccactgattacacagatgggcatcaaaagggtcaaaaagaatctcctataaaacctgaagtgcaaaaaacagctccaccaatagaagttcctgaactttcattagaagaacttaaagaaaaaaccgatgattttggatcaaaggcattaattggtgaaggttcatatggaagagtttattttgcaactttaaataatggaaaaactgttgctgttaaaaaacttgatgtttctactgaggctgaatcaaataacgagtttttgtctcaggtttccatgttctcaatgttgaagcatgagaatcttatagagttgctcggttattgtgttgaaggaaatgtgcgtgttttggcttatgaatttgcaaccatgggatctttacatgacattttgcatggtaggaaaggggtgcaaggagcacaaccagggccagtgattgattggatgcaacgggtaaagattgcagttgatgcagcaaaagggcttgaatatttacatgaaaaggctcaaccttgtataattcatagagatataaggtcaagcaatgtgcttttatttgaagatttaaaagccaaaattgcagacttttatctttcaaatcaatcaccagacatggctgctcgattgcattctactcgtgtattgggcacctttggctatcatgcaccagaatacgcgatgactgggcaattaacacagaagagtgatgtgtatagctttggtgttgttcttcttgagcttttaactggccggaagcctgttgatcacacaatgccacgtggacaacaaagccttgtcacttgggctactccaaggctaagcgaagacaaggttaaacaatgtgtagatccaaagctcaagggagaatatcctccaaaggcagttgcaaagttagcagctgtggctgcattatgtgtgcaatatgaatccgagtttaggccaaacatgagcattgttgtgaaggctcttccaccacttttaaaggcttctccaccaacagcacctgagaattttacagaaatgaaatcttgattcatgaaaaatctcaacttcaatgggaaaacaacattg

SEQ ID NO: 6469 - DNA, 1617 bp, Sciadopitys verticillata
cacccaacgcgatcttcgccagctatttccgttctcacgcgctctgacttctccgttgtttgttgggaagctttctgtctacgctagtgaggtttgaaccggaaccgtctttcaggaaaaaaacaatgcgtcggtggctttgttgcacctgttcggtggattcttctcctgaacaacatgagaatcaatacttaaatgcaacaaaggccccaacaaatggaaaccagggagattataagacatccgagggagcaaagagtggtgcacctcagaaagtagctcctattgaagcaccttctttatcactagaagagttaaaagaagtaacagataactttggtcccaaggctttgattggggaagggtcctatggaagagtatactatgcaactttaaataatggttctgctgcagcaattaagaaattggatgtcagcagtcaaccagaggcaaactcagaatttttagcacaggtttcaatggtgtcaagactgaagcatgaccatgtagttgagctggtgggttactgtgttgagggaaatatccgtgtgttggcttatgagtttgcaacaatgggctctttacatgacattttgcatggacggaaaggagtgcaaggtgctcaaccaggtccagttcttgattggatgcaacgggtgaaaattgctgtgggggcagcaaagggtcttgaatatcttcatgagaaagcacagcctcatattattcatcgagatattaggtctagcaatgttttactttttgatgacttcaaagcaaaaattgctgatttcaatctttcaaatcaagcccctgacatggctgctcgccttcattcaacacgcgtgctgggaacatttggttatcatgctccagagtatgctatgactggacagctgactcagaagagtgatgtatatagctttggggtggttctgcttgaactcctaacaggtagaaagcctgttgaccacacaatgcctcgtggacaacaaagtcttgttacgtgggccactccaagactgagtgaagataaagtaaagcagtgtgtagatcctaaactgaaaggagaatatcctcccaaggctgtggccaagttagctgctgttgcggcactgtgtgtgcagtatgaggcagatttccgtcccaacatgagtatagttgtaaaagctcttcagccactgctcaatccaaagcctgcagctcctccacctgaagctcagaattgatgaccacacataatgcaatagtgtacaatttgatgtctaatttggggatggtttagattaatgtgacaggatatataggggcagtgcctgcggagatcacagctccaattttaaccagcaatagtattcaagagctccaggttttgttcacgagtcgagatttatttctacattcttttaaaatagtagctattctttggttccttgcaaagaatttctgcttgtatgtagacttgaggtcatcgagtcagatccaagcaacgtatcacgtgtttgttatgtttcttagaacccctttgttttgtttgcagttctggagttacgtattgatcctggttgaggaggtatttgtagtttgtttctaagaaattttcatttgtttcttgtatag

SEQ ID NO: 6470 - DNA, 1591 bp, Sequoia sempervirens
agtctaaggcatctcagggggcgaaagaatagacactccacagaaagtaagctcctattgaagcacctgctctatctctagaagagttaaaggaagcaacagataactttggtccaaaagctttgattggagaagggtcctatggaagagtatactatgcaacattaagcaatggttcagctgcagcaattaagaaattagatgtcagcagtcagccagaggcaaacccagaatttttagcacaggtttcaatggtatcaaggttgaagcatgagcatgtagttgagttggtgggatactgtgttgagggaaacatccgtgtgctggcttatgaatttgcaacaatgggctccttacatgacattttgcatggacggaaaggggtgcaaggggcccaaccaggtccagttcttgattggatgcaacgggtgaaaattgctgtgggtgcagcaaagggtcttgaatatcttcatgagaaagctcagcctcatattattcatcgagatattagatctagcaatgttctactttttgatgacttcaaagcaaaaattgctgatttcaatctttctaatcaagcccctgacatggctgctcgccttcattcaacacgggtgttgggaacatttggctatcatgctccagagtatgctatgacaggacagctgactcaaaagagtgatgtatatagctttggggtggttctgcttgagcttctaacaggtagaaagcctgttgaccacacaatgcctcggggacaacaaagtcttgttacttgggcaactccaagattgagtgaagataaagtcaagcagtgtgtggatccaaagctgaagggagaatatccttccaagtctgtagccaagttagccgctgttgcagcactttgtgtgcagtatgaggcagacttccgtcccaacatgagtatagttgtaaaagctcttcagccactgctcaatccaaggccagcagctcctgcacctgaagctcagaattgatgatcaggcatggtgcagtctagtacaatttgaggttgtgttcagcaaaggtttagattaatgtgacgggatattataggggcggtgcctgtggagatcacagttcaaatttttaagcagcaatagtatttgcaccgctccagcttttgttcatgggtcggaattttttctatattcttttaaaattgttattctttggcacctcgtgaagaattttctacatgttctgtaaagttgatgctcttgagtcacttccaagcaacagatagtttgtctgccatatttcctagaatccctgtgcttctttatggtttctgggattacttttttgatcctggttgagtttgtgtttgtagtcttgctttataatatatttttcctattttctttacctgtataggtcatgtatatggacatcttgtttgagatatagggattctctgcaattattatcattatgattttgtgtaaggcgataacaggaaggttaaattattcagaggcatcagagattcttctgggagaagttaaaaatattgaatattgcgttatggcccttacaagttaaactgtcagtcattaatacgcatctg

SEQ ID NO: 6471 - DNA, 1848 bp, Triphysaria pusilla
attttcactgtattttttctcatagaattttcgtaaaggttaaaaacacacttgtattttactccgcccctcctttcgcttgttgagaatcactctctctctctctctccacttgctttgcctggctgtccgctcatctgtttcgccaccccactttttctccgatcttctttgttatcattacttttaaagcaaatctccatagccatatatacaataccaagatttgggtatttaattaattctgtatactcgaagagaattaaaggtcaggaggcaaggtgaaaataataataattaaaagaggtccatgattttcggcacctcctcccggttattttgtacgcttggagaacaagagtgttgaagacaatccttatttgaaaaagagaacaaggatgcggaggtggctgtgttgcacttgtcaagtggaggagtcctataatgccaatgaaaatgagcacctcaagagccccacaaatcatgctgatggacatcaaagaggctctaaggcatcagttccagtgaagaacgaagttcagaagacagtaccccctattgaggtgccttctctgtcactcgaggaattgaaagagaaaactgacaactttggatcaaaatcattaattggtgagggatcatatggaagagtatacttcgcacagttgaacgatggaagtgaggttgctgtcaagaaacttgatgtatcatctgagcctgattcaaatattgagttcttgactcaggtttccatggtgtcaaaactgaagaatgataattttgttgaattgcttggttactgtgtagatggcaatctacgtgtattagcttatgaatttgcaaccatgggatctctacatgacattttgcatggaaggaaaggagttcaaggggcacagcccgggcctgtacttgactggatgcaacgggtaagaattgccgttgatgctgcgaggggactcgaatatttgcatgagaagttccaaccttcaataattcatagagatatcagatccagcaatgtgcttttatttgaagactacaaagccaagattgcagatttcaacctttcaaatcaggctcctgacatggctgctcgtcttcattctactcgagttcttggaacctttggttatcatgctccagagtatgcaatgacaggacaattgacacagaagagtgacgtttatagctttggggttgttctgcttgagcttctgactggaaggaaacctgttgatcacaccatgcctcgtggacagcagagtcttgttacttgggccactccaagactgagtgaggacaaagtgaaacaatgtgttgatccaaaactcaaaggagagtatccaccaaaaggcgtagccaagctggcagcagttgcagcattgtgcgtgcagtatgaagctgagttccgcccgaatatgagtattgttgtgaaggctctgcagccactgttgaggtcgactgtccctgctgctgctcccgagatttaattaccaacgtgaatgcagtttgctatgtgtgttttgtttcgtgagttttacacagtttggttccatttccgcataaatcgccatattactattccattttaccttttctctggtttttagacactcggttgggtgctcttgttggtggtgatgatgtctcattataaaccaagacctgctgctactactattatgcaggatggaatgctttgcttaagaagcaatgcttcttaaacatttaacaaagctttgtttttattactatttcctactttgcttaattcattatttccttaattgtcatacacatcaaatggatctaatattttctatacattcttgatattgtttattg

SEQ ID NO: 6472 - DNA, 1272 bp, Cirsium arvense
attcattcaatcacccccttaattaacacaaaaccctaaatcaagaaaagccagttcagaaaacccaggtgcatgcacctcctggatgctttgtgcatgcgggaaacaaagagctgaaaacggtctatttttgaggaactaaaaataggatgcggaggtggttgtgctgtacttgtcaagtcgaagaatcggtaccatcaaatgacaatgaattcgtaaagaattctacggatcatggggatgggcaccagaagggttcaaaaggatctcctatcaaatctgaagtgcaaaaagcggtgccaccaatggaagtgcctgcacttccattggaagaactgaaagaaaaaaccgacgattttggatcaaaggcactgattggtgaaggttcatatggaagagtttattttgcaaccttgaataatgaaaaaactgtggctgtcaaaaagcttgatgtttctactgaggctgagtccaataacgagttcttgactcaggtctccatgttctcgaggctaaagcatgacaatcttatcgagttgctcggttactgtgtcgaaggaaatgtgcgtgtcctggcctatgaatttgcaacgatgggatctctacacgacattttgcatggtaggaagggtgtgcaaggagcacaaccagggccggtgcttgattggatgcaacgggtaaggattgctgtggatgcagcaaggggactcgagtacttacatgaaaaggcccaaccctccataatacacagagatataaggtcgagcaatgtgctcttatttgaagacatgaaagcgaagattgccgactttaacctttcgaatcagtcaccagatatggccgctcgtttgcattctactagagtccttggcacctttggctatcacgcaccagaatatgcaatgactggacagctaacacagaagagtgacgtttatagttttggggttgtgctgcttgagcttctaacaggccggaagcctgttgatcacactatgcctcgtggacagcagagtctcgtcacttgggctactccaaggctaagtgaagacaaggttaaacaatgtgttgatccaaagctcaagggagaatatcctcccaaagcagttgcaaagttggcagctgtggcagcattatgtgtgcagtatgagtcagagttcaggccaaatatgagcattgtggtgaaggctcttcagccacttctaaaggcttcttctgcaccaccaccaccaccaccagctgatgaagtctagactcatcataaaagaaaag

SEQ ID NO: 6473 - DNA, 1511 bp, Cirsium arvense
caatcgctccttgcttatctgtcttttccccaattctcgatcgtctaaaaaaaaaacacgataaaacaaagccctaaatcaagaaaccccaaagtgacagacacaagacagtttcacacacccccttctggatactttcgacatttggggaaaccaagagctaaagacgatctaattttgaggaagagagataggatgcggaggtggttgtgttgtacttgtcaagtcgaagagcattacccaccaaatgacaacggatttgtaaaaaaccacagtgatcatagtgatgggcagcaaaaggactcaaaagcaacacctcctgtcaaatttgacgtgcataaagcagtgcctacaatcgaagtgcctgcactctcactcgaagaactgaaagaaaaaaccgagaattttggatcaaaggcattgattggtgaaggttcatatggaagggtttactttgcaaccttagataatggaaaaaccgtggctgtgaaaaagcttgatatttctactgaggctgaatcaaataatgagtttttgactcaggtttccatggtctcaacgctgaaacatgacaatcttgttgagttgtgtggttactgtgttgaaggaagtacccgtgtcctggcttatgaatttgcaaccatgggatctctacatgacatattgcacggtaggaagggtgtgcaaggagcacaaccaggccccgtgcttgattggatgcagcgagtaaggattgctgttgatgcagcaaggggactggattacttgcacgagaaagttcaaccttctataattcacagagatattaggtctagcaatgtgctactatttgaagaccttagagccaagattgccgattttaacctttcaaaccaagcaccagatatggctgcccgcttgcattctactcgtgtgttgggaacttttggctatcatgcaccagaatatgcaatgacgggccagctgacacaaaagagtgacgtgtatagctttggggttgttcttcttgagcttctaacgggtcggaaacctgttgatcacacaatgccacgtggacagcagagtcttgtcacttgggctacaccaaggctaagtgaagacaaggtgaaacaatgtgttgatccaaggctcaagggagagtaccctccaaaagcggttgcaaagctggcggcagtggcggctttgtgcgtgcagtatgaggctgaatttaggcctaatatgagtattgtggtgaaggctcttcaaccactgttgagggctcctgcaccaccaccagcggcggctccagaagtgtaataatgtaaacgggatttctttctttctgggacagttggtctacagctttgcgattgtagaatttggtttgaggcatatatagtagtggttttctttgcatttatatcttcttctttttggtttgagaacattgatgtgcacttgtgttggatttgttaaagatttgttcaataatggaacctgctttattcaaaaaagaaaaagtaccgactgcg

SEQ ID NO: 6474 - DNA, 1395 bp, Plantago ovata
ggcgcatgcgcctcctcctggtcaatttgtacggttggggaacaaaagtgctgaagacgatatttatttgagaaagagagcaaggatgcgtaggtggctatgttgcacatgtcaagtagaagagtcttaccatccgagtgaaaatgagcacctgaggagcccacacaatcatggtgatgggaattttaaaggctccaaggtaccagctcctgtaaagcacgaagctcaaaaagcagtacctcctatcgaagtgcctgcattgtctcttgaggaactgaaagaaagaccgataactttggatcaaaggcattaattggtgaaggttcttatggaagggtatattttgcacagttgaacactgggaaggatgttgctgttaagaaactcgatgtggcttctgagcctgattcaaatcatgagtttttaactcaggtttccatggtgtcgaggctgaagcatgaaaatttcgtcgaattgcatggttactgtgtcgaaggaaatctgcgtgtgttagcctatgaatttgcaactatgggatctcttcatgatgttctgcatggaaggaaaggagttcaaggagctcagcctggtccagtacttgactggatgcagcgggtacggattgctgtagatgctgcaaggggtcttgaatatttgcatgagaaggttcagccttcaataattcacagggatatcagatcaagcaatgtgctcctgtttgaagactacaaagccaaggttgcagacttcaatctttcaaatcaggcaccagatatggctgctcgccttcattctactcgtgttttgggaaccttcggatatcatgcaccagaatatgcaatgacaggacagctgacacaaaagagtgacgtttatagctttggggttgttttacttgagctcttgactggaaggaagcctgttgaccatacgatgccacgtggacagcaaagtcttgttacctgggcaaccccgaggctgagcgaggacaaagtgaaacagtgtgttgatcctaaactcaagacggagtacccaccaaaaggagttgccaagctggcggctgttgcagcattatgtgtgcagtatgaagcagagttccggccaaatatgagcatagttgtgaaggctctccagccactactgaggggacctgctaccgctcctgcttctacaccagaggcctagattcttatgcacgtgtgttcatttttttgtgagttttgcacagtggttacacttagatttccctgtatgtttatttctttctgtttgttttgtaattttcaggctttctaagacacgggaggtgttatgattttgtcttgaaaatcgatgtgattggattttgtgtggaggcgaaaatttgtaccctgtgagtttgaaggagcaagaaaa

SEQ ID NO: 6475 - DNA, 527 bp, Cucurbita pepo
gtacagttgacacagaagagtgacgtctacagctttggagtcgttctactcgagcttttgaccgggaggaaacctgtcgatcacaccatgcctcgtgggcagcagagtcttgttacttgggctaccccaagactaagtgaagacaaagttaaacaatgtgttgatccaaggctgaagggtgaatatcctcccaaaggagttgccaagctggctgctgtggcagctctgtgtgtccagtacgaagcggagttcaggccgaacatgagcatcgtcgttaaggctctccagccgcttctaaggcctcctgccccggctcatgctccggaaccgtgaagtaaattgatctgaatttatgttcttccttcttcctcactgttgatatatattatgtcaacgccttcattgcaacataaacttgggttcatagtgaccatatagaattcataatattcattatttatttccctaactagtttatttgttttttacttagtaaaaaaaaaaaataaaagtactatgtctgacta

SEQ ID NO: 6476 - DNA, 1266 bp, Flaveria ramosissima
ttgcaatcgctccttgcttatctgtctttccccaatttctccatcatcagaatcacaaaattaaacaaagccctagatcataactgacaacacaatacagggacacgtgccacccggatactttagacgtttggggaaaccaagggctcaagacgatttaatattgaggaagagagataggatgcggaggtggttgtgttgcacttgtcaagttgaagaatcttatccctcaaatgaacatggcttgataaaaagccacagtggtcatgttgatgggcaccataaggaaaaagtgccacctcctgtcaaatttgatgcaccaaaagcagtgccaacaatcgaagtgccagcactttcacttgatgaactgaaagaaaaaaccgagaattttggatcaaaagcattgattggtgaaggttcatatggaagagtttattttgcaaatttaaataatggtaaaagtgtggctgtcaaaaagcttgatgtttctaccgaggctgaatcagataacgagtttctgacccaggtttccatggtctcaacactgaagcatgacaatcttgttgagctgtgtggttactgtgtcgaaggtaatacgcgtgtcttggcttatgaatttgcaaccatgggatctctacatgacatattgcatggcaggaagggtgtgcaaggagcacaaccggggcccgtgcttgattggatgcagcgggtaaggattgctgttgatgcagcaaagggactggattatttgcatgaaaaggtccagccttcaataattcacagagatgttaggtctagcaatgtgctactatttgaggacttgagagccaagattgctgatttcaatctttcaaatcaagcacccgatatggctgctcgtttgcattctactcgtgtgttgggaacttttggctatcatgcaccagaatatgcaatgactggacagctaacacaaaagagtgacgtgtatagctttggggttgttctgcttgaacttctaactggtcggaaacctgttgatcacacaatgccacgtggacagcaaagccttgtcacttgggctacaccaaggctgagtgaagacaaggtgaagcaatgtgttgatccaaggctcaaaggagaatatcctccaaaagcagttgcaaagctggcggccgtggctgctttatgcgttcaatatgaggctgagtttaggccgaatatgagcatcgttgtgaaagcccttcaaccactgttgagggctcctgcaccagcagctgcagaagt

SEQ ID NO: 6477 - DNA, 762 bp, Flaveria ramosissima
ctttacatgacattctgcatggtaggaaaggtgtgcaaggagcacaaccggggcccgtgcttgactggacacaacgggtaaagattgctgttgatgcagcaaggggattggaatatttgcatgagaaggttcaaccgtctattatacatagagatataaggtctagcaatgtgctattatttgaagtacttaaaagccaagattgcagttttttaatctttcaaatcagtcaccggacatggctgctcgtttgcattctactcgtgttctggcacctttggctatcatgcaccagaatatgcaatgacgggacagttaacacagaagagtgatgtttatagctttggtgttgttcttcttgagcttttaactggcaggaagcctgttgatcaaacaatgccagtggacaacagagtcttgtcacttgggctactccaagactaagtgaagacaaggttaaacaatgtgtagatccaaagctcaagggagagtatcctccaaaagcagttgcaaagttggcagctgtggcgcattatgcgtgcagtatgagtctgagtttaggcctaacatgagcattgtggtgaaggctctccaaccactcctgaaggcttctgcaccaccaccatcagaagaggagtaggctgcaataaacgagtcttggtgatcggtcatcaacgtaacttaaaattctgtagttacaccagaaaacaagcatggtcgtgttcatatgtagattctgcctccagccacctctttacaaac

SEQ ID NO: 6478 - DNA, 1338 bp, Lippia dulcis
gtcgatggcaatctccgtgtcttagcttatgaatttgccaccatgggatctcttcacgacattctccatggaagggagtgcaaggggcacaacccggtcctacacttgactggatgcaacgggttagaatcgctgttgatgctgcccggggtttggagtatttgcatgagaaggtccagccatcaactattcatagagatatcagatccagcaatgtacttctttttgaagactacaaggccaaggttgctgactttaacctttcaaatcaagcttctgacatggctgcccggcttcattcaactcgagttctgggaacctttggttatcatgctccagagtatgcaatgactggacagctgacacagaaaagcgatgtttatagctttggggttgttctgcttgagcttctgacaggaaggaagcctgttgatcataccatgcctcgtggacagcagagtcttgttacttgggccacgccaagactgagtgaggacaaagtaaaacaatgtgttgacccaaaactcaaggattatccaccaaaaggggtagccaagttggcagctgttgcagcattgtgtgttcagtacgaagcagagttccgcccgaatatgagcattgttgtgaaggctttgcagcctcttctgaagtcgactgtccctgctcctgtgacttgagagttgcatcatggtttggttctattatgacatacgtgaggtgccgactatttcttcagccttttttttctctgggtttgagacatatttgggtttatcgtgattcaatttcttttgttggtagtgatttatcatgactggattatgggattgattgtaaggcaaaagaattacgctataaacttggaacacccatatttccattttatcttttcaaattgtttggattgattgtgaatgtggttagtagccgtctgtcttgtctttttgtgccaaggtttgtatgcaattgcagtttagctttggttggaaacgcagaagcttctattttttgagtctatttgtgagtatttcttttcattgactactactaaaatgatttcggtttgagtcattcaaatcttcctttcaaagtgaagcacccattcttttatgtttttcacaggctttaatgtttagaaataattataatggtatcccccacgtacctacacatctatagaaattaaaggagaagaattcttttgaccaaaattaaataaatatggaaacgtgtgttgaaatagagatggaaaaatatatactactactactacaaaaaaagttcattgacgtctttgtcatgtcttggaaagattattttataccatcatggtatttc

SEQ ID NO: 6479 - DNA, 1618 bp, Silene vulgaris
gatttcgaattccaattccaattccgtatttgctgtctttccttctctctctgtttggcattccagctaaacggagattctgaggacgatctgcattcgaaaaagccgacttcaaggatgcggaagtggctctgttgcacttcccatgtcgaagagtcctatccatcaaaggaggagcttcttaaaagccctaataacaatgcagaaaggcccccaaatgcgaaagtagcacctccggtcaaggaagaagtacaaaagacagcaccggcgattgaagtacctgctttatctttagaagagcttaaggaaaagaccgataacttcggttcaaaggcgttaataggtgaaggttcctatggaagagtgtactatgccactttggaatgtggcaaggcagtggctgttaaaaagcttgatatttcccaggagcccgagtccaatgttgaatttttgacacaggtttctagagtctcaactttgaagcacgagaattttgttgagctgcatggttattgtgtggagggaaatatgcgagtgttagcttacgaatttgcaaccatgggatccttgcatgacattttgcacggtaggaaaggtgtgcaaggtgcacagccgggtccagtacttgattggatgcagcgagtgaggattgcaatcgatgctgcaaggggattggaataccttcatgagaaggttcaacctcctattatccacagagacatccgatcgagtaatgtgctcttattcgaagacttcaaggccaagattgctgatttcaatctttcaaatcaggctcctgatatggctgctcgtcttcattctaccagggtcttgggtacctttggctatcatgcacctgagtatgccatgaccggacaattgatgcaaaagagtgatgtttacagctttggcgtggttcttctagagcttctcactggccgcaaaccggtagatcacaccatgcctcgtggtcaacaaagtctcgtgacttgggcaaccccgagactgagtgaggacaaagtcaagcagtgtgttgaccccagattaaaggattaccctgcaaaaggagtcgctaagttggcggcagttgcagcactttgtgtacagtatgaatcagagtttaggccaaatatgagtattgtcgtcaaagcgctacaaccattgttaaagctaccagctccgacacccgagagttaaagaagtgggacttgtctaatttcttggatggagtgccccatgtccatatgataggcttctgttactaccatgtatctttcaatccacttattggtacccgcaaatttgtgggttggattggctgtgaacgagttggggttttggaatgctttcgagttataagcttgtactttcgcagggtgctattatttgtacctagaaacacaaaaaaagttgatgattcggcaaggatattcaaacgatatgtccccgccgaaactctgcaacagttgttagacatccttgcaaaaaaggacaccggcatacatcgggaattatttaatatagatcagaacgagttgccaaaatacatcgattcattaaaggacgatatccggcctgcacagcgggcggaactcatagattccttatattcagaaaa

SEQ ID NO: 6480 - DNA, 1563 bp, Arabidopsis lyrata
gtagttatttgggattcccatttttttcattcctaaattactccacgacctcatcacctcctttcgtccctgcctctcatttgtctaccagcattttttctttttgattcgtctctctggtttattgctcgttgatcgtttgtttctaaattgcattttgatttctgatatatggatcgtgattttcatcgtcgtggtcaagtggcgaatgatcgtacacaaagcaactttgttcgattggataaaccgagagctgtagacgatattgacataggcaagagagggaagatgcgtaggtggttgtgctgttcttgtcgtgtacaagaatcttacccaacagctgaacataaccgcttgaaaacccctcctactcgccattacgactatggacgtaacaacaagaaagcaccagctcctgtgaagcctcctgtcttgaaggagcctcctcccatcgacgtccctgcaatgtcattggttgagctcaaagaaaagactcagaattttggatcaaaggcattgattggagaaggatcctatggaagagtgtactatgcaaactttaatgatggaaaggccgtggctgtgaaaaagctcgataattcatctgaacctgaaacaaatgtcgagttcttgactcaggtctcgaaagtttcgaggctgaaaagtgacaattttgttcagcttcttggttattgtgtagaaggaaaccttcgtgtccttgcatatgagtttgccacaatgggatcattgcacgacatcttacacgggagaaagggagtgcaaggagcacaacctggcccaacacttgagtggatgcaacgagtccgagttgcggttgatgcagctaaaggactagaatacttacacgagaaagtacaacctccggttatacacagagatatccgatctagcaatgtgcttattttcgaagatttcaaagccaagattgctgattttaatctttctaatcaagctcctgatatggctgctcgtcttcattccactagagttttggggacattcggttatcacgcaccagaatatgcgatgacaggacagttgacacagaagagtgatgtttacagttttggagttgtgcttttggagcttcttaccgggagaaaaccggtagatcatacgatgcctcgtggtcaacagagtcttgtcacttgggctactccaaggctgagtgaagacaaagtgaagcaatgtgtagatccaaaactcaaaggagagtatcctcctaaagctgttgcaaagctcgcggcggttgcagcgttgtgtgtgcaatacgaagcagagtttaggccaaacatgagcattgtagtaaaagctcttcaaccgctcttaaggtcagcaacagctgttgctcctccaacacatcaagcttgattcttctttgtggttcttgcatactgattatcttaaggcttcaaggttttttctttactttaatctgtctatttaccatggaatgtaaatgggttatcaaggagagatggtgagtagcaattgggatttcactctatggaaatgatttgtgctatttttgatgggttaatt

SEQ ID NO: 6481 - DNA, 778 bp, Ocimum basilicum
atggacggaaaggagtgcaaggggcacaacctggtcctacgcttgactggatgcaacgggttagaattgctgtcgatgctgccaggggattagaatatttgcacgagaaaactcagccttcaataattcatagagatatcagatccagcaatgtacttcttttcgaagattacaaggccaagattgctgattttaacctttcaaaccaagctcctgatatggctgctcggcttcactctactcgagttctgggaacttttggttatcatgctccagaatatgcaatgactggacaattgacacagaagagcgatgtttatagctttggggttgttctgcttgagcttctgaccggaagaaagcctgttgatcatacaatgcctcgtggacagcagagtcttgttacttgggccactccgagattgagcgaggataaagtcaaacaatgtgttgatccgaaactcaaggagtacccaccaaaaggggttgccaagctggcagctgttgcagcgttgtgcgtgcagtacgaggctgagttccgcccgaatatgagcatcgttgtgaaggctctgcagcctcttctgaagtcgacgatgcctcctccagaggcgtcttagcttcagataagttgaatcgatgggcgtgcttgtcttgttcgagttgcattgttgtgatcgtcacctcttttcttgagcctttatttctctgggtttggtgagacgttaatttgggtgtcttcttccgatttcttctgttggtagtgattatatattgtaag

SEQ ID NO: 6482 - DNA, 1537 bp, Centaurea maculosa
  misc_feature (128)..(128): n is a, c, g, or t
  misc_feature (211)..(211): n is a, c, g, or t
  misc_feature (842)..(842): n is a, c, g, or t
  misc_feature (1166)..(1166): n is a, c, g, or t
  misc_feature (1223)..(1223): n is a, c, g, or t
  misc_feature (1361)..(1361): n is a, c, g, or t
  misc_feature (1401)..(1401): n is a, c, g, or t
  misc_feature (1535)..(1535): n is a, c, g, or t
cggattcccgggattctttctttctctctcctctttctttctttctttcttcttcttgcttatctgtctttcccccaattctccatcttctgaagaaaagaaacaaatcaagccctaattcaacaaancaaaccccaaaactcacagacacaataacacagttacccgcaccccctcctttacactttcgacctttgggaaaaccgagagntaaagacgatctaattttgaggaagagagataggatgcggaggtggttgtgttgtacttgtcaagttgaagagcgttacccaccaaatgacaacggattggtaaaaaaccacagtgatcactccgatgggcagcaaaaggactcgaaagcaacaccacctgtcaaatttgacgttcataaagcagtcccaaagatcgaagtgcctgcactttcactcgatgaactgaaagacaaaaccgagaattttggatcaaaggcattgatcggtgaaggttcatacggaagggtttactttgcaaccttagataatggaaaaaccgtggctgtgaaaaagcttgatgtctctactgaggctgaatcaaataacgagtttttgactcaggtttcgatggtgtcaacgctgaagcatgacaatctcgttgagttgtgtggttactgtgttgaaggaaatacccgtgtcttggcttatgaatttgcaaccatgggatctctacatgacatattgcacggtaggaagggtgtgcaaggagcacaaccggggcccgtgcttgattggatgcagcgagtaaagattgctgtcgatgcagcaaagggactggattacttgcatgaaaaagttcaaccttcgatnattcatagagatattaggtctagcaatgtgttactatttgaagaccttagagccaagattgcggatttcaacctttcgaaccaagcaccggatatggctgctcgcttgcattctactcgtgtgttgggaacttttggctatcatgcaccggaatatgcaatgacgggccagttgacacaaaagagtgacgtgtatagctttggggttgttctccttgagcttctaaccggtcgaaaacctgttgatcacacaatgccacgtggacagcagagtcttgtcacttgggctacaccaaggctaagtgaagacaaggtgaaacaatgngttgatccaaggctcaagggagagtaccctccaaaagcggttgcaaagctggcggcngtggcggctttgtgcgtgcagtatgaggcggagttcaggccgaatatgagcatcgtggtgaaggctcttcaaccactgttgagggctccggcagcggcaccggcagcaccggcaccggaagtgtaacgtaaacggaangagtttcggttggtcgggtcgatcggtctacaggctttgngattgtagattttggtttgaggcatatatagtagtggttttctttgcatttatattttttgatttgagaaagaatgatgtgcactttgtgttttgtttgtcaagatttgttcaataatggaatcctgcttttantc

SEQ ID NO: 6483 - DNA, 1883 bp, Eucalyptus grandis
atcaacgcctacaaggaaaaagaataataatataatacagaaagaccaaaagagaacaagcagccgcgacgcgtttgcttctctgttctgtcaccccagccaaaaagcagagcagcgagaaaaagcgagagacctcttccgaacgcacctgtactttccccccactcatttcccccctccccatccaccgcagcataacccacatctcaagaagaagcccttcttcggccatcgacgcagagcgagcgtgcgtgcgtgcttgcgtgtctctgagagagagagagagagagagagagagagagaaggggagagtggagaaacaggcacatgcttctcctcctagtcactttatgcgactggacagaccgagggcacaagacgatcttttattaaggaagagggataggatgaggaggtggctttgttgcacatgtcaagtggaagagtcttatccatccagggatgatgagcttcttaagagccctaggcaccatgctgatgggtacccaaaaggctcaaaggcatcagtccccatcaagcctgaggtgcagaaggcaccaccacctatcgaagtacccgctttgtctttggatgaattgaaagagaaaactgataactttggatcaaaggcgttgataggtgaaggatcttatggaagagtatattatgcgagcttagatagtgggaaagtggtggctgtcaaaaagcttgatgtttcttctgagcaagagtcgaacatagaatttctgacacaggtctctgtggtttcgagattgaagcatgaaaattttgttgaattgcttggttactgtgtggagggaaatctccgggtacttgcttatgagtttgctaccatgggatctttgcacgatgttctacatggcagaaagggagtccaaggtgcacaaccaggtcctacacttgactggatgcagcgagtcagaatcgctgttgatgcagcacgtggtctggagtacttgcatgagaaggttcagccttctataattcacagagacattagatccagcaatgttcttctatttgaagatttcaaagcaaaaattgcagacttcaacctgtcaaatcaggctcctgatatggctgcccgtcttcattctactagagttttgggaacctttggctaccatgctccagagtatgcgatgaccgggcagttgacccagaagagcgatgtctacagctttggcgtcgtactcttggagctcttgaccgggagaaaacctgttgatcatacaatgccccgtggacagcagagcctagtcacttgggctactccaagattgagtgaggacaaagtcaaacagtgtgttgatcccaagctgaagggagattatcctccaaaggcagtcgcaaagttggcagctgttgctgcattgtgtgtgcaatatgaagctgaattccgtcccaacatgagtatagttgtcaaggctcttcaaccgctcttgaagactgcagttccacctgcggctcctccttctgagacctaaagctagacaaatcgaaagcttcctctggctgtttgccttttctcgcttctcgtgcacagtttgttttattctacagagtcaatggaaaggactcgtattcttttaatttttctttataaagatgagcgtgcgtgcggaaattggatagacccatttctgtcaatgagtgcgatttgtttgaatgattatcgatgctccttttcctggagagttcggactgaagatgggaatggactttgtgcttgggtggtgttccacgagtggtgtaaaatctttgttaatttatgcaacgggtctgatttgcatgagacaccttgagtactttagctgcataagcagaatgggcttttgtttatctgatgctgcagtttactt

SEQ ID NO: 6484 - DNA, 1638 bp, Eucalyptus grandis
  misc_feature (588)..(588): n is a, c, g, or t
  misc_feature (732)..(732): n is a, c, g, or t
  misc_feature (1101)..(1101): n is a, c, g, or t
  misc_feature (1212)..(1212): n is a, c, g, or t
  misc_feature (1275)..(1275): n is a, c, g, or t
cgcgtttgcttctctgttctgtcaccccagccaaaaagcagagcagcgagaaaaagcgagagacctcttccgaacgcaactgtactttcccccactcatttcccccctcccccatccaccgcagcataacccacatctcaagaagaagcccttcttcggccatcgacgcagagcgagcgtgcgtgcttgcttgcgtgtctctctgagagagagagagagagagagagagagaaggggagagtggagaaacaggcacatgcttctcctcctagtcactttatgcgactggacagaccgagggcacaagacgatcttttattaaggaagagggataggatgaggaggtggctttgttgcacatgtcaagtggaagagtcttatccatccagggatgatgagcttcttaagagccctaggcaccatgctgatgggtacccaaaaggctcaaaggcatcagtccccatcaagcctgaggtgcagaaggcaccaccacctatcgaagtacccgctttgtctttggatgaattgaaagagaaaactgataactttggatcaaaggcgttgataggtgaaggatcttatggaagngtatattatgcgagcttagatagtgggaaagtggtggctgtcaaaaagcttgatgtttcttctgagcaagagtcgaacatagaatttctgacacaggtctctgtggtttcgagattgaagcatgaaaattttgttgaattgctnggttactgtgtggagggaaatctccgggtacttgcttatgagtttgctaccatgggatctttgcacgatgttctacatggcagaaagggagtccaaggtgcacaaccaggtcctacacttgactggatgcagcgagtcagaatcgctgttgatgcagcacgtggtctggagtacttgcatgagaaggttcagccttctataattcacagagacattagatccagcaatgttcttctatttgaagatttcaaagcgaaaattgcagacttcaacctgtcaaatcaggctcctgatatggctgcccgtcttcattctactagagttttgggaacctttggctaccatgctccagagtatgcgatgaccggncagttgacccagaagagcgatgtctacagctttggcgtcgtactcttggagctcttgaccgggagaaaacctgttgatcatacaatgccccgtggacagcagagcctagtnacttgggctactccaagattgagtgaggacaaagtcaaacagtgtgttgatcccaagctgaanggagattatcctccaaaggcagtcgcaaagttggcagctgttgctgcattgtgtgtgcaatatgaagctgaattccgtcccaacatgagtatagttgtcaaggctcttcaaccgctcttgaagactgcagttccacctgcggctcctccttctgagacctaaagctagacaaatcgaaagcttcctctggctgtttgccttttctcgcttctcgtgcacagtttgttttattctacagagtcaatggaaaggactcgtattcttttaatttttctttataaagatgagcgtgcgtgcggaaattggatagacccatttctgtcaatgagtgcgatttgtttgaatgattatcgatgctccttt

SEQ ID NO: 6485 - DNA, 1725 bp, Podocarpus macrophillus
gataatccgtgttttaggtatttcttcatcgattctggtggggaaatttttgggcgtggaagacccagtctttgctttttgtgatctctgttgtgccggtgcaggattcttctcacagatcagaaaaacaatgcgtcgttggctttgctgtgcctgcgcagtggatcctgctcccgaacaacctgagaatcaatacttgaatgcgacaaagccccctgcaaatggaaaccagggagattttagagcatccgagggagcaaagggtggcgctccacagaaagtgcctcctattgaaacacctgctttatcactagatgagttgaaggaagcaacagataactttggtccaaaggcattgattggagaagggtcatatggaagagtatactatgcaacattaagcgatggttctgctgcagcaataaagaaattggatgtcagcagtcagccagaggcaaactcagaatttttagcacaggtttcaatggtctccaggctgaagcatgaacatgtggttgaactggttggctactgtgttgaagggaaccttcgtgtgttagcttatgaatttgcaacaatgggctctttacatgatattttacatggacgaaaaggagtgcaaggtgcccaacctggtccagttcttgattggattcaacgagtaaaaattgctgtgggcgcagcaaagggtcttgaataccttcatgagaaagctcagccccatattattcatcgagatattcgatctagcaatgttttactttttgatgacttcaaagcaaaaattgctgatttcaatctttctaatcaagctcctgacatggcggctcgccttcattctacacgtgtcctgggaacatttggctatcatgcacccgagtatgctatgactggacagctaactcagaagagtgacgtatatagctttggggttgtgctgcttgaactactaacaggtagaaagcctgttgaccacacaatgcctcgtggacaacaaagtcttgttacttgggccactccaagattgagtgaagataaagtaaagcagtgtgtagatccaaagctgaagggagaataccctgccaaggctgtggccaagctagctgcagttgcagctctgtgcgtgcagtatgaggcagatttccgtccaaacatgagtatagtagtcaaagcgcttcagccactgctcaatccaaagccagcagctcctgcacctgaaaatcagagttgatgaccattcatgatgcacttttctatatgtttgaggttttgttcaagattgagttatattaaggtggcaagatgttacatgggctgcaggctatctcaattcaaatcataagctgcattacttttctgaagcttcaggttttgttcatgagtctgaagatttctacatattctttttttaaaatccctatattctttggttacatatgaaggaaagtttggttgtgctgtccacctaaaggtcattgagttagttccaaggaatggattctttgtctattatgtttcctagaacctatgtgtcagacacagttctaggaatacttttcagtcttggcggaggaggtatttgtagtgttatttagatattgtttcatttgttttgctgtgtaaatatatatattttatatgttgttgtagtttttttggctattgcaattattaccctaataaatttgtttgagatggtaatgggagataaggctaatcatggtc

SEQ ID NO: 6486 - DNA, 943 bp, Raphanus sativus
tatgagtttgcaacaatgggatcattgcatgatgtcttacacggaaggaagggagtccaaggagcacaacctggtccaacacttgagtggatgcaacgagtcagagttgcagttgatgcagctaaaggattagaatacttgcatgagaaagtacaacctgctgttatacacagagatattcgttctagcaacgtgcttctctttgaagatttcaaagccaagatagctgattacaatctgtcaaaccaagctcctgatatggctgctcgtcttcattccactagagttttggggacatttggttatcacgcaccagaatatgcaatgacaggacagttgacacagaagagtgatgtttacagttttggagttgtgcttttggagcttctaaccgggagaaaaccggttgatcatactatgcctcgtggtcaacaaagtcttgttacttgggctactccaaggttgagtgaagacaaagtgaagcaatgtgttgatccaaaactcaaaggagagtaccctcctaaagcagttgcaaagcttgcagcggttgcagccttgtgtgtgcaatacgaatcagagtttaggccaaacatgagcattgtagtaaaagctcttcaaccactcttgaggtcttcaggaacagctgctcctcctcacaaccatcaaaactgattctcttctttgtggttcttgcatattggattcattcatggcttcaaggtttcttttgtttctccttttttttctgtttacaagtggttatgtaaatgggtttttaaggaagagatgtgagtagagtaacacggatgtgttgtgttaaacgtttttgatggatcatcatctaaacattgtttgttgttttactattataagctctgattcttggaagataatccgaatgtacacacttataacaaatctattttgattcgttactttatac

SEQ ID NO: 6487 - DNA, 1532 bp, Helianthus annuus
aggatttctttctctctctaacaacccgtttctttctctctctaactgcttatctgtctttccccaatttctccatcatctcaaaaaaacaaaacaaaatccccaattaaaccaagccctagatcaacaccccataactgtcacaacaacacagggacacgtgccacctggatactttagacgtttggggaaaccgagggctcaagacgatttgatattgaggaagagagataggatgcggaggtggttgtgttgtacctgtcaagtcgaagaatcttacccctcaaatgaaaacggattgacgaaaagccacagtgccaatgctgatgggcaccaaaaggacaaagtaccgcctcctgtcaaattcgatgcgcaaaaacccgtgccaacaatcgaagtgcctgcactttcacttgatgaactgaaagaaaaaaccgagaactttggatcaaaagcattgatcggtgaaggttcatatggaagagtttatttcgcaaatttaaataacggtaaaagtgtggctgtcaaaaagcttgatgtttctaccgaggctgaatcagataacgagtttttgactcaggttgcgatggtctcaacattgaagcacgagaatcttgttgagctatgtggttactgtgtggaaggaaatacgcgtgtcttggcttatgaattcgcaaccatgggatctctacatgacatattgcatggcaggaagggtgtgcaaggagcacaaccggggcccgtgcttgattggatgcagcgcgtaaagattgctgttgatgcagcaaagggactcgattatttgcatgaaaaggtccagccgtcaataattcacagagatgttaggtccagcaacgtgctactatttgaggatttaagagccaagattgccgatttcaatctttcgaatcaagcacctgatatggctgcacgtttgcattctactcgtgtgttgggaacttttggctatcatgcgccagaatatgcaatgacgggacagctgacacaaaagagtgatgtgtatagcttcggggttgttctgcttgaacttttaactggtcggaaacctgttgatcacacaatgccacgtggacaacaaagccttgtcacttgggctacaccaaggctgagtgaagacaaggtcaaacaatgtgttgacccgaggctcaagggagagtaccctccaaaagcagttgcaaagctggcggcagtggcggctttatgtgtgcaatatgaggctgagtttcggcctaatatgagcattgttgtgaaagctcttcaaccactgttgagagctcctgcacccgcagcagcagcagcagctccagaagtataatgtgaacgacaaagcaaaggagtttgtgagcgttgatttgcatccgtagattttggtttgaacgaggcatataatagcgttatcgttgcatttatattttttggtttgaaaacatggatgcgtggttatgttcagattggtctgtgacatatctttggtttgtcaagatttgtttaataagggaatatatggtttt

SEQ ID NO: 6488 - DNA, 1643 bp, Nicotiana tabacum
  misc_feature (271)..(271): n is a, c, g, or t
  misc_feature (1097)..(1097): n is a, c, g, or t
  misc_feature (1180)..(1180): n is a, c, g, or t
  misc_feature (1366)..(1366): n is a, c, g, or t
  misc_feature (1416)..(1416): n is a, c, g, or t
  misc_feature (1426)..(1426): n is a, c, g, or t
  misc_feature (1465)..(1465): n is a, c, g, or t
  misc_feature (1490)..(1490): n is a, c, g, or t
  misc_feature (1498)..(1498): n is a, c, g, or t
  misc_feature (1506)..(1506): n is a, c, g, or t
  misc_feature (1518)..(1518): n is a, c, g, or t
  misc_feature (1520)..(1520): n is a, c, g, or t
  misc_feature (1534)..(1534): n is a, c, g, or t
  misc_feature (1558)..(1558): n is a, c, g, or t
  misc_feature (1596)..(1596): n is a, c, g, or t
  misc_feature (1617)..(1617): n is a, c, g, or t
ggccattacggccggggggggggatcaatttgaatttgactaaatttcatttttattttttctctcattttcaactttcccaattcatttttggaccctctggatctaacccttgtctgagaaattttcaagatttgattctttttgttcattttgtattgtggattgtaatatttgtttaatttgattgctatggatgataattttcacaggcaagggctagtggcacatgctcctcctcctggtcacttttcacggttggaaaacagangggctgaagacgatctttatttgagaaagagagtgaggatgagaaggtggctgtgctgcacctgtcaagtagaggaatcctacccatcaaatgaaactgagcaccttaaaaaccctgcaactcatgctgatggatatcagaacgggtcaagagtaccagctcctgccaaggctgaagcagaaaaagcaataccaactatagaggtcccagcattgtctttggatgaactgaaagaggaaactgacaattttggatcaaaagcattaattggtgaaggttcttacgggagagtatactatgctaatctaagcaatgaaaaagctgttgccgtgaaaaagcttgatgtttcatccgagcctgagactaatgttgacttcttgactcagcttgctagagtttcaagattgaagcatgacaatcttgttgagttgcttggttactgtgttgaaggaaatattcgtgtattagcgtatgaatttgcaacgatggggtccttgcatgatattttgcacggaaggaaaggagtacaaggggcgcagccggggccaacacttgattggatgcagcgggtaaagattgctgttgatgccgcaaggggactcgagtatttgcatgagaaggtccaaccttcaataatacacagggatataagatcaagcaatgtactcctcttcgaagactacaaagcaaagattgcagattttaacctgtcaaatcaggctcctgatggctgctcgccttcattctactcgagttttaggaacatttggctatcatgcaccggaatacgctatgactggacaactgacacagaagagtgatgtgnatagctttggggtggtcttgcttgaacttttgaccggaagaaaacccgtagaccatacaatgcctcgaggacagcagagcctngttacttgggctaccccgagactgagcgaagataaagtccagcaatgtgtcgatccaaagctgaaaggatatcctcagaaagcagtggctaagatggcagctgtggcagcgctgtgcgtgcaatacgagtctgagttccgtccgaatatgagtattgttgtcaaagctctccaaccactgttgaangctcctcctgcacctgctccagaaatatagggagcatattgtcacttcgnttgttttggnttctctactgataatttgcactgttttggtatatcatgncaggatttcatttgtaacatgacanaaaaatangacttctncaaaattttccncntatttgaaagtggngtgtatgattgattgcttaacttncatggtgagattgttgaggatttcctgagactgagggntgtctataatttttttattanaaaaaaaaaccggattccgtccccaa

SEQ ID NO: 6489 - DNA, 1433 bp, Tripterygium wilfordii
aaagagatagaagaagagcaggcacatgaaccatctcctcgtgtttttgtacgtctggaaaaaccaagtgcacaagacgatttatatctgaggaagagagtcaggatgcgtaagtggttgtgctgtacatgtcaagtggaagagtcttacccgtcaaatgaaaatgaacacctgaagagcccaaataatcatatagatgggtatccgaaaggctcaaaggtgtcagctcctgtcaaacctgaagtgcaaaaggcagtacctatcattgaagtgcctgcattgtctttggaggaactgaaagagaagactgagaattttggatcaaaggctttgattggtgaaggatcttatgggagggtgtattatgcaaacctcgataatgaaaaagctgtagctgtaaaaaagcttgatgtttcatctgagccagaatcaaatgttgagttcttgactcagatctccatggtctcgagattgaagcatgacaatattgtggagttgcttggttactgtgttgaggggaatctccgtgtgcttgcgtacgagtttgcaagaatgggatctctacatgacatattgcatggtagaaagggagttcaaggcgcacaaccaggtccaacacttgattggatgcatcgtgtaagaatcgcagttgatgcagcaagagggttggaatacttgcatgagaaggctcagccaccggttatacacagggacattagatcgagcaatgtgcttctctttgaagactttaaagccaagattgcagatttcaacctttcaaatcaggctcctgatatggctgctcgtcttcattccactcgagttttgggaacctttggttatcatgctccagagtatgcaatgaccggacagctgacccagaagagtgatgtgtacagctttggggtggttctgctggaacttctaactgggagaaaacctgttgatcataccatgcctcgtgggcaacagagtcttgttacctgggctactccaagactgagtgaagacaaagttaagcagtgtgtagatccaaagctaaagggagaatatcctcctaaaggagttgccaagttggcagctgtggcagcactatgcgtgcagtatgaagctgagttccggccaaatatgagcattgttgtcaaggctctgcaaccgcttctgaaggctccggctccggctccagcttcagctccgactgcagctcccgagacttagtgcctgctataggcagtaactgaattgtgttgggatctcaggaaattgtgcagagtttgatacgtctggccagcgatttcatcaattctcgcatatttttttaaatcttttcgtatgtgagatgagatgtttagaattggattggattgagctgtttaatgttgcagttgctggtgttgtaccaggatggatgtactgatgtcttgagttcaaaa

SEQ ID NO: 6490 - DNA, 1101 bp, Brassica napus
actacgcaaagtttaatgatggcaaggccatggccgcgaaaaagcttgataatgcatctgaaccagagacaaacgttgagttcttgactcaggtctccaaggtttcaaggttgaataatgacaactttgttcagcttcttggttattgtgttgaaggcaatgttcgtgtccttgcttatgagtttgcaacaatgggatcattacacgacatcttacacggaagaaagggagttcaaggagcacaacctggtccaacacttgagtggatgcaacgagtcagagttgcagttgatgcagctaaaggattagagtacttacacgagaaagttcaacctgctgttatacacagagatattcgttctagcaatgtgcttctatttgaagacttcaaagccaagattgctgattacaatctgtcaaaccaagctcctgatatggctgctcgtctccattccactagagttttggggacgtttggttatcatgcaccagaatacgcaatgacaggacagctgacacagaagagtgatgtttacagttttggagttgtgcttttggagctcctaaccgggagaaaaccggttgatcatacaatgcctcgtggtcaacaaagtcttgtcacttgggctactccaaggttgagtgaagacaaagtgaagcaatgtgttgatccaaaactcaaaggggagtaccctcctaaagcagttgcaaagcttgcagcagttgcagctttgtgtgtgcaatatgaatcagagtttaggccaaacatgagcattgtagtaaaagctcttcaaccactcttgaggtcttcaggagcagctgctcctcctcctaaccctcacacttgattattcttctttgtggttcttgcatattggattcattcatggcttcaaggtttcttttgtttctcatttttctatttacaaatggttatgtaaatggaagttattaaggaagaaatggtgagtagaggaacatggatttgttgtgttaaacgtttttgatggataatcacctaaaaattgtttgttgttttactattataagcctctcattcatggaatataatccgaatgtacacacttataacaaatattt

SEQ ID NO: 6491 - DNA, 1000 bp, Brassica napus
tacgcgacactaaacgatggcgtagcggttgctctgaagaaacttgatgtctcacctgaagctgagtcagatgctgtgttcttgagtcaggtttcaatggtttctagactcaaccatgagaatctcgttcaactacttggcttctgcgttgatggaagcctccgcgtccttgcgtacgagtttgcaacaatgggatcgttgcatgacatcttacacggtaggaagggagttcaaggagcacagccaggtccaacactagactggacaacgagggtgaaaatcgcggtcgaggcagctaggggtttggagtaccttcacgagaagtcgcagcctcctgtaatccatagagatataagatccagcaacgttcttctttttgaagactacaaggccaagattgctgatttcaacctctcgaaccaagctcctgataacgctgctcgtcttcactcgacaagagtcttgggaactttcggctaccatgctccagaatatgcaatgactggacagttgactcagaagagtgatgtgtacagctttggggttgtgcttctagagcttctgactgggaggaaaccggttgatcacaccatgcctcgtggtcagcaaagtcttgtaacttgggcgacaccaagactcagtgaagataaagtcaaacagtgcattgatccaaagcttaaagcggattaccctccaaaagcagttgctaagctagcagcagtggcagcattgtgtgtgcaatatgaatctgagtttagaccaaatatgagcatagttgtgaaggcgctgcagccactcctcaaacttgcagctccagctcctccctctccagcgccagagtcatgaaacttttctttttatttgcaaactatcagataactatgaaaagatgatattaatgtttcatttgatggatgattgattttgcacacagttttgttgtgctagaagaagagagattatgtgagtgggagagataacaaagacttttgactattaa

SEQ ID NO: 6492 - DNA, 1785 bp, Orobanche aegyptiaca
gtataacgtagcttttctctaatccactccaccgcccaggccgtgtagaatctctctcttccctcccttttcatttgttggtttatttgccttgcctggctgtccgctcaactgtcttgccatctcctttgttattgttacttttataaaacaaaaatcctcattgccatacatatatacacacatacatatatatatatatataacaagatttggtatttaattattctgtatagacagggtcgataaacgaagagaattaaaggtgaggagaaaagggacaggcaagaaaagaaaaggaaattaaaagaggcccatgaatttcggctcaggcacctcctcccggttactttgtacgcttggagaacaagagtgctgaagacgatatctatttgaaaaagagaacaaggatgcggaggtggctgtgttgcacctgtcaagtagaggagtcctatcaacccaacgaaaatgagcacctcaaaagcccaaagggtcatgctgatggctatcaaagaggttctaaagcatcagcagctccaatgaagcaagaagttcagatacctcctattgaggtgccttctctgtcactcgaggaactgaaagagaaaaccgacaattttggatcaaaatcattaattggtgaaggatcttatggaagagtgtactttgcacagttgaacaatggaaatgaggttgctgtcaaaaaacttgatgtttcttctgagcctgattcaaatgttgagttcttgactcaggtttcaatggtgtcaaaaatgaagcatgaaaatcttgttgaattgcttggttactgtgtagatggtaatctgcgtgtgttagtttatgaatttgctaccatgggatctctacatgacattttgcatggaaggaaaggagtgcaaggggcacagcctgggcctgttcttgactggatgcaacgtgtaagaattgcagttgatgctgcaaggggactagaatatttgcatgagaaggtccagtcttcaataattcacagagatatcagatccagcaatgtacttttatttgaagactacaaagccaagattgcagatttcaacctttcaaatcaggctcctgacatggctgcacgccttcattctactcgagttctgggaacctttggttatcatgctccagaatatgcaatgacaggacagttgacacagaagagcgacgtttatagctttggggttgtgctgcttgagcttctgactggaaggaagcctgttgatcacaccatgcctcgtggacagcagagtcttgttacttgggccactccaagactgagcgaggacaaagtcaaacaatgtgttgatccaaaactcaagggagagtatcccccaaaaggggttgccaagctggcagctgttgccgcattgtgcgtgcagtatgaagctgagttccgcccaaatatgagcattgttgtcaaggctcttcagcctctcttgaagtcaactgtcccttctcctgaagtttaagtaccaacaggaatgctgtttgctacgtgtgtttgttttttgtgttttgctcagtttgggtcttatttttgcatgatcgccatattattattcattttccttttctctggtttgtccagacattgttggttgggtgctcttgttgtcggtgatgtgttattataaatgaagactgctgttatgcgagaatgagtgttttgtttaggcggcagaacttgttaaaacagggaacacatttgattttatttgtatttttcatattggtgataatatatatgttcttgagtgg

SEQ ID NO: 6493 - DNA, 1628 bp, Carthamus tinctorius
  misc_feature (280)..(280): n is a, c, g, or t
  misc_feature (308)..(308): n is a, c, g, or t
  misc_feature (382)..(382): n is a, c, g, or t
  misc_feature (497)..(497): n is a, c, g, or t
  misc_feature (712)..(712): n is a, c, g, or t
  misc_feature (966)..(966): n is a, c, g, or t
  misc_feature (1063)..(1063): n is a, c, g, or t
  misc_feature (1622)..(1622): n is a, c, g, or t
gaaagtttgggaagtgctaaaaatgggaataaagtagtaatgaaaaacgttgtttgacgacaaagacttcccaaaaacaaaattcatcaccgcccctttcgatctctttcttcacttttaggctgtttggagacagaaatcgaactaacaaagaggtagcactatttaaacacacccccctttctctttctcaatcattctctctttcatcattcttgcttaccctgtctgtcttctcgaatattcattcaatcataattaacacaaaaccctaaatcangaaagccagttcagaaaacccaggtgcntgcacctcgtggatgctttgtgcatgcgggaaactaagagctgaaaacggtctatctttgaggaactaaaatangatgcggaggtggttgtgctgtacttgtcaagtcgaagaatctgtaccatcaaatgacaatgaattcgtgaagaattcaacggatcatggggatgggcaccaaaagggttcaaanggatctcctatcaaatctgaagtgcaaaaagcagtgccaccaatggaagtgcctgcacttccattggaagaactgaaagaaaaaaccgacgattttggatcaaaagcactgattggtgaaggttcatatggaagagtttattttgcaaccttgaataacgaaaaaactgtggctgtcaaaaagcttgatgtttctaccgaggctgagtccaatancgagttcttgactcaggtttccatgttctcaaggctaaagcatgacaatcttattgagttgctcggttactgtgtcgaaggaaatgtgcgtgtcctggcttatgaatttgcaacgatgggatctctacacgacattttgcatggtaggaagggtgtgcaggagcacaaccagggccagtgcttgattggatgcaacgggtaaggattgctgtggatgcagcaaggggactcgagtacttacatgagaaggcccnaccgtccataatacacagagatataaggtcgagcaatgtgctcttatttgaagacatgaaagcaaagattgccgactttaacctttcgatcagtcancagatatggctgctcgtttgcattctactagagtccttggcacctttggctatcatgcaccagaatatgcaatgactggactaacacagaagagtgacgtttatagctttggggttgtgctgcttgagcttctaacaggccggaagcctgttgatcacactatgcctcgtggacagcagagtctcgtcacttgggctactccaaggctaagtgaagacaaggttaaacaatgtgttgatccaaagctcaagggagaatatcctccaaaagcagttgcaaagttggcagctgttgcagcattatgtgtgcagtatgagtctgagttcaggcctaatatgagcattgtggtgaaggctcttcagccacttctcaaggcttcttctgcaccaccaccaccaccaccaccatcagcagatgaggtctagtagactcatcataaaagaaaaacaaaagaaaaggaaacatgggtgtgttcatctgtagattctatttccatctctatctatacacacacaaacacacacatacatatttatcatatatacataatatgcatcanaaaaaa

SEQ ID NO: 6494 - DNA, 1684 bp, Brassica napus
ctctgtcgcttcttttttacgctttctttcttttcttagctgttgctgtttctttctcttctctcttcctttttatcttttgtgttttgttccttgatcacagctcgtctccctttgtccctgtagcctctcattttgattcgtcctctctggtttattgctcgttgatcctttgtttctgtttgcttttttgcgtcatggatcgtgattttcatcgtcgtggtggtcaagtggcaaaggatcgttcaccgagcagccgctttgttcggttagataaaccgagatctgtagacgatcttgatataggcaagaaagggaagatgcgtaggtggttgtgctgttcttgtcatgtacaagaatctaaccaccctagagttgaacataaccgatccagaacacctcctactcgccactacgactacggacgtaatgataagaaaccaccacctcctatgaagcctgccgtgttgaaggagcctcctcccattgatgtacctacaatgtcactggctgagctcaaagaaaagacggagaactttggatctaaggctttgattggggaaggatcctatggaagagtgtactatgcaaagtttaatgatgggaaggcaatggctgtgaaaaagcttgataatgcatctgaaccagagacaaacgttgagttcttgactcaggtctccaaggtttcaaggctgaacaatgacaactttgttcagcttcttggttattgcgttgaaggcaatgttcgtgtccttgcttatgagtttgcaacaatgggatcattgcatgacatcttacacggaagaaagggagttcaaggagcacaacctggtcctacacttgagtggatgcaacgagtcagagttgcagttgatgcagctaaaggattagagtacttacacgagaaagttcaacctgctgttatacacagagatattcgttctagcaatgtgcttctctttgaagacttcaaagccaagattgctgattacaatctttcaaaccaagctcctgatatggctgctcgtcttcattccactagagttttggggacattcggttatcacgcaccagaatacgcaatgacaggacagttgacacagaagagtgatgtttacagttttggagttgtgcttttggagcttctaaccgggagaaaaccggttgatcatacaatgcctcgtggtcaacaaagtcttgtcacttgggctactccaaggttgagtgaagacaaagtgaagcaatgtgttgatccaaaactcaaaggagagtaccctcctaaagcagttgcaaagcttgcagcagttgcagccttgtgtgtgcagtatgaatcagagtttaggccaaacatgagcattgtagtaaaagctcttcaaccactcttgaggtcttcaggagcagctgctcctcctcccaacccccgcacttgattattcttctttgtggttcttgcatattggattcattcatggcttcaaggtttcttttgttttctcatttttctatttacaaatggtttatgtaaatggaagttattaaggaagaaatggtgagtagaggaacatggatttgttgtgttcaacgtttttgatggataatcatctaaaaattgtttgttcttttactattataagctctcattcatggaagataatccgaatgtacacacttataacaaatattt

SEQ ID NO: 6495 - DNA, 1625 bp, Brassica napus
tctctcttcctttttatcttttgtgttttgttccttgatcacagctcgtctccctttgtccctgtagcctctcattttgattcgtcctctctggtttattgctcgttgatcctttgtttctgtttgcttttttgcgtcatggatcgtgattttcatcgtcgtggtggtcaagtggcaaaggatcgttcaccgagcagccgctttgttcggttagataaaccgagatctgtagacgatcttgatataggcaagaaagggaagatgcgtaggtggttgtgctgttcttgtcatgtacaagaatctaaccaccctagagttgaacataaccgatccagaacacctcctactcgccactacgactacggacgtaatgataagaaaccaccacctcctatgaagcctgccgtgttgaaggagcctcctcccattgatgtacctacaatgtcactggctgagctcaaagaaaagacggagaactttggatctaaggctttgattggggaaggatcctatggaagagtgtactatgcaaagtttaatgatgggaaggcaatggctgtgaaaaagcttgataatgcatctgaaccagagacaaacgttgagttcttgactcaggtctccaaggtttcaaggctgaacaatgacaactttgttcagcttcttggttattgcgttgaaggcaatgttcgtgtccttgcttatgagtttgcaacaatgggatcattacacgacatcttacacggaagaaagggagttcaaggagcacaacctggtcctacacttgagtggatgcaacgagtcagagttgcagttgatgcagctaaaggattagagtacttacacgagaaagttcaacctgctgttatacacagagatattcgttctagcaatgtgcttctctttgaagacttcaaagccaagattgctgattacaatctgtcaaaccaagctcctgatatggctgctcgtcttcattccactagagttttggggacattcggttatcacgcaccagaatacgcaatgacaggacagttgacacagaagagtgatgtttacagttttggagttgtgcttttggagctcctaaccgggagaaaaccggttgatcatacaatgcctcgtggtcaacaaagtcttgtcacttgggctactccaaggttgagtgaagacaaagtgaagcaatgtgttgatccaaaactcaaaggagagtaccctcctaaagcagttgcaaagcttgcagcagttgcagccttgtgtgtgcagtatgaatcagagtttaggccaaacatgagcattgtagtaaaagctcttcaaccactcttgaggtcttcaggagcagctgctcctcctcccaacccccgcacttgattattcttctttgtggttcttgcatattggattcattcatggcttcaaggtttcttttgttttctcatttttctatttacaaatggtttatgtaaatggaagttattaaggaagaaatggtgagtagaggaacatggatttgttgtgttcaacgtttttgatggataatcatctaaaaattgtttgttcttttactattataagctctcattcatggaagataatccgaatgtacacacttataacaaatattt

SEQ ID NO: 6496 - DNA, 1319 bp, Abies balsamea
ggttttgcagagctagatttcattgaagtgaattatcttttaatcggaagtacaacatgcgtcggtggctttgctgtgtttgttcaacagagagtgcttctgaacaacctgagaaccaatacttgaatgcagcaaagaacaatgcaaacgggttccagggagactataaggtgtctgagggtgcaaagagtggtccaccgcagaaagtaccacctattgaagcacctgctttgtcattggaagagctgaaggaagcaacagataactttggggcaacggctttgattggggaagggtcctatggaagagtttactatgcaacattaaaagatggtcaacctgcagcaattaagaaattggatgtcagcagccagccagaggcaaatactgaatttttagctcagatttcaatggtctcaaggctgaagcacgaccatgtagttgagctggtgggctactgtgttgagggaactctccgtgtattggcttatgagtttgcaacaatgggctctttgcatgacattttacatggacggaagggagtgcagggggctcaaccaggcccagttctagattggatgcaagggtaaaaattgctgttggtgcagcgaagggtctcgagtaccttcatgagaaagctcagccccatatcattcatcgtgatattaggtctagcaatgttttgctttttgatgacttcaaagcaaaagttgcagatttcaatctttcaaatcaagcaccagacatggctgctcgcctgcattcgacacgtgtcctgggaacctttggctatcatgccccagagtatgccatgactggacagttgactcaaaagagtgatgtatatagctttggggtggttctacttgaactcctgacaggtagaaaacctgtagaccacacgatgcctcggggacaacaaagtcttgttacttgggcaactccaagattgagtgaagataaagtaaagcaatgtgtagatccaaaactcaagggagagtatcctcccaaggctgtagccaagttagctgcagttgcagcattatgtgtacagtatgaggcagatttccgtcctaatatgagtatagttgtgaaagcacttcaaccgttgctaactccaaaaccagcaattccagcatctgagcctcagacctgatgaccattcgtgttgcagacctctgtaaaattttgttcagagttggtttataagtgtgcaatggaatatttgaagtgcagtacttcaagagattgcattccaagattaaacagcgatggtattccaccgtccaggttcttccatgagttgggaatatgtactt

SEQ ID NO: 6497 - DNA, 2063 bp, Pseudotsuga menziesii
agcgcgtgcgcgcattcgacgggaattggcaatctatatctccgtgattcgtgctaattctactcgatctgtgttccattcgtgtaaattattttactctttccatttcttctcaggccctcccgagtcccgcctacaaattaccctgaccgattcttgcgaggagccgtctgcctgacggaatccggtgaccccgcacgcgctctagcctgcgtcgacgtttcctctcctttgcagcaacggggttacaagcgggaactttccgttaggttcggaccgccgcgttgaagcaatattctgctttctttaataatacgttggcgctctgataattattctcttattcttttaatcgacgggaagtttgccgttcagggttttgcagagctcgatttcagttaggcgaataatcgtttaatcggaagtacaacatgcgtcggtggttttgctgtgtctgttcaacagagggttcccctgaacaacctgagaaccaattcttgaatgcagcaaagaataatggaaatgggttccagggagactataaggcttctgaaggtgcaaagagtggtccaccacagaaagtacaacctattgaagcacctgctttgtcattagatgaactgaaggaagcaactgataactttggggcaaagactttgattggggaagggtcctatggaagagtttactatgcaacgttaagagatggtcaacctgcagcaatcaagaaattggatgtcagcagccagccagaggcaaattctgaatttttagctcaggtttcgatggtctcaaggctgaagcacgaccatatagttgagctggtgggctactgtgttgagggaactctccgtgtattggcatatgaatttgcaacaatgggctctttacatgacattttacatggacggaaaggagtgcagggggctcaaccaggtccagttctagattggatgcaaagggtgaaaattgctgttggtgcagcaaagggtcttgaataccttcatgagaaagctcagccccatattattcatcgtgatattaggtctagcaatgttttgctttttgatgacttccaagcaaaaattgcagatttcaatctttcaaatcaagctccagacatggctgctcgcctgcattcgacacgtgttctgggaacctttggctatcatgctccagagtatgccatgaccggacagttgactcaaaagagtgatgtatatagctttggggtggttttacttgaactcctgacaggtagaaaacctgtagaccacacaatgcctcggggtcaacaaagtcttgttacttgggcaactccaagattgagtgaggataaagtaaagcagtgcgtagatccaaaactcaagggagagtatcctcccaaggctgtagccaagttagctgcagttgcagcattatgtgtgcagtatgagtcagatttccgtcctaatatgagtatagttgtgaaagcactgcaaccgttgctagctccaagaccagcaattccagcatctgaacctcagacctgacgaccgttcatgttgcagacctctgtaaaattttgttcagagttgggttagaagtgtgcaatgcaatactgtctgtgcagtacttgaagagatagcattccaagattaagcagcgatactatgccaggtttttctatgtgttgggaatatgtacacattttacgtttttttatttcccattctttcgttccttatgaggaattttctacttgtatcgtaaccttgaggtcacttgtgtcggatccaagaagcagatcatttgtttgtaatatgtcttataacttctgtgtttcgcttgcagttctagcattatttttaatactggccgacaaggatgtacttacgtttagctttaccataattcatatttcacatatttcatgacttcgaaaaataaaagaaaaacaacttcattaaaagagaggataatctgatggaaagagaaccagcatccccactttctcatatgacactaaatgagtccaaccaatctcctcgatcaaagatagcctcaagtcataaagcttattt

SEQ ID NO: 6498 - DNA, 1806 bp, Picea glauca
tgattcgtgctatttctactcgatctctgttttattcccctaaattatttcaccctttccgtttcttctctcaggctctcccggctgcaaattaccctgacggattctagcgaggaatcgtctgcccgccggaatccggtgactcagcacgcgctctggcctgccgacgtttcctctcttcttctttctgttaatcgattgggagtttgccgttcagggttttgcagagctcgatttcagtgaagtgaattaccgtttaatcgggagtacaacatgcgtcggtggttttgctgtgcttgctcaacagagggtgctcctgaacaacccgagaaccaattcttgaatgcagctaagaacaatggaaatgggttccagggagactataaggcgtctgagggtgcaaagagtggtccaccacagaaagtaccacctattgaagcaccttctttgtcattagatgaactgaaggaagcaacagataactttgggccaaaggctttgattggggaagggtcctatggaagagtttactatgcaacgttaagtgatggtcaacctgcagcaattaagaaattggatgtcagcaaccagccagaggcaaatgccgaatttttagctcaggtttcaatggtctcaaggctgaagcacgatcatatagttgagctggtgggctactgtgttgagggaactctccgtgtattggcttacgagtttgcaacaatgggctctttacatgacattttacatggacggaaaggagtgcaaggggctcaaccaggtccagttctagattggatgcaaagggtgaaaattgctgttggtgcagcaaagggtctcgaataccttcatgagaaagcccagccccatattattcatcgtgatattaggtctagcaatgttttgctttttgatgacttcaaagcaaaaattgcagatttcaatctttcaaatcaagctccagacatggctgctcgcctgcattcaacacgtgtcctgggaacctttggctatcacgctccagagtatgccatgactggacagttgactcaaaaaagtgatgtatatagctttggggtggttctacttgaactcctgacaggtagaaaacctgtagatcacacaatgcctcggggacaacaaagtcttgttacttgggcaactccaagattgagtgaagataaagtaaagcagtgcgtagatccaaaactcaagggagagtatcctcccaaggctgtagccaagttagctgcagtcgcagcattatgtgtgcagtacgaggcggatttccgtcctaatatgagtatagttgtgaaagcacttcaaccgttactaactccaaaaccagcaattccagcatctgagcctcagacctgatgaccattcatcttgcagacctctgtaaaattttgttcagagttgggttagaaatgtgcaatggaatactgtaagtgcagtacttgaagagattgcattccaagattaagcagcgatagtattccaccctccaggtttctccatgagttgggaatatgtacttcacattttacgttctttttgatttcccattctttcattccttatgaggaaacttgtaccgtaacctcgaggtcacttgagtcggatccaagcaacagatcatttgtttgtaatagttcttataacttccgtgttttgtttgcatttctagcattatttattaatactggctgacaagggtgtacttgttttggttttctatgatttctattttcacatatttcatgtatatggatatcacgttgaaaagtttcgaatcaaaagaaaaaa

SEQ ID NO: 6499 - DNA, 515 bp, Brassica napus
ttgggcacctttggctatcacgctccagaatatgctatgacgggacagttgacacagaagagtgatgtgtatagctttggggttgtgcttcttgagcttttgacagggaggaaacctgtggatcacacaatgccacgtggccaacagagtcttgtaacctgggctacaccgagactgagtgaagataaagtgaagcagtgtgttgatccaaagctaaaaggagagtatcctcctaagtcagtagctaagctagcagcggtggcagcattgtgtgtgcaatatgaatcagagtttagaccgaatatgagtatcgttgtgaaagctttgcagccacttctcaaacctccagcgccggcccctgtacctgagtcttgagtttgttggattctttctttgttcatacaaagtttagtttgtattttggtgtgacagggagggatactttgatattttgcatttgttttatgtctggattggagcaacaaaagatgtattgcgtttgctgttcttttgac

SEQ ID NO: 6500 - DNA, 1571 bp, Panicum virgatum
atcggcagcgcgccgtcctcctgctccgtcctcctccgccgccgccgtcgcggaagggaaggatccgtccctccgaccgggcttcggttggtctcgccctcgccggggtgagaggtgacgggacggcggtatgaggcagtggttatgttgtaactgccaagttgatgacgaggaagatggccgtggcaaggagcaatccaaagttcagagcaataagatagacccgaagcagaagtcttcaaagcctcctgttagtcaacctgagccagagatttcccctcctacaattgatgtccctgacttatcattggatgacttgaaagaaaagactgataattttggatccagtgctctgattggtgaaggatcttatggacgagtatatcatgccactttggatgatgggaggcaagcagctgttaaaaaacttgatgcatctgaaaatgaacctaatgatgagttcttgaaacaggtctcactggcatcaaagctaaaacatgaaaatcttgttgagatgttgggttactgtgtggagggaaattaccgtatactagcatatggatttgcaaccatgggttctcttcatgatgttttgcatggaagaaaaggcgtccagggtgcacagcctggacctgtgcttgactggatgcaaagggtcaaaattgctattgaggctgcaaaaggtatagaatatctgcacgaaaaggttcagccctcaatcatccatcgggacatcagatcaagcaatgtactgctgtttgaggatttcaaggcaaaaattgcggacttcaatcttttgaaccaagcaccagatatggcagctcgcctccattcaactcgtgtattgggaacttttggatatcatgcaccagaatatgctatgactggccagctgacacagaaaagtgatgtctacagctttggtgtagtccttttagaacttttgactggtaggaaaccagtagatcacacaatgcctcggggacaacaaagtttagtcacttgggctactccaagattaagtgaagacaaggtcaagcaatgtgtagatcccaggttgaagggagaataccctccaaagggagttgctaagctcgctgcagtggcagctctatgtgtgcaatacgaagcagagttcaggcccaacatgagcattgttgtgaaggcgctttctcctctcctccaacaaagacccgcacctgccccatcagagccagccacggaacctgcaagctgaggccaagtcgcatgcgatgggacctgtgaaggcaaaagccatatcggaatcaggctatcagcacattctgtgtgtaattgagaatattttggatgttcattttgtagcgttcccaatcagataaatcatacatgaagttacccctgccgtttgtggccacctaggttcgccgcttgatatagccgcggtacaatggtatgtggtaggattgaagttctcttttcccttattaaccaactccgtagatttaaggaattcgccatgtttggatgaatagatgattttcggtctgcggcactatatcgctgctactttgatttcttgtgctggttta

SEQ ID NO: 6501 - DNA, 1199 bp, Brassica napus
ctacgacgaaggaccctaacgactaccactattgattacgggtacgaataaaagaagacgacctacgttgctttgtaagccagctgctttaaaggtaagaccaccatccatcgacgtccctcgcattgtcattagatgagttgaaagagaagacagataacttacggatcaaagactttgatcggtgaaggagtcctacggaagagcctactacgcaactctgaaagacggcaaagctgtagcagtcaagaagcttgacaacgcagccgagcctgaatcaaacatcgagttcttgactcaagtctcaagggtctctaagctgcaccatgagaatttcgtccagctctttggttactgcgtagaagggaacctccgcatactcgcttatgagtttgcaaccatggggtctttgcatgatatcttacacgggaggaaaggtgtccagggagcacagccaggtccaactcttgattggatccaacgggtgagaatcgctgttgatgcagcaagagggcttgagtatctacatgagaaggttcagcctgtggttatacacagagacattcgttccagcaatgtgcttttgtttgaagatttcaaagccaagattgctgatttcaatctgtctaatcagtctcctgacatggctgctcgtcttcattcgacaagagtcttgggaacgttcggttaccatgcaccggagtatgctatgactggtcagctgacgcagaagagtgatgtttacagtttcggtgtggtgcttttggagcttttgactggtagaaagcctgttgatcatacaatgcctcgcggccagcagagtcttgtcacttgggccactccgaggctaagtgaagacaaagtgaagcagtgtgttgatcctaaactcaaaggagactatcctcctaaagcagttgcaaagcttgcggctgttgcagcgttgtgtgtgcaatatgaatcagagtttaggccgaacatgagcattgtggtaaaagctctgcaaccgttgctgaggtcatcaacagcagtacctgttcaatcacaggggatatgattcttctatgtaataatgagagattggttttctgttttcatgtgtttgccatatcatatacaaatatgttcttcaaaagtctttttgtcgtctcttcttctatgtttgctggagttgttcgattcttataaaagtattctatata

SEQ ID NO: 6502 - DNA, 1711 bp, Cephalotaxus harringtonia
gccgtttacgcgtgcacgcgttgacggcaagcactataatcccttggctaattcctgcacattctcattcctattctctcttctacgcctggtgttgtgctcattgatttttttttttcattctaacagcttgtttgctttctggttaagccgacggggtttgaaacgggaatcttctaccaggaaaagcacaatgcgtcggtggctttgttgtgcctgttcagtggatgatgctcctgaacaacctgagaatcaatacttcaatgcaacaaagccctccccaaatggaaaccaagggaattctaaggcgtctgagggagcaaagaatgatgctccacagaaagtacctcctattgaagcaccagctctatcactagaagagttaaaggaagcaacagataactttggtccaaaggctttgattggagaagggtcctatggaagagtatactatgcaactttaagcaatggttctgctgcagcaattaagaaattggatgtcagcagtcagccagaggcgaattcggaatttttagcacaggtttcaatggtctcaaggctgaagcaagagcatgtagttgagttggtgggttactgtgttgagggagatatccgtgtgttggcttatgagtttgcaacaatgggctctttacatgacattttgcatggacggaaaggagtgcaaggggcccaaccaggtccagttcttgattggatgcaacgggtgaaaattgctgtgggtgcagcaaagggtcttgaatatcttcacgagaaagctcagcctcatattattcatcgagatattagatctagcaatgttttactttttgatgacttcaaagcaaaaatcgctgatttcaatctttctaatcaagctcctgacatggctgctcgcctccattcaacacgtgtgctgggaacatttggctatcatgctccagagtatgccatgacaggacagctgactcaaaagagtgatgtgtatagctttggcgtggttctgctggagctcctaacaggtagaaagcctgttgaccacacaatgcctcggggacaacaaagtcttgttacttgggcaactccaagattgagtgaagataaagtaaagcagtgcgtagatccaaagctgaagggagaatatccatccaaggctgtggccaagttagctgctgttgcagcactgtgtgtgcagtatgaggcagatttccgacccaacatgagtatagttgtaaaagctcttcagccgctgctcaatccaaagccagtagctcctgcatctgaagctcagaattgatgatcatgcgtggtgcagtcttgtacaatttgagttttgttcaggggtggtttagattaaggtgatgggatattttagggcctgtgcctgtggagatcacatttcaaattttaagcggaaatattgcttgcaaagctccaggttttgttcacaggtcagaaatgactctacattcttttataataactattctttggttccttgtgaagaagtttctgtgtgtaccgtaaacttgatgccctcttgtcagttccaagcaacggatcatttgtttgctctatttcctagaacccatgtttctattgcagttctgggactactttttgatcctggtggaagtggtgtttgtagtcttcttgtttaccaagatattttctttcttttctttccctgtatagattgtgtatccatgtgtat

SEQ ID NO: 6503 - DNA, 978 bp, Fagopyrum esculentum
aggccgagtccagtgtagagtttctgacacaggttgccatggttcacagttgaagcatgaaaattttgttgagcttcaaggttattgtgtagagggaacctccgagttttggcatatgaatttgccaccatgggatccttgcatgatgtcctacatgggagaaaaggtgttcaaggtgcacaacctggtcctgtgcttgactggatgcagagagtaagaattgcagttgaggctgcaaaaggattagagtttctacatgaaaaaattcaacctcctatcatacatagagatattcgatcaagcaatgttttgcttttcgaggacttcaaggctaagattgcagattttaacgtttctaaccaagctcctgacatggctgctcgcttacactctactcgagtattgggaaccttcggctatcatgcaccagagtatgcaatgactggacagctgacacaaaagagtgatgtatacagcttcggggtggtacttctagagctcttaacaggtcgcaagcctgttgatcataccatgccccgtggacaacaaagtcttgtgacatgggccacacctagacttagcgaagacaaagtgaaacaatgtgtggacccgaagatgaaggactatccggccaaaggagttgccaagcttgctgcagtggctgctctttgcgtgcagtatgaggcagagtttagacccaacatgagcatcgtggtcaaagcgcttcagcctctcctgaaggcgccggcacctgctcccgatgctgcgtaggtggtctgaattccggtacttgtttggagagttgggaatgtttaagagtgcatttttttcgctgccttttcactttatcggctttgtggtgacggtttgaatgtgtaaaagaactgggtttgagagcctttagatttgtctctgttgtttgagagcctttagatttgtctctgttcataaggtgatactctatttgcgcaaaaattt

SEQ ID NO: 6504 - DNA, 870 bp, Fagopyrum esculentum
tggcatatgaatttgccaccatgggttccttgcatgacgtcctacatgggagaaaaggtgttcaaggtgcacaacctggtcctgtgcttgactggatgcagagagtacgaattgcagttgaggctgcaaaaggattagagtttctacatgaaaaaattcaacctcctatcatacatagagatattcgatcaagcaatgttttgcttttcgaggacttcaaggccaagattgcagattttaatgtttctaaccaagctcctgatatggctgctcgcttacactctactcgagtcttgggaaccttcggctatcatgcaccagagtatgcaatgactggacagctgacacaaaagagtgatgtatacagcttcggggtggtacttctagagctcttaactggtcgcaagcctgttgatcataccatgccccgtggacaacaaagtcttgtgacatgggccacacctagacttagtgaagacaaagtgaaacaatgtgtggacccgaagatgaaggactatccggctaaaggagttgccaagcttgcggcagtggctgctctttgcgtgcagtatgaggcagagttttagacccaactatgagcatcgtggtcaaggcgcttcagcctctcctgaaggcgccggcacctgctcctgatgctgcgtagagagtagcatgttggtctgaattgtggttacttgtttggagagttggggatgtttaagagtgcatttttttgctgccttttcactttatcggctttgtggtgacgatttgaaggtgtaaaagatctggtttgagagccttttagctttgtctctgttcataaggtgatactctatttgcgcgaaaatttgaaatcgacagtggggg

SEQ ID NO: 6505 - DNA, 1147 bp, Flaveria ramosissima
caagacgatttaattttgaggaagagggataggatgcggaggtggttgtgttgtacttgtcaagtcgaagaatcttacccttcaaatgacaatggctttgtaaaaagccacaatgatcatattgatgggcaccagaaggacaaagtaccagctccagccaaatttgatacacaaaaagcagtgccaacaattgaagtgcctgcactttcacttgacgaattgaaagaaaaaaccgagaattttggatcaaaggcactgatcggtgaaggttcatatggaagggtttattttgcaaatctagataatggtaaaagtgtggctgtgaaaaagcttgatgtttctacggaggctgaatcagataatgaatttttgactcaggtttccatggtctctaaactgaagcatgaaaattttgttgagctgtgcggctactgtgtggaagggaatacacgtgttttggcttatgaatttgcaaccatggggtctctacatgacatattacacggcaggaagggtgtgcaaggagcacaacctggtcccgtgcttgattggatgcaaagagtaaggattgctgttgatgcagcaaagggacttgagtatttacatgaaaaggtccaaccttcgataattcacagagatattaggtctagcaatgtgctattgtttgaagatttaagagccaagattgcggattttaatctttctaatcaagctcctgatatggctgctcgtttgcattctactcgtgttttgggtacttttggctatcatgcaccagaatacgcaatgactggacagctgacacaaaaaagtgacgtgtatagctttggggttgttttgcttgagcttctgactggtcggaaacctgttgatcacacaatgccacgtggacaacaaagccttgtcacttgggctacacctaggctaagtgaagacaaggctaaacaatgtgttgatccaaggctcaaggaggagtacccgtccaaagcagtggcaaagctggcggctgtggcggctttatgtgtgcaatacgagtccgagttcaggcctaatatgagcattgttgtgaaagctcttcaaccactgttgagggctcccgcaccaacagctccagaagtataatgtaacaaccaagaagaaaataaac

SEQ ID NO: 6506 - DNA, 1501 bp, Flaveria ramosissima
ctcaacaacacaacacaataaaaacaaagccctaattcaagaatccaaaactcacaacacaacacaacacaccacaggaatacttgcctccacctggatactttatacgtttgggcaaaccaagggctcaagacgatttgattttgaggaagagggataggatgcggaggtggttgtgttgtacttgtcaagtcgaagaatcttacccttcaaatgacaatggctttgtaaaaagccacaatgatcatattgatgggcaccagaaggacaaagtaccacctccggccaaatttgatacacaaaaagcagtgccaacaattgaagtgcctgcactttcacttgacgaattgaaagataaaaccgagaattttggatcaaaggcactgatcggtgaaggttcatatggaagggtttattttgcaaatttagataatggtaaaagtgtggctgtgaaaaagcttgatgtttctacggaggctgaatcagataacgaatttttgactcaggtttccatggtctctaaactgaagcacgaaaattttgttgagctgtgcggctactgtgtggaagggaatacgcgtgttttggcttatgaatttgcaaccatgggatctctacatgacatattacacggcaggaagggtgtgcaaggagcacaacctggtcccgtgcttgattggatgcaaagagtaaggattgctgttgatgcagcaaagggacttgagtatttacatgaaaaggtccaaccttcgataattcacagagatattaggtctagcaatgtgctattgtttgaagatttaagagccaagattgcggattttaatctttctaatcaagctcctgatatggctgctcgtttgcattctactcgtgttttgggtacttttggctatcatgcaccagaatatgcaatgactggacagctgacacaaaaaagtgatgtgtatagctttggggttgttttgcttgagcttctgactggtcggaaacctgttgatcacacaatgccacgtggacaacaaagtcttgtcacttgggctacacctaggctaagtgaagacaaggttaaacaatgtgttgatccaaggctcaaggaggagtaccgtcaaagcagtggcaaagctggcggctgtggcagctttatgtgtgcaatacgagtccgagttcaggcctaatatgagcattgttgtgaaagctcttcaaccactgttgagggctcctgcaccaacagctccagaagtatgatgtaaaaaccaagaagaaaataatcaaattcgtgagccgttgatttcctgcagctttatgaccgtagattttcgtttaatcgaggcatatatatattttggttttggtttgagaatattgttatttgcttatgttcagattggtctgttatatatctttgctttctcaaatattgttttaagtgcttttctgctcactgtgaacgcatttgttttcttactgttgattttgatacaataattttacatacgac

SEQ ID NO: 6507 - DNA, 1475 bp, Flaveria ramosissima
ccgtaagagtaacaactcggggaagtcgctccgttagtcctaatctcgtctttccccaacttactacatcatatcaacaccaccaacaacaataaaaacaaagaccctaattacagaatccaaactcacaccacaacacaggaatactacctcgacctggatactttatacgttagggggaaccaagggctcaagacgatttgattttgaggaagagggataggatgcggaggtggttgtgttgtacttgtcaagtcgaagaatcttacccttcaaatgacaatggctttataaaaagccacaatgatcatattgatgggcagcagaaggacagagtaccacctccggccaaattcgatgcacaaaaagcagttccaacaattgaagtgccttcactttcacttgacgaattgaaagaaaaaaccgagaattttggatccaaggcactgattggtgaaggttcatatggaagggtttattttgcaaatttaaataatggtaaaagtgtggctgtgaaaaagcttgatgtttctacggaagctgaatcagataacgaatttttgactcaggtttccatggtttctaaactgaaacacgagaattttgttgagctgtgcggctactgtgtggaagggaatacacgtgttttggcttatgaatttgcaaccatgggatctctacatgacatattacacggcaggaaaggtgtgcaaggagcacaacctggccccgtgcttgattggatgcaaagagtaaggattgctgttgatgcagcaaagggacttgagtatttgcatgaaaaggtccaaccttcgataattcacagagatattaggtctagcaacgtgctattattcgaggatctaagagccaagattgcggattttaatctatctaatcaagctcctgatatggctgctcgtttgcattctactcgtgttttgggaacttttggctatcatgcaccagaatatgcaatgactggacagctgacaaaaaaaagtgacgtgtatagctttggggttgttttgcttgagcttctaacgggtcggaaacctgttgatcacacaatgccacgtggacaacaaagcctcgtcacttgggctacacctaggctaagtgaagacaaggttaaacaatgtgttgatccaaggctcaaggaggagtaccgtccaaaagcagttgcaaagctggcggctgtggcggctttatgtgtgcaatatgagtccgagttcaggcctaatatgagcattgttgtgaaagctcttcaaccactgttgagggctcctgcacccacagctccagaagtataatgtaaaaaacaagaataaaataaacaaattcgtgagccgttgatttcctgcagctttatgaccgtagtttttcgtttcatcgaggcatatatattttggttttggtttgagaatattgttatttgcttatgttcagattgatctgttatatatctttgcttt

SEQ ID NO: 6508 - DNA, 1231 bp, Plantago ovata
gaagttcagaaggctgtgccaaccattgaagttcctgccttgtctcttgtggaattgaaagacaaaactgacaattttggttccaaggcattaattggtgaaggttcttatggcagagtatattttgcacagctagacagcggaaaggacgttgctgttaagaagcttgacacctcttctgagaatgagtcagataacgagttcttgactcaggttgctatggtttcagggtttaaacatgaaaatctcgttgaattgcatggttactgcgtagaaggcaatatccgtatcctagcttacgaatttgcgactatggggtccctacatgacattttgcatggaaggaaaggagtacaaggagcgcaacctggtcctgtacttgactggatgcagcgggtaagaattgctgtagatgctgcgaggggactggaatatttgcatgagaaagttcagccttcaataattcacagagatatcagatcgagcaatgttcttctgtttgaagactataaagcaaagattgcagactttaatctttcaaatcaggctcctgacatggctgctcgccttcattctactcgagttttgggaacctttggttatcacgcaccagaatatgcaatgaccggacagttgacccagaagagtgatgtttatagctttggagttgttttacttgagctcctcaccgggaggaagccagttgaccatactatgccccgtggacagcagagccttgttacttgggctaccccaagactgagcgaggacaaagtccaacagtgcgttgatccaaaacttaagacagattatccgccaaaaggtgttgccaagctagcagcagttgcagcattatgtgtgcagtatgaggctgagttccgaccaaatatgagcattgtcgtaaaggctttgcagccactactgaagacacctactcctgccgtcgcccctgctccacaatagatacgctatttaattttatattgttcgtttttctgctatacatgaacaatttggttgggtcgaatgggctaataattgatttctttgatcacttcccgtgttaatgtgttctttaattttcattctgggtccgaaagagatggaaatggtgttatgattccgtttctgtcgatagagccgttgtataatcaggatgtgagattaagtattgtgttgagcagacatataatctgtatgtttttagcaccgaaaggattaaacttgtgca

SEQ ID NO: 6509 - DNA, 1351 bp, Primula obconica
tcaaggatgcgtaaggggttttgctgtacctgccaagttgaagagacttacccatattccgagaatgagccttttaagagcccaaggaactacggtgatgaatatcgaaaagggttgagggcatccgctcctgtgaaagtcgaggctcaaaaggaagtaccgcctattgaagtgccagtgttgtcgctatctgagctgaaggaaaaaactgacaattttgggtcaaaggcattgattggtgaaggatcttacgggagggtctactatgcccatttggacaatggaaaagcggttgctgttaaaaagctagatgtttcaactgaagcagattcaaatgttgaatttttaacacaggtctccacagtttcaagactgaaacatgataatcttgtcgagttgctcagttactgtgttgagggaaatcttcgcgtcctggcatacgagtttgctacaatgggttctttacacgacattttgcacggaagaaaaggagtccaaggagcgcagccaggcccagtgctggattggatgcagcgagtgaggattgctgttgatgccgcaagagggttagagtatttgcacgagaaggttcaaccttctattattcacagagacataaggtctagcaatgtacttctctttgaggacttcaaagccaaaattgccgactttaacctcatgaatcagtcccctgacatggctgcacgtcttcattctactcgtgttttgggaacattcggttatcatgcaccagaatacgcaatgactgggcagctgacacagaagagtgatgtgtacagttttggcgtggttctgttagagcttctgactggacgcaaacctgtcgatcataacatgccacgtggacagcagagtcttgttacctgggctactccaagactgagcgaagacaaagttaaacaatgtattgatccaaagctcaaggactgttgtcctcctaaagcagttgccaagttggcagctgtagcagcgctgtgtgtgcagtacgaggccgagttcaggccaaacatgagcattgttgttaaggctcttcaacctcttttgaagtctgtcgcaccagctccggctcctgaaatataagaccaataattaatcccttctttgtatgggggagtttcagtgaattttgtgctgactttgtcttcgtctgtcgccattcttttcctcaactgtatatgtgtaacatgatttaatttcatttcgttttgctttatgcactgaacacatcttgtactaatacctatttgagttgtgtggtttggtttgtaaaaactcttttcgatattgacttgtcccacaataataatgataaaaaaaaatgtgggtttgt

SEQ ID NO: 6510 - DNA, 1747 bp, Solanum lycopersicum
ggtgacagctaaatatactttgatattttcctcttcggccccctccttcaatttctcaaagtttaacaatacaaacaaagcaaatccacccctacctttttcctctctgtgtcgtttgttctcgctgtctttgcttacctgttcttcactttataattgtcttgatttagcataatcaagaagctacagaagaacaagaaaagattcaatttttcaggcacatgctcctcctcctggttacttttcacgcttggagaaccgaagggctgaagacgatctttatttgagaaagagagtaaggatgagaaggtggctgtgttgtacctgtcaagtagaggagtcctacccatcacatgaaaccgagcacctgaaacaccctgcaagtcatgctgatggatatcagaaagggtcaagagtatcagatcctatcagggctgaagcggataaagcagtgccaactatagaggtccctgcgttgtctttggatgaactgaaacaggaaactgacaattttggatcgaaagcattaattggtgaaggatcttatgggagagtatactatgctaatctaagcaatggcaaggctgttgctgtgaaaaagcttgatgtttcatccgagcctgagactaatgttgacttcttgaatcaggttgctagagtttcaagattgaagcatgacaatcttgttgagttgcttggctactgtgttgaaggaaacattcgtgtattagcttatgagtttgcaacgatggggtccttgcatgatattttgcacggaaggaaaggagtacaaggggcacagcctggcccaacacttgagtgggtgcagcgggtaaggattgctgttgatgctgctaggggtcttgagtatttgcatgagaaggtccaaccttcagtaatacacagggatatcagatcaagcaatgtcctcctctttgaagactacaaagcaaagattgcagattttaacttgtcaaatcaggctcctgacatggctgctcgccttcattctactcgagttttaggaacatttggctatcatgcaccagaatacgctatgactggacaactgacacagaagagtgatgtgtatagctttggagtggtcttgcttgaacttttgaccggaagaaagcctgtagatcatacaatgcctcgaggacagcagagcctggttacttgggctaccccgagactgagtgaagataaagtgcagcaatgtgttgatccaaagctgaaaggatgtcctccgaaagcagtggctaagatggcagccgtggcagcactgtgcgtgcaatatgaagctgaattccgtccaaacatgagtattgttgtcaaagctctccaaccacttctgagggctcctgctgcacctgctccagaaatatagggagcctattgtcgctcgcttgttctggagttcctactgctaatttgcaactgttttggtatatcatgccagtatttcattttttaagatgatctcacaaaaaaaaaagaaaaaaaaaagacttcaatgttttcctttattgaaactggtgtgtgtaggatttgattgattgattgcttaacttacatggtgagattgttgagaagatttccctaagaactgaggggtgtctatattttgtttttcctaaaagaacacctgaggtatgttctttcaatttgtgtattatatttgtacttaaatggtgttgtattatatttatggatttatacttatacacaagatgttggtaacacc

SEQ ID NO: 6511 - DNA, 543 bp, Brassica juncea
ttgagtatttacatgagaaagttcaacctgtggtgatacacagagatatccgttctagcaatgtgcttctctttgaagatttcaaagccaagattgctgattttaatccttcgaatcagtctcctgatatggctgctcgtcttcattccactagagtcttgggaacctttggttaccatgcaccagagtatgcgatgactggtcagctgacgcagaagagtgatgtttatagtttcggtgtggtgcttttggagctcttgactggtagaaaacctgttgatcatacaatgcctcgtggccaacaaagtcttgtcacttgggccactccaaggctgagtgaagacaaggtgaagcaatgtgttgatccgaaactcaaaggagagtatcctcctaaagcagttgcaaagcttgcggctgttgcagccttatgtgtgcaatacgaatcagagtttaggccgaacatgagcattgtggtaaaagctctgcaaccattgctgaggtcatcaacagctgtagctgttcaatcacatagaagaatcatat

SEQ ID NO: 6512 - DNA, 585 bp, Curcuma longa
gagctcgcctacattctacacgagtcttgggtacctttggttatcatgctccagagtatgctatgacgggtcagctgacgcaaaagagtgatgtatatagttttggtgtggttcttttggaacttctgacaggaaggaagcctgtggatcatacaatgcctagagggcagcaaagtcttgttacttgggcaactccgagactgagcgaagacaaagtcaaacaatgtgtagatccaaaattgaagggagattacccaccaaaaggggttgcaaagctggcagctgttgcagctctgtgtgttcagtatgaagctgagtttagacccaatatgagcattgtggtgaaggcactctctcctcttctaaataagcaagctccaccaccggtggctaacccttcaacagatgctcgagggatgcaatgatcagtggtaggcctctccgcgctcttcgtatgtttcaagggtattgtctagttcgtggtgttttgtagtcattatattcagttaatgcaaaagggagatttctattgtatatttgttccagtaacttcagtttggcttgtttgatgagtgtactacataa

SEQ ID NO: 6513 - DNA, 2130 bp, Marchantia polymorpha
  misc_feature (2014)..(2014): n is a, c, g, or t
gtgcgttgtgggagaggcagtcaaggcccgcacctcgcattcgcactctgttcgtgctgttgcgtttacgttgcgattcggtggtggagcggtcgagagctgcaagaagaagcagaggccgcgaagggcgaggcaggaagaaatcacactggttcatattctagaccctgagaattggtttgtgcgtgaggaggggtggcgtcgagaagaattcgccgattgtctatgaggggcgcagggctcggtgcctgggctggagacctgtgttcttggtgattgaaggttgtccgcttcgtgatcgccttaacagatttgatcttcaagtgatggagaaggggcgccggtgaaacatctgcctcgacatttgatctacacaaattcactgagggaagaaatggcatggtgttgttgctgcgaggatagaaacattgaaaagctttccaatgaccaatctggctaccaccaccccaatcaaaacatgcatggaggtggacaaggagcacctaaaccctctgagaaccagcctcctaagccaggtggtcagacacccaaactccaacccatctcggcaccttcaatcaccattgaggaactaagggaagcaacggacaattttggcccgaaggcactgattggagaaggatcgtatggaagggtgtactatgctaacttgcaggatggtcgtgctgccgccatcaagaaattggatgccagtactcagcctgaccaggaatttctcacacaggtttctatggtatccaggcttaaaaacgaaaacgtcgtagagcttattggatactgtctggacaatacccaacgagtgttggcctacgaatttgcgactatgggttcacttcacgatatattacacggaaggaaaggtgtgaaaggtgcccagcccggacctgtgctggactggatgcaacgcgtgaaaatcgcggttggatctgcaagaggcttggagtatcttcatgagaaggctcagccagcaatcattcacagagacatcaagtccagtaatgtcctgttgttcgacgattacactgcaaagattgccgatttcaatctttcaaaccaagcgccggacatggcagctcgtctccactctacacgtgttcttggaacattcggatatcatgcacccgagtacgccatgactgggcaattgacacaaaaaagtgatgtttacagttttggagtggttctattggaactgcttactggtagaaagccagtcgaccataccatgccccggggacagcaaagtcttgtcacttgggcaactccaaggctgagtgaagataaagttaaacagtgcgtggatcccaagttgaagggggaatatcctcccaaggctgtcgcgaagatggcggcggttgctgcgctttgtgtgcaatatgaagcggatttccgtccgaacatgagcattgtcgtgaaagctctccaacctcttctgacaactcggactgctgcacctgtccaaggatcacccacacgggattgatcctattctgattagagctggatattgtgtaagtttagaactgtttgttgtggttgatatctatcaaagctgtggcacaagggtgtctccaaatagagtcacaaaccggcatgttgcctattctgatcgtgccctttttgttggccacaaatgacatactattttggtaagtgatagagaaacctcatgacatggatagaagtgtcataagcctgcagtttggagcatattagtaggtgctcccacaaaggcacgggatcccaaattcgtgcaggaggattgtatagactcctgcatgcgggagactgatcttcatgttgctgcccaaggagcccgctggaagatgacgtatgtgaggagcaagagtaaaaattgggtgtcacaggagtcatttggggagtgtacagatataggaattctaatggcctcatgtgggtatttttttaacttcatctatttgttatattggcactgtttatgctgcattcagtggcagtgcggaaaagtcanaccacttcggcttgtttgtagttatacggtatgctgtttaaaaaaaactgttaaatcggatggtaattttgacggacagtcaatgcactcaaaactcttgggtctgaaaaaaaaaa

SEQ ID NO: 6514 - DNA, 1665 bp, Avena sativa
gaagccgctcttctgctgcgctgcccaccgccctctcctctccactaccttcgcttcgcttccaagctacgcttcgcccgttcgccgggcgaaccctacctagccagccacaacgcgcggcgggcctgctactgctggtggtgccggcgggaaggagagctcgtggccgcggcccaagcgcgcagcgaggagacaatatggggcactggttttgttgcaattgccggtctggcgacgtggaggacgaccatgaaacggaacgctccaaagctcagggaaataagatagacggcaagcagaaatcttcgaaacctgttgaccaacccgagccagatatttcccctcctacaattaatgtcccagaattgtcatttgaggacttaaaagaaaaaaccgacaacttcgggtcgaattctctgattggtgaaggttcgtatggacgagtgtatcatgctactatggatgatggcaggcaagcagctattaagaaatttgatgcatctgaaaatgagcccaacgacgagttcttgaaacaggtctcagttgtatcaaggctaaagcatgaaaaccttgtggagatgttaggctactatgtggagggcaactatcgtatacttgcatatgaatttgcaactatgggttctcttcacgatgttctgcatggaagaaaaggagttcaaggtgcgcagcctggccctgtgcttgactggatgcagagggtcaaaattgctattgaagcggcaaagggtatagagtacctgcacgagaaggttcagccttcaatcatccatcgggacatcagatcaagcaatgtacttctgtttgaggacttcaaggcaaaaattgcagacttcaacctcttaaatcaagctccagatatggcagcacgtctccattcaactcgtgtattagggacatttggatatcatgcaccagaatatgctatgactggccagctgacacagaagagtgacgtctacagctttggtgtggttcttctcgaacttctgactggaaggaaaccggtcgatcacacaatgcctcgggggcaacaaagtttagtcacatgggccactccaagactgagtgaagataaggtcaaacagtgcatagatcctaggttgaagggagaataccctccgaagggagtcgctaagcttgctgcggtggcagctctgtgcgtgcaatacgaagcggagttcaggcccaacatgagcatcgtcgtcaaggcactcactcctttgctaacccacagagcagcggctccagcagcctcagagcctgtggcggccccggcaaccgaggcttgaggcgttagaacatgggacctctcggcgcgtactaactcgcgatagcacattcggtgtaactgggagtggtctgggcacatttattttgcgagatacttggttggacggagacagaatatagtacatggatgattccctctgccaatatgtcgccaccctaggtttttttgctgcttgagatttgtgctgtacattgatctgttgtaggttcgaggttgtctgttcccgttttattgcaagtaaacttcagaggtgtcggaaacttagacatcatttggaatcaaattaaacataagaggtctctagaagagtaacattgtcctggactctatggtactattacctttcttattcg

SEQ ID NO: 6515 - DNA, 1663 bp, Avena sativa
gaagccgctcttctgctgcgctgcccaccgccctctcctctccactaccttcgcttcgcttccaagctacgcttcgcccgttcgccgggcgaaccctacctagccagccacaacgcgcggcgggcctgctactgctggtggtgccggcgggaaggagagctcgtggccgcggcccgcgcgcagcgaggagacaatatggggcactggttttgttgcaattgccggtctggcgacgtggaggacgaccatgaaacggaacgctccaaagctcagggaaataagatagacggcaagcagaaatcttcgaaacctgttgaccaacccgagccagatatttcccctcctacaattaatgtcccagaattgtcatttgaggacttaaaagaaaaaaccgacaacttcgggtcgaattctctgattggtgaaggttcgtatggacgagtgtatcatgctactatggatgatggcaggcaagcagctattaagaaatttgatgcatctgaaaatgagcccaacgacgagttcttgaaacaggtctcagttgtatcaaggctaaagcatgaaaaccttgtggagatgttaggctactatgtggagggcaactatcgtatacttgcatatgaatttgcaactatgggttctcttcacgatgttctgcatggaagaaaaggagttcaaggtgcgcagcctggccctgtgcttgactggatgcagagggtcaaaattgctattgaagcggcaaagggtatagagtacctgcacgagaaggttcagccttcaatcatccatcgggacatcagatcaagcaatgtacttctgtttgaggacttcaaggcaaaaattgcagacttcaacctcttaaatcaagctccagatatggcagcacgtctccattcaactcgtgtattagggacatttggatatcatgcaccagaatatgctatgactggccagctgacacagaagagtgacgtctacagctttggtgtggttcttctcgaacttctgactggaaggaaaccggtcgatcacacaatgcctcgggggcaacaaagtttagtcacatgggccactccaagactgagtgaagataaggtcaaacagtgcatagatcctaggttgaagggagaataccctccgaagggagtcgctaagcttgctgcggtggcagctctgtgcgtgcaatacgaagcggagttcaggcccaacatgagcatcgtcgtcaaggcactcactcctttgctaacccacagagcagcggctccagcagcctcagagcctgtggcggccccggcaaccgaggcttgaggcgttagaacatgggacctctcggcgcgtactaactcgcgatagcacattcggtgtaactgggagtggtctgggcacatttattttgcgagatacttggttggacggagacagaatatagtacatggatgattccctctgccaatatgtcgccaccctaggtttttttgctgcttgagatttgtgctgtacattgatctgttgtaggttcgaggttgtctgttcccgttttattgcaagtaaacttcagaggtgtcggaaacttagacatcatttggaatcaaattaaacatcagaggtctctagaagagtaacattgtcctggactctatggtactattacctttcttattcg

SEQ ID NO: 6516 - DNA, 593 bp, Capsicum annuum
gcacgagggtaaaaattgctgttgatgctgcaaggggtcttgagtatttgcatgagaaggtccagcctccaataatacacagggatattagatcaagcaatgtccttctctttgaggactacaaagcaaaaattgctgattttaatctgtcaaatcagtctcctgacatggctgctcgtctacattctacacgagttttgggaacatttggttatcatgcaccagaatatgcaatgacaggacaattgacacaaaagagtgatgtatatagctttggggtggttcttcttgaacttttgacgggaagaaaacctgtagatcataccatgcctcgtggacaacagagcttggttacttgggctactccgagactaagtgaagataaggttaagcaatgcattgatcctaagctgaaagaagttcctggaaaaggagttgctaagatggcggctgttgcagcactgtgcgtacaatatgaggctgagttccgtcctaatatgagtattgttgtcaaagctcttcaaccattgttaaaggcgcctcctcctgctcctgagtcatagggctctagtatcagttgctcatttcacatc

SEQ ID NO: 6517 - DNA, 1685 bp, Solanum tuberosum
gtttaacaatacaaacaaagcaaatccacccctacctttttcctctctgtgtcgtttgttctcgctgtctttgcttacctgttcttcaccttatattttttcttgatttagcataatcaagaagctacagaagaacaagaaggacaagaaaagatttattttttcaggcacatgctcctcctcctggttacttttcacgcttggagaacagaagggctgaagacgatctttatttgagaaagagagtaaggatgagaaggtggctgtgttgtacctgtcaagtagaggagtcctacccatcacatgaaaccgagcaccttaaacaccctgcaagtcatgctgatggatatcagaaagggtcaagagtatcagatcctatcagggctgaagcggataaagcagtaccaactatagaggtccctgcgttgtctttggatgaactgaaacaggaaactgacaattttggatcgaaagcattaattggtgaaggatcttatgggagagtatactatgctaatctaagcaatggcaaggctgttgctgtgaaaaagcttgatgtttcatccgagcctgagactaatgttgacttcttgaatcaggttgctagagtttcaagattgaagcatgacaatcttgttgagttgcttggttactgtgttgaaggaaacattcgtgtattagcttatgagtttgcaacgatggggtccttgcatgatattttgcacggaaggaaaggagtacaaggggcacagcctggcccaacacttgagtgggtgcagcgggtaaggattgctgttgatgctgctaggggtcttgagtatttgcatgagaaggtccaaccttcagtaatacacagggatatcagatcaagcaatgtcctcctctttgaagactacaaagcaaagattgcagattttaacctgtcaaatcaggctcctgacatggctgctcgccttcattctactcgagttttaggaacatttggctatcatgcaccagaatacgctatgactggacaactgacacagaagagtgacgtgtatagctttggagtggtcttgctcgaacttttgaccggaagaaagcctgtagatcatacaatgcctcgaggacagcagagcctggttacttgggctaccccgagactgagtgaagataaagtgcagcaatgtgttgatccaaagctgaaaggatgtcctccaaaagcagtggctaagatggcagccgtggcagcactgtgcgtgcaatatgaagctgaattccgtccaaatatgagtatcgttgtcaaagctctccaaccacttctgagggctcctgctgcacctgctccagaaatatagggagcctattgtcgctcgcttgttttggaattcctactgctaatttgcaactgttttggtatatcatgccagtatttcatttgtaacatgatttcaaaaacaaaaaaaacaagacttcaaagttttcccttgttgaaactggtgtgtaggatttgattgattgattgcttaacttacatggtgagattgttgagaagatttccctgagaactgaggggtgtctatattttgtttttcctaaaagaacacctggtgtatgttctgtcaatttgtgtattatatttgtacttaatggtgttgtattatatttatggatttatactatacacaaaatgttggtacacc

SEQ ID NO: 6518 - DNA, 1686 bp, Solanum phureja
ctccttcaatttctcaaagtttaacaatacaaacaaagcaaatccacccctacctttttcctctctgtgtcgtttgttctcgctgtctttgcttacctgttcttcactttatattttttcttgatttagcataatcaagaagctacagaagaacaagaagaacaagaaaagatttattttttcaggcacatgctcctcctcctggttacttttcacgcttggagaacagaagggctgaagacgatctttatttgagaaagagagtaaggatgagaaggtggctgtgttgtacctgtcaagtagaggagtcctacccatcacatgaaaccgagcaccttaaacaccctgcaagtcatgctgatggatatcagaaagggtcaagagtatcagatcctatcagggctgaagcggataaagcagtaccaactatagaggtccctgcgttgtcttttgatgaactgaaacaggaaactgacaattttggatcgaaagcattaattggtgaaggatcttatgggagagtatactatgctaatctaagcaatggcaaggctgttgctgtgaaaaagcttgatgtttcatccgagcctgagactaatgttgacttcttgaatcaggttgctagagtttcaagattgaagcatgacaatcttgttgagttgcttggttactgtgttgaaggaaacattcgtgtattagcttatgagtttgcaacgatggggtccttgcatgatattttgcacggaaggaaaggagtacaaggggcacagcctggcccaacacttgagtgggtgcagcgggtaagaattgctgttgatgctgctaggggtctcgagtatttgcatgagaaagtccaaccttcagtaatacacagggatatcagatcaagcaatgtcctcctctttgaagactacaaagcaaagattgcagattttaacctgtcaaatcaggctcctgacatggctgctcgccttcattctactcgagttttaggaacatttggctatcatgcaccagaatacgctatgactggacaactgacacagaagagtgacgtgtatagctttggagtggtcttgcttgaacttttgactggaagaaagcctgtagatcatacaatgcctcgaggacagcagagcctggttacttgggctaccccgagactgagtgaagataaagtgcagcaatgtgttgatccaaagctgaaaggatgtcctccgaaagcagtggctaagatggcagccgtggcagcactgtgcgtgcaatatgaagctgaattccgtccaaatatgagtatcgttgtcaaagctctccaaccacttctgagggctcctgctgcacctgctccagaaatatagggagccttatgtcgctcgcttgttttggaattcctactgctaatttgcgactgttttggtatatcataccagtatttcatttgtaacatgatttcaaaaacaaaacaaaaaaaacaagacttcagagtttttgcttgttgaaactggtgtgtaggatttgattgattgattgcttaacttacatggtgagattgttgagaagatttccctgagaactgaggggtgtccatattttgtttttcctaaaagaacacctggggtatgttatgtcaatttgtgtattatatttgtacttaatggtgttgtattatatttatggatttatact

SEQ ID NO: 6519 - DNA, 1779 bp, Taxus baccata
tttggtaactatgatatacatatacatgtgaaatagcactgggggaagtgccagaggaataaacatgtgagagttctaccagatacttggcttcttatactagacttaaagctgttttgatctgggtacgtgtcatataatttcaactaggttctgttcacataatgtaaattttggaaattcgcataaggcagattgctaggggtagagaggttgtctggttatgccatgtagcctgtggcttaatgctagaataatacatttttatacattatacattattttaaatttgtttgataatcaatttcatgatattttctctctaccttcctctgttgtactggtgcattggctcatttactgtttttgatatgctttgcaaacatgtttctaatacaagctgattaaatgggcaggaaaagcacaatgcgtcggtggctttgttgtgcctgttcagtggatgctgctcctgaacaacccgagaatcaatacttcaatgcaacaaaggccttcccaaatggaaaccagggcaattctaaggtgtctgagggagcaaagaatgacgctccacagaaagtacctcccattgaagcaccggctctatcgctagaagagttaaaggaagcaactgataattttggtccaaaggctttgattggagaagggtcctatggaagagtatactacgcaactttaagcaatggttctgctgcagcaattaagaaattggatgtcagcagtcagccagaggcaaactcggaatttttagcacaggtttcaatggtctcaaggctgaagcaagagcatgtcgttgagttggtgggctactgtgttgagggaatattcgtgtgctggcctatgagtttgcaacaatgggttctttacatgacattttacatggacggaaaggagtgcaaggggccaaccaggtccagttcttgattggatgcaacgggtgaaaatcgctgtgggtgcagcaaagggtcttgaatatcttcacgagaaagctcagcctcatataattcatcgagatattagatctagcaatgttttactttttgacgacttcaaagcaaaaattgctgattttaatctttctaatcaagctcctgacatggctgctcgccttcattcaacacgtgtgctgggaacatttggctatcatgctccagagtatgctatgacgggacagttgactcaaaagagtgatgtctatagctttggggtggttctacttgagctcctaacaggtagaaagcctgttgaccacacaatgcctcggggacaacaaagtcttgttacttgggcaactccaagattgagtgaagataaagtaaagcagtgtgtagatccaaaattgaagggagaatatccttccaaggccgtggccaagttagctgctgttgcagcactgtgtgtgcagtacgaggcagatttccgacccaacatgagtatagtcgtaaaagctcttcagccattgctcaatccaaagccagtagctcctgcatctgaagctcagaattgatgatcatacacggtgcagtcttgtacaatttgagattttgtttggggaaagtttgtattaaagtgacgggatattatagggatagtgcctgcagagatcacagttcaaatgctaagcagcaatagtatttgcaaagctcttggtgttgttcacgagttagaaaatcaccctaaattattttaaaatagctattctttggttccatgtgaagatttttctgcgtgtactgtaaacttatgccctcaagtcagttc

SEQ ID NO: 6520 - DNA, 1723 bp, Solanum lycopersicum
ggtgacagctaaatatactttgatattttcctcttcggccccctccttcaatttctcaaagtttaacaatacaaacaaagcaaatccacccctacctttttcctctctgtgtcgtttgttctcgctgtctttgcttacctgttcttcactttataattgtcttgatttagcataatcaagaagctacagaagaacaagaaaagattcaatttttcaggcacatgctcctcctcctggttacttttcacgcttggagaaccgaagggctgaagacgatctttatttgagaaagagagtaaggatgagaaggtggctgtgttgtacctgtcaagtagaggagtcctacccatcacatgaaaccgagcacctgaaacaccctgcaagtcatgctgatggatatcagaaagggtcaagagtatcagatcctatcagggctgaagcggataaagcagtgccaactatagaggtccctgcgttgtctttggatgaactgaaacaggaaactgacaattttggatcgaaagcattaattggtgaaggatcttatgggagagtatactatgctaatctaagcaatggcaaggctgttgctgtgaaaaagcttgatgtttcatccgagcctgagactaatgttgacttcttgaatcaggttgctagagtttcaagattgaagcatgacaatcttgttgagttgcttggctactgtgttgaaggaaacattcgtgtattagcttatgagtttgcaacgatggggtccttgcatgatattttgcacggaaggaaaggagtacaaggggcacagcctggcccaacacttgagtgggtgcagcgggtaaggattgctgttgatgctgctaggggtcttgagtatttgcatgagaaggtccaaccttcagtaatacacagggatatcagatcaagcaatgtcctcctctttgaagactacaaagcaaagattgcagattttaacttgtcaaatcaggctcctgacatggctgctcgccttcattctactcgagttttaggaacatttggctatcatgcaccagaatacgctatgactggacaactgacacagaagagtgatgtgtatagctttggagtggtcttgcttgaacttttgaccggaagaaagcctgtagatcatacaatgcctcgaggacagcagagcctggttacttgggctaccccgagactgagtgaagataaagtgcagcaatgtgttgatccaaagttgaaaggatgtcctccgaaagcagtggctaagatggcagccgtggcagcactgtgcgtgcaatatgaagctgaattccgtccaaacatgagtattgttgtcaaagctctccaaccacttctgagggctcctgctgcacctgctccagaaatatagggagcctattgtcgctcgcttgttctggagttcctactgctaatttgcaactgttttggtatatcatgccagtatttcattttttaagatgatctcacaaaaaaaaaagaaaaaaaaaagacttcaatgttttcctttattgaaactggtgtgtgtaggatttgattgattgattgcttaacttacatggtgagattgttgagaagatttccctgagaacttaggggtgtctatattttgtttttcctaaaagaacacctgaggtatgttctttcaatttgtgtattatatttgtacttaaatggtgttgtattatatttatggatttatact

SEQ ID NO: 6521 - DNA, 1108 bp, Zostera marina
aaatgatgagaggcaagttgcaataaagaaacttgatgtttcatcagagccaaactcaagtaacgagttcctctcccagatttcattggtgtcaaggctaaagcatgaaaattttgtcaaattgcttggatattgtgtggaaggaaataatcgcttgttagcctatgagtttgcaaccatgggttctttgcacgatgttttgcatggtcggaaaggagtccaaggttcccaacctggccctgtactagattggatgcaacgtgtaagaatcgctgttgatgcagcaagaggattagattttttgcatgagaaggttcagccttcaataatacacaaagatatgagatcaagcaatattcttctatttgaggacttcaaggcaaaaattgcagacttcaacctttcaaaccaagcacctgacatggcggctcgtcttcattctactcgtgtcttgggaacttttggctatcatgcaccagagtatgctatgactggccagttaactcagaaaagtgatgtctatagttttggcgttgtacttttagaacttcttacaggcaggaagcccgtggaccacacaatgcctagagggcaacaaagtctagttacttgggcaactcccaggttgagtgaagataaggtaaaacaatgcgttgatccgagactaaagggcgaatatccaccgaaaggagttgctaagcttgcagcagttgctgccttgtgcgtgcaatatgagtcagaattcaggccaaacatgagtattgtcgtgaaggcgctacaaccactactagctcaaaagctacctccgccaattgcttcagatggcactaattaaaaatctccatcaattcagcttttggtttccttttcttttcattatggttggttgtttcatagctgcagttctttttagttgtgtacttgtgtatatcaatcatcatcgagaccttaaatgaattttaattcaaattaaaagattcgaaccatgtcattaatagtgtatagaagaacttaaggaaaattggactgttattagttttgtgaggttttaaaatatttaaattgtgttcggaacagattttctgctaactatacaatagtcttttaa

SEQ ID NO: 6522 - DNA, 418 bp, Jatropha curcas
attccaatgactggacagctgacccagaagagtgatgtttatagttttggagtggttcttctggaacttcttaccgggaggaaacctgttgatcacactatgccacgtggacagcagagtcttgtaacctgggctactccaagactgagggaggacaaagttaaacaatgtgtagatccaaagttgaagggagagtatcctcctaaaggagtggccaagttggcagctgttgctgcattatgcgtgcaatatgaggctgagttccgaccaaatatgagcattgttgttaaggcacttcaaccacttttgaagcctccggctccggccccagttgctgctgctcctctagagacctaaaacgaagaaagaaagaaagttttataacttgggcagtttgtttattttgctggaaattgtt

SEQ ID NO: 6523 - DNA, 1370 bp, Pteridium aquilinum
ttcttcaagcaaggacggtctgttggtgttctccaccttgctctgccatcgccatcacagacaaggcggtgtgcgtaaagcaagtacaaatgggaaattgttgcagttgttggcgagggtatgatgctgacaagcctccaccaaccctcactgttcctgcaactaatggaaatgggggtgttcaaaggagtgatttggcagctaagaatgctgccatcgtgagcacacaggcaatagaggcgccttgtatatcactggatgttctgaaggaggcgactgaaaattttggagtaaaagctttgattggtgagggttcatatggtcgtgtgtattatgcaatacttgatgggagggcagctgccattaagaagttggatatcaacagtcagcaagagtctgatgaagactttttatctcaggtttccatggtttcaaggctgaggcatgagaatgtggttgaacttgttggttattgtcttgatggtgatttgcgtgttctggcttatgaattcgcaacaatgggctctctgcatgatattcttcatggtcgaaaaggtgttcaaggtgcacaaccaggtcctgttcttgattggatgcaaagggtaaagattgcagtgggtgctgcaaggggtctggaataccttcatgagaaggtgcaaccacccattattcatcgtgacattaggtccagcaatgttctcctttttgacgactttactgcaaaggttgcagatttcaatctttcaaaccaggctcctgacatggccgctcgtttgcactccactcgtgtgctgggcacctttggttatcatgccccagaatatgcgatgaccgggcagctcactcagaaaagtgatgtgtacagttttggtgtggtactattagagttgcttacaggtagaaaacctgtggaccacaccatgcctcgtgggcaacagagcttggtcacatgggcaaccccccggcttagtgaagacaaagtgaagcaatgtgtagatccgaagcttaagtcagagtaccctcctaaggcagttgctaagattgcagcagttgcagccctttgtgtgcagtatgagtcagagtttcgccccaacatgagtattgtagttaaggcattgcaaccattgttgacactcaaaccaaatccaacagtcactctctctgtagaatctcagacatgatgtggaacacagctgaagttgatcaattttgtattaatctcttagagaactggtaagcccattatctactgcatgaagggttttgcaaagtgtgctggagagatgtccagtttcttacactatgtttttgtacttatctcaactctatgtaccccttgtaacaatagcttcttgtatacaaatataatg

SEQ ID NO: 6524 - DNA, 669 bp, Brassica oleracea
cgagtttgcaacaatgggatcgttgcatgacatcttacacggtaggaagggagttcaaggagcacagccaggtccaacactagactggacaacgagggtgaaaatcgcggtcgaggcagctaggggtttggagtaccttcacgagaagtctcagcctcctgtaatccatagagatataagatccagcaacgttcttcttttcgaagactacaaggccaagattgctgattttaacctctcgaaccaagctcctgacaacgctgctcgtcttcactcgacaagagtcttgggaacttttggctatcatgctccagaatatgcaatgactggacagttgactcagaagagtgatgtgtacagctttggggttgtgcttctagagcttctgacagggaggaaaccggttgatcacaccatgcctcgtggtcagcaaagtcttgtgacttgggcaacaccaagacttagtgaagataaagtcaaacaatgcattgatccaaagcttaaagctgattaccctccgaaagcagttgctaagcttgcagcagtggcagcactgtgtgtgcaatatgaatctgagtttagacccaatatgagcatagttgtgagggctctgcagccgctcctcaaacttgcagctccagctcctccctctccagcgccggagtcttg

SEQ ID NO: 6525 - DNA, 720 bp, Nuphar advena
attattggggtactgtgtagaaggaaacttgcgtgttttatcatacgagtttgctacaatgggttccttacatgatatcttgcatggtagaaaaggagtacaaggtgcacagcctggacctgtgcttgactggatacaacgagtgaaaattgctgttgatgcagcaaaggggctggaatatttgcacgagaaagttcagccctcaataatacatagggacatcagatccagcaatgtgttgctatttgaggatttcagagccaaaattgcggacttcaaccttttaaatcaggctcctgacatggctgctcgtcttcattcaacccgagtattaggaacctttggctatcatgcaccagagtatgcgatgacaggtcagctgactcagaaaagtgatgtatatagctttggtgttgttcttcttgagcttctaactggaaggaaaccagtggaccatacgatgcctcgagggcaacaaagtcttgtcacttgggcaactcctagactgagtatggacaaggtgaagcaatgcgtggatccaaagttgaagggggactatcctgcaaaaggagttgctaagttagcggctgtggcagcactgtgtgtgcagtatgaatcggaattccggccaaacatgagcattgttgttaaggcactacagccacttctggcacagaagcctccgtctgctctgccccctctaccgctgagaccaaagtt

SEQ ID NO: 6526 - DNA, 1145 bp, Cedrus atlantica
ttactatgcaacgttaagagatgatcaacctgcagcaattaagaaattggatgtcagcagccagccagaagcaaattccgaatttttagctcagatttcaatggtgtcaaggctgaagcatgaccatgtagttgagctggtgggctactgtgtcgagggaaccctccgcgtattggcttatgagtttgcaacaatgggctctttacatgacattttacatggacggaaaggagtgcagggggctcaaccaggtccagttctagattggatgcaaagggtgaaaattgccgttggtgcagcgaagggtcttgagtaccttcatgagaaagcccagccccatattattcatcgtgatattaggtctagcaatgttttgctttttgatgacttcaaagcaaaaatagcagatttcaatctttcaaatcaagctccagacatggctgctcgcctgcattcaacacgtgtcctgggaacctttggctatcatgctccagagtatgccatgactggacagttgactcaaaagagtgatgtatatagctttggggtggttctacttgaactgctgacaggtagaaagcctgtagaccacacaatgcctcggggacaacaaagtcttgttacttgggcaactccaagactgagtgaagataaagtaaagcagtgcgtagatccaaaactcaagggagagtatcctcccaaggctgtagccaagttagctgcagttgcagcattatgtgtgcagtatgaggcagatttccgtcctaatatgagtatagttgtgaaagcacttcaacccttggtaactccaaaaccagcaattccagcatctgagcctcagacctgatcatcattcatgttgcagacctctgtaaaattttgttcagagttggtttagaagtgtgcaatggaatattgcaagtgcagtacttgaagagattgcattccaaagttaaacaacgatagtattcgaccctccaggtttttccatgagttgggaatatgtacttaacattttatgttcttttcgatttcccattctttcattccttatgaggaattttctacttgtaccgtaaccttgaggtcacttgagtcggatccaagcaacagctcatttgtttgtaatatttcttataactccc

SEQ ID NO: 6527 - DNA, 2058 bp, Chelidonium majus
aaaggcctcacttgtaactttcaagttataatagtatagttaacaaggaaatacatataaacagctctaacaaaaattacacagtttccttcatcaacaagtaaaccctctattctaaacaacaaacacctcccccctcccccctaaagacttcttacacagttaaagcagcagaaggggtataccagccatgatgcatctccacggccttctttctcctggcaagccgagactttctgttggctccggtattcctgtgcaacgctcctgctttcactgccttatcaatagctgaatatgcttcagctattaatttctcaaccgaaacgatttcttcagattgtgcatccgtcttcttcttgagcacatccagtgcttcaagcaccttcttcattcgggttttcatctcagatttcttccctttattgtaaatccgtctcttctctgcttgtcgagctcgtttagcagcagaatcagcctttttggctggagccgcttcacatacaacagaccgacctctgtgtctctgaattggcattaaagagaaactaccattggagaagggagtctcagaaagatgactggagaaactgagagctcttagagaagtacataatgggtttgctaaacgaatagaaggagagctgctggtgacaattgagaactgcttcttggggaatgttaagcaagaggaaaggcattgaacagcagccccctctctctctctaaaaaattcctgttttcgtctcctctcacaaaccaaacctaataatcgaacagaaaccagtattggctgtggtcggacaggtgcatgcgacttctcctggtttatttggatagctggagatacgcagtataccaatcaaagaaaatttaatttttgctcgatttatacccatcaaagaattgatataaggaagaagaaacaagatgcgtcggtggttatgttgtactcctcaggtagaagaatctaacagtaaaaaggaaaatgatgttgtcctgaaaagatcgaggagccatggatatgtagatgctcaatacaaaccctcaaggcattctcatacagccaagcctgaaatcccaaaagctccaccacctattgaagtgcctccattgtctttagatgagctgaaagaaaagactgacaactttgggtcaaagtctttaattggtgaggggtcttatgggagagtttattatgcaaccttgaacagtggaaaagctgttgctataaaaaagcttgatgtttcgtctgaacctgagccgaataatgagttttttaaccaggtttccgtggtttcaagactgaagaatgacaactttgttgagttgcttggttactgtgtggaaggcaatattcgtgccttggcttatgagtttgcaaccatgggttctctacatgatattttgcatggtagaaaaggagtccaaggtgcacaaccaggtcctgtgcttgattggatgcagcgagtgcgaattgctgttgatgcagcaaggggattggagtatttgcatgagaaggctcaaccgtctataatacacagggatgtccgatcaagcaatatcctcatatttgatgacttcaaagccaaaattgcagacttcaacctttcaaatcaggctcctgacatggctgcccgtcttcattctactcgagttttgggaacctttggttatcatgcaccagagtatgctatgactggtcaactaacacagaagagcgatgtgtatagctttggtgttgttcttcttgagcttctgactggtaggaaacctgttgatcacacaatgcctcgtggacaacaaagtcttgtaacttgggcgactccgagactgagtgaggacaaggtcaaacaatgtgtagatcctaggctaaagggagattatcctccaaaaggacttgccaagctggctgctgtagcagcactctgcgtgcaatatgaatctgaattccgtccaaacatgagcatcgttgtcaaggcattacaaccacttctctcacagaagcctcaagttcccccaccagttctctccgagatttaagatgtaaactttttt

SEQ ID NO: 6528 - DNA, 1528 bp, Distylium racemosum
atcaacttccattattttcggaaccactctcctctccgatctgtattggctcggatcgaatcccctcggtgcaatgtctagaactttccttggtcatgtgctgcaagaacctttgatgagatgagcatgtgagaagtcagcccattacaaaatgtgtcggttgctgtgctgtgctggttcagaagaagaaagttttgttccagttgataaccattacacaagtccagcagttggcactgcaaatggaactcaaggagagtctaaggcatctgaaacagttaagaatggcactccacagaaaatgttgcctattgaagcacctgctctgtcctatgaagagttgaaggaagcaacagataattttgggccaaagtctttgattggtgaagggtcatatggaagggtttattatgcaaccttaaacaatggtcgtgctgcagcaattaagaaattagatgtcagcagccagcaagagcctgattctgattttcttgcacaggtgtcaatggtttccaggctgaaacatgagcatgttgttgaattggtgggttattgcgtggatggaaacctacgtgttttggcttacgagtttgccacaatgggttccttacatgatattttacatggaaggaaaggagtacaaggtgctcaacctggtcctgtgcttgactggatgcagcgagttaaaattgctgttggtgcagcaaagggtcttgagtaccttcacgagaaagctcaacctcatataattcaccgtgatataaggtcaagcaatgttcttctttttgatgattttacagccaagattgctgattttaacctttcaaatcaagctcctgacatggctgcacgccttcattcaactcgagtgctgggaacctttggctatcatgctcctgagtatgccatgactggtcaattaacccagaagagtgatgtatacagctttggagtggtcctacttgagcttttgacaggaagaaaaccagtggaccatacaatgcctaggggacagcaaagccttgttacttgggcaactccgagattgagtgaagacaaagtaaagcagtgtgttgatccgaagttgaagggtgaatatcctccaaaggctgttgctaagatggccgctgttgcagctttatgcgtgcagtacgaagcagactttcgtcccaacatgagtattgttgttaaagcacttcagccattgcttactccaaaaccaaatgcctctgcatctgatcctaatgcatgattctcccttgatagatattctcatagttttgaatcttcttgtggattgttttgtagctgacatgtggttattattagatgatggcacttgcttcaaaaagattattttaaccagtggatcaagttgcatgcttccattgtatgtgttattaaaatgttggttaatgtatgggtttctaatcagtggttcaagttgcatacttaaatttgtgtgtgtcacctaagacatcggcattaaagctgtggatttatttgaacaatctcagattcttttgtt

SEQ ID NO: 6529 - DNA, 2129 bp, Pinus pinaster
tactattggggctctctaatggtggaaagttgaacattagaacaaggcccgttcgttgcggattaatatgctaaaatgtactctcttgtaattcgcctcctcattttacacacctgcactttgtaaaaacctccagaatctccctgctgccactgatacgcctttctgttaattgtcggctccagcgcgtgcgcgcattcgacggtaattcccaatctacagctccgtgattcgtgctatatctactcgatctctgttccatgctgcttaattatttcactcttttccgattcttcccacgctcgctcgcctgcagattaccctgacggattctagcgaggagtcgtctgcctgccggaatccggtgactccgaacgccctctgccctgccgtggtctttcgcgtcggcgcttcttctcttctgcgataagcggggtttggagcgggaactttccgttaggcttgccgttgagggtttggcagagctcgatttcagtgaagtgaattatcatctaaacgggaatacaacatgcgtcggtttttttgctgtacttgctcaacagagggtgctcctgaacaacctgaggcccatttcttgaatgcagctaagaacaatggaaacgggttccagggagactataagatgtctgagggtgcaaagagtggtccgccacagaaaatagctcctattgaagcacctgctctgtcattagaagaactgaaggaagcaactgataactttggggcaaaggctttgattgggagggtcctacggaagagtttactatgcaatgttaagtgatggtcaacctgcagcaattaagaaattggatgtcaacagccagccagaggcaaattccgaattcttagctcaggtttcaatggtctcaaggctgaagcatgaccatatagttgagctggtgggttactgtgttgagggaactctccgtgtattggcttatgagtttgcaacaatgggctctttacatgacattttacatggacggaaaggagtgcagggggctcaaccaggtccagttctggattggatgcaaagggtgaaaattgctgttggtgcagcaaagggtctcgagtaccttcatgagaaagtgcagccccatattattcatcgtgatattaggtctagcaatgttttgctttttgatgacttcaaagcaaaaattgcagatttcaatctttcaaatcaagctccagacatggctgcccgcctgcattcaacacgtgtcctgggaacctttggctatcatgctccagagtatgccatgactggacagttgactcaaaagagtgatgtatatagctttggggtagttctacttgaactcctgacaggtagaaaacctgtagatcacacaatgcctcggggacaacagagtcttgttacttgggcaactccaagattgagtgaagataaagtaaagcagtgtgtagatccaaaactcaagggggagtatcctcccaaagctgtagctaagttagctgcagttgcagctctatgtgtacagtatgaagcagatttccgtcccaatatgagtatagttgtaaaagcacttcaaccgttactaactccaagaccagcaattccagcatctgagcctcagacctgatgacctttcatctaccagacgtctgtaaaatttcgttcagagttgggttagaagcgtgcagtggaatactgtgaatgcagtacttgaagagattgcattccaagattaagccagccataatattattccatcctccaggtttttccacgagttgggaatatgtgcttcacattttaagttctttttgatttcccattctttcattccctacgaggaattttctacttgtactgtaatctcgaggtcacttgagtcggatccaagcaacatatcatttgtttgtaatagttcttataacttacgtgttttgtttacagttttagcattattttttaatactgggcggacaaggatgtacttgtgttttggttttctatgatttctactttcacatagttcgtgtatatagatatcacgttgaaaagtttgggattatgtgcactgttttcttcatgaacttatgcaatgtcataacaatagcggttaagctttgtttcttgt

SEQ ID NO: 6530 - DNA, 1722 bp, Arabidopsis thaliana
gtagttatttgggattccaaatttttttcattcctaaatttctccacgagctcatcacctcctttcgtctctgcctctcatttgtctacaaacattttttccttttgattcgtctctctggtttattgctcgttgatcgtttgtttctaaattgcattctgatttctgatggatcgtgattttcatcgtcgtggtcaagtggcgaatgatcgtacacaaagcaactttgttcgattggataaaccgagagctgtagacgatcttgatataggcaagagagggaagatgcgtaggtggttgtgctgttcttgtcgtgtacaagaatcttacccatcagctgaaaataaccgattgaaaacccctcctactcgccattacgactatggacgtaacaacaagaaaacaccagctcctgtgaagcctcctgttttgaaggagcctccgcctattgatgtccccgcaatgtcattggttgagctcaaagaaaagactcagaattttggatcaaaggcattgattggagaaggatcctatggaagagtgtactacgcaaactttaatgatgggaaggccgtggctgtgaaaaagcttgataatgcatctgaacccgaaacaaatgtcgagttcttgactcaggtctctaaagtttcgaggctgaaaagtgacaattttgttcagcttcttggttattgtgtagaagggaaccttcgtgtccttgcttatgagtttgccacaatgagatcattgcacgacatcttacacgggagaaagggagtgcaaggagcacaacctggtccaacacttgagtggatgcaacgagtccgagttgcggttgatgcagctaaaggattagaatacttacacgagaaagttcaacctgcggttatacacagagatattcgatctagcaatgtgcttattttcgaagatttcaaagccaagattgctgactttaatctttccaatcaagctcctgatatggctgctcgtcttcattccactagagttttggggaccttcggttatcatgcaccagaatatgcgatgacaggacagttgacacagaagagtgatgtttacagttttggagttgtgcttttggaacttcttaccgggagaaaaccggttgatcatactatgcctcgtggtcaacagagtcttgtcacttgggctactccaaggctgagtgaagacaaagtgaaacaatgtgttgatccaaaactcaaaggagagtatcctcctaaagcagtggcaaagcttgcagcggttgcagcgttgtgtgtgcaatacgaagcagagtttaggccaaacatgagcattgtagtaaaagctcttcaaccgctcttgaggtcagcaacagctgctgctcctccaacacctcaaccttgattcttctttgtggttcttgcttactgattatcatggcttcaaggttttgtcttcactttattctttctatctaccatggaatgtaaatggttattaaggggaggtggtgaggagcaattgggatttcactccatggaaatgatctgtgttaactgctttttgatgggttgattcttatgaaatattctataacttttgtttgttcgtttgaacatataagctgacacttctctttttttaggcaaattcatgggaaaatagcttgaatatacagaaatttataacaccatgattttatagtgttaaagagtgtcacacaaactttggactaga

SEQ ID NO: 6531 - DNA, 1988 bp, Pinus taeda
cccatctctaatggtggaaagttgaaagttgaacattagaacaaggcccgttcgttgcggattaatatgctaaaatgtactctcttgtaattcgcctcctcattttacacacctgcaccttgtaaaaacctccaccatccctgctgccactgatacgcctttctgttaattgtcggctccagcgcgtgcgcgcattcgacggctcgctcgcctgcagattaccctgacggattctagcgagaagtcgtctgcctgccggaatccggtgactccgaacgccctctgccctgccgtggtattccgcgtcggcgcttcttctcttcttctgcgataagcggggtttggagcgggaactttccgttaggcttgccgttgagggtttggcagagcttgatttcagtgaagtgaattatcgtctaaacgggaatacaacatgcgtcggtttttttgctgtacttgctcaacagagggtgctcctgaacaacctgaggcccatttcttgaatgcagctaagaacaatggaaacgggttccagggagactataagatgtctgagggtgcaaagagtggtccgccacagaaaatagcacctattgaagcacctgctttgtcattagaagaactgaaggaagcaactgataactttggggcaaaggctttgattggggaggggtcctatggaagagtttactatgcaatgttaagtgatggtcaacctgcagcaattaagaaattggatgtcaacagccagccagaggcaaattctgaattcttagctcagatttcaatggtctcaaggctgaagcatgaccatatagttgagctggtgggttactgtgttgaggggactctccgtgtattggcttatgagtttgcaacaatgggctctttacatgacattttacatggacggaaaggagtgcagggggctcaaccaggtccagttctggattggatgcaaagggtgaaaattgctgttggtgcagcaaagggtctcgagtaccttcatgagaaagtgcagccccatattattcatcgtgatattaggtctagcaatgttttgctttttgatgacttcaaagcaaaaattgcagatttcaatctttcaaatcaagctccagacatggctgcccgcctgcattcaacacgtgtcctgggaacctttggctatcatgctccagagtatgccatgactggacagttgactcaaaagagtgatgtatatagctttggggtagttctacttgaactcctgacaggtagaaaacctgtagatcacacaatgcctcggggacaacagagtcttgttacttgggcaactccaagattgagtgaagataaagtaaagcagtgtgtagatccaaaactcaagggggagtatccccccaaagctgtagctaagttagctgcagttgcagctctatgtgtacagtatgaagcagatttccgtcccaatatgagtatagttgtgaaagcacttcaaccgttactaactccaagaccagcaattccggcatctgagcctcagacctgatgacctttcatgtagcagacctctgtaaaatttcgttcagagttgggttagaagtgtgcagtggaatactgtgagtgcagtacttgaagagattgcattccaagattaaggcagccataatattattccatcctccaggtttttccacgagttgggaatatgtgcttcgcattttaagttctttttgatttcccattctttcattccctacgagaaattttctacttgtactgtaatctcgaggtcacttgagtcggatccaagcaacatatcatttgtttgtaatagttcttataacttatgtgttttgtttacagttttagcattattttttaatactggcggacaaggatgtacttgtgttttggttttctatgatttctactttcacatggttcatgtatatagatatcgcgttgaaaagtttgggattatgtgcactgttttcttcatg

SEQ ID NO: 6532 - DNA, 1642 bp, Podocarpus macrophillus
attccaagtccagtcttcaattcaattaattctgtgaaaggctttaatgttttcataatttatttctctgattcgattcgattggattctttctcagaccaccacgcaggtttccgatcagcgctcgtcacgtcgcgggatcgaatcttagcgggtgcatttctgagctttctttggtcgtgcactgcaagagtctttttgtcatatgagcatgtgagaagtgagccaaatacatgatgtgtcggttgctgtgctgttccggaacagaagaagaaaactttgtcccagttgataaccagtatacaagtccagcagttggtgccgcaaatggaggccaaactgagtccaaggcaactgaaactgtcaagaatggtgctcctcataaagttttgcctattgaagcacctgttctgtcctttgaagaactgagggaagcgacagataattttgggccaaagtctttaataggggaaggatcttatgggagagtttattatgcaaatttgaccaatggtcgtgctgcagcaattaagaaattagatgttagcagccagcaagaatctgattctgattttctggcacaggtatcaatggtttccaggttgaagcacgaccatgtcgttgaattggtgggttattgtgtggaaggcaatgcacgtgttttggcttatgagtttgcaacaatgggttccttgcatgatattttacatggaaggaaaggagtacaaggtgctcaacctggtcctgttcttgattgggtgcaacgggttaaaattgctgttggtgcagcaaagggtcttgaatacctccatgaaaaagctcaacctcatataattcaccgtgatattagatcaagcaatgttcttctttttgatgattttgcagccaaaattgctgattttaacctctcaaatcaagctcctgacatggctgcacgccttcattcgactcgtgtgctggggacttttggctatcatgctcctgagtatgctatgactggtcaattaacccagaagagcgatgtatatagcttcggggtggtcctacttgaacttttgacaggaagaaaaccagtagaccatacaatgcctaggggacagcaaagccttgttacttgggcaactccacgattgagtgaagacaaagtaaagcagtgcgttgatccaaaactaaagggtgaatatcctccaaaggctgttgccaagttggctgctgttgcagcattatgtgtgcagtacgaagcagactttcgccccaacatgagcattgttgtcaaagcacttcagccattgcttaatccaaaaccaaccaccgctgcatctgatcctcatgcatgattttccagttacagtagtttttcagtttttaaaatttttggtggactatcttgtatttgacttggggatgattagatgatggtacttcttgagttttgttcctcaaatcaccctaattactggttgaagtttcatggttcattgcatgcagtatttaagggcctgttagttaattctagttagtttatggatttctaaacagtggttgaagttgccggcatgcagttgtgtgtatcacttaagtggttggtaaaaaacctttaattattgaacaactcattcatttgtaagacttgatctttgaa

SEQ ID NO: 6533 - DNA, 1322 bp, Taxus baccata
aatggaaaccaaggagagtccaaggcatctgaatcagccaagaatggtgcaccacagaaatttacccattgaggcacctgctctatcctttgaagaattgaaggaagcaactgataactttggaccaaagtctttgattggggaaggatcgtatggaagggtttattatgcaactttaaacaatggccgtgccgcagcaattaagaaattagatgtcagcagccagcaagaatctgattctgagtttctggcacaggtatcaatggtttccaggctgaagcatgaacatgttgttgaattggtgggttattgtgtggaagggaatctgcgagttttggcatatgagtttgcaacaatgggttccttacatgatatattacatggaagaaaaggagtacaaggtgctcaaccaggtcctgttcttgactggatgcaacgggttaaaattgctgttggtgcagcaaagggtcttgagtacctccatgagaaggctcaacctcatataattcaccgcgatattagatcaagcaatgttcttctttttgatgattttgcagcgaaaattgctgattttaacctttcaaatcaggctcctgacatggctgcccgccttcattctactcgtgtcctgggaactttttggctatcatgctcctgagtatgctatgactggtcaattgactcagaaaagtgatgtatatagctttggagtggtcctacttgaacttttgacaggaagaaaaccagtggaccacacaatgcccaggggacagcaaagtcttgttacttgggcaactccaagattgagtgaagacaaagtaaagcagtgcgtcgatccaaaattgaagggcgaatatcctccaaaggctgttgcgaagatggctgctgttgcagcattatgtgtgcaatatgaagcagattttcgtcccaacatgagtattgttgtcaaagcgcttcagccattgcttaatccaaagccgattacccctgcatctgatcctcatgcctgatgttccagagatggtcatttctgtagattggagattttcttatggattgttttgtagttgggttgtggattattacatgatggtattaacatctagagttcttatcttcaaattattttaatcagtggttgaagttgcatacatcagttgtatgcatcacctaagatgcaggtttttaacttgtggatttctttcaacaaacttagattctttcgttctttattgagagtctgaagcgatgtatgttgatttgatgagtttgcaagacttattatgttggactcaaattttgtgtctctacatatttttgtg

SEQ ID NO: 6534 - DNA, 1443 bp, Sciadopitys verticillata
gatcatattatgcaagaaactttacataaaatgagcatgtgagaagtcagcccaatacacaatgtgtcggttgctctgctgttctggtacagaagaagaaagttttgtccccgttgataaccattatacaactccagcaattggcactgcaaatggaaaccaaggagagtctaaggcatctgaatcagtcaagaatggtgctccacagaaaatattacctattgaagcacctgctctgtcctttgaagagttgaaggaagcaacagacaattttgggccaaagtctttgattggggaaggatcatatggaagggtttattatgcgactttaaacaatggtcgtgctgcagcaattaagaaattagattccagcagccagcaagagcctgattctgattttcttgcacaggtatcaatggtttcgaggctgaagcatgaacatgttgttgaattggtgggttattgcgtggatgggaatctacgtgttttggcttatgagtttgcaacaatgggctctttacatgatattttacatggaagaaaaggagtacaaggtgctcaaccagggcctgttcttgactggatgcaaagggttaaaattgctgttggtgcagcaaagggtcttgagtaccttcacgagaaagctcaacctcatataattcaccgtgatattcgatcaagcaatgttcttctttttgatgattttacagccaaaattgctgattttaacctttccaatcaagctcctgacatggctgcccgccttcattccactcgtgtactgggaacttttggatatcatgctcctgagtatgctatgactggtcaattaactcagaagagtgatgtatatagctttggggtggtcctacttgagcttttgacaggaaggaaaccagtggaccatacaatgcccaggggacagcaaagccttgttacttgggcgacaccaagattgagtgaagacaaagtaaagcagtgtgtcgatccaaagttgaagggtgaatatcctccaaaggctgttgctaagatggctgctgttgcagcattgtgtgtgcagtatgaagcagactttcgtcccaatatgagtattgttgtcaaagcgcttcagccattactcaatccaaaaccagcgccatctgtgtctgatcacgcctgatgtttcaatgacagtcttttctgtagtcttcaaattttcttatggattgttttgtagttggtacagggatatttatagtgactgtacttttggagtcattattgttaaagttgcatacttaagttgtgtgcatcacttaagaggttggggtttaaattatttctttgaacactattagattcgttcgttcttttgagggtcactactgatgtttgttgatttgacaaatcaaatatttgtaagacttcctatattggactcttaatttcatttgttgttctgca

SEQ ID NO: 6535 - DNA, 1565 bp, Abies balsamea
ccctgtacgttataatcacattgctttcactacaaatgttctggatctgtacgggtctcgaattttctggatctgtaccgggctcgtctcaggatcgaacctcttctggtgcattttgggcattttcttggtcatatgctccgagaatcttttttaacttgagcatgtgagtagtcagccaatacacaatgtgtcgtttgctttgctgttctggtgcagaagaggaaagctttgtcccaactgacaaccaatatcaaaatcaagcggctcataatccatatggaagccaaggagaatccaagcctcaagcagtgaataatggtgctccacagaaagttttacctattgaagcacctactttgtcacttgaagagttaaaggaagcgacagataattttgggcccaaatctttgattggggaaggatcatatggaagggtttattatgcaactttaagcaatggccaggctgctgcaattaagaaattggatgtcagcagccagcaagagtccgattctgattttctggcgcaggtgtcaatggtatccaggctgaaacatgagcatgttgttgaattggtgggctattgtgtcggagggaatcaacgcattttggcttatgagtttgcaactatgggttccttacatgacattttgcatggaaggaaaggagtgcagggtgctcaaccgggcccggttcttgactggatgcaacgggtgaaaattgctgtgggtgcagcaaagggtcttgagtaccttcatgagaaagctcaacctcatatcatccaccgtgatattagatccagcaatgttcttctttttgatgactttgcaggcaaaattgctgattttaatctttcaaatcaagctcctgacatggctgcccgacttcattccactcgtgttctgggaacttttggctatcatgctcctgaatatgccatgacaggtcagttgactcagaagagtgatgtatatagctttggggtggtcctccttgagcttttgacaggaagaaagcctgtggaccatacaatgcctaggggacaacaaagtcttgttacttgggcaactccaagattgagtgaagacaaagtaaagcagtgcgttgatccaaagttgaagggtgaatatcctccaaaggctgttgcaaagatggctgctgttgcggcattgtgtgtgcagtatgaagctgattttcgtccgaatatgagtattgttgtcaaagcacttcagccattgctcaatccaaaaccaactccctctgcatctgaagctcaactatgatgcttccaatggacttttctgaagtttccaaatttttgcgtttggattgttctgtagttcacatgtagattattagataatggaacttgcttatggagttcttatagtccaattctgttcagtggtggaggttgcatactttgtatgaagattggtatttgtactttggttttatttgaacaatcaaattctttcgttctttattgatggtgtcgtgatatttgttgatgcaacatatcatatatttgtaatccttgctatgacttaaatatcacttgt

SEQ ID NO: 6536 - DNA, 919 bp, Brassica napus
tcctacggaagagcctactacgcaaccttgaaagacggcaaagccgtggctgtcaagaagcttgacaacgcagctgagcctgaatcaaacatcgagtcttgactcaagtctcaagagtctctaagctgcaccatgataacttcgtccagctcttggttactgcgtcgaagggaacctccgcatactcgcttatgagtttgcaacgatgggatctttgcatgacattttgcacgggaggaagggagtccagggggcacagccaggtccaactcttgattggatccaacgggtgagaatcgccgttgatgcagctagagggcttgagtatttacatgagaaggttcagcctgtggtgatacacagagatattcgttctagcaatgtgcttttgtttgaagactttaaagccaagattgctgattttaatctgtcgaatcagtcccctgacatggctgctcgtcttcattcgacaagagtcttgggaacgttcggttaccatgcaccggagtatgctatgactggtcagctgacgcataagagtgatgtttatagtttcggtgtggtgcttttggagctcttgactggtagaaagcctgttgatcatacgatgcctcgcggccagcaaagtcttgttacttgggctactccgaggctgagtgaagacaaagtgaagcagtgtgttgatcctaaactcaaaggagactatcctcctaaagcagttgcaaagcttgcggcggttgcagcgttgtgtgtgcaatacgaatcagagtttaggccgaacatgagcattgtggtaaaagctctgcaaccattgctgaggtcatcaacagcagtacctgttcaatcacaggggatatgattcttctatgtgataaagagagattggttttctgttttcatgtgtttgccatatcatata

SEQ ID NO: 6537 - DNA, 1529 bp, Cephalotaxus harringtonia
agtgctgtgcgagaatttatttataagacgagcatgtgagtaatcagcccaatacataatgtgtcggttgttgtgctgttctggtacagaagaggaaagttttgtccctgctgataaccattatacaagtccagcagtcggcactgcaaatggaaaccaaggagagtctaagggatctgagtcagccaagaatggtgctccacagaagatgttgcccattgaggcgcctgctctgtcctttgaagaattgaaggaagcaacagataactttgggccaaagtctttgattggggaaggatcatatggaagggtttattatgcaactttaagcaatgaccgtgctgcagcaataaaaaaattagatgtcagcagccagcaagaatctgattccgagtttctggcacaggtatcaatggtttccaggctgaagcatgaacatgttgttgagttggtgggttattgtgtggaagggaatctacgtgttttggcttacgagtttgcaacaatgggttccttacatgatatattacatggaaggaaaggagtacaaggtgctcaaccaggtcctattcttgactggatgcaacgggttaaaattgctgttggtgcagcaaagggtcttgagtacctccatgagaaggctcaacctcatataattcaccgtgatattagatcaagcaatgttcttctttttgatgattttgctgcgaaaattgctgattttaacctttcaaatcaagctcctgacatggctgcccgccttcattccactcgtgtgttgggaacttttggctatcatgctcctgagtatgctatgactggtcaattaactcagaagagtgatgtatatagctttggggtggtcctacttgaacttttgacaggaagaaaacctgtggaccatacaatgcccaggggacaacaaagccttgttacttgggcaactccaagattgagtgaagacaaagtaaagcagtgtgtcgatccaaagttgaagggtgaatatcctccaaaggctgttgctaagatggctgctgttgcagcattatgtgtgcagtacgaagccgactttcgtcccaatatgagtattgttgtcaaagctcttcagccattgcttaatccaaaaccgacgccctctgcatctgatcatcatgcctagtgttccagtgatggtcatttctgtagattggagattttcttatggattgttttgtaggtttgtggattatagataatggtatttgtgtctagagttcttatcttcagattattttaatcagtagttgaagttgtatacttcagttgcatgcatcacctaagatgcaggtatttaacttatggatttctttcaacaatcttagattcttttgttctttattaagagtctcgggcgatgtatgttgatttgacatgagtttgtaagacttactatgttggactcttaaattttatttgtggctctgcttattcattggatttttgtgtataacatgttttgtcttaaaaggctcggcacagagtcggagacc

SEQ ID NO: 6538 - DNA, 1505 bp, Flaveria ramosissima
cgtttttgcattgatggcaatttaaacccttgttccattctctctctttctctttgtaatcgcttcgttgcttatctgtctttccccaatttctacatcatatcaacaccaccaacacaataaaaacaaagccctaattcaagaatccaaaactcacaccacaacacaggaatacttacctccacctggatactttatacgtttgcgggaaccaagggctcaagacgatttgattttgaggaagagggataggatgcggaggtggttgtgttgtacttgtcaagtcgaagaatcttacccttcaaatgacaatggctttataaaaagccacaatgatcatattgatgggcagcagaaggacagagtaccacctccggccaaattcgatgcacaaaaagcagttccaacaattgaagtgccttcactttcacttgacgaattgaaagaaaaaccgagaattttggatccaaggcactgattggtgaaggttcatatggaagggtttattttgacaaatttaaataatggtaaaaagtgtggctgtgaaaaagcttgatgtttctacggaagctgaatcagataacgaatttttgactcaggtttccatggtttctaaactgaaacacgagaattttgttgagctgtgcggctactgtgtggaagggaatacacgtgttttggcttatgaatttgcaaccatgggatctctacatgacatattacacggcaggaagggtgtgcaaggagcacaacctggtcccgtgcttgattggatgcaaagagtaaggattgctgttgatgcagcaaagggacttgagtatttgacatgaaaaggtccaaccttcgataattcacagagatattaggtctagcaacgtgctattatttgaagatttaagagccaagattgcggatttcaatctttctaatcaagctcctgatatggctgctcgtttgcattctactcgtgttttgggtacttttggctatcatgcaccagaatatgcaatgactggacagctgacacaaaaaagtgacgtgtatagctttggggttgttttgcttgagcttctgactggtcggaaacctgttgatcacacaatgccacgtggacaacaaagccttgtcacttgggctacacctaggctaagtgaagacaaggttaaacaatgtgttgatccaaggctcaaggagggagtaccgtcaaagcagtggcaaagctggcggctgtggcggctttatgtgtgcaatacgagtccgagttcaggcctaatatgagcattgttgtgaaagctcttcaaccactgttgagggctcctgcaccaacagctccagaagtataatgtaaaaaccaagaagaaaataaacaaattcgcgagccgttgatttcctgcagctttatgaccgtagattttcgtttaatcgaggcatatatatattttggttttggtttgagaatattgttatttgcttatgttcagattggtctgttatatatctttgct

SEQ ID NO: 6539 - DNA, 1658 bp, Eutrema parvulum
tagttatttgggattccatatttttttgtcttcctaaatttctcgagtagctcgtcccctctcgtctctgcctctcatttgtctaccattttttttcttttttgattcgtcctctctggtttgttgctcgtcgataatttgtttctatctgcattttgcgtgatggatcgtgattttcatcgtcgtggccaagtggcgaatgatcgttcaccgagcagctactttgttcggttggataaaccgagagctgtagacgatcttgatataggcaaaagagggaagatgcgtaggtggctgtgctgttcttgtcatgtacaagaatcatacccttcagctgaacataaccgattgaaaagccctcctactcgccaccacgactacggacgtaacaataagaaaccaccagctcccgtaaaaccttccgtcttgaaggagcctcctcctattgatgtgcctgcaatgtcattgggtgagctcaaagaaaagactgataattttggatcaaaggctttgattggggaaggatcctatggaagagtgtactatgcaaactttaatgatgagaaggccgtggctgtgaaaaagctcgataattcatccgaacctgagacaaatgtggagttcttgactcaggtctcaaaggtttcgaggctgaagaacgacaattttgttcagcttcttggttattgtgtggaaggaaattttcgtgtccttgcgtatgagtttgccacaatgggatccttgcacgatgttttacatgggagaaagggagtccaaggagcacaacctggtccaacacttgagtggatgcaacgagtccgagttgcagttgatgcagctaaaggattagaatacttacacgagaaagtgcaacctcccgttatacacagagatattcgatctagtaatgtgcttctttttgaagatttcaaagccaagatcgctgatttcaatctgtcgaaccaagctcctgatatggctgctcgtcttcactccactagagttttggggacattcggttatcacgcaccagaatacgctatgacaggacagctgacccaaaagagtgatgtttacagtttcggagttgtgcttctggagcttctaaccgggagaaaaccggttgatcatacaatgcctcgtggtcaacaaagtcttgtcacttgggctactccaaggctgagtgaagacaaagtgaagcaatgtgttgatccaaaactcaaaggagaatatcctcctaaggcagttgcaaagcttgcggcagttgcagcgttgtgtgtgcaatacgaagcagagtttaggccaaacatgagcatcgtagttaaagctcttcaaccgctcttgaggtcttcaggaactgctgctgcttctccaaacccttaaatttgattttcctctttgtggttcttacatattggattaattcatggcttcaaaagttttttttgtgttttactttttctatttacaaatggaatgtaaatgggttattaagaagatggtgagtaagaaagaaaatggatttgttgtgttaaacgtttttgatgggtaacgttctaaaaaattgtttgttcttttactatataagcttattcgtggaagatagctcgaatgtacacaaacttataacaattctttattgattcatgaatttagac

SEQ ID NO: 6540 - DNA, 1461 bp, Brassica juncea
ggggatcgttgcatgacgtcttgcatggtaggaaaggagttcaaggggcacagccaggtccaacacttgactggacaacgagggtcaaaatagcagttgaggcagccagaggtttggaataccttcatgagaggtctcagcctcctgtgatccacagagacataagatctagcaatgttcttcttttcgaagactacaaaccaaagattgctgatttcaatctctcaaaccaatcgcctgataacgctgctcgtcttcactctacaagagtcttgggaactttcggttatcatgctccagaatacgcaatgacaggacaattaactcagaagagtgatgtgtacagctttggggttgtacttctagaacttctgacggggaggaaaccagtcgataataacatgcctcgtggtcaacaaagtcttgtcacctgggcgacaccgagactcagtgaagataaagtcaaagagtgcattgatccaaagctacaagcggattaccctccaaaagcagttgctaagctagcagcggtggcagcattgtgtgtgcaatacgaatctgaatttagaccaaatatgagcatagttgtgaaggcgctacagcctctcctcaaacctcctccacctgctgcagctccatcttcttgaaaacttttcttttcattttgcaaactatcagcatctgtaatcactactgcccttgccaatatatgaatggagtggtaactataaagatgatattattatgtttcatttgatgattgattatacaaatgaatctaccgaattcaatttttttgatcaagcatagaaagcgaagccagcaaagataaaagcatcatctttttgatagtttctcaaaagctcagtttcattttcctttttttacaagagacggatgaagacagaaagcaaagcagagtactgatctgtttgtgttgctttgattcaagcaacactgaaagaagtggctgctttctcgacaaatttgttggctcccttgaaccacctcttgtctccagcttgtgctttgcagatgtaaagcttgcctccgttcacggtggctgtgatcagctgatgcttaccaccttcatctccatcggccgttcttgtcaacacggacaagtaatagtatggtttcccaccaacgtcctgaacatttgtctccagaatgtttgctgttgccactgcattgttgtcaaagcctccctcagaggcagtctcaccgaagtaagcttgtttcccaaggaggtaattgacctgagagaggaactcttcaggagagccgtaatcagtgatggacttcttgtcggtaggagtgaccatgacattgagattgctagtagcatcgaagttgtcttcgtacctaaggacttgtcctggatactctacctctctactcgggttccattttgctggcacttgcacttggaatccatctccactgtatgccgtgaagtct

SEQ ID NO: 6541 - DNA, 1519 bp, Gossypium hirsutum
atttgcaataaaaaggagaggaatttgagagaaaagccaggtacatgctcctcctcaactagaaaatactgacgatttgtatttgaagaaaagagcaaggatgcgtcggtggctttgttgtacccgtcaggtaaacgagaattatcgatcacatgaaagtgagcacttcaagagccccgtgtttctatcagacgggcaggaaaaagacacaagggtagcagctgatgtcaagcccgaagtgcataaatcagcaccacctattgaagtacccgcactatcactggaagagttgaaagaaaagactgacaattttggatcaaaggctttggttggtgagggttcctatggcagagtttattatgcaaatttggacaatggaaaagctgtggctgtgaaaagctagatacttccgctgagcctgactcaactgtagagtttttgacccaggtttccatggtttcaagattgaagaatgaaaatgttgtcgagttgcaaggttactgtgttgaaagaaatctccgcatccttgcatatgagtttgcaactatgggatcactacatgacatattgcacggaaggaagggggttcaaggggcacaagcaggtccagtgcttgactggatgcagcgggtaagaatagctattgatgccgcaaggggcttggaatacttacatgagaaggctcaacctgctattatacacagagatattagatctagcaatgtgcttctcttcgaagacttcaaagcaaaaattgcagattttaacctctcaaaccaatctcctgacatggctgctcgtcttcattctactcgagttttagggacatttggttatcatgctccagaatatgcaatgactggacagttgacacagaagagtgatgtgtacagttttggggttgtccttctagaacttctgactgggaggaaacctgttgaccatacaatgcctcgtggacagcagagtcttgttacatgggctactccgagacttagtgaagataaagttaaacaatgtgtggatccaaaactaaatggagagtatcctcctaaaggagttgctaagctggcagctgtggcagcattgtgtgtgcagtatgaatccgagttccgtccaaacatgggcatcgtcgttaaggctctccaaactctggcaaagggacaagcagcagcagcggcatcagagacataaaaacagataatgcagtccttcaccttggattgaaatttctgcaacttatgcacagttcatttccattctgactacaaattccatatgtattcaacatattatatgtatttacttctttctgcttttttctttttgtttgtttggtttttgtcatatacgacaaccatgtataggattgggttggattgtttaacatcacctgatatatgatatgatctctccggtgccggttttggtcaccgggtgccgatgtccttttgagttgtacaattaagcaagggattgggtcttgtggaagagagaaatgttaacaaattattattat

SEQ ID NO: 6542 - DNA, 745 bp, Solanum melongena
ctcgagttttaggaacatttggctatcatgcaccagaatatgctatgactggacaactgacacagaaaagtgacgtgtatagctttggagtggtcttgcttgaacttttgactggaagaaaacctgtggatcatacaatgcctcggggacagcagagcctggttacttgggctaccccaagactgagtgaagataaagtccagcagtgtgtcgatccaaagctgaaaggatgccctccgaaagcagtggctaagatggcagccgtggcagcactgtgcgtgcaatatgaagctgaattccgtccaaatatgagtattgttgtcaaagctctccaaccactactgagggctcctactgcacctgctccagaaatttagggaacctattgtcgctcgcttgttttggaatttctgctaatttgcaactgttttgtggtatatcatgccagtatttcatttgtgacatgatttcgaaaagcaaactagacttcaaatttttttccccttgttgaaattggtgtgtaggattgattgatttcttaactttacatggtgagattgttgaagagatttccctgagaattgaggagcatctatatatttttttctttcctaaaagaacacctggggtctggttctttcaatttgtgtattataatttgtatttatactatggtattgtattatatttatggatttatactgtacagattggacctcaaatttgacccattgtcattcatcct

SEQ ID NO: 6543 - DNA, 1963 bp, Gnetum gnemon
ccgcccaccaggttcagccgcagcagcagctgaacctgagccgcagaaacccgcaacatcgtagccacctcacagatccgtgtaacccatgtgaagaagaggaaggagaatattgcatagtgatgtaaaccaaaaactttctccgctttagtggggagggctgcatcggttgcctgtaaatgcctgcagaagttcctgtggccagaccctcgctgccacaggcacgacaccaccagcccaaccgttgccgctgcgataactgtcaaaaaggtccacaacagcccacgagcaacagagagaaactagagcccactaaagctggaaataggaagaaccaaacatgcatttagagtacttggtctattctattggtattattttttgataataagcaatgagttgacgcgtagcttcaacttcgatgagcaacatgtcattctaagagaattatgtgagaagctttttgtgtcttcatcttcaattcatcttgcaagaacagcttttgcatcctctgaatggtcttcctacttctttttgctaaggcctggtaccatacatggcatctatacacaaaagcaggataaatggatgcttaaacatgcggcggtttctttgctgtgtttgtggatcagatgaagctcatgaccaaacagacaatccttatttaagtacaacaaggaatcctcctaatgggaactatgagagtattacaacttctgagggagcaaataatggccctcctgcaaaagttcctccaatagaagcaccttccctttccattgaggagctaaaggaggcaactgataactttggaccgaaggccttgataggggagggttcttatggaagagtttattacgctgttcttaacaatggtaatgcagctgcaatcaagaagctagatgctagcagccagccagattcaaactctgagttcttggctcaggtttcgatggtgtcaaggctaaagcatgagaatgttgttgagttggtgggttactgtgttgagggaaaccttcgtgttttggcatatgagtttgcaacaatgggctctttgcatgatgttttacatggaagaaaaggagttcaaggtgcacaacctggtccagtccttgattggatgcagagggtaaagattgcagttggtgctgcaaagggtctagagtatcttcatgagaaggcgcaaccccatattatacatcgtgatattagatctagcaatgttcttctttttgatgattttaaaacgaagattgctgacttcaacctgtctaatcaagctccggacatggctgcacgcttacattccacacgtgttttaggaacttttggttatcatgcaccagagtatgcaatgactggccagttgacccaaaagagcgatgtttacagctttggtgttgttcttcttgaacttttgaccggtaggaagcctgttgatcacacaatgccccgaggacagcaaagtctagttacgtgggctacccctagattaagtgaagataaagttaagcagtgtgtagatcccaaactcaagggagagtaccctcctaaagctgtggccaagttagcagcagtagcggcgttgtgtgtgcaatatgaggcagacttcagacctaatatgagtattgttgtgaaagcacttcagccattgctgaatccaaggcctgcaacacctgcctctgatgttaatacctgatgaatattcacttctgttgcttgtttcaatgtgtatgatattttagattcttgtttgaagggatgcacaataaatgttaaacagtaatacgagttatgaagaggatattttgaagcaattatatttgagctttataggaagatgaaaatctgctttatgctgcgtctttttgcttaattctttggtctggtctgtacgagttatccttttaatgtaacagtgagctatgggattgattccctcttagtatatttgtaagatcca

SEQ ID NO: 6544 - DNA, 1402 bp, Lactuca sativa
cgggggattcacaccgccttcttctgctgttgttaatttaaacccccattatttctctctctaacgacccgtttctttctctctcctcctcctctttgaatcgcttcttgcttatctgtctttccacaacttctcgatcctctgaaatacaataaaacaaagccctaaatcaagaactacaaagtgacaacacaaaaggcattcgaaagacaggcagacgcccctcctcctggacactttttacgtttgggaaaaccaagggctcaagacgatctaattttgaggaagagagataggatgcggaggtggctgtgttgtacttgtcaagttgaagagtcttatccttcaaatgaaaatggattgataaaaaaccacaatgatcacaatgatgggccacataaggactcaaaactaccacctcctgtgaaacatgatgctcagaaagcagtgccaacaattgaagtgccttcactttcactcgatgaattgaaagaaaaaactgagaattttggatcaaaggcattgattggtgaaggttcatatggaagggtttattttgcaaacttaaataatggaaaaagtgttgctgtgaaaaaacttgatgtttctccagaagctgaatcaaattcagagtttttgactcaggtttcaatggtgtcaacactgaagcatgacaactttgttgagttgtgtggttactgtgttgagggaaatacacgtgtcttggcttatgaatttgcaaccatgggatctctacatgacatattgcatggtaggaagggggtgcaaggagcacaaccaggtcctgtgcttgattggatgcaaagagtaaggatagctgttgatgcagcaaaagggctggagtatttgcatgaaaagattcaaccttcaataattcacagagatattaggtcaagcaatgtgctactttttgaagacttgagagccaaaattgcagactttaacctttcaaatcaagcaccagatatggctgctagattgcattcaactcgtgtgttgggaacttttggctatcatgcaccagaatatgcaatgactggacaattgacacaaaaaagtgatgtgtatagctttggggttgtgttgcttgagcttctaactggtaggaaacctgttgatcacacaatgccacgtggacaacagagtcttgtcacttgggctacaccaaggttaagtgaagataaggtgaagcaatgtgtggatccaaggctcaagggagagtaccctccaaaagcagttgcaaagttggcagctgtagctgcattgtgtgtgcagtatgagagtgagtttaggccaaatatgagcattgttgtgaaggctcttcaacccactgtgagggctcctgcacctgttgctgctgctgctgctgctgctgaagtct

SEQ ID NO: 6545 - DNA, 1369 bp, Sequoia sempervirens
cacagagatatatattgggcttcttttggtaatgtgctgcgagaactttttcataagttgagcatgtgaataatcagcctaatacacaatgtgtcatttgttgtgctgttctggtacagaagaggaaagttttgtcccagctgatagccattacacaagtccagcagttggcactgccactggaaaccaaggagagtctaaggcatctgaatcagccaagaatggtgctccacaaaaaattttgcccattgaggcacctgctctgtcctttgaagaattgaaggaagcaacagataactttgggccaaagtctctgattggggaaggatcatatggaagagtttattatgcaactttaagcaatggccgtgctgcagcaataaagaaattagatgtcagcagccagcaagaatctgattctgattttctggcacaggtatcaatggtttccaggctgaagcatgaacatgttgttgaattggttggttattgtgtggaagggaatctacgtgttttggcctatgagtttgcgacaatgggttccttacatgatatattacatggaaggaaaggagttcaaggtgctcaaccaggtcctgttctcgactggatgcaacgggttaaaatcgctgttggtgcagcaaagggtcttgagtaccttcacgagaaggctcaacctcatataattcaccgtgatattagatcaagcaatgttcttctttttgatgattttgctgccaaaattgcggattttaacctttcaaatcaagctcctgacatggctgcccgccttcattccactcgagttctgggaacttttggctatcatgctcctgagtatgctatgactggtcagttaactcaaaagagtgatgtatatagttttggggtggtgctacttgagcttttgacaggaagaaaaccagtggaccatacaatgcccaggggacagcaaagccttgttacttgggcaactccaagattgagtgaagacaaagtaaagcagtgtgttgacccaaagttgaagggtgaatatcctcccaaggctgttgctaagatggctgctgttgcagcattatgcgtgcagtatgaagcagattttcgtcccaacatgagtattgttgtcaaagcacttcagccattgcttaatccaaaaccaactccttctgcatccgatcctcatgcctgatgctccagcgacagtcttttctgcaattttcagattttcttatcaattgttttgtaataggtctgtggattatcagatgatggtattttgttctagagttcttctcttcaaataattttttgtcactgattgaagtcgcatgcttaagttgtgcgtgtcacctaagttgttgatatttta

SEQ ID NO: 6546 - DNA, 1575 bp, Zostera marina
gttattttgatcttttctttcagctcgtaccagccacgaccaccgatcgatcaagatagcggagcaggcgcgagtaaacgcggtagaaggaactcgtcaaaaattccaacccttttccagttgccatcatcgaagatcggatctcgcgacttctcgtctcttcggatcggatttatttagatctctagtgaaaatctttttaggagaaacggaaggaaataatgatgcgtcgctggatttgttgctcacggttcatggaagaaagatatgacatacaagacaatgattataatatggaaaccactgctgatgtgaaaccaaagaacccaaaatttcttaatgaagcagaaactaggcctcagaatctgtctgagcctcccagaatagaactacctactatacctcttactgaaattttgcaaaaaactaccaattttgactcaaaatctctggttggggaagggtcatatggaagagtttattatgcacttttgaatggtgaaagacaagtagccataaaaaagcttgatgtgtcatctgaatcaaataatgagtttctgtcccaggttgcggtggtatcaaagctgaagcatgataattttgttgagttattaggttattgcgtggaggaaggtaatcggttattggtgtatgagtttgcaacaatgggttctcttcatgacgttttgcatggtcgaaaaggagtccaagggtcacaacctggtcctgttcttgactggatgcagcgagtaagaattgctgtcaatgccgcaagggggcttgattacttgcatgaaaaggttcaaccatccgtcattcatagggatattcgatcaagcaatgttcttctatttgaggacttcaaagctaaaattgcagactttaatctttcaaaccaagcaccggacatggctgcacgtctccattccacacgtgttttgggaacctttggttatcatgcaccagagtatgctatgactggccagctaacccagaaaagtgatgtatatagttttggtgtcgtacttttagagcttcttactggtaggaaacctgtggatcatacaatgccaagggggcaacaaagtctagttacatgggcaactccgagattgagtgaggataaggtaaagcaatgtgtcgatccaaggctcaagggagaatacccacctaaaggagttgccaagttggcagctgtggcagcactatgcgtgcaatatgaagctgagtttaggccgaacatgagcatcgtcgttaaagcactccagcctctactaaatcagaaaatccccaccccttcccatgatcctgcaatgtgagaaagatagtcatccattcccttgatttttagtttggcatttcactatatagatttttattctttgatcaaataatttgtatctatctatacctgctcatcatttctcaaaagtgcatcatccatagagttgggagtggttggttcatttatctctaattctctattaagtttgctcaaacacgttgttgaataatgaattggcaccttcaaagttgtatttgtaatcaaacacaccatctattaattaccatatt

SEQ ID NO: 6547 - DNA, 1738 bp, Eucalyptus grandis
gagctagagagagagagagagagagagagagaataaaaagcaaaagcagaagcgcccatctcctcttcctcctctccttcctcttcttcctcctcctcccttacctgtcacttccgttccaatctcatcacagagtctctctctctctctctctcgcaacagacaagagacaaggcaaggattacagagggatcccaggtagactcttccctcaaattcggcacatgcgcctcctccaggttactttgttcacctggaatatcggagaactcgagagagccttctcttgaagaagagtcctagcaagaaaatgcgtcggtggctttgttgtacctgtcaagtcgaagaatcttacgctgcaaatgatgatgagctactgaaaagcccaaggaaccatgtacatgggccccaaaaaaattcaaagttgtctgctcctgttaaacctgaagtgcaaaagtcagcaccacctattgaggttcctgctctgtcgttggatgaactaaaagaaaagactgataattttggatcaaagtcattgattggtgaaggatcttatggaagagtatattatgctaacttagatagtgggaaagctgtggctgtcaaaaagcttgacaattcatctgaggctgagtcagatgtggagttcctgacccaggtttccatggtatcaaggttgaagcatgaaaattttgtacagttgcttggttactgtgttgaagggaatcttcgtgtgcttgcatatgaatttgcgaccatgggatcactacatgatgtactacacggaagaaaaggagttcaaggtgcgcaacctggccctgtccttgactggacacagcgagtgagaattgctgttgatgcagcgaggggattggaatatttgcatgagaaggttcagccttctataatccacagggatattaggtctagcaatgtgcttctttttgaagacttcaaagccagaattgcagattttaatctgtcaaatcaggcacctgacatggctgcccgccttcattctaccagagttttgggaacctttggctatcatgctccagagtatgcgatgactggacaattgacacagaaaagtgatgtgtatagctttggagttgttcttctagagcttttaactgggagaaaacctgttgatcataccatgccgcggggacagcagagtcttgttacctgggcaactccaagattgagcgaagacaaggttaagcaatgcgtagatccaaggcttaatggagactatcctccaaagggagttgccaagttggcggctgttgctgccttgtgtgtgcaatatgaagcagagtttcggcccaacatgagcatcgttgtcaaggctatgcagcctctgctgaaagctgcagcaccagcatctgctccagtgacttgattgaaaacgaattcgaagtccttccgcctcgcagtatcatcttatgcatagtttgctccatattctctggtgcatacgatgatgatattttcttttttcctttttcagagtagagatgatgggtatacattatttgatgagttgtgttctctgacgggagattgtatttagaatgtgagcggcccatgccaagccagctgctaaggcagtcagtgccggcatgacgctccgttagcttgtccctttcgtcgtaagctgtcttctgtggacatatatcttcaattctttccaagtaaattttactggctgtctcgttaaaaacaaaaaaaaaaa

SEQ ID NO: 6548 - DNA, 901 bp, Cannabis sativa
gtgctacaaaatgtaagagtgtattatgcaagcctgaacaatgggaaagctgtggctgtaaagaaacttgatgtttcttctgaacctgagacaaatgttgaatttttgacccaggtttccatggtttctagattgaagcaggaaaatcttgttgagttgcttggttattgtgttgaaggaaatcttcgtgtacttgcatatgaatttgccaccatgggatctttacatgacatattgcatggtagaaagggagttcaaggtgcacaaccaggtccaacacttgattggatgcagcgagtgaggattgctgttgatgcagctagaggattggaatacttgcatgagaaggttcaaccttctataatacatagggatatcagatctagcaatgtgcttctctttgaagacttcaaagccaaggttgcagatttcaacctttcaaatcaggcccctgacatggctgctcgtcttcattctactcgagttttgggaaccttcggttatcatgcaccagagtacgcaatgacaggacaattgacacagaaaagtgatgtgtacagctttggagtggttctccttgagcttttaactgggaggaagcctgttgatcataccatgcctcgtggacagcagagtcttgttacttgggctactccaaggttgagtgaagacaaagtcaaacaatgtgtagatccaaagctgaagggagaatatcctcccaaaggggttgcaaagttggcagctgtggcagcattgtgtgttcagtatgaagctgagttccggccaaatatgagcattgttgtgaaggcacttcaaccgctcctgaagccaccggccccagctccagatgcttcataaacagagcaggtcaggtatcccagttctatcagcagtcacaaca

SEQ ID NO: 6549 - DNA, 1734 bp, Sorghum bicolor
ccagactttccagtttcacttggggacagcacgcaccgcagtccgcagcgtctttcccttctgctcgtcctccgcctccgtcgcaggtgccggcgctaagcgaggatccctccgcccctccctccggccgtccgtcccgacgggacctcgactggtatcgtcggtcgctgtggcgacaggtgacgggacggcgatatgaagtggttatgttgtaactgccatgttgatgacgaggaagatggccacgacatggaacaggccaaaactcagagcaataagatagaccccaagcagaagtcttcaaaacctcctgttagtcaacctgagccagagttctcccctcctacaattgatgtccctgaattgtcgttggatgatttgaaacaaaagactgatgattttggatcaagcgctctgattggtgaaggttcttatggacgagtgtatcatgctactttggatgatgggaggcaagcggcagttaaaaagcttgatgcatctgaaaatgagcctaatgatgagttcctgaaacaggtctcactggcatcaaagctaaaacatgaaaatcttgttgagatgttgggttactgtgtggatgggaattatcgtatacttgcatatgaatttgcaaccatgggttcgcttcatgatgttttacatggaagaaaaggcgttcaaggcgcgcagcctggacctgtacttgactggatgcaaagggtcaaaattgctattgaggctgcaaaaggtatagaatatctgcatgaaaaggttcagccttcaatcatccatcgggacatcagatcaagcaatgtactgctgtttgaggatttcaaggcaaaaattgcagacttcaatcttttgaaccaagcaccagatatggcagctcggctccattcaactcgtgtattgggaacttttggatatcacgcacctgaatatgctatgactggtcagctgacacagaaaagcgatgtctacagctttggtgtagttcttttggaacttttgactggaaggaaaccagtagatcacacaatgcctcgaggacaacaaagtttagtcacatgggctactccaaggttaagtgaagacaaggtgaagcaatgtgtggatcccaggttgaagggagaatatcctccaaagggagtcgctaagcttgctgcagtggcagctctatgcgttcaatacgaagcagagttcaggcccaacatgagcatagttgtgaaggcgctttcgcctctccttcaacaaagacctgcaccagccaccgcagagccagccccgcaacctgtgagctgaaaccagtcatatgtgatgggaccctcggcatgcattcaaccagcacattctatgagtcattgagagtattttggctatttgttctgtagcattctcagttgggtacagcatacatgaacttgcctctactgtttgtggacaacaacagttcgtggcttgatgttggcgccacacaatggtatatgcagtaggctcgaagttgtttttttaccttctctaccaataccaactgtttgtaggtttcagaattcgttgcttgaagaatgatgcagaatgatctggactttttacctttggcgtggcgttgctgccttgccttccatgctggttatcatgaacttcctcccaaatcacaattcacttttaatttgttgtaagccaaaattcttaaactgtgatcaagtttatgaaatatagatatggacgtctaaaaca

SEQ ID NO: 6550 - DNA, 1847 bp, Sorghum bicolor
aaagaaagaaaaaaaaaaaaagcagagaaggggtctgctgtgtggtcccgcaggtcgcaccattcactcccctgtgttccgccgagacacgcgccccgcacggctcgcccagactttccagtttcacttggggacagcacgcaccgcagtccgcagcgtctttcccttctgctcgtcctccgcctccgtcgcaggtgccggcgctaagcgaggatccctccgcccctccctccggccgtccgtcccgacgggacctcgactggtatcgtcggtcgctgtggcgacaggtgacgggacggcgatatgaagtggttatgttgtaactgccatgttgatgacgaggaagatggccacgacatggaacaggccaaaactcagagcaataagatagaccccaagcagaagtcttcaaaacctcctgttagtcaacctgagccagagttctcccctcctacaattgatgtccctgaattgtcgttggatgatttgaaacaaaagactgatgattttggatcaagcgctctgattggtgaaggttcttatggacgagtgtatcatgctactttggatgatgggaggcaagcggcagttaaaaagcttgatgcatctgaaaatgagcctaatgatgagttcctgaaacaggtctcactggcatcaaagctaaaacatgaaaatcttgttgagatgttgggttactgtgtggatgggaattatcgtatacttgcatatgaatttgcaaccatgggttcgcttcatgatgttttacatggaagaaaaggcgttcaaggcgcgcagcctggacctgtacttgactggatgcaaagggtcaaaattgctattgaggctgcaaaaggtatagaatatctgcatgaaaaggttcagccttcaatcatccatcgggacatcagatcaagcaatgtactgctgtttgaggatttcaaggcaaaaattgcagacttcaatcttttgaaccaagcaccagatatggcagctcggctccattcaactcgtgtattgggaacttttggatatcacgcacctgaatatgctatgactggtcagctgacacagaaaagcgatgtctacagctttggtgtagttcttttggaacttttgactggaaggaaaccagtagatcacacaatgcctcgaggacaacaaagtttagtcacatgggctactccaaggttaagtgaagacaaggtgaagcaatgtgtggatcccaggttgaagggagaatatcctccaaagggagtcgctaagcttgctgcagtggcagctctatgcgttcaatacgaagcagagttcaggcccaacatgagcatagttgtgaaggcgctttcgcctctccttcaacaaagacctgcaccagccaccgcagagccagccccgcaacctgtgagctgaaaccagtcatatgtgatgggaccctcggcatgcattcaaccagcacattctatgagtcattgagagtattttggctatttgttctgtagcattctcagttgggtacagcatacatgaacttgcctctactgtttgtggacaacaacagttcgtggcttgatgttggcgccacacaatggtatatgcagtaggctcgaagttgtttttttaccttctctaccaataccaactgtttgtaggtttcagaattcgttgcttgaagaatgatgcagaatgatctggactttttacctttggcgtggcgttgctgccttgccttccatgctggttatcatgaacttcctcccaaatcacaattcacttttaatttgttgtaagccaaaattcttaaactgtgatcaagtttatgaaatatagatatggacgtctaaaacaccaaa

SEQ ID NO: 6551 - DNA, 1421 bp, Saccharum officinarum
cccagacttcagtttactggggacagcacgcaccgcagtccgcagcgtcttccccttctgctcatcctcctccgcctccgtcgcaggtgccggcgctaagcgaggatccctccctctgtccgtcccgacgggacctcgactggtttcgtccgtcgctgtggcgacaggtgacgggacggcgatatgaagtggttatgttgtaactgccacgttgacgacgaggaagatggccacgacaaggaacaggccaaagctcagagcaataagatagaccccaagcagaagtcttcaaaacctcctgttagtcaacctgagccagagttcttccctcctacaattgatgtccctgaattgtcgttggatgatttgaaacaaaagactgatgattttggatcgagtgctctgattggtgaaggttcttatggacgagtttatcatgccactttggatgatgggaggcaagcggcagttaaaaaacttgatgcatctgaaaacgagcctaatgatgagttcctgaaacaggtctcactggcatcaaagctaaaacatgaaaatcttgttgagatgttgggttactgtgtggatgggaattatcgtatactcgcatatgaatttgcaaccatgggttcgcttcatgatgttttacatggaagaaaaggcgttcaaggcgcgcagcctggacctgtacttgactggatgcaaagggtcaaaattgctattgaggctgcaaaaggtatagaatatctgcatgagaaggttcagccttcaatcatccatcgggacatcagatcaagcaatgtactgctgtttgaggatttcaggcaaaaattgcagacttcaatcttttgaccaagcccagatatggcagctcggctcaatcaactcgtgtattgggacttttggatatcacgcacctgaatatgctatgactggccagctgacacagaaaagcgatgtctacagttttggtgtagttcttttggaacttttgactggaaggaaaccagtagatcacacaatgcctcgaggacaacaaagtttagtcacatgggctactccaaggttaagtgaagacaaggtgaagcaatgtgtggatcccaggttgaagggagaatatcctccaaagggagtcgctaagcttgctgcagtggcagctctatgtgtgcaatacgaagcagagttcaggcccaacatgagcatagttgtgaaggcgctttcgcctctccttcaacaaagacctgcaccagccaccgcagagccagccccgcaacctgtgagcttgaaccagtcacatgtgatgggaccctccgcatatattcaatcagcacattctatgagtcattgagagtattttggatatttggtctgagcaatctcaggtggtacagcatacatgaacttgccctactgtttctgacaac

SEQ ID NO: 6552 - DNA, 1679 bp, Eutrema halophilum
ctctgtcgcttccttttgacgttttctttcttttcttagctgttttcttttccctctctctcttatcctattttctttctaattccaacatttctcgactacctcgtcctccttcgtctctgcctcattttgattcgtctctctggtttattgctcgtcgatcgtttgtttatcattttccatttttgtgcttgatggatcgtgattttcatcgtcgtggtcaagtggcgaatgatcgttcaccgagcagctactttgttcgattggataaaccgagatctgtagacgatcttgatataggcaagagagggaagatgcgtaggtggctttgctgttcttgtcatgtaaaagaatcttacccttcatctgaacataaccgattgaaaagccctcctactcgccaccacgactatggacgtaacaataagaaaccaccagctcctgtgaagccttcagtcttaaaggagcctcctcctattgatgtgcctgcaatgtcattggatgagctcagagaaaagactgataattttggatcaaaggccttaattggggaaggatcatatggaagagtgtactatgcaaacttgaatgatggaaaggccgtggctgtgaaaaagctcgataactcatctgagcccgagacaaatgtcgagttcttgactcaggtctccaaggtctcaaggctgaagaatgacaactttgttcagcttcttggttattgtgtccaaggaaatctccgcgtccttgcgtatgagtttgccacaatgggatccttgcacgacattttacacgggagaaagggagtccaaggagcacagccaggtccaacacttgagtggatgcaacgagttcgagttgcagttgatgcagctaaaggattggaatacttacacgagaaagttcaacctccagttatacatagagatattcgatctagcaatgtgcttcttttcgaagatttcgaagccaagatcgccgatttcaatctgtctaatcaagctcctgatatggctgctcgtcttcattccactagagttttggggacttttggttatcacgcaccagaatacgcaatgacaggacagctgacccaaaagagtgatgtttacagttttggagttgtgcttttggagcttctaaccgggagaaaaccggttgatcatacgatgcctcgtggtcaacaaagtcttgtcacttgggctactccaaggctaagtgaagacaaggtgaagcaatgtgttgatccaaaactcaaaggagagtaccctcccaaagcagttgcaaagcttgcagcggttgcagcgttgtgcgtgcaatacgaagcagagtttaggccaaacatgagcattgtcgtaaaagctcttcaaccgctcttgaggtcttcaggaacagcttctgctcatccaacccctcagatatgattttcttctttgtggttcttgcatattaaattaattcatggcttcaaaggttttattttttcctatttctatttacaaatggaatgtaaatgggttatcaaggaagagatggtgagtaggaattggctttgagtagatgaagataaattgagttgatgggtaatcttctaaaatttcttcgttcttttaccataaccgctgattgagggaatgtacacagacttataacaaacctgttctgattcatgactttataca

SEQ ID NO: 6553 - DNA, 1915 bp, Aristolochia fimbriata
cagaaattgtcgaaatgacgaccaacggaagccctccttgctggaaatttcctccacaaaccgtcgacttcttttaagcgagggctctccgttggcaatcccgcatcgcatcaaacgctgccatcatttttctcttccttccttccttccttccttccaccaccggcctccctctcggtgcttttcccccaaagatttttctctaaacaacagtctttctttcttcctccggcaacgaaacaacgccgcgaatcacaggacgacgaagaatttaaggaactgataagaggataattggtgcacgggcggaaaccgggcgcataaacgttcgcctagtttctccgcacgtctggaaaatatcttaaacaggtgtagaggagaaacaaataaggaaagcaagatgaagcgctggttgtgttgtacatgccaagccgatgaaagttaccatccgcaggacaatgaattccagaagaacctgaaggaatatccagatggaaaccagaaaggtccaaagatgccggccccgacaaaaagtgagccacccagagctcctcctgaaattgatgtacctgctcttcctttagatgaaataaaagaaaaaactgataactttggctccaaggcactaattggtgaaggatcttatggaagagtgtattatgcaacattatatgatggaagagctgtggcaattaaaaagctagatgtttcatctgagcctgaatccaatggcgactttttaactcaggttgctgtcgtctcaaaattgaggcatgataatcttgtcgagttgcttggttactgtgtggaaggaaaccttcgtgtgttagcgtatgaatttgcaacaatgggttcactgcatgatattttgcatggtaggaaaggagtgcaaggtgcacaaccaggcccaacacttgactggatgcagagagtcaaaattgctgttgatgctgcgagaggcctcgagtatttacatgagaaggttcaaccgtccattatacatcgtgatatcagatcgagcaacgtacttctgtttgaggacttcaaagcgaaaattgcagattttaacctttcaaatcaggctcctgacatggctgctcgtttacattctacccgtgttttgggaacctttgggtatcatgctcctgagtatgccatgactggacagttgacacagaaaagtgatgtatatagcttcggtgtagtactgctggagcttcttactggtagaaaacctgttgatcataccatgccccgggggcaacaaagtcttgtcacttgggcaacccctagactaagtgaagacaaggtcaaacaatgtgtagatccaaagcttaagggtgactatccaccaaaaggagttgctaagttggcagctgtggcagcattatgtgttcaatatgaagctgagttccggccaaacatgagcatagttgtgaaagccctgcaaccacttctccatcttaaagctgcacctcctgttgctccggttactgatatttaagacatcggttttctctccattatttctctgatgttagacaagtcacatcttttgcagtgattcggttgtgttgtgttggcggcagagtagttggttggtctttattctttttattgtttaaaaaaaaaaaattctgacatgggatttggttgagacttgagagtgtttcccaacttggggttgctcttcaatgctttctttatgtggcgctttgttgctatggtggcattattactaattttttcttttttaatttaaaaaacgagaatggtgaaaactttgcctgcttgcagcattggtgccgtgtagcttgaattgtccatatattctgatgatggcttcttcctcattgagaacatgattttggccgaagaaacactggctctttaatatcttggtcttatttgttct

SEQ ID NO: 6554 - DNA, 1691 bp, Cedrus atlantica
taaaatcacattgctgttacgacaaattttctggatctgtactgtgctcgaattttctggaactgtgctgtgctagtctcgggatcgaaccccatcgggtgcattttgggcattttcttggtcatataccctgagaatctttttttaagaagagcatgtgagtagtcaaccagtacagaatgtgtcgtttgctttgctgttccggtgcagaagaagaaagctttgtcccaagtgataaccaatatcaaaatccagctgctcataattcatatggaggccaaggagattcgaagcctcaagcagtgaataatggtgctccacagaaagttttacctattgaagcacctagtttgtcacttgaagagttaaaggaagcaacggataattttgggcccaaatctttgattggtgaaggatcatatggaagggtttattatgcaactttaagcaatggccgggctgcagcaattaaaaaattggatgtcagcagccaacaagaggccgattctgattttctggcacaggtgtcaatggtttccaggctgaaacatgagcatgttgttgagttggtgggctattacgtcgatgggaatcaacgcattttggcttatgagtttgcaactatgggttccttgcatgacattttgcatggaaggaaaggagtgcagggtgctcaaccaggcccagttcttgactggatgcaaagggtgaaaattgctgtgggtgcagcaaagggtctcgagtatcttcatgagaaagctcaacctcatatcatccaccgtgatattagatctagcaatgttcttctttttgatgactttgcagccaaaattgctgattttaatctttcaaatcaagctcctgacatggctgcacgacttcattccactcgtgttctgggaacttttggctaccatgctcctgaatatgccatgacaggtcagttgactcagaagagtgatgtatatagctttggggtggtcctccttgagcttttgacaggaagaaagcccgtggaccatacaatgcctaggggacaacaaagtcttgttacttgggcaactccaagattgagtgaagacaaagtaaagcagtgtgttgatccaaagttgaagactgaatatcctccaaaggctgttgcaaagatggcagctgttgcggcattgtgtgtgcagtatgaagctgattttcgtcccaatatgagtattgttgtcaaagcacttcagccattgctcaatcctaaaccagctccctctgcagctgaagctcaactatgatgcttcgattgacatggtcttttctgtagtttccaaattttgtgtctggattgttctatcgttgaaatgtagattattcgataatggaacttgcttatgcagttcttagatcccaattctggtcagtggtagaggttgcatactttgtatgaagattggtattaatacttaggatttatttgaatgatcaaattctttcgttctttattgatggtgtcctgatatttgttgatgcaacatatcatatatttgtaatccttgctacgactcttaaatatcacttgtggccctgtttattctttaagacttcatggataaggagtttttatccaagtctgaacacaggaaaccagagggattataacatttacctgtgctttatatcgaatgtatattttaggtgattcaatctat

SEQ ID NO: 6555 - DNA, 1529 bp, Pteridium aquilinum
ggcctgcttcaaacagttattcctgcttcgcccatcgagctctgcaagtgcgaaaatattggtagaatgatgatggagaagctgcttgagtgagctgtccagttatgggaaactgctgcactaagcagattgccagcgtcaaaccttcgatcgtttcgagtaatccagcaataaatggtagaacaggtaatacagctgcccacagggttgacgcggtggttagcagcactgccacaattaccacaaaacccatagaggttccttgtctttcaatggatgacttgaaggaagcaacagaaaattttggagcgaaagctttgattggagagggctcatatggccgtgtgtactatgcaattcttaatggacgggctgcggcaatcaagaggttggacatcaacaatcagcaagaatcaaatgaggaatttctgccacaggtgtccatggtttcaagaataaaacatgaaaatgtggttgaactcgttggttactgtcttgatggagatttacgaattttggcttatgagtttgcgacaatgggctccctacatgatattcttcatggtcgaaaaggtgttcaaggtgctcaaccagggccagttcttgattggatgcaacgggtaaagatagcagtgggtgcagccagagggttggaataccttcatgagaaggtgcaaccaccggtcattcatcgcgacgttcggtcaagcaacgttcttctttttgacgacttcattgcaaaggttgcagattttaatctttcaaaccaggccccagatatggccgctcgcttgcactctactcgagtgttgggcacctttggttatcatgctccggagtatgcgatgactggacagctcacgcagaaaagtgatgtgtatagttttggggttgtactgttagagttgcttactggaagaaaacctgtggaccacaccatgcctcgaggccaacagagtctggtcacatgggcgactcctcgacttagcgaagacaaagtaaaacaatgtgtggacccaaagataaagtcagagtaccctccaaagggagttgctaagatggcagcagtcgcggccctgtgtgtgcagtatgaggctgagttccgtcccaacatgagtatcgtggtgaaggcattacaacctttgctgaacctgagaccaaatccaacacctgtcgggcaagttgatcttccgacgtgaggttggagtgcagtgtcttcaatggaacttaataaaatttgtatgctagtgtatcaaaattaaaggggaggttgtattattgtcgtatagattcaagggacctgcatatgattgcaagttgtggagaatgagcattgatagttgcatgagcttttgcaacgtgtgagtctctgattttttggggcttgaagagagtcaagttagccggatttgtgtgtattgcctaggtgttgtaacaatacgttcttgtacactaagttcatgtcatgaaatgtacatgttttgtatgctttatttagttgggtcaagaattttgagtacctttgaaaa

SEQ ID NO: 6556 - DNA, 1346 bp, Brassica napus
tttttcttgttcgtcgtctccatcaagcaagcctctctctctctccttctctggaggagacgatcatcgtacgcaaggaatcctagagagggattgagagggacagcgagttttgttggtgacgcacggaggttagacacaggagccaaagaaaaaagaggttgtggaaaggatgaggatgtgcaagtggatgtgctgtacttgtcaaattcaagactctcatgaagaggaacatttgaaatcttctcaccagcatcatcatcattctgatgcggcaaatcacaagaatcctaaaccaccagctcttgcaaagcctgaggtgcgcaaggaacctcttcccatcgaggttcctgccttgtccttggatgaggtcaagcaaaagactgataatttcggatccaagtccctcattggtgaaggctcttacggaagagtgtactacggcacactgaatgatggcattgctgttgctctcaagaaacttgatgccgcacctgaagccgaatcagacgccgagttcttgagtcaggtctccatggtttctagactgaagcatgagaatctcgttcaattgcttggtttttgtgttgatggaaagctccgcgtccttgcttatgagtttgcaactatgggatcgttgcatgacgtcttgcatggtaggaagggagtgcaaggagcacagccaggtccaacacttgactggacaacgagggttaaaatagcagttgaggcagctaggggtttggaataccttcatgagaagtctcagcctcctgtgatccacagagacataagatctagcaatattcttctttttgatgactacaaaccaaagattgctgatttcaatctctcaaaccaatcgcctgataacgctgctcgtcttcactctacaagagtcttgggaacttttggttatcatgctcctgaatacgcaatgactggacaattaactcagaagagtgatgtgtacagctttggggttgtacttctagaacttcttacagggaggaaaccagttgataataacatgcctcgtggtcaacagagtcttgtcacctgggcgacaccaagactcagtgaagataaagttaaagagtgcattgatccaaagctaaatgcggattaccctccaaaagcagttgctaagctagcagcggtggcagcattgtgtgtgcaatacgaagctgagtttagaccaaatatgagcatagttgtgaaggcgctacagcctcttctcaaacctcctccacctgcagcagctccatcttcttgaatcttttcttttcattttgcaaactatcagcatctgtaatcactactgcccttgccaatatatgaatgga

SEQ ID NO: 6557 - DNA, 834 bp, Brassica napus
gatcaagtcactgattggcgtaggagtctacgaacggtgtattacggtaacgctaacgatcggtaaagcagtagctttgagaacttgacgttggacctgaagctgaacaacgctgagttcttgagtcaggttctatggtttcgagactgaagcatgataacctcatccaactagtcggttactgcgtcgacgaggacctccgtgttcttgcttacgagttcgcaacgatgggatcacttcacgacgttctacacggtaggaaaggagtgcaaggcgcgcagccaggtccgacgctagactggataacgagggtgaagatagccgtggaggcggctaggggattagagtaccttcacgagaaggttcagcctcctgtgatacacagagacgtgagatctagcaacgtgcttctctttgaagactatcaagcgaaaatcgctgattttaatctctcgaatcaggctcctgataatgctgctcgtcttcactctactagagtgttgggaacctttggctatcacgctccagaatatgccatgactggacagttgacgcagaagagtgacgtgtatagctttggggttgtgctgcttgagcttttgacagggaggaagcctgtggatcacacgatgccacgtggccagcagagtcttgtaacatgggctacaccgagacttagtgaagacaaagtgaagcagtgtgttgatccaaagctaaaaggagagtatcctcctaaatcagttgctaagctagcagcggtggcagcgttgtgtgtgcaatacgaatctgagtttagaccgaatatgagtatagttgtgaaagctttgcagccac

SEQ ID NO: 6558 - DNA, 1538 bp, Catharanthus roseus
gctttgccgttcaattcccaatttacaaatacaagagagagaagagagaatttgcaggaaatttcaggcacatgcacctcctcccagttactttgtacgcctggaccatacaagtgctgaagacgatcattatttgagaaagagagcaaggatgcgtaggtggctgtgctgttcctgtcaagttgaggagtcttacccatcgaatgagaatgaaccttttagaagcccaaagaatcatatggatgggcaccagaaagggtcaaaggtatcagctcctgttatgtctgaagcacagaaggcagttccacctattgaggtgccacctttgtctctggatgaattgaaagaaaaaactgacaattttggatcaaaggctttaattggtgaaggatcttatggaagagtatactatgcaaacctggagaatggaaaagcagtggctgtaaaaaagcttgacgtgtcatctgaaccggaatcaaatgttgagttcttgactcaggtttccgtggtttcaagattgaagcatgaaaatcttgttgaattactcgggtactgtgtagaaggaaacattcgcgtattagcttatgagtttgcaaccatgggatctctgcatgacatattgcatggcaggaagggagtgcaaggtgctcagcctggtcctgtacttgactggataacacgggtaagaattgcagttgatgctgctaggggactcgaatatttgcatgagaaggttcaacctcctataatacacagagatatcagatccagcaatgtgctagtttttgaagactataaagcaaagattgcagatttcaacctttcaaatcaggctcctgacatggctgctcgtcttcattcaaccagagttctgggaacatttggttatcatgcaccagaatacgcaatgacggggcaactgacacagaagagtgatgtgtatagctttggcgtggttctacttgagctattgactggcaggaaacctgttgatcacaacatgcctcgtgggcagcaatctcttgttacttgggctactccaagactgagtgaggacaaagttaaacaatgtatagacccaaaactgaaggattaccctgctaaaggagttgctaagctcgcagctgtggccgcactctgcgtacagtatgaggctgaattcaggccaaatatgagcattgttgtcaaggctctccagcctcttctgaagtctcaagtccctcctcctgagagttagcactaagatgttttcgagttgctgttggattggaattttctgcgacattttcaatagtggagtacgtttgttcagaaatttaattggccttccggaatggataggatttccccccaatttgcaatctatttataggctttagttcccttcttgtaatgatttgtatttgctgatacttctgtgtggtactgaggctcttggatcatcaattgacggccaaactattgtggagtgaaaatttgttgaaaggactatatgctcgagtatattggatgaattgacatatatgcttgacttggat

SEQ ID NO: 6559 - DNA, 1881 bp, Pinus pinaster
aattcggcacgaggcttgtcgcggattccaaatgaagcgttaaaccgaattgaattttgacaattcattcataatactcctaaaacagctgcttgtaccggcgaaatctactcactctgtacacgtttacccgctcaggcccgtacgttaaattcacgtttgctttccttccaattttccggatctgcaccgggctggattttctggatctgtgctcggctggtctcggactcgaattccctctggtgcattctcgggtttttcttgatcatataagctgagaatcttttcataagatgagcatgtgagcagtcagccaatacacaatgtgtcgtttgctttgctgtgctggtgcagaagaagaaagctttgtcccacctgataaccattatcaaaaccaaggggctcataatgcatatggaaaccaaggagaatccaagcctcaaccagtgaataatggtgctccacagaaggttttacctattgaagcacctagtttgtcacttgaagaattaaaggaagcaacagataattttgggcccaaatctttgattggagaaggatcatatggaagggtttattatgcgactttaagtaatggcaaggctgcagcaattaagaaattggatactagcagccagcaagagtctgattctgattttctggcgcaggtatcaatggtttccaggctgaaacatgagcatgttgttgaattggtgggctattatgttgatgcaaatcaacgcattttagcttatgagtttgcaactatgggttccttacatgacattttacatggaaggaaaggagtgcagggtgctcaaccaggcccagttcttgactggatacaaagggtgaaaattgctgtgggtgcagcgaaagggcttgagtatcttcatgagaaagctcaacctcatatcatccaccgcgatattagatctagcaatgttcttctttttgacgactttgcagccaaaattgctgattttaatctttcaaatcaagctcctgacatggctgcccgacttcattccactcgtgttctgggaacttttggctatcacgctcctgaatatgccatgacaggtcagttgactcagaagagtgatgtatatagctttggggtggttctccttgaacttttgacaggaaggaagcctgtggaccatacaatgcctaggggacaacaaagccttgttacttgggcaactccaagattgagtgaagacaaagtaaagcagtgtgttgatcccaagttgaagagtgaatatcctccaaaggctgttgcaaagatggctgctgttgcggcattgtgtgtgcagtatgaagcagattttcgtcctaacatgagtattgttgtcaaagcacttcagccattgctcaatccaaaaccgactccctctgcatctgaagctcaattatgaagatttcatgacatggtcttttctgtagtttccaaattttgtgtctgtgttctgtagttgaaatgtagattactagataatggaacttgcttatgcagatcttatattccaattctgctcagtcgtggtggaggttgcatacttcgtatgaagattggtatttggattctggatttatttgaagttgaacaatcaaattctttagttcgttattgatggtcgcgtcatatttgttgaagcaacgtagcatatattgtaatccttgctatgactcttaaatatcacttgtggccctgtttattctttaagacttcatgtaggaggagtttttattcaagtctgatctactatgacttttgaccacttcaggaacatggatattgcatttaagaagcagttttcttgcctctccctgcaccctgccccccctccaacctttagcaattgtacaagatcg

SEQ ID NO: 6560 - DNA, 1466 bp, Tabernaemontana elegans
actctctttatccctttttcccgacttcccccaacatatccaccccaccaaaaacccttcccactttctgttcaaattctaatttacaaaaacaagagagagaaatacaagaaattccaggcacatgcacctcctcccggttactttgtacggctggaccataaaagtgctgaagacgatctttatttgagaaagagagctaggatgcgaaggtggctgtgctgtacctgtcaagtggaggagtcttacccatcaaatgagaatgaaccttttagaagcccaaagaatcatgctgatgggcaccaaagagggtcaaaggtatcagctcctgttatgtccgaagttcagaaggcaataccacctattgaggtgccagctttatctctggatgaattgaaagacaaaactgacaattttggttcgaaggctttaattggtgaaggatcttatggaagagtatactatgcaaacctggagaatggaaaagcagtggctgtaaaaaagcttgatgtgtcatctgaaccagaatcaaacgttgagttcttgactcaggtttccatggtttcaagattgaagcatgaaaatcttgttgagttacttggttactgtgtagaaggaaatcttcgtgtattggcttatgagtttgcaaccatgggatctctgcacgacatattgcatggcaggaagggggtacaaggtgctcagcctggtcctgttcttgattggataacacgggtgagaattgcagttgatgctgctaggggacttgaatatctgcatgagaaggttcaacctcctataatacaccgagatatcagatccagcaatgtgcttgtttttgaagactacaaggcaaagattgcagatttcaacctttcaaatcaggctcctgacatggcggctcgccttcattcaactagagttctgggaacatttggttatcatgcaccagaatatgcaatgacgggacagctgacacagaagagtgatgtgtatagctttggcgtggttctacttgagctattgactggtaggaaacctgttgatcataacatgcctcgtgggcagcaatctctggttacttgggccactccacggctgagtgaggacaaagttaaacaatgtatagacccaaagctgaaggactaccctgctaaaggagttgctaagctggcagcagtggctgctctgtgcgtgcagtatgaggctgaattcaggccaaatatgagcattgttgtcaaggcactgcaacctctcttgaagtctcatgtccctcctccagagagttagtgttaaaatgtattgcgttgctggattggaattctctggcatgtttggatagttttgagtatttggtgcataaatttaattggcttctcggtaaggtatagtattttttgtcctttttttttttcgtttccaacctattttatgggtttccgtgctccccgtgtaatggattgcgt

SEQ ID NO: 6561 - DNA, 2471 bp, Vinca minor
tcaccgacgacgtacgatgaccttgaattccatcttcgtacgatccttccgctgttgatttcttgtacttcgacgaaattctctgcagaatttgcagagttttatttatatattttcgtttttaaaattggttgattgatcatggtttgaattagatctattgatttattgctttaaagtagtgatcttttagctttattttggtgaaatcatagacccgtctcgttttgtttactgttctcgttattatggtggaaaatattggtagttttgggtgtcagtacttttagttgcatttcgagtgaattgttaaagatttgaattggattttgtctcgaaattgaaaaaatgaattgtttgtgagagatgtggggtttgagcgaaaatttgtgttagagttttaaatgaaagtcacgttaatgagattttaattgcttttttttcaatgaatggttttgatcaggtgagtttgagtgcatttgcattcttgttttcagagcatgaatttcggttgatcgtctgtggctgttattgttagtttgaattgatattatgtgttcatctgtctctctttcttttctggcatcagacaggcatttatctccttttttgttttgtctttgtccctttgtctctctttctcggatctctcagcctattttaattttcatcagtctgctccaatggtaacaatcttctttttttctctttggggaacaatcttcttttgatttactaatatgtaatgtatctttgataattggattttctatgcttttttaattctcatgggattcctcatatcttcgttaccacaattctaaaacatgatgatcaatttaggtttcggtcaagaaattgtttgtactgtatgccaaagaaattgtttgtactgtatgccaattgggttttatttcatatcaccttttatgtttcctaaggttaagattcttttatctttttatgtatgcttctagtaggatcaatcatggctttatccaatttcttaagaaggtttttgtgattttctaacagatgggtatcatttgacaggcgcaggcacctcctcctcctcctcccagttactttgtacgcctcgaccatacaagggctgaagacgatcttcgtttgagaaagagagctaggatgcgtaggtggctttgctgcacctgtcaagttgacgagtcttcttacccatcaaatgagaatgaaccttttaggagcccaaagaatcatgctgatgggcatcaaagagggtcaaaggtatcagctcctgttacatctgaaacacagaaggcagtgccacctattgaggtgccagctttatctctggatgaattgaaagacaaaaccgacaattttggatcaaaggctttaattggtgaaggatcttatggaagagtatactatgcaaacctggagaatggaaaagcagtggccgttaaaaagcttgacgtgtcatctgaaccagaatcaaatcctgagttcttgactcaggtttccatggtctcaagattgaagcatgaaaatgttgtggagttactcgggtactgtgtagaaggaaaccttcgtgtgttagcatatgagtttgcaaccatgggatcgctacatgacatattgcatgggaggaagggggttcaaggtgctcagcctggtcctgtacttgactggataacacgggtaagaattgcagttgatgctgccagggggcttgaatatttgcatgagaaggttcaagctcctataatacacagagatattaggtccagcaatgtgcttgtttttgaagactataaagcaaagattgcggatttcaatctctcaaatcaggctcctgacatggctgctcgcctccattcaactagagttctaggaacatttggttatcacgcaccagaatatgcaatgacgggacagctgacacagaagagtgacgtgtatagctttggcgtggttctacttgagctattgactggtaggaaacctgttgatcacaatatgcctcgtgggcagcaatctcttgttacttgggccactccaagactgagcgaggacaaggttaaacagtgtatagacccaaagcttaaggactaccctgttaaaggagttgctaagctggcagcggtggctgctctgtgcgtacagtatgaggctgaattcaggccaaacatgagcattgttgtcaaggcactccagcctctcctgaagtcacaaacgcctcttcctgagagttagtgctgaaatgattcgaacttgctgggacatctccattagtttgagtaaatttgttcagaaatttaattggcctttggtccaatgatggattacttttccccatttgaaatatattcatagggtaatggattgaatttgctgatatttctgtgtactgccgttcctggatcatcaattaacgacaaccaaattgatttgcggagtgtagtcgaatatattggatgaattgtcgttgc

SEQ ID NO: 6562 - DNA, 1454 bp, Vinca minor
cctcctcccagttactttgtacgcctcgaccatacaagcgctgaagacaatcttcatttgagaaagagagctaggatgcgtaggtggctgtgctgtacttgtcaagttgaggaggcttacccatccaatgagaatgaacattttagaagcccaaagaatcatgctgatgggcaccaaagagggtcaaaggtatcagctcctgttatatctgaaacacagaaagcaataccacctattgaggtgccagctttgtctcttgatgaattgaaagataaaactgacaattttggatcaaaggctttaattggtgaaggatcttatggaagagtatactatgcaaacctggagaatggaaaagcggtggctgttaaaaagcttgacgtgtcatctgaaccagaatcaaacgcagagttcttgactcaggtttccatggtctcaagattgaagcatgaaaattttgttgagttactcgggtactgtgtagaaggaaaccttcgtgtgttagcatatgagtttgcaaccatgggatcgctacatgacatattgcatggcagggaagggggttcgaaggtgctcagcctggtccggtacttgactggataacacgggtaagaattgcagttgatgctgccagggggcttgaatatttgcatgagaaggttcaagctcctataatacacagagatattaggtccagcaatgtgcttgtttttgaagactataaagcaaagattgcggatttcaatctctcaaatcaggctcctgacatggctgctcgcctccattcaactagagttcttggaacatttggttatcacgcaccagaatatgcaatgacgggacagctgacacagaagagtgacgtgtatagctttggcgtggttctacttgagctattgactggtaggaaacctgttgatcacaatatgcctcgtgggcagcaatctcttgttacttgggccactccaagactgagcgaggacaaggttaaacagtgtatagacccaaagcttaaggactaccctgttaaaggagttgctaagctggcagcggtggctgctctgtgcgtacagtatgaggctgaattcaggccaaatatgagcattgttgtcaaggcactccagcctctcctgaagtcacagacgcctcttcctgagagttagttctgaaatgattcgaacttgctgggacatctccattagtttgagtaaatttgttcagaaatttaattggccgttggtccaatgatggattacttttccccatttgaaatatattcatagggtaatggattgaatttgctgatatttctgtgtactgccgttcctggatcatcaattaacgacaaccaaattgattttgcggagtgtagtcgaatatattggatgaattgtgttgcattttcaactttgatgtgacccttataagtcttgcccgtcttaaagtatgcgagt

SEQ ID NO: 6563 - DNA, 1683 bp, Hordeum vulgare
ggtggatgggtcggcgtgggccgcgctgttaggggcagccgtgtaattagcacacgctccgctcccacaccggtaacggacggcggcttttgcttaggcggggtggaagcgaagcgaggctgctgctctgcccaccgccctctccgctcgctccgtcccgttccccttggctctctctcaggcgaggctgccggagctagcgacctagcgcgcgcgtgctggtggtcgccgcggaggagggggctcgcggccgcggccggcgcgcagtggccaggagacagtatgaggaattggctttgttgcaagggccggcgtggcgaggacgacgacgaacatgagatggaacattctaaagctcagggcaataagatagacggcaagcaaaaatcttcgaaacctgctgaacctgagccagatatttcccctcctacaattaatgtcccagaactgtcatttgaggacttgaaagaaaagaccgacaattttggatcgagttctctgattggtgaaggttcatacggacgagtatatcatgctaccatggatgatggcaggcaagcggctattaagaaatttgatgcatctgaaaatgagcataacgatgaattcttgaaacaggtctcacttgtatcaaggctaaaacatgaaaatcttgtggagatgctgggctactatgtggagggcaactatcgtatattggcatatgaatttgcaacaatgggttctcttcacgatgttctgcatggaagaaaaggagttcaaggtgcgcagcctggccctgtgcttgactggatgcagagagtcaaaattgccatcgaggcggcaaagggaatagagtacctgcatgagaaggttcagccttcaatcatccatcgggacatcagatcaagcaatgtgcttctgtttgaggacttcaaggcgaaaatcgcagacttcaacctcttaaatcaagctcctgatatggcagcacgtctccattcgactcgtgtattagggacatttggatatcatgcgccagaatatgctatgactggccagctgacacagaagagtgacgtctacagctttggcgtggttcttcttgaacttctgactggaaggaaaccggtcgatcacacaatgcctcggggacaacaaagtctagtcacttgggctactccaagattgagtgaagataaggtcaagcaatgcgtagaccctaggttgaagggagaatatcctccaaagggagttgctaagcttggtgcggtggcagctctgtgcgtgcagtatgaagcagagttcaggcccaacatgagcatcgtcgtcaaggcactctctcctctgctacaacaaagagcagcagcaccagcagcctcggagctggcccaggcacccgaggtttaggaggcgttgggtcatgagagacaccccagcgcttactggcccaaaatggcagaccgggtgtgatatgcgagcggtttgtagatttgttttgcgggattcttcggtcggatatagaatactttttctgcgagtctgatgccaccctagggacttttctgctgtttgagatttgtgctgtacatctgtctgttataggtggttagtggttatctctttcctgcaagtgcatatcggaagtgtcgaaaactgaacttgagatttcgtttgggattagtagattataaatgcaacatccta

SEQ ID NO: 6564 - DNA, 736 bp, Catharanthus roseus
ggcacgaggtacacagagatatcagatccagcaatgtgctagtttttgaagactataaagcaaagattgcagatttcaacctttcaaatcaggctcctgacatggctgctcgtcttcattcaaccagagttctgggaacatttggttatcatgcaccagaatacgcaatgacggggcaactgacacagaagagtgatgtgtatagctttggcgtggttctacttgagctattgactggcaggaaacctgttgatcacaacatgcctcgtgggcagcaatctcttgttacttgggctactccaagactgagtgaggacaaagttaaacaatgtatagacccaaaactgaaggattaccctgctaaaggagttgctaagctcgcagctgtggccgcactctgcgtacagtatgaggctgaattcaggccaaatatgagcattgttgtcaaggctctccagcctcttctgaagtctcaagtccctcctcctgagagttagcactaagatgttttcgagttgctgttggattggaattttctgcgacattttcaatagtggagtacgtttgttcagaaatttaattggccttccggaatggataggatttccccccaatttgcaatctatttataggctttagttcccttcttgtaatgatttgtatttgctgatacttctgtgtggtactgaggctcttggatcatcaattgacggccaaactattgtggagtgaaaat

SEQ ID NO: 6565 - DNA, 671 bp, Eucalyptus grandis
  misc_feature (321)..(321): n is a, c, g, or t
  misc_feature (658)..(658): n is a, c, g, or t
cggccgggatccacagggatattaggtctagcaatgtgcttctttttgaagacttcaaagccagaattgcagattttaatctgtcaaatcaggcacctgacatggctgcccgccttcattctaccagagttttgggaacctttggctatcatgctccagagtatgcgatgactggacaattgacacagaaaagtgatgtgtatagctttggagttgttcttctagagcttttaactgggagaaaacctgttgatcataccatgccgcggggacagcagagtcttgttacctgggcaactccaagattgagcgaagacaagnttaagcaatgcgtagatccaaggcttaatggagactatcctccaaagggagttgccaagttggcggctgttgctgccttgtgtgtgcaatatgaagcagagtttcggcccaacatgagcatcgttgtcaaggctatgcagcctctgctgaaagctgcagcgccagcatctgctccagtgacttgattgaaaacgaattcgaagtccttccgcctcgcagtatcatcttatgcatagtttgctccatattctctggtgcatacgatgatgatattttcttttttcctttttcagagtagagatgatgggtatacattatttgatgagttgtgttctcngacgggagattgt

SEQ ID NO: 6566 - DNA, 1958 bp, Pinus taeda
aattcggcacgaggcttgtcgcggattccaaatgaagtgttaaactgaattgaaatttgacaattcattcataatactcctaaaacagctgcttgtaccggcgaaatctactgactctgtacacgtttaccgctcaggcccgtacgttaaattcagatttgctttacttccaattttccggatctgcaccgggctggattttctggatctgtgctcgggtggtctcgggctcgaattccctctggtgcattctcgggtttttcttgatcatatactctgagaaccttttcataagatgagcatgtgagcagtcagccaatacacaatgtgtcgtttgctttgctgcgctggtacagaagaagaaagctttgtcccacctgataaccattatcaaaatcaaggggctcataatgcatatggaaaccaaggagaatccaagcctcaaccagtgaataatggtgctccacagaaggttttacctattgaagcacctagtttgtcacttgaagagttaaaggaagcaacagataattttgggcccaaatctttgattggagaaggatcatatggaagggtttattatgcgactttaagcaatgggaaggctgcagcaattaagaaattggatactagcagccagcaagagtctgattctgattttctggcgcaggtatcaatggtttccaggttgaaacatgagcatgttgttgaattggtgggctattacgttgatgcaagtcaacgcattttagcttatgagtttgcaactatgggttccttacatgacattttacatggaaggaaaggagtgcagggtgctcaaccaggcccagttcttgactggatacaaagggtgaaaattgctgtgggtgcagcgaaagggcttgagtatcttcatgagaaagctcaacctcatatcatccaccgtgatattagatctagcaatgttcttctttttgacgactttgcagccaaaattgctgattttaatctttcaaatcaagctcctgacatggctgcccgacttcattccactcgtgttctgggaacttttggctatcacgctcctgaatatgccatgacaggtcagttgactcagaagagtgatgtatatagctttggggtggttctccttgaacttttgacaggaaggaagcctgtggaccatacaatgcctaggggacaacaaagccttgttacttgggcaactccaagattgagtgaagacaaagtaaagcagtgtgttgatcccaagttgaagagtgaatatcctccaaaggctgttgcaaagatggctgctgttgcggcattgtgtgtgcagtatgaagcagattttcgtcctaacatgagtattgttgtcaaagcacttcagccattgcttaatccaaaaccgactccctctgcatctgaagcccaattatgaagatttcatgacatggtcttttctgtagtttccaaattttgtgtctgtgttctgtcgttgaaatgtagattattagataatggaacttgcttatgcagatcttatattccaattctgctcagtcgtggtggaggttgcatacttcgtttgaagattggtatttgtattctggatttatttgaacaatcaaattctttagttcgttattgatggtggcgtcatatttgttgaagcaacgtagcatatatttgtaatccttgctatgactcttaaatatcacttgtggccctgtttattctttaagacttcatgtagaaggagtttttattcaagtctgatctactatgtcttttggccacttcaggaacatggatattgcatttaagaagcagttttcttgcctctccctgcaccctcccttccttccaacctttagcaattgtacaagatcgaaacacaggaaatgagatggttcataacatttacctgtgctttatatcacatgtgatatttcagataattcaatctatattta

SEQ ID NO: 6567 - DNA, 1081 bp, Pseudoroegneria spicata
  misc_feature (757)..(757): n is a, c, g, or t
  misc_feature (767)..(767): n is a, c, g, or t
  misc_feature (879)..(879): n is a, c, g, or t
  misc_feature (1008)..(1008): n is a, c, g, or t
  misc_feature (1058)..(1058): n is a, c, g, or t
cttgtatcaaggctaaaacatgaaaatcttgtggagatgctgggctactatgtggagggcaactatcgtatactggcatatgaatttgcaacaatgggttctcttcacgatgttctgcatggaagaaagggagttcaaggtgcgcagcctggccctgtgcttgactggatgcagagagtcaaaattgccatcgaggcggcaaaaggtatcgagtacctacatgagaaggttcagccttcaatcatccatcgggacatcagatcaagcaatgtgcttctgtttgaggacttcaaggcgaaaattgcagacttcaacctcttaaatcaagctcctgatatggcagcacgtcttcattcgactcgtgtattagggacatttggatatcatgcgccagaatatgctatgactggccagctgacacagaagagtgacgtctacagctttggcgtggttcttcttgaacttctgactggaaggaaaccggtcgatcacacaatgcctcgggggcaacaaagtttagtcacttgggctactccaagattgagtgaagataaggtcaagcaatgcgtagatcctcggttgaagggagaatatcctccaaagggagttgctaagcttggtgcggtggcagctctgtgcgtgcagtatgaagcagagttcaggcccaacatgagcatcgtcgtcaaggcactctctcctctgctacaacaaagagcagcagcgccggcagcctcggagctggccccggcacccgggncttaggaggngttggatcatgagacttcccagcgcctactagcccgaaatggcacacctggtgtgatttgcgagcggtttgtagatttgttttgcgggattcttcggtcggatacagaatantttctctgccagtctgttgccaccctagggattttctgctgtttgagatttgtgatgtacatttgtctgttataggcgaatagtggttatctgttctctttttactggaagtgcatatccgaaagtgtngaaaaccgaacttgagacgtggtttggaattagtagattaaatgcaatangctctgaacttttatacctggta

SEQ ID NO: 6568 - DNA, 1701 bp, Pseudotsuga menziesii
actgtgctggtctcaggatcgaatcccatccgggagggggattggagagtgccttgggtcgcctgtacaaattttttatgtggccagtgcagacctcccaagcaagtcagaacgcatgtgcatgatatatatgggttgcaacttgcgtttgatcccagaactttgctagctcaaaaccaactctggaggtgcatttttggtcattttcttgtcatatgctctgagaattttttcataagactagcatgtgagtggtcagccattacacaatgtgtcgtttgctatgctgttctggtacagaagaagaaagctttgtcccacctgataaccattatcaaaatcaagcagctcataattcatatggaggccaaggagaatccaagcctcaaccagtgaataatggtgctccacagaaagttttacctattgaagcacctagtttgtcatttgacgagttaaaggaagcaacagataattttgggcccaaatctttgattggggaaggatcatatggaagggtttattatgcaactttaagcaatggccgagctgcagcaattaagaaattggatgtcagcagtcagcaagagtctgattctgattttctggcacaggtgtcaatggtttccaggctgaaacaggagcatgttgttgaattggtgggatattgtgtcgatgcaaatcaacgcattttggcttatgagttcgcaacaatgggttccttacatgacattttgcatggaaggaaaggagtgcagggtgctcaaccaggcccggttcttgactggatgcaaagggtgaaaattgctgtgggtgcagcgaagggtcttgagtatcttcatgagaaagctcaacctcatatcatccaccgtgatattagatctagcaatgttcttctttttgatgactttgcagccaaaattgctgattttaatctttcaaatcaagctcctgacatggctgctcggcttcattccactcgtgttctgggaacatttggctatcacgctcctgaatatgccatgacaggtcagttgactcagaagagtgatgtatatagctttggggtggttctccttgagcttttgacaggaagaaagcctgtggaccatacaatgcctagaggacaacaaagccttgttacttgggcaactccaagattgagtgaagacaaagtaaagcaatgtgttgatccaaagttgaagagtgaatatcctccaaaggctgttgcaaagatggctgctgttgcggcattgtgtgtgcagtatgaagcagattttcgtcccaacatgagtattgttgtcaaagcgcttcagccattgctcaatccaaaaccaactccctctgcatctgaagctcaactatgatgcttctatgacatgttcttttctgtagtttccaaattttgtgtctggattgttctgtagttgaaatgtagattattagataatggaacttgcttttgcagttcttatattacaactctggtcattggtggaagttgcatactttgtatgaagattggtatttgtactttggatttatatcaacgatcaaattctttcgttcgttattgatggtgttgtgatatttgttgatgcaacatatcatatatttgtaatccttgatatgactcttaaatatcacttgtgtctctgtttattctttaagacttcatttatgaggagtttttgaccaagt

SEQ ID NO: 6569 - DNA, 1872 bp, Picea glauca
  misc_feature (36)..(36): n is a, c, g, or t
atggccggccatacaaggcaaatttaataacacccntatatggaaatcctgcaaatcctcgtactggcttgacgcggattccaaatggagtgttaaaactgaattgaaaattgaaattagacaattcattcataatcctccgaaaacagttgcctgtacctgcgaaatccactcactttatacaagtttagccctccactccgtacgttaaattcacattgcctttactgcaaattttctggatctgtaacgggctggattttctggatctgtgctggggggtctcgggatcgaattccctctggtgcatttccgggcattttcttgatcatatgctttgagaatcttttcataagctgagcatgtgagtagccagccaatacacaatgtgtcgtttgctttgctgttctggtgcagaagaagaaagctttgtcccacctgataaccattatcaaagtcaagcggctcataatccatatggaagccaaggagaatccaagcctcaaccagtgaataatggtgctccacggaaagttttacctattgaagcacctagtttgtcacttgaagagttaaaggaagcaacagataattttgggcccaaatctttgattggagaaggatcatatggaagggtttattatgcaactttaagtaatggccaggctgcagcaattaagaaattggatgtcagcagccagcaagagtccgattctgaatttctggggcaggtgtcaatggtttccaggcttaaacatgagcatgtcgttgaattggtgggctatttcgttgatgcgaatcaacgcattttggcttatgagtttgcaactatgggttccttacatgacattctgcatggaaggaaaggagtgcagggtgctcaaccaggcccggttcttgactggattcaaagggtgaaaattgctgtgggtgcagcgaagggtcttgagtatcttcatgagaaagctcaacctcatatcatccaccgtgatatcagatctagcaatgttcttctttttgatgactttgcagccaaaattgctgattttaatctttcaaatcaagctcctgacatggctgcccgacttcattccactcgtgttctgggaacttttggctatcatgctcctgaatatgccatgacgggtcagttgactcagaagagtgatgtatatagctttggggtggttctccttgagcttttgacaggaagaaagccggtagaccatacaatgcctaggggacaacaaagccttgttacttgggcaactccaagattgagtgaagacaaagtaaagcagtgtgttgatccaaagttgaagagtgaatatcctccaaaggctgttgcaaagatggctgctgttgcggcgttgtgtgtgcagtatgaagcagattttcgtcccaacatgagtattgttgtcaaagcacttcagccattgctcaatccaaaaccaactccctctgcatctgaagctcaactatgatgctaccatgacgtggtcttttctgtagtttccaaattttgtttcttgattgttctgtagttgaaatgtagattattagataattgaacttgcttatgcagctcttatattccaattctggtcagtaggtggaggttgcatactttgtatgaagattggtatttgtactctggatttattttaacgatcaaattcttttgttcgttattgatggtgttgtgatatttattgatgcaacatatcatatatttgtaatccttgctatgactctgaaatatcacttgtggccctgtttattctttaagacttcatgtataaggagtttttatccaagtctgatctactatggcttttgggcacatcatgaatatggatattgcatttaaga

SEQ ID NO: 6570 - DNA, 1575 bp, Triticum aestivum
gcgaggctgctgctctgctctgccctgcccaccgccctctctgctctctccgtcccgttcccctccatccccttggatttcaggcgaggcggccggagcgagctagcgcgcgggcggtagtgcggcgtgctgctgctgctgctgctggtcgccgcggccggcgcgcagtggccaggagacagtatgaggcattggctttgttgcaatatccggagcggtgacgacgacgacagacatgaggtggaacattccaaagctcaggggaataagatagacggcaagcaaaaatcttcgaaacctgctgatcaacctgagccagatatttcccctcctacaattgatgtcccagaactgtcatttgaggacttgaaagaaaagactgacaattttggatcgagttctctgattggtgaaggttcatacggacgagtatatcatgctaccatggatgatggcaggcaagcggctattaagaaatttgatgcatctgaaaatgagcctaacgatgaatttttgaaacaggtctcacttgtatcaaggctaaaacatgaaaatcttgtggagatgctgggctactatgtggagggcaactatcgtatactggcatatgaatttgcaacaatgggttctcttcacgatgttctgcatggaagaaaaggagttcaaggtgcgcaacctggccccgtgcttgactggatgcagagagtcaaaattgctatcgaggcggcaaaaggtatagagtacctacatgagaaggttcagccttcaatcatccatcgggacatcagatcaagcaatgtgcttctgtttgaggacttcaaggcgaaaattgcagacttcaacctcttaaatcaagctcctgatatggcagcacgtctccattcgactcgtgtattagggacatttggatatcatgcgccagaatatgctatgactggccagctgacacagaagagtgacgtctacagctttggcgtggttcttcttgaacttctgactggaaggaaaccggtcgatcacacaatgcctcgggggcagcaaagtttagtcacttgggctactccaagattgagtgaagataaggtgaagcaatgcgtagatcctcggttgaagggagaatatcctccaaagggagttgctaagctgggtgcggtggcagctctgtgcgtgcagtatgaagcagagttcaggcccaacatgagcatcgtcgtcaaggcgctctctcctctgctacaacaaagagcagcagccccggcagcctcggagctggccccggcacccggggcttaggaggtgctggatcatgagacttcccagcgcttactagcccgaaatggctggcacaccgggtgtgatttgcgagcggtttgtagatttgttttgcgggattcttcggtcggatacagaatattttctctgccagtctgttgccaccctagggattttctgctgtttgagatttgtgctgtacatttgtctgttataggtggttagtggttatctgttgtctttttcattggaagtgcatatcagaagtgtcagaaaactcgagacatcgttggaactagattaaat

SEQ ID NO: 6571 - DNA, 1754 bp, Zea mays
gtatagaaaacggagctgataggaacgagattttttacatccattttcatccctagctgtggtcccacaggtcgcaccattctcccctcttcttccgccgatacacacgccctgcacgggggctcgccgaggcttcagtttactactgaagcacgcaccgcagcgtctccaccttctgctcaacctccgcttccgtaggtgccggcgctaagcgaggatccctccgttcatcggtcccgacggcacctcgactcgtttcgtcggtcgctgtggcgacgggtgattgactgcgatatgaggcaatggttatgttgtaactgccactttgatgacgaggaagatggccatgacaaggaacaggccaaagctcagagcaataagatagaccccaagcagaagtcttcaaaacctcctgttagtcaacctgagccagagttctcccctccaacaattgatgttcctgaattgtcattggatgatttgaaacaaaagactgatgattttggatcaagtgctctgattggtgaaggttcttatggacgagtatatcatgccgctttagatgatgggaggcaagccgcagttaaaaaacttgatgcatctgaaaatgagcctaatgatgagttcctcaaacaggtctcactggcatcaaagctaaaacatgaaaatcttgttgagatgttgggttattgtgtggatgggaattatcgtatacttgcttatgaatttgcaaccatgggttcgcttcatgatgttttacatggaagaaaaggcgttcaaggcgcgcagcctggccctgtgcttgactggatgcagagggtcaaaattgttattgaggctgcaaaaggtatagaatatctgcatgaaaaggttcagccttcaatcatccatcgggacatcagatcaagcaatgtactgctgtttgaggatttcaaggcaaaaattgcagacttcaatcttttgaaccaagcaccagatatggcagctcgtctccattcaactcgtgtattgggaacttttggatatcatgcacctgagtatgctatgactggccagctgacacaaaaaagcgatgtctacagctttggcgtggtccttttggaacttttgactggaaggaaaccagtagatcacacaatgcctcgaggacaacaaagtttagtcacatgggctactccaaggttgagtgaagacaaggtgaagcaatgtgtagatcccaggttgaagggagaatatcctccaaagggagtcgctaagcttgctgcagtggcagcactgtgtgtgcaatacgaagcagagttcaggcccaacatgagcattgttgtgaaggcgctttcgcctctccttcaacaaagacctgcaccaggcaccgcagagccagccccgcaacctgtgagctgaatccagtcacgtgtgatgggacctcgcagcatcaggcatctccgcgatcattcaatcagcaagtcattgagagtattttgaatatttgttctgtagcattctgttcctggcttgatgttggcgctgcacaatgacaatggtatatgcagtaggtttgatttttctttttcttttaccttctctataccagtaccaagttaccaactgttcgtagattttcagaattcgctgcttgaagaatagatgcaggatgatctggattttttttttggtctggcgtggcgttgctgccttctcttccatggttaccaaataccatgattgaaatcaagtcacttctactttgtttgaag

SEQ ID NO: 6572 - DNA, 1875 bp, Mimulus guttatus
cttcaggctgtaaagactctgactttctctctcatcactttctctctctagtagtttctctctccattcgttgggaatatttgctttgcctggttgtcctcgcacctgtctttccaccccactttttctgcgatccactttactattactcctaaagcttaattccaatttccatatatatacatacaagatttcatatatatatatttaattcggtgtgtgtagtagacagagtcgcgcacacgcagaggattaaaggtgaggagaaaaagggcaggcgagagaaaaaaaataaaattaaaattaaaagagggccatgaatttcggctcaggcacctccacccggttattttgtgcgcttggagaacaagactgttgaagaagatccttatttgaaaaagagaacaaggatgcgtaggtggctgtgctgcacttgtcatgtagaggagtcctatcagcagaacgaaaatgagcacctcaaaagcccaaggaataatgctgatgggcaccaaagaggctctaagacatcggctccagtgaaacccgaagttcagagggctgtacctcccatcgaggtgccttctctgtctcttgaggaactgaaagagaaaaccgaaaacttcgggtcaaaggcattaattggtgaaggatcgtacgggagagtatactttgcacaattgagtgatggaaaagaggttgctgtcaagaaacttgatgtgtcatctgagcctgattcaaatgttgagttcttgacacaggtttccatggtgtcgagattgaagcatgacaatcttgttgaattgcttggttactgtgtagatggcagtctccgtgtcttggcttatgagtttgccaccatgggatctctacatgacattttgcacggaaggaaaggagtacaaggggcacaacctggtcctgtacttgactggatgcaacgggtgaaaattgctgttgatgctgcgaggggactggaatatttgcacgaaaagtctcagccttcaatgattcacagagatatcagatccagtaacgtacttttatttgaagactacaaagccaaaattgcagattttaacctttcaaatcaggctcctgacatggctgcccgcctccactctactcgtgtgctaggaacctttggttatcatgctccagaatatgcaatgacagggcaattgacacagaagagtgatgtttatagctttggagttgttctgcttgagctccttactggaaggaagcctgttgatcatactatgcctcgtggtcaacagagtcttgttacttgggctactccaagacttagtgaggacaaagtcaaacagtgtgttgacccaaaactcaagggagagtatccagctaaagcggtcgccaagctggcagcagttgcggcattgtgcgtgcagtatgaagctgagtttcgcccgaatatgagtattgttgtgaaggcgcttcagcccttgttgaaatcggttgtacctgctccagagatccagcacccttaaactccagaagctctttgtgttgttttttgtgtgtgtttgcacagtttgggcctgcataatgaccacctttcattgaccacttcggcactcccttcgacacaatatttttattttttttcattttccgtttctctgatttcgagaaattgttggatttgtacttgtgattccatttctggtgttggtagtgaatatcttttataaatcatgaccgaatggatcgatggatgtggattgagtttgttttttttttttcttttcccccagagtcggaagggtttgtggtttcagttcttaaacatatattttggttctttttaaacaatgtgatttgtattggtttgtttaagttcgtgcattctttggt

SEQ ID NO: 6573 - DNA, 1507 bp, Mimulus guttatus
tattttgtgcgcttggagaacaagactgttgaagaagatccttatttgaaaaagagaacaaggatgcgtaggtggctgtgctgcacttgtcatgtagaggagtcttatcaacagaacgaaaatgagcacctcaaaagcccaaggaataatgctgatgggcaccaaagaggctctaagacatcggctccagtgaaacccgaagttcagagggctgtacctcccatcgaggtgccttctttgtctcttgaggaactgaaagagaaaaccgaaaacttcgggtcaaaggcattaattggtgaaggatcgtacgggagagtatactttgcacaattgagtgatggaaaagaggttgctgtcaagaaacttgatgtgtcatctgagcctgattcaaatgttgagttcttgacacaggtttccatggtgtcaagattgaagcatgacaatcttgttgaattgcttggttactgtgtagatggcagtctccgtgtcttggcttatgagtttgccaccatgggatctctacatgacattttgcacggaaggaaaggagtacaaggggcacaacctggtcctgtacttgactggatgcaacgggtgaaaattgctgttgatgctgcgaggggactggaatatttgcacgaaaagtctcagccttcaatgattcacagagatatcagatccagtaatgtacttttgtttgaagactacaaagccaaaattgcagattttaacctttcaaatcaggctcctgacatggctgcccgcctccactctactcgtgtgcttggaacctttggttatcatgctccagaatatgcaatgacagggcaattgacacagaagagtgatgtttatagctttggagttgttctgcttgagctccttactggaaggaagcctgttgatcataccatgcctcgtggtcaacagagtcttgttacttgggctactccaagactgagtgaggacaaagtcaaacagtgtgttgacccaaaactcaagggagagtatccagctaaagcggtcgccaagctggcagcagttgcagcattgtgcgtgcagtatgaagctgagtttcgcccgaatatgagtattgttgtgaaggcgcttcagcctctgttgaaatcagttgtacctgctcctgagatccagcacccttaaactccggaagctctttgtgtttgttttttttgtgtgtttgcacagtttgggcctgcataatgacctttcactgatcacttcggcactcccttcgacacaatatttttattttttttcattttccgtttctctgatttcgagaaattgttggatttgtacttgtgattccatttctggtgttggtagtgaatatcttttataaatcatgaccgaatggatcgatggatatggattgagtttgttttttttttttttctttccccccgagtcgaaagggtttgtggtttcagttcttaaacatatattttgcttctttttaaacaatgtgatttgtattggtttgttt

SEQ ID NO: 6574 - DNA, 1795 bp, Setaria italica
ccaccccccgcactccagttcactcgagcacgcatcgccagcgccacccctcctcctcctgctctatcctcctcctcctcctccgtcgcgggggccggcgcgggtgggaggacccatccctccgaccggaactcgattgggttctccgttcgtcgctgtggtgaacaggcgacgggacagcgatatgaggcagtggttttgttgtaactgccacttcgatgatgaggaagatgggcacaacaaggagcagtccaaggctcagagcaataagatagacccgaagcagaaatcttcgaagcctcctgttactcaacctgagccagagatctcccctcctacaattgatgtccctgaattgtcattggatgacttgaaagaaaagactgataattttggatcgagtgccctgattggtgaaggttcttacggacgagtatatcatgccactttggatgatgggaggcaagcagcagttaaaaaactcgatgcatctgaaaatgaacctaatgatgagttcttgaaacaggtctcactggcatcaaagctaaaacatgacaatcttgttgagatgttgggttactgtgtggagggaaattaccgtatactggcatatgaatttgcaaccatgggttcgcttcatgatgttttgcatggaagaaaaggtgttcaaggtgcacagcctggacctgtgcttgactggatgcagagggtcaaaattgctattgaggctgcaaaaggcatagaatatctgcatgagaaggttcagccttcaatcatccatcgggacatcagatcaagcaatgtactgctgtttgaggacttcaaggcaaaaattgcagacttcaatcttttaaatcaagcaccagatatggcagctcgcctccattcaactcgtgtattgggaacttttggatatcatgcaccagaatatgctatgactggccagctgacacagaaaagcgatgtctatagctttggtgtagtccttttagaacttttgactggaaggaaaccagtagatcacacaatgcctcgaggacaacaaagtttagtcacttgggctactccaagattaagtgaagacaaggtcaagcaatgtgtagatcccaggttgaagggagaatatcctccaaagggagttgctaagctcgctgcagtggcagctctatgcgtgcaatacgaagcagagttcaggcccaacatgagcattgttgtgaaggcgctttctcctctccttcaacaaagacctgcaccgaccgcctcagagccagccccagaacctgccagctgagaccagtcgcatgcgatcggacctctcggcaccaatcgcatgcgatcggacctctcggcacaagccatgttggaatcgagcacattctgtgtgtaattgagtgtgttttggatgttcgttttgtagcgttcccaattggataaagcatacatgaagttgcccctgccgttcgtggccgcctaggtaggttcgctgcttttatattggcgccgtacaatggtatgtagtagggtcgaagttttcttttcccttttttaccaactctgtaggtttaagggactcgccgtgtttggaagaatagaatgattttccgtctgctgcatgatatcattgctacctttgttcgttttcttgtgctggttcttactgatggaatatggatgcttggcagcactcgtaagcaatagttgtaacaactcaggtgttcaattgcaacaccaaaatcggcccttgagattgcatgcgaggtgagagccagaaatgtaactcttcagaaaagatgag

SEQ ID NO: 6575 - DNA, 1077 bp, Setaria italica
gtggagggaaattaccgtatactggcatatgaatttgcaaccatgggttcgcttcatgatgttttgcatggaagaaaaggtgttcaaggtgcacagcctggacctgtgcttgactggatgcagagggtcaaaattgctattgaggctgcaaaaggcatagaatatctgcatgagaaggttcagccttcaatcatccatcgggacatcagatcaagcaatgtactgctgtttgaggacttcaaggcaaaaattgcagacttcaatcttttaaatcaagcaccagatatggcagctcgcctccattcaactcgtgtattgggaacttttggatatcatgcaccagaatatgctatgactggccagctgacacagaaaagcgatgtctatagctttggtgtagtccttttagaacttttgactggaaggaaaccagtagatcacacaatgcctcgaggacaacaaagtttagtcacttgggctactccaagattaagtgaagacaaggtcaagcaatgtgtagatcccaggttgaagggagaatatcctccaaagggagttgctaagctcgctgcagtggcagctctatgcgtgcaatacgaagcagagttcaggcccaacatgagcattgttgtgaaggcgctttctcctctccttcaacaaagacctgcaccgaccgcctcagagccagccccggaacctgccagctgagaccagtcgcatgcgatcggacctctcggcacaagccatcttggaatcgagcacattctgtgtgtaattgagtgtgttttggatgttcgttttgtagcgttcccaattggataaagcatacatgaagttgcccctgccgttcgtggccgcctaggtaggttcgctgcttttatattggcgccgtacaatggtatgtagtagggtcgaagttttcttttcccttttttaccaactctgtaggtttaagggactcgccatgtttggaagaatagaatgattttccgtctgctgcatgatatcattgctacctttgttcgttttcttgtgctggttcttactgatggaatatgaatgcttggcagcacccga

SEQ ID NO: 6576 - DNA, 1572 bp, Pennisetum glaucum
tggtgagcaggtatgaggcagtggttttgttgtaactgccattttgatgatgaggaagatgggcacaacaaggatcagtccaaggctcagagcactaagatagacccgaagcagaaatcttcaaagcctcctgttagtcaacctgtgccagagatctgccctcctacaattgatgtccctgaattgtcattagatgacttgaaagaaaagactgagaattttggatcaagtgctctgattggtgaaggttcttacggacgagtatatcatgccactttggatgatgggaggcaagcagcacttaaaaaacttgatgcatctgaaaatgaacctaatgatgagttcttgaaacaggtctcactggcatcaaagctaaaacatgacaatcttgttgagatgttgggttactgtgtggatggaaattaccgtatactggcatatgaatttgcaaccatgggttcgcttcatgatgttttgcatggaagaaaaggtgttcaaggtgcacagcctggacctgtgcttgactggatgcagagggtcaaaattgctattgaggctgcaaaaggcatagaatatctgcatgagaaggttcagccttcaatcatccatcgggacatcagatcaagcaatgtgctgctgtttgaggacttcaaggcaaaaattgcagacttcaatcttttaaatcaagcaccagatatggccgctcgcctccattcaactcgtgtattgggaacttttggatatcatgcaccagaatatgctatgactggccagctgacacagaaaagcgatgtctatagctttggtgtagtccttttagaacttttgactggaaggaaaccagtagatcacacaatgcctcgaggacaacaaagtttagtcacttgggctactccaagattaagtgaagacaaggtcaagcaatgtgttgatcccaggttgaagggagaatatcctccaaagggagttgctaagctcgctgcagtggcagctctatgcgtgcaatacgaagctgagttcaggcccaacatgagcatcgtcgtgaaggcactttctcccctccttcaacaaaaacccgcaccaaccgcctcagagccagccccggaacctgcgagctgagaccagtcccatgcgatgggatctctcggcacaagccatctcggaatcaagcacattctgtgtgtaattgagagtgttttggatgttggttttgtagcgttccaaattggataaagcatacatgaagttgtgcccctaccctttcgtggacaccgactagctaggctcgctgcttttatattggcgtcgtacaatggtatgtaggagggtcgaagttttctgttccctttatttagcaaccctgtaggtttaagggagggagccatgtttggaagaaaagaatgattttccgtctgctgcatgatatcattggtacctttgttttcttctgatggaatatgcgtgcttggcagcactggtagttgtaacaactcgggtgttcaattgtaacgtcaaaatcggcccttgagattgcatgcgaggtgagaggtagaaatgcacaataagatgagg

SEQ ID NO: 6577 - DNA, 1856 bp, Setaria italica
cctccgtctcctccccacgccaccgaagcaatccaggccaggccagggcgcttagcgccacaaccaaaccccaccaccccgcacgagatcatttcgccagctcatccgccaccgccccccacctctccgctccgctcccgcgtctccacctccacctcgtcttcgtcgtcgccgggccccgcttaccgccgccccgcccgccgtcgactcgtctcaggcaagaggcaaggagaaaggagaggtcgttatgcgccggtggttttgctgcacgcagtttcacgcgtcatatcgcgaacatgaaaatgaacttcccatcagtccagatgagaaagaaggaaatggttttgttgccaatagtgatcctaacaaagcaccacctcccattgaagtccctgaattatcatttgaagaactgaaagaaaagacagacaattttggatcaaaggctttgatcggggagggatcgtatggaagagtgtattatgctattctggacagcggaaaacatgttgctgttaaaaagcttgatgcttcaacagaccctgaacttgataatgagtttttgacacaggtatccattgcctcaaagctaaaacatgctaattttgtggaaatgcttggatattgtgtggaaggaaatcagcgtttagtggcctatgaatttgctacaatgggttctctacatgatattctgcatggaagaaagggtgttccaggtgcacagcctggcccagcacttgactggatgcagcgggttaagattgctatagatgctgctaaagggctagagtatcttcatgaaaaggttcggccttcgatagtccaccgggacatacggtccagcaatgttcttctgtttgaggactacaaagcgaaaattgcagatttcaatctttcaaatcagtctccagatatggctgctcgtttgcattctacccgtgtccttggaaccttcggttaccatgctcctgagtatgccatgactggtcagctaactcagaaaagtgatgtatatagctttggagttgttcttttagagcttctaacaggaaggaaaccggtagatcatacaatgcctagaggtcagcagagtctggttacatgggcaacacctagattgactgaggatacagtgaaacaatgtgttgatccgagattaaagggagagtatcctccaaagggagttgccaagcttgcggcggtggcagcactctgtgtgcaatacgaatctgagtttagacccagcatgagcatcgtagtcaaggcactctctccccttcttcaacataagccgcatccaccaccggccgtagctcctgatgcaacagcaccttcagatgcctgactttctcagtcccgacaagaatgtaaagagataaccatttccccttcggtgcgtgcgctgtttttcagtactgttctgtgcaggcggagtgattagtgtcacacaagtaacggcatcgtggactgatgcatagcttatcctttacataggctgctacaaacaagaggcttttccttgtcattaccgtgtgctgagccgagtgatttggactaatgcatagcttatcctttacataggctgctacaaacaagaggcttttccttgtcattaccgtgtgctgagctgagtgatttgctgccttcgttggccgggcgaggttgtgcttggttggccagcggtcgtgatcacctaattaccgtgttctgagtctatactgtaaattgggaaggttctaacttttcatggcttgattcctttttgtttgcgttttgtctgattttgagctgatcccctcctttttacaatcagtcttgattgctgaggcttctggcgtgcatgcctacgcttgaga

SEQ ID NO: 6578 - DNA, 2252 bp, Brachypodium distachyon
accgccctcctcccttggcttccaagctacgcttcggctgcgagaggagcccgcgaccgtggcctgctgctggtgtgctgcggggtgcagtggagaggagacaacatgaggcactggttttgttgcaattgccggttcggtggggaggaggatgaccatgacatggagcattccaaagctaagggcaataagatggacgccaagcaaaagtcttcaagacctgctgatcaacccgagatagattttttccctcctacaattgatgtccctgaattgtcgttcgaggacttaaaacaaaagaccgacaattttggatcgaattctctgattggtgaaggttcatatggacgagtatatcatgccactatggatgatgggagacaagcggcaatcaagaaatttgatgcatcagaaaatgagcctaacgatgaattcttgaaacaggtctcgcttgtatcgaagctaaatcatgaaaatcttgttgagatgttgggctactatgtggagggcaactatcgtatattggcatatgaatttgcaacgatgggttctcttcatgatgttctgcacgggagaaaaggagttcaaggggcgcagcctggacctgtgcttgactggatgcagagggtcaaaattgctatcgaggcggcaaaaggtgtggagtatctgcatgagaaggttcatccttcaattatccatcgggacatcagatcaagcaatgtacttctgtttgaggacttcaaggcgaaaattgcagacttcaatctcttaaatcaggctccagatatggcagcacgtctacattcaactcgtgtattaggaacatttggatatcatgctccagaatatgctatgactggccagttgacacagaagagtgatgtctacagctttggcgtggttcttctggaactgctgactggaaggaaaccagtagatcacacaatgcctcggggacaacaaagtttagtcacttgggctactccaagattgagcgaagacaaggtcaaacaatgtatagatcctaggctgaagggagaatatcctccaaagggtgttgctaagcttgctgcagtggcagctctatgcgtgcagtatgaagcagagttcaggcccaacatgagcatcgttgtcaaggcactctctcctctgctacaacaaagaccagtggtgccagctgcctcagagccggaaggttcttcctcgcgctcttgtctccggtggcatttcctacccgacaatgatgcctggattaagtccagcacgcccctctgcccgttccaggtaatttcctcaggtttgatagaagatgaggaacaagaagcccttgaggttgactttgtgaataaatatttgggaggcggtgcactttccaagggttgtgttcagttgtcttataaatgttgtatctgttctatggtacatgaagagattcgttttatgataaactcagaactaattgtgggcatgctctttatggcttccatggaagataacgaggctatagaaattgtcggcgcagaaaggtatggttcctcattccgctttgttggtgactgttcagatacaaagccccttgatgcattgggtagacgaaaaactaggatattggccattgattctttggactgcccaactaagttacagtatgaaattagtggtcttctaagggaagtgaacaaagcattctgtggatttttggaccaatcaaagcatcagctatacgtgaaacctttccaggattctaataccaaggataactgtccaagtgtcagctctgatggatgtataagagtttcaactggaatctggggcttttggtggaaaccctgaaattaagagcatgattcagtggattgctgcatcacaggcatgccgaccttttgttaattactatacttttgaggctgcgtcactgagaagactagaagaggtgatccagtggatattgctgcatggatggactgtcggcgaattgtgggacatgcttgtcgagtattcaacccagatgctgagatgagaaacacacgagggctttttgacttggttacttccaaagaacggtgctaatagcgatgtggattacatgtgtgagtagcctgatgctgtgaggttagcatctacatgtaatgcgcaggtgtgcactatacttgtgtgaacaactttgtaaaaacattaattggtagattttctttccctggccacaaactggtcagcaatgcgtgagaccaacacataatagtttcgtaatg

SEQ ID NO: 6579 - DNA, 1251 bp, Setaria italica
gtatccattgcctcaaagctaaaacatgctaattttgtggaaatgcttggatattgtgtggaaggaaatcagcgtttagtggcctatgaatttgctacaatgggttctctacatgatattctgcatggaagaaagggtgttccaggtgcacagcctggcccagcacttgactggatgcagcgggttaagattgctatagatgctgctaaagggctagagtatcttcatgaaaaggttcggccttcgatagtccaccgggacatacggtccagcaatgttcttctgtttgaggactacaaagcgaaaattgcagatttcaatctttcaaatcagtctccagatatggctgctcgtttgcattctacccgtgtccttggaaccttcggttaccatgctcctgagtatgccatgactggtcagctaactcagaaaagtgatgtatatagctttggagttgttcttttagagcttctaacaggaaggaaaccggtagatcatacaatgcctagaggtcagcagagtctggttacatgggcaacacctagattgactgaggatacagtgaaacaatgtgttgatccgagattaaagggagagtatcctccaaagggagttgccaagcttgcggcggtggcagcactctgtgtgcaatacgaatctgagtttagacccagcatgagcatcgtagtcaaggcactctctccccttcttcaacataagccgcatccaccaccggccgtagctcctgatgcaacagcaccttcagatgcctgactttctcagtcccgacaagaatgtaaagagataaccatttccccttcggtgcgtgcgctgtttttcagtactgttctgtgcaggcggagtgattagtgtcacacaagtaacggcatcgtggactgatgcatagcttatcctttacataggctgctacaaacaagaggcttttccttgtcattaccgtgtgctgagccgagtgatttgctgccttcgttggccgggcgaggttgtgcttggttggccagcggtcgtgatcacctaattaccgtgttctgagtctatactgtaaattgggaaggttctaacttttcatggcttgattcctttttgtttgcgttttgtctgattttgagctgatcccctcctttttacaatcagtcttgattgctgaggcttctggcgtgcatgcctacgcttgagattgagattatgcacattgttttcttttctcgaaaaatgctcacgagtgacagg

SEQ ID NO: 6580 - DNA, 2307 bp, Oryza sativa
gtctcgttccctcgtactagctcgtctcgtctcttctctaccccaatcccgttctctccctttccccccaccccacccccaaccccgtgccgcggcctcgccgatcgatcgatcgtgcgctccacctcctcgagctccctccctcgccgccgccgccgccgcgcgccgccggttcgacgccttcttcgcgctctcaggtgaaatcatcttctctctcaggttcaggaatgaatgcgtgggggatgggggttgatcggtttcggctagggggtgctggattggtgggtggggggtggcgcaatgctgctgcggcggggtggcgtttttgccgggtcgaggcgggcggaattgtggggaattttttttttttgcgtgcgcaattttggcgtggctcgggatgatggctgggtggcgtacggcggcgtgagctagggggaactcgcagcggcgccgggggtgggtttcggtggtggtttgtgtgagtcatttgtctcatcgagctccaagtttggaggtggtgttatgctgttttagcactggaggttttgtagtacggacttgcttggatgtggaggatatggtcatgtttttgttgattcccggaggccacctcttgtttctgatttccttttggtttgtgtcattggttcatcaggtagcggtagacactgaacatgatgattcaattggtgtgacggatgagtctggttggccatgcatagaattagacaggcggatgcgtaggatgaacggcagaaacccagaaaagaacataaaaatggaacatgaaaatgatagttcacttgcttgggtgtttcacgcaccatatcgtgaacacgaaaatgaatttcctgacatcccagaggagaaagaaggaaatggttttgctcccaaaagtgatgatcccacaaaagcacctcctcccattgaagtaccagaattatcatttgatgaactgaaagagaaaactgataattttggttcaaaggctttagttggtgaaggatcatatggaagagtgtattatgctactctagacaacggaaagcaagttgctgttaaaaagcttgatgcttcaacagaacctgaggttgataatgattttttgacacaggtgtccattgtgtcaagattaagacatgaaaattttgtggaaatgcttggttactgtgtggaaggaaatcagcgcctagtggcctacgaatttgctacgatgggttctctgcatgatattttgcatggaagaaagggtgtccctggtgcacaacctggcccagcacttgactggatgcagcgagtgagaattgctattgatgctgctaaagggctagaatatcttcatgagaaggtccaaccttctatagtccatcgggacatacgctctagcaatgttcttctatttgaggactacaaagcaaaaattgcagatttcaatccttcaaatcagtctcctgatatggctgctcgtttgcactcaactcgtgtccttggaaccttcggctatcatgctcccgagtatgccatgactggccagttgactcagaaaagtgatgtatatagttttggagttgttcttctagagcttctaacaggaaggaaaccagtagatcacacaatgcctaggggtcagcagagtctggttacatgggcaacacctcgtttgacagaggacactgtgaaacaatgcgttgacccgagactgaagggcgagtatcccccaaaaggggttgccaagctcgcagcggtggcggcactctgtgtgcaatacgagtctgagtttagaccaagcatgagcattgtggtcaaggcactctcccctcttctccagcataaaccgccaccgccaccagccgttgctcctgagacctgagctccagattcaactgcttcttatgcttttacttccgagtttcaacatggatgtaaagagggatggaatttcttcatcggtccctgtcgttactgtttcatgcttgccaattggttaccatgccgtttaagtactggtcctgtgagctttacaatagatttttggtgtttacactcggagctttccttgtcattcctttcatgtgtgcttatgctgagtgctgtgctgccttcgttggtcggcaaagttgtgtttttagctgcccagcggtggtgatcaccgaataatcttgttctgagttgaactgtgacatgggaaggttctaaatctaactgttcatggcttgacatgctttcggtgtgtgcctacgtgagaggatgatggttcttcactttgttaacatgtgagttatgaatggatgcttttggcttgctaca

SEQ ID NO: 6581 - DNA, 1850 bp, Sorghum bicolor
aggctctgggctctggccctctcgtctcgtccctctgcttctgcttctccccacgccaccgaagcaatccaggccaggaccaggaccaggacagggtgccacaaaaccaaaaccaaaccccaccactccgcacgagatcatttcgccagctcatcgccaccgccctccacagcccccgctcggctcccgcgactccttctcctcgtcgccgggtgagtgggtccacctctcgccgcgccccgccgtcgacccgcctcagaggcaaagataagtcaaaggagaggtcggtatgcgccggtggttttgctgcacgcagtttaatgcttcatatcgtgaacatgaaaatgaacgtcccatcagtccggaggagaaagaaggaaatggttttgctgttaaaagtgatcccatcaaggtaccaccttccattgaagtccctgaattatcatttgaagaactgaaagaaaagaccgacaattttgggtcaaaggctttgattggtgagggatcatatggaagagtgtattacgctattctggacagtgaaaaacatgttgctgttaaaaagcttgacgcttcaacagaccctgaactcgataatgagtttttgacacaggtatccattgcctcaaaactaaagcatgataattttgtggagatgcttggatattgtgtggaaggaaatcagcgtctagtggcctatgaatttgctacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaacgttcttctgtttgaggactacaaagcgaaaattgcagatttcaatctttccaatcagtctccagatatggctgctcgtttgcattctactcgtgtccttggaaccttcggctaccatgctcccgagtatgccatgactggccagctaactcagaaaagcgatgtatatagcttcggagttgttcttttagagcttctaacaggaaggaaaccagtagatcatacaatgcctagaggtcagcagagtctggttacatgggcaacacctcgattgactgaggacacagtgaaacaatgtgttgatccaagattaaagggagagtatcctccaaaaggagttgccaagcttgcggctgtggcggcactctgtgtgcaatatgaatctgaatttagacccagcatgagcatcgtagttaaggcactctctccccttcttcaacataaaccgcaaccaccaccagccactactcctgatgcaacagcaccttcagatgcctgactttttcaacaagctatgaatcatgaatgtaaagagagccatttcctcttcggtgcgtgcgctgttctgaagtactaccgtgtgcctgtgaagtgatcagtgtcacacaagtaacggcattgtggactaatgcatatgcacacctttacataggttggtacagacaggaggctcccccccttgtcattaccgcgtgctaagctgagtcatgtcctgccttcgttggccgggtgaggtgtgcttgttggccagcggtcgtgatcacctaattaccgtgttactgtaacatgtgaaggttctaatttttttttcaaggtttgtttttcgtgtgcatgtctatgcgtgagattgtgatgacattatgcgcattattttcttttactggagatacgctggagagctagattgtgcactgatgctgttcgttgtagcatctgtttgtccaagtcaagggtgacgttac

SEQ ID NO: 6582 - DNA, 1811 bp, Sorghum bicolor
gcttctccccacgccaccgaagcaatccaggccaggaccaggaccaggacagggtgccacaaaaccaaaaccaaaccccaccactccgcacgagatcatttcgccagctcatcgccaccgccctccacagcccccgctcggctcccgcgactccttctcctcgtcgccgggtgagtgggtccacctctcgccgcgccccgccgtcgacccgcctcagaggcaaagataagtcaaaggagaggtcggtatgcgccggtggttttgctgcacgcagtttaatgcttcatatcgtgaacatgaaaatgaacgtcccatcagtccggaggagaaagaaggaaatggttttgctgttaaaagtgatcccatcaaggtaccaccttccattgaagtccctgaattatcatttgaagaactgaaagaaaagaccgacaattttgggtcaaaggctttgattggtgagggatcatatggaagagtgtattacgctattctggacagtgaaaaacatgttgctgttaaaaagcttgacgcttcaacagaccctgaactcgataatgagtttttgacacaggtatccattgcctcaaaactaaagcatgataattttgtggagatgcttggatattgtgtggaaggaaatcagcgtctagtggcctatgaatttgctacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaacgttcttctgtttgaggactacaaagcgaaaattgcagatttcaatctttccaatcagtctccagatatggctgctcgtttgcattctactcgtgtccttggaaccttcggctaccatgctcccgagtatgccatgactggccagctaactcagaaaagcgatgtatatagcttcggagttgttcttttagagcttctaacaggaaggaaaccagtagatcatacaatgcctagaggtcagcagagtctggttacatgggcaacacctcgattgactgaggacacagtgaaacaatgtgttgatccaagattaaagggagagtatcctccaaaaggagttgccaagcttgcggctgtggcggcactctgtgtgcaatatgaatctgaatttagacccagcatgagcatcgtagttaaggcactctctccccttcttcaacataaaccgcaaccaccaccagccactactcctgatgcaacagcaccttcagatgcctgactttttcaacaagctatgaatcatgaatgtaaagagagccatttcctcttcggtgcgtgcgctgttctgaagtactaccgtgtgcctgtgaagtgatcagtgtcacacaagtaacggcattgtggactaatgcatatgcacacctttacataggttggtacagacaggaggctcccccccttgtcattaccgcgtgctaagctgagtcatgtcctgccttcgttggccgggtgaggtgtgcttgttggccagcggtcgtgatcacctaattaccgtgttactgtaacatgtgaaggttctaatttttttttcaaggtttgtttttcgtgtgcatgtctatgcgtgagattgtgatgacattatgcgcattattttcttttactggagatacgctggagagctagattgtgcactgatgctgttcgttgtagcatctgtttgtccaagtcaagggtgacgttactga

SEQ ID NO: 6583 - DNA, 1691 bp, Phalaenopsis aphrodite
aattaagggcagccggcgttgtctttgtcgggcgacgtctctcaacgttctcctttgtcctttaagcatctcccgagttcttatccgcccatcaccggaaaccctaccttctgctcctctctgttgttctataatcgtccttggcgagaaatccaggtaatgttcaacaaacagcaactataaagaagaaatataagatgccacgctggctttgctgttcttttaatttgaaagatacggatgaccttcacgagaatgaagctttaaagagttccaaaccttatgaggatggactgcaaaaagatccaaaactctccattgtagctaaaaatgagaccaaggtaccgcctcctattgatgtacctgccctctcacttgatgaactgaaggagaaaactgacaattttggatcaaaagcattggttggagaagggtcatatggaagggtatattttgccgttctaaaagatggtagacaagtggcaattaaaaagcttgatgtttcacaagagcctgagtccaacgtagagtttttgacccaggttgcaatggtatcaaaagtaaggcatgataactttgttgaactgcggggctactgcgtggaggaaaatctcagattactttcctatgagtttgctaccatgggttctctgcatgatgttttgcatggcaggaaaggagtgctaggtgcacaacctggtcctgtccttgactggatgcagcgtgtgagcattgctattgatgcagctaaaggtctagaatatctccacgagaaagttcagccttccattatacacagggatatccgttcaagtaacattttactatttgaagacttcaaagcaaaaattgcagatttcaatctttctaatcaagcacctgatatggctgctcgtctccattctacacgtgtactcggaacctttggttatcatgctccagaatatgcaatgacagggcagttgacccagaaaagcgatgtgtacagctttggtgttgttcttttagagcttctcactgggaggaaacctgttgatcatacaatgcctagagggcagcagagtttggttacttgggctactccacgattgagcgaagataaggtaaagcaatgtgtggatccaaggttaaagggagaatatccaccgaaaggcatagcaaagcttgcagcagtggccgctttatgcgtgcaatatgaagctgagttcaggcctaatatgagcattgtagttaaagcactttccccgctccttgtaaataagcaatgtctaccacagccagatcctgctgcagcgattgctgatgcctgaatcctgcaaagcgtgttaatcgttgtacttcagttgaactggtttgcaaatttgctgtaccattttgatttggggagtggaggttcattttcaattttttagtattggtgcaaattttctattttgcgtgcagtgtgatgttttgcatggagaaaataatttgaacatatggtttttgcgaatggagtggtgttgggcaaggatcttaattttggttcttattgttcatagcatcattaagcaagagcttctcatctgatggaattttaaataaagttatatgccttaactattttccacatggattcaattatggtagattgttttagtgtcctaattttcttatgtacccttggtaaacctgtgttagtgtcgtacttt

SEQ ID NO: 6584 - DNA, 769 bp, Platanus occidentalis
tgatgtttcatctgagcaggagtccaatgctgagtttttgactcaggtttcaatggtgtcaagactgaagcatgaaaatcttgttgagttgcttggttattgcgtggaaggaaatctacgcgtgttagcatacgagtttgcaactatgggctctttacatgacattttgcatggaagaaaaggagtccaaggtgcacaaccaggtcctgtgcttgactggatgcagcgagtgagaattgctgttgatgcagcaaggggattggaatatttgcacgagaaagttcaaccttctataatacaccgggatatcagatcgagcaatatacttttatttgaagacttcaaagccaaaattgctgatttcaatctttcaaaccaggctcctgacatggctgctcgccttcattcaactcgagttttggggacctttggttatcatgctccagagtatgcgatgactggtcaattaacacaaaaaagtgatgtgtatagctttggtgttgtgcttttggagcttctcactggtagaaaacctgttgaccatacaatgcctcgtgggcagcagagtcttgtcacttgggctactccaaggttgagtgaggacaaggttaaacaatgtgtagatcaaactaaaggagaatatcctccaaaggagttgctaagctggctgctgtggcagctttatgtgtgcagtatgaatctgagtttcgaccgaatatgagcatcgtagttaaggcactccaaccgcttctcacgcagaagcctcctg

SEQ ID NO: 6585 - DNA, 1736 bp, Oryza sativa
aaaacgcttagaaataggcagcagaaaaaaaaaaagaaaagaggaaaccgaactccgctataaaaccgcgcctccgccgcgacgaagccgaccaagtgaagcagcgccgccgccgccgacgacgacgacgacgacgacgaaaccgccggaggcagagaggagcagagactacaaggggtaaagtagtgagaagagatggtaaggtggcgccgctggatctgctgcaattgtcaagtgaacgagtctgatcagcttgaaaatggacatgccaaggtcctgactagtaatgcagatggagtgacaaagggtttgaaagattctgctactgaaaaagctcagccacaaaattcggctctcactatcaatattcctgttctatccttggacgaactagtagaaaagacagatgattttggctcaagtgctttgataggcgaaggttcttatggtagagtgtactacgctgttcttgacagtggaacaaaaattgcagtgaagaaacttgattctaatgaaaatgagcccacttcagaattcttgacccaggtcgctttggtttcaagattgaaacatgaaaactttgtagatatgttgggatactgcacggagggtaaccttcgcctagtagcatatgaatttgccactatgggttcactgcatgatgttctacatggaagaaaaggggtgcaaggtgcacaacctggtccagcacttgattggatgcaacgagtaagaatagctgttgatgctgccaaaggacttgaatatctacatgagaaggttcagccctccattgttcatagggatattagatcaagtaacatactcttatttgaagacttcaaggcaaaagttgcagacttcaatctctcaaatcaggctccagatatggctgctcgtctgcattctactcgtgtactgggaacctttggttatcatgctccagagtatgcaatgaccggtcagctgacacagaaaagtgatgtgtatagcttcggagttgttctcttggaacttctgacaggaagaaaaccagtagatcatacaatgcctagagggcagcagagcttggttacatgggctacaccaagattaactgaagataaggtgaagcagtgtatagatccacggttgaatggtgaatacccaccaaaaggagttgccaagcttgcagcggttgcagcattgtgcgtacaatacgaagctgagtttcgcccaaacatgagcattgtggtgaaggctttatctccactgctcacaagtaagccgactccacccgcgcctccaccagctctggacggttgatgtacagaatcatcagagaagaaataacaactaagaccatataagcttctaagggtcagggactattgtttttcctgcttggtcattttgcatggcataccacagaatggagctacttgcttattgcttctcggaattcaggctaactgcatggagaatgtgttttgccttttgaaggaacacgatccgagcacaataacatacttaatttttgcagacggtgtctaacaatcgggattgcattgcatatactgtcattctgggccaaccataggatttgcaagtatttaggtgcctgtttacagaagattagacgatggcttgtgttctagtagtcgtttattcagtgaactagagatgatgtactgctgaatactgatgatgttctttgattcaaatagtatcgctgttacttgtgttgctttaccgtt

SEQ ID NO: 6586 - DNA, 2636 bp, Amsonia hubrichtii
ccaattaaattgtccattccgttccttctcagtaatcgctctttactgaattgatgtatagacataaagttcaagatgatgtttatgggtaaagttcttgaatcccatcagtttatgctaaacattgcaagaatttctggccgagatattactagttgttgatggattatacatgtctagagtctacgacaattgggataggctggtgcgagccacattgcgcagagagcagctccgcctcagtgctctaaggactcccagtgacctttccgtagtatcatcatcctcttcttttaattccagtgtttcctctcgccgtgtgtcctctttcagcttccctgacttattagtcggggagatatttgagtataatcaaattctccgtgccacagattacttcggtgcctccaatctcatgaggcatggccgttctggggatttcttttccggtgttttggaagatggaactccagttgtggtaaagaggattgactggtcatcggccaagaatgagtcatactgcatatcagaattggaattttttggaaaggcttctcattctagactggtgcctctactggggcactgcttggaacttctggatgagaagtatttggtttacaaatatatgcccaacggggacttatcgagcactttgtcccgggaagttcgttccgatggtgatcgtcagttagaatcattagacttgatgacgagattaaagattgcaactggggctgccgaggctctgagttatctacatgatgaatgtgttccctctcttgttcacagggatattcaggcaagcagcatacttctcgaccatgactttgaagtgcggctagggagctgcagtgaggtctgtgctgaggaaaagaaagggaaacaaagtagaattgcatggttgttgcaattgccactggaatctagacgaagcccttctggaacaacacctaatgcaagctgtgcttatgatgtttattgctttggaaaggttttgcttgagttagtgacaggcaagcttggtatcagtgcatccagtgatgctgccacgaaagaatggttggaacagacgctgccctacatcagtatatacgacaaagaactcatgaccaggattattgatccatctttaatcatagatgacgatctattagagaaaggatgggccatggcaattgttgcaaggtcttgcctctatcctaagccttcagggcggccccgaatgagatatattcttatagcattagaggatctattgaaagtagttgtcaaacctgaccagaaaattcgagatatctggccttattctgggcacataatctggcttctaaaattactgcagctggatcatgacctaccattgctgagtcttgagaatgaacgagctctggcaatagagaacaaagggcaccaaagaggttcaaaggtatcagctcctgttatgtctgaagcgcagaaggcaataccacctattgaagtgccaggtttatctctggatgaattgaaagacaaaactgacaattttggatcaaaggctttaattggtgaaggatcttatggaagagtatactatgcaaatctggataatggaaaagcagtggctgtaaaaaagcttgatgtgtcttctgaaccagaatcaaatgttgagttcttgactcaggtttccatggtttcaagattgaagcatgaaaatcttgttgagttactcggctactgtgtagatggaaatcttcgtgtattagcttatgagtttgcaaccatgggatctctacatgacatattgcatggcaggaagggggtacaaggtgctcagcctggtcctgtacttgactggattacccgggtaagaattgcagttgatgctgctaggggactcgaatatttgcatgagaaggttcaacctcctataatacacagagatatcagatccagcaatgtgcttgtttttgaagactataaagcaaagattgcagatttcaacctttcaaatcaggctcctgatatggctgctcgccttcattcgactagagttctgggaacgtttggttatcatgcaccagaatatgcaatgactggacagttgacacaaaagagtgatgtgtatagctttggcgtggttctacttgagctattgactggtaggaaacctgttgatcacaatatgcctcgtggccagcagtctcttgttacttgggccactccgagactgagtgaggacaaagttaaacaatgtatagacccaaaactgaaggactaccctgctaaaggagttgctaagttggcagcggtggctgcactgtgcgtgcagtatgaggctgaattcaggccaaatatgagcattgtcgttaaggctctccagcctctcctgaagtctcaagtccctcctactgagagttaatgctgaaatgttttgagttgctgttggattggaattttctgggatgtctgcataggtttgagcatacttgtttgcagatttaattggctcctcggaatgaatatagatttttccccattttttccccgtttgcgacctatttatgggtttcagtgctgatcttgtaatgaatcgtgtttgctgatatctcttcttggtactgaggttctccgatcatcaattgacagctgaattg

SEQ ID NO: 6587 - DNA, 1463 bp, Distylium racemosum
aggcccttgcgctttcccttttccatccgtctctccgatctcttgtttagctcgatctcttgtttagcttggccggtttgggttgctgcgctgctgtctgtactcgcctgctcttcctgtttagagacttcaaaaaattggtgggctgtaaagaatcaaatatctctatgtttgtagaatcatgatatgctttaggtgctgccgagaagatgaaattcaaaagttggctgatggtacaaacccttatacgtcaaatgtgcctatgacaggaaatgatggaatatacaagagtgtagacacaggtttcaaggggggtcaaaatctaaaagctcagcctatctctgtccctgagatcacagtggaggaattgagggagataacagaaaactttggtccgaaatcattgattggagagggatcgtatggtcgggtgtattatgcaaccttaagcaatggctgtgcgacagccattaagaagttagattccagtaaacaaccagaacaggaattacttgcacaggtgtccatggtttcgaggttgaagcatgaaaatgtggtggaactggttggttattgtgttgatggtgtcttaagagttcttgcatatgagtttgcaacaatgggatcacttcacgacatccttcatggcaagaagggcgtaaaaggagcagaacctggtccagttcttacatggatgcagagggtaaaaattgcagtaggagctgcaaaagggctcgagtatctccatgagaaggcacaacctccaataattcatcgtgatatcaagtcaagcaatgtcttactttttgatgactactcagcaaagatagctgatttcgatctttcaaatcaagctcctgacacagcagcacggcttcattctactcgtgtccttggaacgtttggttatcatgctccggaatatgcaatgacaggacaactgagtcaaaagagtgatgtttacagctttggtgttgttctcctagagctattgactgggagaaagccagtagatcacacattgccacgtggtcagcagagtcttgtgacatgggcaactccaagacttagcgaggacaaagtgaagcaatgtgtggatccaaggttgaaaggagactatccacctaaggcagtggctaagctggcagcagttgctgccttgtgtgtacagtatgaagctgattttcgtccaaacatgagtattgttgtaaaagctcttcaacctctgttgcatgcaaaaccagctcctgctgttgagatcccagctttttaatctgcatcatgcgtcatattattattccttatgatattcgatttgtgtgatatttagttttgctccagtgcaatcagttatgccttttctgaattgctgcttgggcacatttggacccaaatgtaaatttggaagagattgtacttattgtgtgagaattgagagtctcaggtgatggcaaatgggacat

SEQ ID NO: 6588 - DNA, 1249 bp, Humulus lupulus
gcgttgcttctctgtccatttctctcagacacaacaaaagcaaccaacagccaatctcacctgtcttcttcttcttctcacacaatcacaaaccctagaatttcaataaaggcacatgcacctcctcctggctactttgtacgtttggaaaacagaactgaagacgatttgtatttgaggaagagagtcaggatgcgtaggtggctttgttgtacttgtcaggtagaagagtctttcccatcaaacgaaaatgagcatttgaagagcccgaggaattattcagatgggaaccaaaagggttcaagagtagcagctcctgtcaaacctgaagtgcaaaaggcagcaccgcctattgaggtgcctgctttgtctctggaagaactcaaagagaagactgataattttggatccaaggcattgattggtgaaggatcttacggaagagtgtattatgcaagcctgaacaatgggaaagctgtggctgtaaagaagcttgatgtttcttctgagcctgagacaaatgttgaatttttgacccaggtttccatggtttctagattgaagcaggaaaatcttgttgagttgcttggttattgtgttgaaggaaatcttcgtttgcttgcatatgaatttgccaccatgggatctttgcatgacatattgcatggtagaaagggagttcaaggtgcacaaccgggtcccacacttgattggatgcagcgagtgaggattgcagttgatgcagctagaggattggaatacttgcatgagaaggttcaaccttctataatacacagagatatcagatctagtaacgtgcttctctttgaagacttcaaagccaaggttgcagatttcaacctttcaaatcaggcccccgacatggctgctcgccttcattctactcgagttttgggaacctttggttatcatgcaccagagtacgcaatgacaggacaattgacacagaagagtgatgtgtacagctttggggtggttcttcttgagcttttaactgggaggaaacctgttgatcataccatgcctcgtggacagcagagtcttgttacttgggctactccaaggttgagtgaagacaaagtcaaacaatgtgtagatccaaagcttaagggagaatatcctccgaaaggagttgcaaagttggcagctgtggcagcattgtgtgttcagtatgaagctgagttccggccaaatatgagcattgttgtgaaggcacttcaaccactcc

SEQ ID NO: 6589 - DNA, 1653 bp, Vinca minor
agcattgttcgtcgttggtttgttgcctggttgtcgtctcctctccttacctgtctctccctccctttattcctttttcccgattcctccacaacaaacccaaccaaaaacactttttctctttccgttcaaattccataattacgaaaacaggggagagagtaaacgcaagaaatttcaggcaaatgcacctccttccagttactttgtacgcctggaccatacaagtgctgaagacgatctttatttgagaaagagagctaggatgcgtaggtggctgtgttgtacctgtcaagttgaggagtcttacccatcaaacgagaatgaaccttttagaagcccaaagaatcacgctgatgggcaacaaagaggatcaaaggtatcagctcctgttatacctgaaacacagaaggcagtaccacctattgaggtgccagctttatctctggatgaattgaaagacaaaactgataattttggatcaaaggctttaattggtgaagggtcttatggaagagtatactatgcaaacctggagaatggaaaagcagtggcggttaaaaagcttgacgtgtcatctgaaccagagtcaaatgatcagttcttgactcaggtttccatggtctcaagattgaagcatgaaaatcttgttgacttacttgggtattgtgtagaaggaaaccttcgtgtgttagcatatgagtttgcaaccatgggatcgctacatgacatattgcatggcaggaagggggttcaaggtgctcagcctggtccggtacttgactggataacacgggtacgaattgcagttgatgctgctagggggcttgaatacttgcatgagaaggttcaacctcctataatacatagagatattaggtccagcaatgtgcttgtttttgaagactataaagcaaagattgcggatttcaatctctcaaatcaggctcctgacatggctgctcgcctccactcaactagagttcttggaacatttggttaccatgcaccagaatatgcaatgacagggcagctgacacagaagagtgacgtgtatagctttggcgtggttctactggagctattgactggtaggaaacctgttgatcacaatatgccacgtgggcagcaatctcttgttacttgggccactccaagactgagcgaggacaaggttaaacaatgtatagacccaaagctgaaggactaccctgctaaaggagttgctaagctggcagcggtggctgctctatgcgtacagtacgaggctgaattcaggccaaatatgagcattgtcgtcaaggcactccagcctctcctgaagtcacaaacacctcctcctgacagttagtgctgaaatattttgagttgctgttggatttgaagttgctgctgggacatctccattagtttgagtaaatttgttcagaaatttaattggcctttggtccaattatggattaattttccccatttgcaatctatttatagggtaatggtttgaatttgctgatatttctgtgtggtactgcttttcctagatcatcaattgacgacatccagattgatttgtggagtgaaaatattgaaaggagtgtgtagtcgaatatattggatgaactgtcatgcatgtccaacttttatctgagttga

SEQ ID NO: 6590 - DNA, 1327 bp, Vinca minor
aaaaaatttcaggcacaggcacctcctcccagttactttgtacgcctcgaccatacaagcgctgaagacaatcttcatttgagaaagagagctaggatgcgtaggtggctgtgctgtacttgtcaagttgaggaggcttacccatccaatgagaatgaacattttagaagcccaaagaatcatgctgatgggcaccaaagagggtcaaaggtatcagctcctgttatatctgaaacacagaaagcaataccacctattgaggtgccagctttgtctcttgatgaattgaaagataaaactgacaattttggatcaaaggctttaattggtgaaggatcttatggaagagtatactatgcaaacctggagaatggaaaagcggtggctgttaaaaagcttgacgtgtcatctgaaccagaatcaaacgcagagttcttgactcaggtttccatggtctcaagattgaagcatgaaaattttgttgagttactcgggtactgtgtagaaggaaaccttcgtgtgttagcatatgagtttgcaaccatgggatcgctacatgacatattgcatggcaggaagggggttcaaggtgctcagcctggtccggtacttgactggataacacgggtaagaattgcagttgatgctgctagggggcttgaatatttgcatgagaaggttcaacctcctgtaatacacagagatattaggtccagcaatgtgcttgtttttgaagactataaagcaaagattgccgatttcaatctctcaaatcaggctcctgacatggctgctcgcctccattcaactagagttcttggaacatttggttaccatgcaccagaatatgcaatgacgggacagctgacacagaagagtgacgtgtatagctttggtgtggttctacttgagctattgactggtaggaaacccgttgatcacaatatgcctcgtgggcagcaatctcttgttacttgggccactccaagactgagcgaggacaaggttaaacagtgtatagatccaaagctgaaggactaccctgctaaaggagttgctaagctggcagcggtggctgctctatgcgtacagtatgaggctgaattcaggccaaatatgagcattgtcgtaaaggcactccagcctctcctgaaatcacaaacgcttcctcctgagagttagtgctgaaatgttgagttgctattggatttgaacttgctgggatatctccattagtttgagtaaatttgtttagaaatgtaattggcgtttggtccgattatggattacttttcccctatttgcgatatatttatagggtaatgga

SEQ ID NO: 6591 - DNA, 1425 bp, Gnetum gnemon
tagatcttatgatgtgtacctgatttactgatcagtttcgagagaatgtgtcggttattatgttgttatggctcagaagaagacaactttgttccagctgataatcactatcatgctccagtagctggcgtcggcagtggatatacagttgaatccaaaccaggagatggagtggaaccccctggtgctcccacaaaagttttgccaattgaagcacctgctttatcttatgatgagttaacggaagaaactgataattttggaccaaaatctttgattggagaaggatcttatgggcgtgtttattttgctaatttgagcacagggagagcagcagcaattaaaaattagatagcagcagccagcaggaatctgaaaatgaatttctggcccaggtttcaatggtatcaagattgaaacatgaccatgttgttgagctgatgggctactgtgttgaagggaataatcgtatattggcatatgaatttgcaacaatgggatccctgcatgatattttgcatggaagaaaaggagtacaaggtgcccagcctggtccagttcttgattggatgcaaagggtcaaaattgctgtaggtgcagcaaagggtcttgagtatctacatgaaaaggcccagccttctgtaattcaccgtgacattcgatccagcaatgttctcctgtttgatgactataatgcaaagattgctgattttaatatttctaatcaagctcctgatatggctgctcgccttcattctacacgtgttctggggacttttggctaccatgctcctgaatatgctatgactggccagttgactcaaaagagtgatgtgtatagctttggtgttgtcttgcttgagcttctgaccggtagaaagcctgttgatcataccatgccaaggggtcaacaaagtttggttacttgggcaactccaagattaagtgaagataaagtaaaacagtgtgttgatcctaagttaaaggaagaatatcctgcaaaagctgttgcgaagatggcagcagttgcagctctctgtgtgcaatatgaggcagacttccgtccaaacatgagcattgttgtcaaagcactccaaccattgcttactccaagaccacattctactgtgtcagaagcccatgtttgattcttaatcatagttttgttgaggatcttttgtttggcttgcatgtgtcaaagaaaattagtacagattattgaacgtcaatatcatttacgttatcgaaattctatttgaatactagagtttcagtggatgagccattcgcaatcctgtgtggacttttaaacaatggatttcatcagatgtgcacatgtgattcatttgcatgtcagttacgcagaatctattcttctaggcttgttacaacatatatgattgtctttaattcttttgcagtgat

SEQ ID NO: 6592 - DNA, 1230 bp, Selaginella moellendorffii
ctcttgcgcgtctccagcggcgcgccctggacggcggcgcctcccagtgcatggatgctcgcggcagctcggccgcgatcccggggagatttctccaggtgtagggtaaatattttgatctggggcgaggtgtagcgaagcaatgggatgcgttttctcgtcttgcgccgggaatgatatcacgaagccatcggatgctccgttcaccactgtgacaaatggcaaccctggtggtgctaaagcaaatgaaggagcaaatagagctggacaagctgccagagtccaaccgatcgctgttccaatgcttggcattgacgagctgaaagaagccaccgagaattttggtcccaagtcacttatcggcgagggatcctatggtcgagtttaccttgcggagttgcgaagtggtcaagctgcgataaagaagctggaccagaattcacagcctgatcaggagttccttgctcaggtttccatggtgtcgagactaaaaaatgagaacgttgttgagctcattggatactgtgttgacgggccactccgtgttttggcgtatgagtttgcaacgatgggctctttgcatgacatactccatgggagaaaaggtgttaaaggtgctttgcccggtccggtgttggattgggcccagcgtgtgaagatcgcggtaggggctgcaaaagggctcgaatatttgcatgaaaaagtttctccaccactaattcaccgtgacatcaagtccagtaatgttctcctgttcgacgactacacagcaaagatagccgacttcaatctttccaaccaggctccggacacggccgcacggcttcactcgactcgtgtacttggaactttcggctaccacgctccagaatatgcgatgacaggtcagctcacacaaaagagtgatgtctatagctttggcgtggttttgttggagctcctcactgggagaaagccagtggatcactcaatgcctcgtggacagcagagccttgtaacgtgggccacacccagacttagcgaagacaaagtcaagcaatgtgtggatccaaagctgaaaggagagtaccctgcaaaggcagttgccaagatggccgctgttgccgctctgtgcgtgcaatacgaggcggactttaggccaaacatgggcatcgtggtgaaagcgctccaacctttgctcacggcccgagccgccccggcagcggagtaaattatttattttcgagtgct

SEQ ID NO: 6593 - DNA, 1428 bp, Selaginella moellendorffii
agcggcgcgccctggacggggcttcgatcagtgcctcccagtgcatggatgctcgcggcagctcggccgcgatcccggggagatttctccaggtaagtgagcgagagatctggtgtttgcggtgtttaggtcaggagcgcgcggcaatggtgccgctgctggagctgggagtgaggaattgagcggaattgtgctggcttgacccgggcgctggcgattcttccaggtgtagggtaaatattttgatctggggcgaggtgtagcgaagcaatgggatgcgttttctcgtcttgcgccggcaatgatatcacgaagccatcggatgctccgttcaccactgtgacaaatggcaaccctggtggtgctaaagcaaatgaaggagcaaatagagctggacaagctgccagagtccaaccgatcgctgttccaatgcttggcattgacgagctgaaagaagccaccgagaattttggtcccaagtcacttatcggcgagggatcctatggtcgagtttaccttgcggagttgcgaagtggtcaagctgcgataaagaagctcgaccagaattcacagcctgatcaggagttccttgctcaggtttccatggtgtcgagactaaaaaatgagaacgttgttgagctcattggatactgtgttgacgggccactccgtgttttggcgtatgagtttgcaacgatgggctctttgcatgacatactccatgggagaaaaggtgttaaaggtgctttgcccggtccggtgttggattgggcccagcgtgtgaagatcgcggtaggggctgcaaaagggctcgaatatttgcatgaaaaagtctctccaccactaattcaccgtgacatcaagtccagtaatgttctcctgttcgacgactacacagcaaagatagccgacttcaatctttccaaccaggctccggacacggccgcacggcttcactcgactcgtgtacttggaactttcggctaccacgctccagaatatgcgatgacaggtcagcttacacaaaagagcgatgtctatagctttggcgtggttttgttggagctcctcactgggagaaagccagtggatcactcaatgcctcgtggacagcagagccttgtaacgtgggccacacccagacttagcgaagacaaagtcaagcaatgtgtggatccaaagctgaaaggagagtaccctgcaaaggcagttgccaagatggccgctgttgccgctctgtgcgtgcaatacgaagcggactttaggccaaacatgggcatcgtggtgaaagcgctccaacctttgctcacggcccgagccgccccggcagcggagtaaattatttattttcgagtgcttaccatcgctgtcttgttcataggtaggcccttggttatcattttgtaagcatacgtacgacgatgcatt

SEQ ID NO: 6594 - DNA, 1855 bp, Zea mays
tccaaagacagaaaaaaaagaaagggaaaaaagggggtctgctgtggactgtgtggtcccgcagggcgcaccattcacccgtcttccgccgagacaccctgcacggctcgccgagacttcagtttactggagcacgcaccgcagcgtctcccccttctgctcatcctccgtccctccgtcggaagggctggcgctaagggacgatccctccgtccgcccgtccgttcgacgggacctcggttggtttcgtcggtcgctgggaggacaggtgacggaacggtgatatgaggcggtggttatgttgtaactgccactatgacgtcgaggaagatgaccacgccaaggaacaggccaaagctcagagcaataagaccgactccaagcagaagtcttcaaagcctcctggtagtcaacctgagccagagttctcccctcctacaattgatgtccctgaattgtctttggatgatttgaaactaaagactgatgattttggatcaagtgctctgattggtgaaggttcttatggacgagtatatcatgccactttggacgatgggagacaagcagcagttaaaaaacttgatgcatctgaaaatgagcctaatgatgagtttctcaaacaggtctcactggcatcaaagctaaaacatgaaaatcttgttgagatgttgggttactgtgtcgatgggaattaccgtatactcgcatatgaatttgcaaccatgggttcgcttcatgatgttttacatggaagaaaaggcgttcaaggtgcgcagcctggacctgtacttgactggatgcagagggtcaaaattgctattgaggctgcaaaaggtatagaatatctgcatgaaaaggttcagccttcaatcatccatcgggacatcagatcaagcaatgtactgctgtttgaggatttcaaggcaaaaattgcagactttaatcttttgaaccaagcaccagatatggcagctcgtctccattcaactcgtgtattggggacttttggatatcatgctcctgagtatgctatgactggccagctgacacaaaaaagtgatgtctacagctttggtgtggttcttttggaacttttgactggaaggaaaccagtagatcacacaatgcctcgaggtcaacaaagtttagtcacatgggctactccaaggttaagtgaagacaaggtgaagcaatgtgtagatcccaggttgaagggagaatatcctccaaagggagtcgctaagcttgctgcagtggcagctctatgtgcacagtacgaagcagagttcaggcccaacatgagcatcgttgttaaggcgctttcgcctctccttcaacaaagacctgcaccaaccaccgaagagccagctccacaacctgggagctgaaaccagtcacatgtgatgggacccctaggcataagccatctccgcaaccattcaatcagcacattctataaatcattgagagtattttgggtatttgttctgtagcgttctcagttgggtatagcatacatgaacttgcccctgctgtttgtggccacctagttcgtggcttgatgttggcgccgcacaatggtatatgaagttggttcgaagtttttttttaccttctctataccaataccaagtgaccaactgtttgtaggttttcataattcgcggcttgaagaatagatgcaggatggtctggatttttttttgtccgtggcgtggtgttgctgcctgacctacgtgatgtacttcctctcttccaaatcccaattcaccttttcttgttctaagctagaattatcaaactttgacttgtttatataaatatatttatggacgtctacaacagtatcaaa

SEQ ID NO: 6595 - DNA, 1681 bp, Oryza sativa
attaatactaataatccccttcccctcccataaggacggcggctttaactcgagcaggcaaccaggacgcggaggctgcgccaccgccgccgccgccgctgccgctgccggccacttcctccaccctcccctgagcctgtgcgcgcccaagctccacttcgtctcgcctctgaaccctagctccccctggtggtgtctcgaattctctcgtcgcgccatcgccatcgaacccggcggtgatttcgtttgcttggtgttcaagttgtgaggagacaatatgaggcagtggttttgttgtaattgccactttgacgaggaggatgaccatgggaaggaacgctccaatgctcagggcaataagatggatgccaagcaaaagtcttcaaaacctcctgctggtcaacctgaaccagagatagccccacttacaattgatgtccctgagttgtcactggaggacttaaaacaaaaaaccgacaattttggatcaaatgctctgattggtgaaggttcatatggacgagtataccatgccactttggatgatgggaggcaagcagcagttaaaaaattggatgcatctgaaaatgagcctaacgacgaattcttgaaacaggtctcccaggcatcaaggctaaagcatgaaaatcttgtggagatgttgggttactgtgtagagggcaattatcgtatactggcatacgaatttgcgaccatgggttcccttcatgatgttctccatggaagaaaaggagttcaaggtgcgcagcctggtcctgtacttgattggacgcagagggtaaaaattgctatagaggcagcaaaaggcttagagtacctgcatgagaaggttcagccttcaatcattcatcgggacatcagatcaagcaatgtacttctgtttgaggacttcaaggcaaaaattgcagatttcaatctcttaaatcaagctccagatatggcagcacgccttcattcaactcgtgtattaggaacctttggatatcatgcaccagaatatgctatgactggccagctgacgcagaagagtgatgtgtacagttttggtgtagttcttttggaactcctgactggaaggaaaccagtggaccacacaatgcctcggggacagcaaagtctagtcacttgggctactcctagattaagcgaagacaaggtcaaacaatgtgtagatcctaggttaaagagtgaatatcctccaaagggagttgctaagcttgctgcggtggcagctctttgtgtccaatacgaagcagagttcaggcccaacatgagcattgttgtcaaggcgctctctcctctgcttcaacaaaaaccagcagtgccagctgcctcagagccggcgccagcaactgagaattaagatgttagctcatggtagacctcccggcacatgccagttcgtaatcagcgcattctgtgtgtaattgcaattggtttaagaagtttcttttgtggggttctctgttggatgcagatcacatggatttctctttgccttttgttgctaccttaggtttgcggtttgagatttgtgctgtacattggtctgtaggtgcaagaatactgcttcctctcttttccacagcttcacttcagaggtgtcaaatactccagacatcgtttgaactttcaatagatgcaacatgttctgaatttc

SEQ ID NO: 6596 - DNA, 671 bp, Momordica charantia
actgctgtttgaggacttcaaggcaaaaattgcagacttcaatcttttaaatcaagcaccagatatggcagctcgcctccattcaactcgtgtattgggaacttttggatatcatgcaccagaatatgctatgactggccagctgacacagaaaagcgatgtctatagctttggtgtagtccttttagaacttttgactggaaggaaaccagtagatcacacaatgcctcgaggacaacaaagtttagtcacttgggctactccaagattaagtgaagacaaggtcaagcaatgtgtagatcccaggttgaagggagaatatcctccaaggggagttgctaagctcgctgcagtggcagctctatgcgtgcaatacgaagcagagttcaggcccaacatgagcattgttgtgaaggcgctttctcctctccttcaacaaagacctgcaccgaccgcctcagagccagccccggaacctgccagctgagaccagtcgcatgcgatcggacctctcggcacaagccatcttggaatcgagcacattctgtgtgtaattgagtgtgttttggatgttcgttttgtagcgttcccaattggataaagcatacatgaagttgcccctgccgttcgtggccgcctaggtaggttcgctgcttttatattggcgccgt

SEQ ID NO: 6597 - DNA, 1627 bp, Brachypodium distachyon
tgcccgcctggacgcctccttctcaggaaccagagggagataagaagaagtagacaagggaggtcattatgcgccggtggttttgctgcagtcagtttcatgctccatatcgtgaacatgaacatgaatttccttccagcccagatgagaaagaaggaaatggttttgcttccaaaagtgatccaacaaaagcacctcctccgattgaaatacctgaattgtcacttgatgaactgaaagaaaagactgacaattttgggtcgaaggctttgattggtgaaggatcatatggaagagtgtattatgctattctggacagtgaaaagcatgttgcagttaaaaagcttgatacttcatcagaccctgaacctgataatgaatttttgacacagatctcaattgtgtcaaaattgaagcatgaaaattttgtggaaatgcttgggtactgtgtggaaggaaatcaacgtctggtggcatatgaatttgctacaatgggttctttacatgacattttgcatggaagaaaaggtgtccctggtgcacagcctggcccagcacttgactggatacagcgggtcaaaattgccatagatgctgctaaagggctagcgtatcttcatgagaaggttcaaccttcgatagtccatcgggacatacgttctagcaacatccttctatttgaggactataaagcgaagattgcagattttaatctttcaaaccagtctcctgatatggctgctcgtttgcattccacccgtgtccttggaaccttcggctatcatgctcctgagtatgccatgactggccagctaactcagaaaagtgacgtatatagctttggagttgttcttttagagcttctaacaggaaggaaaccggtagatcatacaatgcctagaggtcagcagagtttagttacatgggcaacacctcgtttgactgaggatacagtgaaacagtgtattgacccaaggttgaaaggcgagtatcccccaaaaggcgtcgccaagcttgcagcggtggcggcactctgtgtgcaatacgaatccgagtttaggcccagcatgagcattgtcgtcaaagcgctctctccccttcttcagcataaaccgcaacctccaccagccattgctcctaacacaacggcttcagacatctgacctacccagttcaatatggatgtaaaaagagatggcatgccctcgttggtgccggtgcacgcctcattttacagtactgtctcgtgcttgtcagttggtaacgacatcgtgggccaataatgcataatcagcatggcttgatcagtacataggttgtctctgtaaccgcaagactccctttctccttcctcaccgtgtggttttgcctggtgctgtgctctattgcattcattggctcggtggagaatgtgttttgttggtgaccaccttaataatctttttcagggttacactgtaacatgggaacttggggaggttgttattggttcatggcttggttttgggggtttacccttttataatttgagctggaccccgtcgattgtgtaatctgtgaacgcgaagcttggtgtgtgcttgcttgcatatgtgtgagatatgaaaattggccacattcttgttca

SEQ ID NO: 6598 - DNA, 679 bp, Nuphar advena
ggaaccttcggctatcatgcaccagaatatgcaatgacaggtcagttgactcagaaaagtgatgtatatagctttggcgttgttcttcttgagcttctaactggcaggaaaccagtggaccataccatgcctcgagggcaacagagtcttgttacttgggcaactcctaggctgagcgaggataaggtgaaacaatgtgtagatccaaggttgaagggagaatatcctgccaaaggagttgctaagttagcagctgtggcagcactgtgtgtgcagtacgaatcagaattccgtccaaacatgggtattgttgttaaggcactgcagccacttctcctgcagaagcagcctcaatcggccgtgcctccaccttccactgggacataaacttcagaacatgctgtatctggatctgtgctttgagacgttttcagttgccatcccatgctgttttttatctattgaaggttctgtttcacctgggatttggttgttcttagtctgtcgttttagatttggcatgcttgcaccaaatttcagtgtttgtacatgctttccaacttttgactcttgtagctggcagttgcctgcattagagtggctgtgtatttggattggaaccggaatgatctggttgagtgatttaatggtgtatttgctgattttgtattttaaaaaa

SEQ ID NO: 6599 - DNA, 1733 bp, Panicum virgatum
ccgccctcccccacctctccccgctccgctccgctccgctcccgcgtctcctccacctcctcgtcgtcctcttcgcgcccgcccgggggatcgagcccgccgtcgacccgtctcaggcatacaagcaaggagaagtcaacagggaggtcattatgcgccggtggttttgctgcacgcagtttcatgcatcataccgtgaacatgaaaatgaactccccatcagtccagatgagaaagaaggaaatggttttgctgccaatagcaatcctatcaaagcaccacctcctattgaagtccctgaattatcatttgaagaactgaaagaaaagaccgacaattttggatcaaaggctttgattggcgagggatcatatggaagagtgtattacgctattctggacagcgaaaaacatgttgctgttaaaaagcttgatgcttcaacagaccctgaacttgacaatgagtttctgacacaggtatccattgcctcaaagctaaaacatgataattttgtggaaatgcttggatattgtgtggaaggaaatcagcgtttagtggcctatgaatttgctacaatgggttctctacatgatattttgcatggaagaaagggcgtaccaggtgcacagcctggcccagcacttgactggatgcagcgggttaagattgctatagatgctgctaaagggctagagtatcttcatgaaaaggtgcagccttcgatagtccaccgggatatacgttctagcaatgttcttctgtttgaggactacaaagcaaaaattgcagatttcaacctttcaaatcagtctccagatatggctgctcgtttgcattctactcgggtccttggaaccttcggctaccatgctcccgagtatgccatgacaggccagctaactcagaaaagtgatgtatatagctttggagttgtgcttttagagcttctaacaggaaggaaaccagtagatcatacaatgcctagaggtcagcagagtctagttacatgggcaacacctcgattgacggaggatacagtgaaacaatgtgtagatccaagattgaagggagagtatcctccaaagggagttgccaagcttgcagcggtggcggcactctgtgtgcaatacgaatctgagtttagacccagcatgagcatcgtagtcaaggcactctctccccttctccaacataagccgcaaccgccaccagtggcagctcctgatgcaaaagcaccttcaggtggctgactttcttagtccgccaagaatgtaaagagataaccacttcctcttcggtgcgttcgccggtcttgcagtactgccatgtgcatatgaagtactagttccacacagataacggcattgtgaactgatgcatgtcttcacttttatataggttgctacaaacttgaggcttttccttgtcattaccgtgtgctaagctgagtggtgtgttggcttttatggccgggtgaggtgtgcttggttggccagcagtcgtgatcacctaattaccgtgttctgggtctattctgtagaatgggaaggttctaacttctcatgcttgattccttttttgtttgttttgtctgattttgagctgatcccctcgtttgtactctctgattgcgaggcttctggcgtgcatgcttatgcatgagaattgagattatgcacattgttttcttccgcggaatacacagtagtgacatgagagctagattctgcgaa

SEQ ID NO: 6600 - DNA, 1907 bp, Zea mays
tgcctctgcttctccccacgccaccgaggcagtccaggccaggacagggtgccacaaaaccaaaaccaaaccccaccaccactccgcacgagatcatttcgccagctcatcgccaccgccctcctccgctcccgcgtctccttcccctcgtcgtcgtcgggttggtgggtccacctctcgccgtgccccgccgtcgacccgcctcagaatcaaagataagtcaaaggaaaggtcggtatgcgccggtggttttgctgcacgaggtttaatgcttcatatcgtgaacatgaaaatgaacgtcccatcactccagaggagaaagaaggaaatggtttttctgttaaaagtgatcccatcaaggcaccaccttccattgaagtccctgaattatcatttgaagaattgaaagaaaagaccgacaattttggttcaaaggctttgattggtgaggggtcatatggaagagtatattatgctattctggacagcggaaaacatgttgctgttaaaaagcttgacgcttcaacagaccctgaacttgataatgagtttttgacacaggtatccattgcctcaaaactaaaacatgataattttgtggagatgcttggatattgtgtggaaggaaatcagcgtctagtggtctatgaatttgcgacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaatattcttctgtttgaggactacagagcgaaaattgcagatttcaatctttcgaatcagtctccagatatggctgctcgtttgcattctactcgtgtccttggaaccttcggctaccatgctcccgagtatgccatgactggccagctaactcagaagagtgatgtatatagctttggggttgttcttttagagcttctaacaggaaggaaaccagtagatcatacaatgcctagaggtcagcagagtctggttacatgggcaacacctagattgactgaggacacagttaaacaatgtgttgatccaagattgaagggagaatatcctccaaagggagttgccaagcttgcggctgtggcggcactgtgtgtgcaatatgaatctgaatttagacccagcatgagcatcgtagttaaggcactctctccccttcttcaacataaaccgcaaccaccggcagccactactgacgctacagcaccgtcagatgcctgactttctcaaggagctatgaatcatgaatgttaagagaaccattttctcttcggtgcgtgcgctgttctagatcactatcgtgtgcctatgaagtgatcagtgtcacacaagcaacagcattgtgggctaaagcatatctccacctttacttagcttggtacaggcaggagacttcccattgtcattaccgtgttctatgctgagtcatgtgctgctttcgttggccgggtgaggtgtgcttgttggccagcggtcgtgaccacctaattaccgtgttatggtcatcactgtaacatgcgaaggttctaatttttttttcatggtttgtttttcctcgtttttttgatggatcgtttttccttattttgtttgcctgtcgtctgattttgaactggcgcctccactgtacaacccactctgaatcgcgagactactcgtgtgcatgtttatgcgtgagaattgtgatgagatcatgcgcattgattaactactcgtgtgcatgtttatgcgtgagaattgtgatgagatcatgcgcattgattttattttcctggaaatacgcaggagagctaaac

SEQ ID NO: 6601 - DNA, 1739 bp, Zea mays
caataatagggatgatcaccaaacgcattatttagaaaaccgccgggagctggaaagggcgaggcgagcggtgccggcggaggtcgacaggggggctacaggtagaaaggcgactccgccgctccagctgaaaatggcgaaatgatttgccttccccagaacccagctcagacagacgccgccctccgctgctctgctctgttcctcttcctccttgccccctgagcaggcgagttgccagcccggaaaccattcgaacaggccgagcccgcccgcctccattgctcgcgtgcgtcagagaaggaaggaaaagaagaactaggagcagagttgaataggtcattatgcgccggtggctttgctgcagtcattttgacacaccgtatctcgaaaacgaaaatggatttacgagcagtcctgatagaacaagtggtaatggaaacggtttaaatgcaaacagtgatcctgcaaaaccgccttctattgaagtacctgcattgtcattagatgaattgagggaaaagacggatgattttgggtccaaggctttggttggtgaggggtcatatggaagagtatattatgctgttctggaaaacgaacaacatgtggctgtcaagaagcttgatacttcagcagatcctgagcctgataatgaatttctagcacaggtgtccgttgtttcaagattgaagcatgaaaactttgtggacatgcttggttattgtatccaaggagatcaacgtctactggcttacgaattcgctacgatgggctctctacatgatattttgcacggaagaaaaggtgttgcaggtgcacaacctggacctgctcttgattggatgcaaagagtcaaaattgctgttgatgctgcaaaaggtcttgaatatcttcatgagaaggttcaaccttccatagtccatcgagatatacggtccagcaatgttcttttatttgaggattacaaggccaaaattgcagacttcaatctttcaagccaatctccagatatggctgctcgtctacattctactcgtgtccttggaaccttcggatatcatgctccagagtatgctatgactggccaactgactcaaaaaagtgatgtatatagttttggggttgtccttttagagcttcttactggaaggaaacctgtagatcatacaatgccaaggggccagcagagtcttgttacttgggcaacaccaaggcttggtgaggacaaggtgaaacaatgtgttgatccaagattgaatggagagtaccctccaaagggagtagcaaagctagcggcagtggcggctctctgtgtccaatacgaatctgagttcagaccaagcatgagcattgtagtcaaggcgttgtctcctcttcttgtgaatgcaccgtatcagccggctgctgctcctgatgtatcttcagatgcctgacagcatgagcaactgaaaacccatgtaaagaaacaccatttactgtcggtatgccattttttccacgaattattcatctttcgtaaaatcagaattgtgtgtgtgtttattggagaggaagggaagaggaaagagcaacgcatttgttttgaacccatgtacttcgtgcttgagagctgctgcagttgaaattaattacttaatgtacacacttgtgcatccgttgcccttcccctgtttcagtttcttttttttttcttttgaaatggtcatccttgtaatctacccctgctttgctgttgg

SEQ ID NO: 6602 - DNA, 1680 bp, Sorghum bicolor
gctggaaagaccggtgccggcggaggccgacaggcaggctacagccggaaaggcgactccgccgcccccgctgaaatggcagcgaaatgattttccctccccctggcagcaccagctcagtcacagcacagccagaccagacgccgccctcctcctgctctgctccctccgtcctccgtcttcctccttgcccctctggaggcgagccgccagcccagaaaaccaatcgaacagcgcgagcgaggccgcccgcctccactgctcgcccgcgtgcgtgcgtcccgatcccggcagcaggaacagaaaaggaaggaaaagaagaaccaagagcagagttgaataggccattatgcgccggtggctttgctgcagtcattttgacacgccatatctcgaaaacgaaaatggatttacaagcagtcctgataaaacaagtggaaacgatttgaattcaaatagtgatcctgcaaaaccgccttccatcgaagtacctgcattgtcatttgatgaattgaaagaaaagacagatgattttgggtccaaggctttggttggtgaggggtcatatggaagagtatattatgctgttctggaaaccgaacaacatgtggctgtaaagaagcttgatacttcagcagatcctgagcctgataatgaatttctagcacaggtgtccactgtttcaagattaaaacatgaaaattttgtggacttgcttggttattgtattgaaggagatcaacgcctactggcttatgaattcgctacaatgggctctctacatgatattttgcacggaagaaaaggtgttgcaggtgcacaacctggacctgctcttgactggatgcaaagagtcaaaattgctgttgatgctgcaaaaggtcttgaatatcttcatgagaaggtgcaaccttccattgtccatcgagatatacggtctagcaatgttcttttatttgaggactacaaggctaaaattgcagacttcaatctttcaagccaatctccagatatggctgctcgtcttcattctactcgcgtcctcggaaccttcggataccatgctccagagtatgctatgactggccagctgactcaaaaaagtgatgtatatagttttggggttgtccttttagagcttctaactggaaggaaacctgtagatcatacaatgccaaggggccagcagagtcttgttacatgggcaacaccaaggcttggtgaggacaaggtgaaacaatgtgttgatccaagattgaatggagaataccctccaaagggagttgcaaagctagcggcagtggcggctctctgtgtgcaatacgaatctgagttcagaccaagcatgagcatagtagtgaaagcattatctcctcttcttgtaaatgcaccatatcagccggctggtgctcctgatatatcttcagatgcctgacaacatgcacaactcaaaacccatgtaaagaaacaccatttattttcggtatgccatttttatgagttacttatctttcgtaaaatctgaattgtgtgtatttattggagaggaagggaaggaaaaggagtaatgcgtttattttgaacccatgtacttcatatgcttgagagctgctgcagaaaagttcattacttaatctacacatttgtgcatttggtgttcttcccctgtttcattccttt

SEQ ID NO: 6603 - DNA, 1689 bp, Sorghum bicolor
ggcggaggagctggaaagaccggtgccggcggaggccgacaggcaggctacagccggaaaggcgactccgccgcccccgctgaaatggcagcgaaatgattttccctccccctggcagcaccagctcagtcacagcacagccagaccagacgccgccctcctcctgctctgctccctccgtcctccgtcttcctccttgcccctctggaggcgagccgccagcccagaaaaccaatcgaacagcgcgagcgaggccgcccgcctccactgctcgcccgcgtgcgtgcgtcccgatcccggcagcaggaacagaaaaggaaggaaaagaagaaccaagagcagagttgaataggccattatgcgccggtggctttgctgcagtcattttgacacgccatatctcgaaaacgaaaatggatttacaagcagtcctgataaaacaagtggaaacgatttgaattcaaatagtgatcctgcaaaaccgccttccatcgaagtacctgcattgtcatttgatgaattgaaagaaaagacagatgattttgggtccaaggctttggttggtgaggggtcatatggaagagtatattatgctgttctggaaaccgaacaacatgtggctgtaaagaagcttgatacttcagcagatcctgagcctgataatgaatttctagcacaggtgtccactgtttcaagattaaaacatgaaaattttgtggacttgcttggttattgtattgaaggagatcaacgcctactggcttatgaattcgctacaatgggctctctacatgatattttgcacggaagaaaaggtgttgcaggtgcacaacctggacctgctcttgactggatgcaaagagtcaaaattgctgttgatgctgcaaaaggtcttgaatatcttcatgagaaggtgcaaccttccattgtccatcgagatatacggtctagcaatgttcttttatttgaggactacaaggctaaaattgcagacttcaatctttcaagccaatctccagatatggctgctcgtcttcattctactcgcgtcctcggaaccttcggataccatgctccagagtatgctatgactggccagctgactcaaaaaagtgatgtatatagttttggggttgtccttttagagcttctaactggaaggaaacctgtagatcatacaatgccaaggggccagcagagtcttgttacatgggcaacaccaaggcttggtgaggacaaggtgaaacaatgtgttgatccaagattgaatggagaataccctccaaagggagttgcaaagctagcggcagtggcggctctctgtgtgcaatacgaatctgagttcagaccaagcatgagcatagtagtgaaagcattatctcctcttcttgtaaatgcaccatatcagccggctggtgctcctgatatatcttcagatgcctgacaacatgcacaactcaaaacccatgtaaagaaacaccatttattttcggtatgccatttttatgagttacttatctttcgtaaaatctgaattgtgtgtatttattggagaggaagggaaggaaaaggagtaatgcgtttattttgaacccatgtacttcatatgcttgagagctgctgcagaaaagttcattacttaatctacacatttgtgcatttggtgttcttcccctgtttcattccttt

SEQ ID NO: 6604 - DNA, 1338 bp, Ananas comosus
cgactaatcatatggatggactccaaaggggttcaaagctttctgctgctgccaaacctgaaccccccaaagcacctcccccaatcgaagttcctgcactatcattggaagaattgaaagaaaaaactgacaactttggatcaaaggctttggttggtgaaggttcttatggaagagtctattttgcaactttaaacaatgggaaacaagtagcaataaaaaaacttgatgtttcatctgagcccgagtcgaacactgaatttctaacccaggtctcaatggtatcaagactgaagcatgaaaatgtcgttgaaatgttgagttattgtgtggaaggaaaccttcgtatactggcctatgaattcgcaacaatgggttccctccatgatgttttgcacggaagaaaaggagtccaaggtgcgcaacctggcccggtgcttgactggatgcaacgggttcgaattgcaattgacgcagccaaaggactggaatatcttcatgagaaagttcagccttctataatacatagggacattagatcgagcaacgttctcttatttgaggacttcaaagcaaaaatcgcggacttcaatctttcgaatcaggctcctgatatggctgctcgtcttcattctactcgtgtcttgggaacctttggctaccatgcaccagagtatgctatgactggccagctgactcagaaaagtgatgtgtatagctttggagttgttcttttggagcttctgactggaaggaaaccagtggatcacacaatgcctagaggccagcagagtctcgtcacatgggcgactccgaggttgagtgaggacaaggtcaagcaatgtgtagaccctaggttgaagggtgaatatccaccaaaaggagttgctaagcttgctgcagtggcagctctctgtgttcaatacgaagccgagttccggcccaatatgagcatcgtggtcaaggcattatctccactcctcgtaaataggcatgcggcaccacctcctgctgctgcacctgccgcaactccggatagttaaattctggggtttaagaacaaaaaagaacaagcggcatatcttgttggcatgtctttgtcacaacatcttgttttattgcgtgtgggtttccttcttacggcaaagagcttttatgttcagttgccaattattgttgtgtgagcaggcagagactgctgtgttttctcttctctctcggaagtcgtgcaatggtaagttgagtaaggagagttcttatatcataaacagctcaaatgttatgtacctcaaataaacacatctattcggcttaaacaacttgttattattatttgtt

SEQ ID NO: 6605 - DNA, 1546 bp, Phalaenopsis aphrodite
aattcgtgttcgatgtcttctgctttacttttctgctatagaactccttcctttctccttccgaccgcgtctcgtcttctatacttctcgtccccgaaactctgaattctagggcgggctatcttgatctctgttcttcataggagagaggaattttgtttgagtaaaaaaagaaacaaattcaagatgtcgtgctggctttgctgttcatgtaaggtggacgagtccgatgaccctcgtgagaatgaagccttaaagagcccaaagcgttatgtggatggtaggaacggagtgcaaaaaggttcaaagctctctgctgtagagaaaacagagagtcagaaggcaatactacctattgacgtacctgcattatctcttgaagaactgaaaaataaaacggacaactttggctcaacggctttggtcggtgaaggttcatatggaagagtatattttgctcttttaaatgatggtagacaagtggcaatcaaaaagcttgatgctgcacaagagcccgagtccaatgccgagtttctatcccaggttgctaaggtatcaaaattgaagcatgaaaattttgtccaattgctgggttactgtgccgaggagaatctccgcttgctatcctatgagtttgcaaccatgggctcattgcatgatattctgcacggtagaaaaggtgtgcaaggtgcacaacctggtcctgcgcttgactggatgcagcgtgttaggattgccattgatgcagctaaggggctcgagtatctccatgagaagatacagccttcgattatacatagggatatccggtcgagcaacattttgttatttgaggacttcagggctaaaatagcagactttaatctttcaaatcaggctcctgatatggctgctcgccttcattctacccgtgtcctcggaacctttggttatcacgctcctgaatatgccatgaccggacagttgacccagaaaagtgatgtttatagctttggagttgttcttctggagcttcttacgggaaggaaacctgttgatcatacaatgcctagagggcaacagagtctggttacttgggctactccacgattgagcgaggataaggtgaagcaatgtgtagatccgagattgaaggcagattatccacccaaaggagttgcaaagctggcagcagtggcggccttatgcgtgcagtatgaagcggagttcaggccaaacatgagcattgtagtgaaggcgctatcacccctcctaaataagcagactccacaacagccatctctttcaccaggggtcatggatacttgaattcccgcagcttccgcaagtcctttattttagaattttaggcattttcctatatttattatgatcgctcactggcatcaatcacagcagcaaagccttggctgcattaagcaggtttgcaaatttatccagggccgtagcgtgtttgtttctgtgtttgatcttttttgtaaaattacctacaatttgtatgcgtcaggctggaaatttctttgaggattaatattagtgttttttt

SEQ ID NO: 6606 - DNA, 1552 bp, Valeriana officinalis
gaaagggacggacttttcttcattccattcctcctcttttttgatttcttcttgcctcctgtctctccctccgatccacgaaccgaacagctcattttgcataagcttctccttccgacggagaaatccagacgcattcgccacatcgtacttccattgtgtgcatagaggataaaaccagaaaaggcgattattatttgcgaaagataacaagcatgcgcaggtggctttgctgtacttgtcaagtagaagataactacccatctaaccgcggcgaggttatcaaaagccccaagaataatacagatgggaaccagaaaggaggaagggcattatctccggtcaaagctgatgcaaagaagtcatcagtaccacctattgaagttcccttaatttctttggaagaactgaaagagaaaacagacaatttcggctcacaagcattgattggagagggttcgtacggaagagtgtattatgccgacttaagcagtgggaaatgtgtagccgccaaaaaacttgatgttccagctgaagcagagtctaatgatgattttctggctcaggtatccatggtttcgaggctgaagcatgataatgttgttgagttgcttgggtaccatgttgatggaaatattcgcattttagcatatgaatatgctaccatgggatctctacatgacgttttacatggtaggaagggagtgcaaggggcacaaccaggtccgccgctcgattggataacacgcgttaaaatagcggttgatgcagcaagaggattggaatatctgcacgagaaagttcaaccttctgtaatacacagagatataagatctagcaatgttcttctcttcgaagatttcagagccaaaattgccgattttaacctctcaaaccagtcccctgatatggctgctcgtcttcattctacccgagttttgggaacttttggttaccatgcaccagagtatgcgatgacaggacagttgacgcaaaagagtgatgtatacagctttggggtagtattgctagagctgcttactggacgaaaaccggtcgatcataccatgcctcgtggtcagcagagtctcgtcacttgggcgactccacggctaagtgaagataaagttaaacaatgtatagacccaaagctcactacttatcctcctaaagctgtcgcaaagctggcagctgttgcagcgttgtgcgtgcaatacgagtcggagtttaggccaaatatgagcattgttgtaaaggctcttcagccacttgtgagggctcctaccccaactattaccatcgattaatgaaatcgatcatgtggatttttacttccgattctttatccgttgttttcattacccttctcattctctctctgtatacctatatatctatatctacatataaacatggtttcctttcgaggcttgaggcttaggattgcattctttttcgtgaattgtgtcgtgcttgcattttcttatacataaactcgggaggtgaggaaaggaactggtatatatgtttatttgtttggctgtctaatttg

SEQ ID NO: 6607 - DNA, 1441 bp, Brassica rapa
  misc_feature (967)..(967): n is a, c, g, or t
  misc_feature (970)..(970): n is a, c, g, or t
  misc_feature (973)..(973): n is a, c, g, or t
  misc_feature (1119)..(1119): n is a, c, g, or t
  misc_feature (1142)..(1142): n is a, c, g, or t
  misc_feature (1180)..(1180): n is a, c, g, or t
  misc_feature (1186)..(1186): n is a, c, g, or t
  misc_feature (1192)..(1192): n is a, c, g, or t
  misc_feature (1215)..(1215): n is a, c, g, or t
ggcaaggatcgttcaccgagcagccgctttgttcggttagataaaccaagatctgtagacgatcttgatataggcaagaaagggaagatgcgtaggtggttgtgctgttcttgtcatgtacaagaatctaaccaccctagagttgaacataaccgatccagaacacctcctactcgccactacgactacggacgtaatgataagaaaccaccacctcctatgaagcctgccgtgttgaaggagcctcctcctattgatgtgcctacaatgtcattggctgagctcaaagaaaagactgagaactttggatcaaaggctttgattggggagggatcctatggaagagtgtactacgcaaagtttaatgatggcaaggccatggctgtgaaaaagcttgataatgcatctgaaccagagacaaacgttgagttcttgactcaggtctccaaggtttcaaggctgaataatgacaactttgttcagcttcttggttattgtgttgaaggcaatgttcgtgtccttgcttatgagtttgcaacaatgggatcattacacgacatcttacacggaaggaagggggttcaaggagcacaacctggtccaacacttgagtggatgcaacgagtcagagttgcagttgatgcagctaaaggattagaatacttacacgagaaagttcaacctgctgttatccacagagatattcgttctagcaatgtgcttctatttgaagacttcaaagccaagatagctgattacaatctgtcaaaccaagctcctgatatggctgctcgtcttcactccactagagttttggggacattcggttatcatgcaccagaatatgctatgacaggacagttgacacagaagagtgatgtttacagttttggagttgtgcttttggagctcctaaccgggagaaaaccggttgatcatacaatgcctcgtggtcaacaaagtcttntcnttnggctactccaaggttgagtgaagacaaagtgaagcaatgtgttgatccaaaactcaaaggggagtaccctcctaaagcagttgcaaagcttgcagcagttgcagctttgtgtgtgcaatatgaatcagagtttaggccaaacatgngcattgtagtaaaagctcttcanccactcttgaggtcttcaggagcagctgctcctcctcntaaccntcacanttgattattcttctttgtggttnttgcatattggattcattcatggcttcaaggtttcttttgtttctcatttttctatttacaaatgattttgtaaatggaagttattaaggaagaaatggtgagtagaggaacatggatttgttgtgttaaacgtttttgatggataatcacctaaaaattgtttgttgttttactattataagcctctcattcatggaatataatccgagatgtacacacttataa

SEQ ID NO: 6608 - DNA, 1444 bp, Pennisetum glaucum
ttcttcatcctttgccttccgctgaggagccgcccgccaagaacatccaccgatccgagcacgccagcatccgtcggctcccggcgcaccagatagataagaaagaagagcaggaagagtttgacagaccactatgcgccggtggttttgctgcactcatttcgacacaccatatcttgaaaataaaaaatggatttacaagcagtccggacagaacaagtggaaacggtcttacttcaaacagtgatcctgcaaaaccaccttccattgaagtacctgctttgtcatttgatgaactgaaagaacagacagatgattttgggtcaaagactttggttggtgaggggtcatatggaagagtatattatgctgttctggaacatggaaaacatgcagctgtgaagaagcttgatgcttcagcggaccctgagcctgacaatgaatttcacaatgaatttctagcacaggtctctgttgtttcaagattaaaacatgagaattttgtggacatgcttggttattgtattgaaggagatcaacgtctgttggcttatgaatttgctaccatgggctcactacatgatattttgcatggaagaaaaggtgttgcaggtgcgcagcctggtcctgctctagactggatgcaaagagtcagaattgctgttgatgcggcaaaaggtcttgagtaccttcatgagaaggtccaaccttccatagtccatcgagacatacggtctagcaatgttcttttatttgaggactacagggctaaaattgcagacttcaatctttcaagccaatctccagatatggctgctcgtctacattctacccgtgtcctcggaacttttggatatcatgctccagagtatgctatgactggccagctgactcaaaaaagtgacgtctatagttttggagttgtccttttagagcttctaactggaaggaaacctgtagatcatacaatgccaagaggccagcagagtcttgttacttgggcaacaccaaggcttggtgaggacaaagtgaaacaatgtattgatcccagattaaatggagagtaccctccaaagggagttgctaagcttgcggcagtggcagctctctgcgttcaatacgaatctgagttcaggccaagcatgagcattgtagtcaaggcattgtcaccccttcttgcaaatgcaccgtatcaggctgctactgctgctactgatacaccttcagatgcctgacaacggggctctccgtcgatggtgctgatgaaccggttaacatcatcgacgaactaaaagtgaccctctccgtaccatagggcgcacgcatgtacgagaagctcctagaggacacaaatagactttccaagtgtgatgttttggtgctgaaatttgaggcggtaagcatggcttgaggccaataatggtgcatcttctccagcagtgtg

SEQ ID NO: 6609 - DNA, 1470 bp, Raphanus sativus
  misc_feature (91)..(91): n is a, c, g, or t
  misc_feature (307)..(307): n is a, c, g, or t
  misc_feature (661)..(661): n is a, c, g, or t
  misc_feature (721)..(721): n is a, c, g, or t
  misc_feature (1414)..(1414): n is a, c, g, or t
gggataaacgcacccacaaaggcttaatctctcttttttctttcattctcgtttgtcgtctccatcaagcaacctcctctctctctctctntctctcgaggagacgatcgttacgcaacgaatccttgagagagagattgagagggacagcgagttttgttggtgacgcacggtgtggttagacaaaaaggagagccataaaaaaaagtttgtggagacaatgaggatgtgcaagtggatgtgctgtacatgtcaaattcaagactctaatgatgaggaacatttgaaatcttctcaccagcatcancatcagcatcattctgatgcaaatcacaagaatccaaaaccaccagctgttgttgcaaagcctgaggtggtgcggaaggaacctcttcccatcgaggttccttccttgtctttggacgaggtcaaggaaaagactgataatttcggatccaaggccctgattggtgaaggctcttacggaagagtttactacggcacattaaatgatggtgttgctgttgctctcaagaaacttgacgccgcacctgaagctgaatctgattccgacttcttgagtcaggtctccatggtttctagactgaagcatgagaatctcgttcaattgcttggtttttgtgttgatggaaagctccgngtccttgcatatgagtttgcaactatgggatctttgcatgacgtcttacatggtaggaanggagttcaaggggcacagccaggtccaacacttgactggacaacaagggtgaaaatagcagttgaggcagctaggggtttggaataccttcatgacaagtctcagcctcctgtcatccacaaagacataagatctagcaatattcttcttttcgaagactacaaaccaaagatttctgatttcaatctctcaaaccaatcgcctgataacgctgctcgtcttcactctactagagtcttgggaacttttggttatcatgctcctgaatatgcaatgactggacaattaactcagaagagtgatgtgtacagctttggggttgtacttctagaacttctgactgggaggaaacctgtcgataataacatgcctcgtggtcaacaaagtcttgtcacctgggcgacaccaagactcagtgaagataaagtcaaagagtgcattgatccaaagctagcggattaccctccaaaagcagttgctaagctagcagcggtggcggcattgtgtgtgcaatacgaagctgaatttagaccaaatatgagcatagttgtgaaggccctacagcctctcctcaaacctgctgcagctccatcttcttgaaaacttttatttcaatttgcaaactatcagaatctgtaatcactgcctttaccagtatatgaatgaagttggttttgtgagtgatgattaacnacaaagatgatattattatatgtttcattgataattgattatacatatgatattca

SEQ ID NO: 6610 - DNA, 1418 bp, Setaria italica
ttcttcatccttgcctttcgctgaggagccgccagccaagaacatccaccgatccgagcccgccagcctccattgcctcccggcgcagcaggaatagataagaaagaagagcaggaagagttcaacaggtcactatgcgccggtggttttgctgcactcatttcgacacaccatatcttgaaaatgaaaatggatttacaagcagtccggatagaacaagtggaaacggtcttacttcaaacagtgatcctgctaaaccaccttccattgaagtacctgcattgttatttgatgaactgaaagaaaagacagatgattttgggtcaaagactttggttggtgaggggtcatatggaagagtatattatgctgttctggaaaatggaaagcatgcagctgtgaagaagcttgatgcttcagcggaccccgagcccgacaatgaatttctagcacaggtctccgttgtttcaagattaaaacatgaaaattttgtggacatgcttggttattgtattgaaggagatcaacgtctgttggcttatgaattcgctacaatgggctccctacatgatattttgcatggaagaaaaggtgttgcaggtgcgcagcctggtcctgctctcgactggatgcaaagagtcagaattgctgttgatgctgcaaaaggtcttgagtaccttcatgagaaggtccaaccgtccatagtccatcgagacatacggtctagcaatgttcttttatttgaggactacaaggctaaaattgcagacttcaatctttcaagccaatctccagatatggctgctcgcctacattctacccgtgtccttggaacttttggatatcatgctccagagtatgctatgactggccagctgactcaaaaaagtgacgtttatagttttggagttgtccttttagagcttctaactggaaggaaacctgtagatcatacaatgccaagaggccagcagagtcttgttacttgggcaacaccaaggctcggtgaggacaaggtgaaacaatgtattgatccaagattaaatggagagtaccctccaaagggagttgctaagcttgcggcagtggcagctctctgcgttcaatacgaatctgagttcagaccaagcatgagcattgtagtcaaggcattgtcaccccttcttgcaaatgcaccatatcaggctgctgctgctactgatacaccttcagatgcctgacaacatgttcaattaagcattcatgtaaagaagtagcatttgtttctcggtatgccatttttatgaattattgtctttcatacatctgaataatgtgtgcttactgtagatgaagggaagaataggagtaatgcaatgatttttgaacacatgtacttcataatgcttgaaaactgctgcggttaatttatgcatttg

SEQ ID NO: 6611 - DNA, 549 bp, Amaranthus tuberculatus
cagttgacacaaaagagtgatgtgtatagttttggcgtggttcttttggaacttctaactggtcgtaaacctgtggatcatactatgcctcgtggtcaacagagtcttgtaacctgggcaactccgaggctgagtgaagacaaagtaaaacaatgtgttgaccctagattgaaggattatcctgcaaagggtgttgctaagttggccgctgtggcagcactttgtgtccaatatgaaggcgaattcaggccgaacatgagcattgtcgttaaagcactccaaccgctattgaaagccgcagctccagctccggatgcagcttaacactgaggattactttctagttcatcatgttgattgtgttagtaatttcatataatattcaatgtatttttgttcatcaccatatatatccaatttattttaattcattcccaagtttgatgacttttgtatgtgacattatttgtatgaaaatagaaagggcagtttgcacatttctttctgttcttgttgattttcgcagtttgtaccagtggcacatgtttc

SEQ ID NO: 6612 - DNA, 1048 bp, Cynodon dactylon
atggaagaaaaggagttcaaggtgcgcaacctggaccagcactagattggatgcagcgagtgaaaattgctgtcgatgctgcaaaagggcttgaatttcttcatgagaaagtacaaccttctatcgtccatagggatgtcagatcaagtaacatcctcttatttgaagacttcatggcaaagatagcagatttcaatctctcaaatcaggcacctgatatggctgcacggctgcattctacccgtgttttgggaacctttggatatcatgctccagagtatgcaatgactggtcagttaacccaaaaaagtgatgtatatagctttggagtagttctcttggaacttttgacaggtcgaaagccagtagaccatacaatgcctagagggcagcagagcctggtaacttgggccactccgagattaaccgaagacaaggtgaagcagtgtgttgatcctcgattgggtgaatatccagcaaaaggagttgcaaagcttgctgctgtggcagctttgtgtgtgcaatatgaagctgagttccgtcccaatatgagcattgtggtcaaggcattatctccactacttgtaaataagcagactccagctcctgcacaaccacctgctcttgagaattgatatatagaactaaccaaagttgcagatatgctagggacagtagcatggatagtgcataaaatggaccaatttgacttctcagatttcggcaactaactgcaaggaggacgtctttaggagagcaatggcaatggattatcttcaccgtgtcaacaagttctacataaaattttcagtctgaaactgagctttgttttgctcatgcatctgtatcttggctaaatgtaggatgaaaatatgtatactcccgagtcctgatttaagctacttgtaatgtggagatttcctgatgcttatcgcagtcaatatttggttgctgtgcggaagtggcttgatatctttttttttttaaaaaaaataataatttgtaaatgatggcatgtaaaagcagtgctgggccacagctttgtttc

SEQ ID NO: 6613 - DNA, 1542 bp, Pennisetum glaucum
gtttacactgaaggcatagatttaagaagtcaaaggagaggtcgttatgcgccggtggttttgctgcacgcagtttcacgcgtcatatcgcgaacatgaaaatgaacttcccgttagtccggatgagaaagaaggaaatggttttgttgccaatagtgaacctatcaaagcaccacctcgcattgaagtccctgaattatcatttgaagaactgaaagaaaagacagacaattttggatcaaaggctttgattggtgagggatcgtatggaagagtgtattacgctgttctggacagcgaaaaacatgttgctgttaaaaagcttgatgcttcaacagaccctgaacttgataatgagtttttgacacaggtatccattgcctcaaagctaaaacatgctaattttgtggaaatgcttggatattgtgtggaaggaaatcagcgtttagtggcctatgaatttgctacaatgggttctctacatgatattttgcatggaagaaagggtgttccaggtgcacagcctggcccagcacttgactggatgcagcgggttaagattgcaatagatgctgctaaagggctggagtatcttcatgaaaaggttcagccttcgatagtccaccgtgacatacggtccagcaatgttcttttgtttgaggactacaaagcgaaaattgcagatttcaatctttcaaatcagtctccagatatggctgctcgtttgcattctacccgtgtccttggaaccttcggctaccacgctcctgagtatgccatgactggtcagctaactcagaaaagtgatgtatatagctttggagttgttcttttagagcttctaacaggaaggaaaccggtagatcatacaatgcctagaggtcagcagagtctggttacatgggcaacacctagattgactgaggatacagtgaaacaatgtgtcgatccaagattaaagggagagtatcctccaaagggagttgccaagcttgcggcggtggcggcactctgtgtgcaatacgaatctgagtttagacccagcatgagcatcgtagtcaaggcactctctccccttcttcaacataagccgcaaccgccacggactgcagctcctgatgcaacagcaccttcagatgcctgactttctcagtctcaacaaaaatgtaaagagataaccatttccccttcgacgtgttcgctgtttttcagtactaccctgtgcaggcggagtgattagtgtcacacaaacaagtaacggcattgtggactaatgcatagcttatcctttacataggctgctacaaacaagaggcttttccttgtgattaccgtgtgttgagctgagtgatttgctgccttcgttggctgggcgaggttgtggttggccagcggtcgtgatcacctaattagtgttctgagtctatactgtaaattgggaaggttctaacctttcatggctttgattcctttttgtttgcgttgtctgattttgagctgatccccctgcatttgtacaatgagtctttggttgctgaggct

SEQ ID NO: 6614 - DNA, 1509 bp, Avena sativa
cccgggttgacccctcgaaggaatcagaggtatatagacaggaagagctaaaagggggccattatgcgccggtggttttgctgcactcagtttcatgcttcgtatcgtgaacatgaacatgagtttccttccagcccagatgagaaagaagaaaatgggtttgcttccaaaagtgatccaacaaaagcacctcctcccattgaaatacctgaaatgtcacttgatgaactgaaagaaaagaccgacaattttgggtcaaaagctttgatcggcgaaggatcatacgggagagtgtattacgctactctagacagcggaaaacatattgctgttaaaaagcttgatacttcagcagaccctgagcctgataacgaatttttgacacagctctcaattgtgtctagattgaagcatgaaaattttgtggaaatgcttggctactgtgtggaaggaaatcaacgactggtggcctatgaatttgctacaatgggttccctacatgatattttgcatggaaggaaaggtgtccctggcgcacaacctggcccagcacttgactggttgcagcgggtcaaaattgctatagatgctgctaaggggctagcatatcttcatgagaaggttcaaccttccatcgtccatcgggacatacggtctagcaatgtccttctatttgaggactacagagcaaaagttgcagattttaatctttcaaatcagtctcctgatatggctgctcgtttgcattccacccgtgtccttggaaccttcggctatcatgctcctgagtatgccatgactggccagctaacccagaaaagtgatgtatatagctttggagttgttcttttagagcttctaacaggaaggaaaccggtagatcatacaatgcctagaggtcagcagagtctagttacatgggcaacacctcgtttgactgaggatacagttaaacaatgtattgacccaaggttgaagggcgattatcccccaaaaggcgttgccaagcttgctgctgtggcagcgctctgcgtgcagtacgaatccgagttcagacccagcatgagcatcgtcgtcaaggcgctctctccccttctccagcacaaacctcaacctccgccagccgctgctcctgatactacggcttcagatgcctgacctacctgtttcaagcgcttggatgtaaaaagagtgcaacgcggcatgccctcgtatgaccttgtgcgtgagattttttacagtatattgagagtactaccccttgctttaccgagttcagcgacaggctactgtgtttttggcgagtgatatgcatgatgtgttgtgttggtgatcacctcagcctcagtaatcgtgctctgaacttgggaaggtcgtaagcttgtaagtagatcatcccttgacatttctgggtttgccattgtgattttgagctaacagtacacctgccgactgtaacctgttgaacctgaagcttgtgtgagacgtgagaaatgtttgatgcattct

SEQ ID NO: 6615 - DNA, 1509 bp, Avena sativa
cccgggttgacccctcgaaggaatcagaggtatatagacaggaagagctaaaagggggccattatgcgccggtggttttgctgcactcagtttcatgcttcgtatcgtgaacatgaacatgagtttccttccagcccagatgagaaagaagaaaatgggtttgcttccaaaagtgatccaacaaaagcacctcctcccattgaaatacctgaaatgtcacttgatgaactgaaagaaaagaccgacaattttgggtcaaaagctttgatcggcgaaggatcatacgggagagtgtattacgctactctagacagcggaaaacatattgctgttaaaaagcttgatacttcagcagaccctgagcctgataacgaatttttgacacagctctcaattgtgtctagattgaagcatgaaaattttgtggaaatgcttggctactgtgtggaaggaaatcaacgactggtggcctatgaatttgctacaatgggttccctacatgatattttgcatggaaggaaaggtgtccctggcgcacaacctggcccagcacttgactggttgcagcgggtcaaaattgctatagatgctgctaaggggctagcatatcttcatgagaaggttcaaccttccatcgtccatcgagacatacgatctagcaatgtccttctatttgaggactacagagcaaaagttgcagattttaatctttcaaatcagtctcctgatatggctgctcgtttgcattccacccgtgtccttggaaccttcggctatcatgctcctgagtatgccatgactggccagctaacccagaaaagtgatgtatatagctttggagttgttcttttagagcttctaacaggaaggaaaccggtagatcatacaatgcctagaggtcagcagagtctagttacatgggcaacacctcgtttgactgaggatacagttaaacaatgtattgacccaaggttgaagggcgattatcccccaaaaggcgttgccaagcttgctgctgtggcagcgctctgcgtgcagtacgaatccgagttcagacccagcatgagcatcgtcgtcaaggcgctctctccccttctccagcacaaacctcaacctccgccagccgctgctcctgatactacggcttcagatgcctgacctacctgtttcaagcgcttggatgtaaaaagagtgcaacgcggcatgccctcgtatgaccttgtgcgtgagattttttacagtatattgagagtactaccccttgctttaccgagttcagcgacaggctactgtgtttttggcgagtgatatgcatgatgtgttgtgttggtgatcacctcagcctcagtaatcgtgctctgaacttgggaaggtcgtaagcttgtaagtagatcatcccttgacatttctgggtttgccattgtgattttgagctaacagtacacctgccgactgtaacctgttgaacctgaagcttgtgtgagacgtgagaaatgtttgatgcattct

SEQ ID NO: 6616 - DNA, 1413 bp, Saccharum officinarum
cacgagcttctccccacgccaccgaagcaatccaggccaggacagggtgccacaaaaccaaaaccaaaccccaccacaccactccgcacgacgagatcatttcgccagctcatcgccaccgccctcctccgctccgctcggcttccgcgtctccttctcctcctcgtcgtcgtcgggtgggtgggtccacctctcgccgcgccccgccgtcgacccacctcagagcaaagataagtcaaaggcgaggtcggtatgcgccggtggttttgctgcacgcagtttaatgcttcatatcgtgaacatgaaaatgaacgtcccatcagtccagaggagaaagaaggaaatggttttgctgttaaaagtgatcccatcaaggtaccaccttccattgaagtccctgaattatcatttgaagaactgaaagaaaagactgacaattttggatcaaaggctttgattggtgagggatcatatggaagagtgtattacgctattctggacagtgaaaaacatgttgctgttaaaaagcttgacgcttcaacagaccctgaacttgataatgagtttttgacacaggtatctattgcctcaaaactaaaacatgataattttgtggagatgcttggatattgtgtggaaggaaatcagcgtctagtggcctatgaatttgctacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaacattcttctgtttgaggactacaaagcaaaaattgcagatttcaatctttcaaatcagtccccagatatggctgctcgtttgcattctactcgcgtccttggaacctttggctaccatgctcccgagtatgccatgactggccagctaactcagaaaagcgatgtatatagctttggagttgttcttttagagcttctaacaggaaggaaaccagtagatcatacaatgcctagaggtcagcagagtctggttacatgggcaacaccacgattgactgaggacacagtgaaacaatgtgttgatccaagattaaagggagagtatcctccaaagggaggtgccaagcttgcggctgtggctgcactctgtgtgcaatatgaatctgaatttagacccagcatgagcatcgtagttaaggcgctctctccccttcttcaacataaaccgcaacccccaccagccactactactgatgcaacagctccttcagatgcctgactttctcaacgagctatgaatcatgaatgtaaagagaaccatttcctcttcggtgtgtgcgct

SEQ ID NO: 6617 - DNA, 518 bp, Brassica juncea
ggtcagctgacgcagaagagtgatgtttatagtttcggagtggtgcttttggagcttttgactggtagaaagcctgttgatcatacgatgcctcgcggccaacaaagtcttgtcacttgggctactccaaggctgagtgaagacaaagtgaagcagtgtgttgatccaaaactcaaaggagactatcctcctaaagcagttgcaaagcttgcggctgttgcagcgttgtgtgtgcaatacgaatcagagtttaggccgaacatgagcattgtggtaaaagctctgcaaccattgctgaggtcatcaacagctgtagctgttcaatcacagggaatatgattcttctatgtaataatgagagattgatttctgttatcatgtgttggcatatcatatacaaattaatatgttcttcaaagtatttttgttgtctcttcttatatgtttggtggagttgtttcgattcttataaaaggttaaatatcagcaggaggatgaccaggcatgcttggacaggt

SEQ ID NO: 6618 - DNA, 1262 bp, Pteridium aquilinum
cacaaagcgcgcgcgccctcacaagacagttttctctgcgatttcttcttctgatgcaggtgcaataaaaaacatcgcaaccagatgatttacatgcttttgttgaacacatagcagttgagatatgaaagcaagtagacttgaattatagtacttgagtgattcaggcatgggaaattgttgctcttgcccctgtggttcacaagaggaggtgcctcctattactcaaaatgcttcaggagcaatcaatgggaacaatggtacaactggtgcatacacgattgattcggcagcaagcattgctaacgtgcagcctatagatgcacctctgatctcacttgatgtgctgaaggaggcgaccgataattttggaccgaagtctttaattggtgaaggatcatatggcagagtttacttcggacatgtggtcaatggacgagctgctgctatcaaaaagcttgatgaaataaccaacaagaagtggacaacgagtttctggcacaggtttctgttgtctccagattgaagcatgagaatgtggttgaacttatcggctattgtgttgagggcaatttacgagtccttgcttttgagtttgcaaccatgggatcgctgcatgacattcttcatgggcgtaaaggtgtgcaaggtgcacaacctgggccagttctggattggatgcagcgagtaagattgctgtaggagctgcaaggggtttggaatatttgcatgagaaggtgcagccacccatcatccatcgtgatgttagatcaagcaatgttctctttttgatgattttaccgcaaaaattgcagacttcaatctatcaaaccaggctccagacatggctgcaagacttcactcaacccgtgtattaggcacgtttggctaccatgctcccgagtatgcaatgacggggcagcttacgcaaaagagtgatgtttatagttatggggtggttctattggagcttctgacaggcagaaaacctgttgatcacaccatgccccgcgggcaacaaagcttagtaacttgggcaacaccccgacttagtgaagacaaagtgaagcagtgtgtggatccaaagctcaagtcagactaccctccaaaggctgtggcgaagatggcagctgttgcagcattgtgtgtgcagtatgaaccagagtttcggccgaatatgagtattgtcgtcaaggccatgcaaccgttactgacattgaggccagctccgagtgttacggaacctcaaaattgaagtgggt

SEQ ID NO: 6619 - DNA, 1597 bp, Hordeum vulgare
agagggaaaactcgttttgggctttaaagaaatccaagccagtaagtagctcgcttttccatcatcgtcgccaccacctccccttcttccctttccctcctcgccgtcgtcccagataggcagattgctctgctcagctcagttcagctcagggtctcctcctctcccaagaggccaggaccatccgcgccactatccccgcctggttcttgctccgccgcgccgtcgcgcgcagctgagggacaagaagcgagcaaaaggagaagtggatcgattggtcattatgcggcggtggttttgctgcgcacatgttgacacaccgtatgaggaaaatggggatgagtttccacacagtcctgaaagggcaaatggtaatggttttactcaaattggtgatcagggaaaagcacctccctccattcaagtacctgaattgtcatttgatgaactgaaagaaaaaacagatgattttgggtcaaaagctttggttggtgagggttcatacggaagagtgtattacgctgttctagagaacgggacacatgtggctgtgaaaaagcttgatacttcagcagaccctgagcctgacaatgaatttatcgcgcaggtctccgttatttctagattaaaacatgaacattttgttgacttgcttgggtactgtctggaaggagatcaacgcttactggcctacgaatttgctactatgggctctctacatgatattttgcatgggagaaagggtgttgctggtgcacagcctggccctgcacttgactggatgcaaaggatcaacattgctgttgatgctgcaaaagggcttgagtatcttcatgagaaggtccagccttctgtagtccatcgagacatacggtcgagcaatgtacttttatttgaggactacaaagctaaaattgcagatttcaacctttcaaatcaatcccctgatatggctgctcgtctacattcgactcgtgtgcttggaacctttggatatcatgctcccgagtatgccatgactggccaactgacgcaaaaaagtgatgtgtatagctttggggttgttcttttagagctcctaactggaaggaaaccagtagatcacacgatgccaaggggacagcagagtcttgttacctgggcaacaccaaggcttggtgaggacaaggtaaaacaatgtgttgatccaagattaaatggagagtaccctccaaaaggagttgccaagctcgcggcagtggcagctctctgtgtgcaatacgagtctgagtttagacctagcatgagcattgtagtcaaagcattgtctccccttcttataaataaaccacaacagcaaccgggagctccagacacaccttcagatacatgacaacatgtgcaatgcgaggttcatgtaaagtgatagcaattttacttggttaccctggcaggtactgcttgcccgtatttcttgtggtcatcgaggactactgcagttaatttgttattttgtgtctttttcactcatatacttcgttttttttgttctgtgttatgtgttcttcgggcagtacttgatgcttcctttcaccttgtaattgggtttctcatactt

SEQ ID NO: 6620 - DNA, 1583 bp, Brachypodium distachyon
gtttcttttttctttttgttaaagaaaccggagctcgccatccatcatcgccgccagctagggagtcctgagtcctcctctctctttgcctccttcctcgccgccgtccccagctaagctcaggtctcttccttctcctccctctctccgggactctccgagccccccacgccccgccgcacgcctccgtccgatcctcccttccccgtcgccgccgcgctcagctgatttgagggctgcccttgagggtgagaagaagtaagcaaaaggagaattcgatcggcaggtcatcatgcgtcggtggttctgctgtgctcacgtcgacacaccataccacgaacatggggacgggtttgtcaacagtcctgaaaaggcaaatggtaatggttttactccagatggtgatcatgggaaaacacctctacccattgaagtacctgaattatcatttgccgaactgaaagaaaagacggacgattttgggtctaaagctttggttggtgaaggttcgtatggaagagtatattatgctgtactagagaatgggaaacatgtggccgtgaaaaagctagatacttcagcagaccctgagcctgacaatgaatttatagcacaggtctccgttatctcaagactaaaacatgataattttgtggacatgcttgggtactgcctggagggagatcaacgcttattggcctatgaatttgccacgatgggctctctacatgatattttgcatggaagaaaaggtgttgcaggtgcacagcctggcccagctcttgactggatgcaaaggatcaaaattgttgttgatgctgcaaaggggcttgagtatcttcatgagaaggtccagccttctgtagtgcatcgagacatacggtctagcaatgttcttttatttgaagactacaaagctaaaattgcagacttcaatctttcaaatcaatctccagatatggctgctcgtctacattctacgcgtgtccttggaacctttggataccatgctcctgagtatgccatgactggccagctgactcaaaaaagtgatgtatatagctttggggttgttctcttggagctcctaactggaaggaaaccggtagatcatacaatgccaaggggccagcagagtcttgttacatgggcaaccccaagacttggtgaggacaaggtgacacaatgtgttgatccaagattaaatggagagtacccaccaaaaggagttgccaagctcgcggcagtggcggctctctgcgtgcaatacgaatcggagttcagacccagcatgagcatcgtagtcaaggcattgtcccccctccttgtaaataaaccacagcagcagcaacctacacctctggatgcctaaacaaacgaccgcaacgggagactcatgtgtaaaggaaatggcgagacggttaattcatttatctcctgtccttctacattcctgtccttgtgtttccagtttttttgtctgttctgttcttcaggcagcacttgtggcatcctttcaccttgtaattggattgttcatacttggctctcagctgttaataatagtaccttcttcattcttt

SEQ ID NO: 6621 - DNA, 1267 bp, Leymus cinereus x Leymus triticoides
ctggaaggagatcaacgcttactggcctacgaatttgctactatgggttctctacatgatattttgcatgggagaaagggtgttgctggtgcacagcctggcccagcacttgactggatgcaaaggatcaacattgctgttgatgctgcaaaagggcttgagtatcttcacgagaaggtccagccttctgtagtccatcgggacatacggtcgagcaatgtacttttatttgaggactacaaagctaaaattgcagatttcaacctttcaaatcaatcgccagatatggctgcccgtctacattctactcgtgtgcttggaacctttggatatcatgctcccgagtaattatttcaacttatatatctgaaatattttccatagttctgtataatatatttttgattgtggtcctgagtaataatctgttgggggtttcaccaaatcatcacagtaagaaagaattctagtgaacttcagttttgtgttttgcaactgaattttctttaacacttattatttaggtactgaatagatatggcaaactataataatcacctgattccaacatataagaggtgtcctatgccatgcaggtatgccatgactggccaactgacgcaaaaaagtgatgtgtatagctttggggttgttcttttggagctcctaactggaaggaaaccagtagatcacacgatgccaaggggacagcagagtcttgttacctgggcaacaccaaggcttggtgaggacaaggtaaaacaatgtgttgatccaagattaaatggagagtaccctccaaaaggagttgccaagctcgcggcagtggcagctctgtgtgtgcaatacgagtctgagtttagacctagcatgagcattgtagtcaaagcattgtctccccttcttataaataaaccacaacagcaaccgggagctccagacacaccttcagatacttgacaacatgtgcaatgcgagcttcatgtaaagtgataccaattttccttggttgccctggcaggtactgcttgcccatatttcttgtggtcatcgaggactactgcagttaattggttattttgtgtctttttcacccctatacttgttttctttgttctgtgttatgtgttcttcaggcagtacttgatgcttcctttcaccttgtaattgggtttctcatacttcgatctcagtggttaataatgccttaattctttgagtttgtattctagtgttgatagattaaaatgccacaggtgctagtgca

SEQ ID NO: 6622 - DNA, 776 bp, Pseudoroegneria spicata
  misc_feature (35)..(36): n is a, c, g, or t
tagtccatcgggacatacggtcgagcaatgtactnntatttgaggactacaaagctaaaattgcagatttcaacctttcaaatcaatcgccagatatggctgctcgtctacattctactcgtgtgcttggaacctttggataccatgctcccgagtatgcaatgactggccaactgacacaaaaaagtgatgtgtatagctttggggttgttcttttggagctcctaactggaaggaaaccagtagatcacacgatgccaaggggacaacagagtcttgttacctgggcaacacccaggcttggtgaggacaaggtaaaacaatgtgttgatccaagattaaatggagagtaccctccaaaaggagttgccaagctcgcggcagtggcagctctctgtgtgcaatacgagtctgagtttagacctagcatgagcattgttgtcaaagcattgtctccccttcttataaataaaccacaacagcaaccgggagctccagacacaccttcagatacttgacaacatgtgcaatgcgaggttcatgtaaagtgataccaattttcctcggttgccctggcaggtactgcttgcccatattccttgtggtcatcgaggactactgcagttaattggttattttgtgtctttttcactcctatacttgttttctttgttctgtgttcttcaggcagtacttgatgcttcctttcaccttgtaattgggtttctcatacttcgatctcagtggttaataatgccttaattctttgagtttta

SEQ ID NO: 6623 - DNA, 628 bp, Saccharum officinarum
ctttcaagccaatctccagatatggctgctcgtctacattctactcgcgtccttggaacctttggatatcatgctccagagtatgctatgactggccaactgactcaaaaaagtgatgtgtatagttttggggttgtccttttagagcttctaactggaaggaaacctgtagatcatacaatgccaagggggcagcagagtcttgttacttgggcaacaccaaggcttggtgaggacaaggtgaaacaatgtgttgatccaagattgaatggagaataccctccaaagggagttgcaaagctagcagcagtggcggctctctgtgttcaatacgaatctgagttcagaccaagcatgagcatagtagtcaaggcattgtctcctcttcttgtaaatgcaccatatcaggcggctggtgctcctgatatatcttcagatgcctgacaacatgcacaactcaaaacccatgtaaagaaacaccatttatttttggtatgccatttttgtgaattatttatctttttgtaagtcagaattgggtgtgtttattggagaagaaaggaagggaaaaagggtaatgcatttattttgaaaccatgtacttcgtatgcttgagagctgttgcagt

SEQ ID NO: 6624 - DNA, 1492 bp, Panicum virgatum
gaactagtccctctgcttcttcatctcttgcctttctctgacgagccgccacccaagaaactgcccagagcagacccgcccccattgcctcccggcgcagcaggtgtgggttccgcttccgctcctcctcggcttcggcgattcggggattccggtgttctttacatcaggaaagaagagcaagaagagttcagtaggtcaccatgcgccggtggttttgctgcactcattttgacacaccatatctcgaaaatgagaatggatttacaaaaagtccggacagaacaagtggaaacggtctaacttcgaacagtgatcctgcgaaaccaccttccattgaagtaccggcattgtcgtttgatgaactgaaagaaaagacagatgattttgggtcaaagactttggttggtgaggggtcatatggaagagtatattatgctgttttggaaaatggaaaacatgcagccgtgaagaagcttgatgcttcagcagaccctgagcccgacaatgaatttctagcgcaggtctccgttgtttcaagattaaaacatgaaaattttgtggacatgcttggttattgcattgaaggagatcaacgtctgttggcttatgaattcgctacaatgggctccctacatgatattttgcatggaagaaaaggtgtcgcagtgcgcagcctggtcctgctctcgactggatgcaaagagtcagaattgctgttgatgctgcaaaaggtcttgagtaccttcatgagaaagttcaaccttccatagtccatcgagacatacgatctagcaatgttcttttatttgaggactacaaggctaaaattgcagacttcaatctttcaagccaatctccagatatggctgcccgcctacattctacccgtgtcctcggaacttttggatatcatgctccagagtatgctatgactggccaactgactcaaaaaagtgatgtttatagctttggagttgtccttttagagcttctaactggaaggaaacctgtagatcatacaatgccaaggggccagcagagtcttgttacttgggcaacaccaaggctcggtgaggacaaggtgaaacaatgtgttgatccaagattaaatggagagtaccctccaaagggtgttgccaagcttgcggcagtggcagctctctgcgttcaatatgaatctgagttcagaccaagcatgagcattgtagtcaaggcattgtctccccttcttgtaaatgcaccctatcaggtggcggctgctcctgatacaccttcagaagcctgacaaaatgttcaactcaaatcatgtaaagaaatagcatttgtttctcggtaataccaattttatcaattatttgtcttttatacatctgaattatgtgtgtttactatagaggaagggggaagaaaggagtaatgcaatttttttaacacgtgtacttcatatgcttgagaacggctgcaattaatctttgcatctgtatgtttc

SEQ ID NO: 6625 - DNA, 911 bp, Linum usitatissimum
tatgcatccatgggttcatacacgatgtgttacacggaaggaaaggggtgcaaggggccgagccaggaccggctctgaactggagccagagagtgaagatagcctttggagcagcaaaagggttggggtatttgcacgagaaatgccagcctcctatcgtccatagggatgtaaggtcgagcaatgttcttctattcgatgagttcacctccaagattgccgatttcaacatctctagtgcctcgtccgataccgctgcccggttgcattcgactcgtgttttgggaactttcggctaccatgctccagagtacgcaatgacgggacaaataactcaaaagagcgatgtatacagttttggagtcgttctactcgaactcttgaccggtagaaagcccgtggatcacacaatgcctaaagggcaacaaagtctcgtcacttgggctacaccaagattgagcgaagacaaagtgaaacaatgtgtagacccaaagctaaacaatgaatacccaccaaaggcggttgccaagttagcagccgttgcagcactatgtgtccagtacgaggcagatttcaggccaaacatgaccattgttgtaaaggctcttcagccattgctcaacgctcgaccggccgccggcccggaccctgctgctgcacatggttgaacaaacttacatggttttttttcggcatctgtatcgatgtaatttcgattccatacgagaggaaaagggagaatttgtgtataaatagtttgatttttccgaatatatgtttataaagaaaaggtaacattacaacaaagggagagcagcagatgttaattgttaagtcaccataatcaaaatacttttgtatgtaacttgtaaatgctgggtaatgtcatctagggggtgtttataaggtgt

SEQ ID NO: 6626 - DNA, 1201 bp, Humulus lupulus
ctagagaagccgcaccaagagagatcaggactgttcctgtccaacccattgctgtgcctggcatttcaattgatgacttgaaagagatgaccgatagttttggcaccaaggccttgattggagagggctcatatggaagagtgtatcgcggtgttttgaaaactgggcaaaccgcagctatcaagaagttagattcaagtaaacagccagaacaagagtttttagctcagatctccatggtatcaagactaaaacatgaaaatgtcgtccagcttcttggttattgtgtggatggtccactccgagtccttgcatatgagtatgcttctaatggatctcttcatgatcttcttcatggaaagaagggtgtcaaaggagcacaaccaggtccagttctctcatggcctcaaagagttaaaattgctgttggagcagctagaggtcttgagtatttacatgaaaaggctcagccccatatcatacatcgtgatattaagtccagcaatatactactttttgactatgatgttgcaaaaattgctgatttcgatctctctaatcaagcccccgatgcagcagcccgacttcattctactcgtgttcttgggacttttggttaccatgctccagaatatgcaatgactggacagctgagttcaaagagtgatgtctacagttttggtgttgtcttgctggaacttttgactggccgtaaacctgttgatcatacattgccacgtggacaacagagccttgtgacatgggctacaccaaaactcagtgaagacaaggtgaagcagtgtgttgatgctagactgaatggagaataccctccaaaggcagttgcaaagttggctgctgttgctgccttgtgtgtgcagtatgaagccgatttccgtccaaatatgagcattgtagtcaaagctctacagcctttgttgaatcctcggccagcgccaagtccaggtccgccacagtgaagcgccactacaatgaatatgaattccccgacctctttatagtggaatataatgttaaagatttgttttgtacacagaatggttctactcaaagttttattggtttcccttggcttccatcatttggcctcttatggtcgttactagagctttgtaattgacattatcattctatagattgaattatacaagtgttgattatgatggagatggtttctttc

SEQ ID NO: 6627 - DNA, 1514 bp, Triticum aestivum
cttcgccgccgtcccagacaggcagatagctcagctcaggggctcttcctctccccaagaccatccgcgcccccatcctccgtctggttcttgcttcgctgcgccgccgccggcagctgagggacaagaagtgagcaaaaggagaagtcgatcgattggtcattatgcggcggtggttttgctgcgcacatgttgacacaccgtatcaggaaaacggggatgagtttcccaacagtcctgaacgggcaaatggtaatggttttactcaagttggtgatcagggaaaagcacctccctccattgaagtacctgaattgtcatttgatgaactgaaagaaaagacggatgattttgggtcaaaagctttggttggtgagggttcatatggaagggtgtattatgctgttctagagaacgggacacatgtggctgtgaaaaagcttgatacttcagctgaccctgagcctgacaatgaatttatcgcacaggtctccgttatttctagattaaaacatgaacattttgttgacatgcttgggtactgtctggaaggagatcaacgcttactggcctacgaatttgctactatgggttctctgcatgatattttgcatgggagaaagggtgttgctggtgcacagcctggcccagcacttgactggatgcaaaggatcaacattgctgttgatgctgcaaaagggcttgagtatcttcacgagaaggtccagccttctgtagtccatcgggacatacggtcgagcaatgtacttttatttgaggactacaaagctaaaattgcagatttcaacctttcaaatcaatcgccagatatggctgctcgtctacattctactcgtgtgcttggaacctttggatatcatgctcccgagtatgccatgactggccaactgacgcaaaaaagtgatgtgtatagctttggcgttgttcttttggagctcctaactggaaggaaaccagtagatcacacgatgccaaggggacagcagagtcttgttacatgggcaacaccaaggcttggtgaggacaaggtaaaacaatgtattgatccaagattaaatggagagtaccctccaaaaggagttgccaagcttgcggcagtggcagctctctgtgtgcaatacgagtctgagttcagacccagcatgagcattgtagtcaaagcattgtctccccttataaataaaccacagcagccaccgggagctccagacacaccttcagatacttgacaacatgtgcaattcgagattcatgtaaagtaataccaattttcctcggttgccctggcaggtactgcttgcccatatttcttgtggtcatcgaggactactgcagctaattggtttttttgtgtccttttcactcctatacttgttttgtttgttctgtgttctgtgttcttcaggcagtacttgatgcttcctttcaccttgtaattgggttgctcatacttcgatctcagtggttaataatgccttaattttttgagctgc

SEQ ID NO: 6628 - DNA, 510 bp, Scabiosa columbaria
tggtgcggcaaggggactcgaacatttgcatgagaagatccagccttccattattcatcgagatataagatccagcaatgttctattgtttgaagactttaaggccaagattgccgattttaacctttccaaccaagctcctgacatggctgctcgccttcattctacccgtgtccttggcacttttggttatcatgcacctgagtatgcgatgacaggacagttgacacagaaaagcgacgtgtatagctttggtgtggttctacttgaacttctgaccggtaggaaacctgttgatcacacaatgcctcgtggacagcagagtcttgtcacttgggcaactccaaggctaagcgaagacaaagttaaacaatgtgtagatcccaagctcaaactttatccaccaaaagcagttgcaaagatggcggctgtggcagcattgtgcgtgcaatacgagtcggagtttaggccaaacatgagcattgtggttaaagcccttcaaccacttct

SEQ ID NO: 6629 - DNA, 1750 bp, Physcomitrella patens
cagacctcctccgtcatttgccgcacaagcaccaccctctgctctctctctgctctctgctctctgctctctccctccctctccctcgatctgtgcgcacctcccctgctgttgttgctcctcctcctcgcaactccccctctctcccttccttccctccctgcctgcctcctcttcctcctctcctcctgcctgctccctcctcctcctcgtctccgtcccgtctctgctccagggcatgtgaagaagctggtgtgctgaagcaacgtgcgcagttttgattttgggattagaaatgggttgttggtgttggcccgacaaggaaccccacaatgaatctactgatccgcacagtcattaccttcctcacaatggaaacatgggtcaccaaggtatgtcgggatccactcccggcgaacaaccacagaggactgggcagggccctaccagggttcaacctatttctgctccacagttgtctctcgatgaaattagagactgcacagataattttggtccaaagtctttgatcggggaaggatcatacgctagggtatattatgcatcccttccagaccgcgttgctgccatcaaaaaattggacgtaagttcccagccggattcggagtttctttcgcaggtgtcacttgtttccagactcaagcacgagaacgtggttgagctgattggatactgtctggatgggcagctgcgggtgctcgcttacgaatatgctaccatgggatctctgcacgatattctccacggacggaaaggtgtgaagggtgctcagcccgggccagtgttggattggatgcagcgagtaaaaatagcagtgggagctgccaggggtttggaatatctacacgagaaggcacagccacctattattcatcgggacatcaagtcgagcaatgttttgctgtttgattcgtatgtggcaaagatagccgacttcaacttgtcgaaccaggcgcccgacatggctgcgcgtctacactccactcgtgttcttggaaccttcggctaccacgcaccggagtacgcaatgacgggccagttaactcagaagagcgatgtgtacagctttggcgtggtacttttggagcttttgacaggaaggaaaccagtggatcctacgatgccccgcgggcagcagagtcttgttacctgggccacaccgaggttgagtgaagataaggtgaagcagtgcgtggatccaaaattgaggtcggagtatcctccaaaggctgttgccaagatggcagctgttgcggcgttgtgtgtccagtatgagccagattttcgccccaatatgagcattgttgtgaaggcactgcaaccgttgttgtcagcaagacctgctcctcaaggaggagggtatcaaggagaatgagtggtgtaggccgtaatcacgtagccagtctgaaatttctctgtatgaattagtgaagacctcaattttcatgtggggtctttggattgttttgtgttaagttgctttcagattctatttattgtcagctcataagagacagactgtagcaggctgtgctgcttcagttggtgcaagaagcttgaggtatgccttctagtgtcttatatcttaagtgattttgatgtaggtttcacagggaaaattgtttggctgagagatggttttttgaagctagtatacactgagatgtgctgtgtgtgcaatggttggccacttgtcatttctataaatatactctctctttttccatgc

SEQ ID NO: 6630 - DNA, 686 bp, Pseudotsuga menziesii
gcttcattctactcgtgtgcttggaacatttggctaccatgctccagaatatgctatgacggggcaattaagtcaaaagagtgatgtttatagctttggagttgttctcctggagttgttgacaggcagaaagccagttgatcatacaatgccacgtggtcaacagagccttgtgacatgggcaactccaagacttagtgaagacaaagttaagcaatgtgttgattcaagattgaaaggtgactatccacctaaagcagtggctaagatggctgcagttgctgccttatgtgtgcagtatgaagctgatttccgccccaacatgagcattgttgtgaaagctctccaacctctactgaatgctagaccagttcctgctggcagaagtccttaattgtaacatcctgtatggttgattttgtcattcttcatggcattaaaacttctggggaagattttggtcatgtttggaacaattggaaacattgttaaatttgtgttaattgctgactacataactcctgaagtgaaatatctaattgtggacacgatcaaccatataatacacaagtatcaggcaaattctggaagtgagacttggtatagccactaatttattgaaattttgagatctatgctatatttgagctcttcaaatctttgttttctaatgttttaatgtaaag

SEQ ID NO: 6631 - DNA, 532 bp, Sequoia sempervirens
atgtctactttttgtacgactacttggcaaagattgctgattttgtatctgtctaatcaagctcctgacatggctgcacgacttcattccactcgtgtccttggaacatttggttatcatgctccagaatatgcaatgacaggacaacttagtcaaaagagtgatgtttacagctttggtgttgtacttctagagctgttgacagggagaaagccagttgatcatacattgccacgtggtcagcagagtcttgtaacttgggcaactccaagacttagcgaggacaaagtgaagcaatgtgtggatccaaggttgaaaggagactatccacctaaagcagttgccaagatggcagcagttgctgccttgtgtgtacagtacgaagctgattttcgcccaaacatgagtattgttgtcaaagctctccaacctctgttaaatgcaagacctgctcatgctaatgatagtccatctatctaatctgcaacatgtgtcaaaattagatcattccttacactgaccagatatgtga

SEQ ID NO: 6632 - DNA, 1170 bp, Taxus baccata
cagatgactatacagaaatctgctgatgcaggaagtcctttttgtcaaatggcaatatagcaggtaacaatggagatcacaagactgctgatgcaactaataaggatggcctagtactccaacctctacctattggagtacctgagatccctgtagaggaattgagggaagcgacagaaaactttggtccaaaaccactgattggagagggttcatatggtcgggtgtactactcaagcttaagcagtggccgccctgcagccattaagaagcttgataccagcaaacaatcagatcaagaattccttgcacaggtgtctatggtctcaaggttaaaacatgaaaatgtgctggaactggttggatatagtgttgagggcaaccttcgtgcacttgcatacgagtttgcgacaatggggtcattgcatgatattcttcatggtaggaaaggtgttaaaggagcacaaccgggtccagtactcacttggatgcagagggtaaaaattgccatagaagctgctaaagggcttgaatacctccatgaaaaggctcaaccatccattattcatcgtgacattaagtcgagcaacattttactttttgacgattgcacagcaaaaattgctgattttgatttatcaaaccaagcacccgacatggcagcacgactccattccacacgcgtgcttggaacatttggctaccatgctcctgaatatgctatgacagggcagctaagccaaaagagtgatgtttatagctttggagttgttctcctggagttgttaactggcagaaagccagttgaccatacaatgccacgtggtcaacagagccttgtgacatgggcaacacctagacttagtgaagacaaagttaagcaatgtgttgattccaaactgaaatccgaatatccgcctaaagcagtggctaagatggctgcagttgctgcattatgtgtgcaatatgaagctgatttccgtcccaacatgagcattgttgtgaaagccctcaacctctgttgaatgttaaatcagttcctaacagtggaagtccagcattgtaatgtcctgtatagtcaaatttgtattattctttacagcgtctaatatgtatgcaaatactgcaaacattttggtaatgttcggagagcgcatctgttcaaattct

SEQ ID NO: 6633 - DNA, 532 bp, Allium cepa
atgcaccagagtatgctatgactggtcagctaactcagaagagtgatgtgtatagctttggcgttgttcttttggagcttttaactggcagaaaaccagttgatcatactatgcctagagggcagcaaagcctggtcacttgggctactccaaggttgagcgaggacaaagtaaaacagtgtgtggatcctagattgaaaggagagtatccacctaaaggagttgctaagcttgcagcagtagccgcactgtgtgtgcaatacgaagctgaattcaggccaaacatgagcattgttgtgaaagcgctctcaccgctcctggctaacaagcaacctcatgcagctcctccccctcctgttgcagtccccgatatctgaactcatcaaaaactgatatattccatttaattcttctcatgtttaccattaattctatgtctgcgcttgtgtgtgtgtgtctatccgagtctaaattaaacttatgttgctactcttcaggctttcctcttaaaataacttatgttgagcttaag

SEQ ID NO: 6634 - DNA, 1462 bp, Raphanus sativus
  misc_feature (296)..(296): n is a, c, g, or t
  misc_feature (347)..(347): n is a, c, g, or t
  misc_feature (447)..(447): n is a, c, g, or t
  misc_feature (460)..(460): n is a, c, g, or t
  misc_feature (571)..(571): n is a, c, g, or t
  misc_feature (648)..(648): n is a, c, g, or t
  misc_feature (664)..(664): n is a, c, g, or t
  misc_feature (729)..(729): n is a, c, g, or t
  misc_feature (732)..(732): n is a, c, g, or t
  misc_feature (738)..(738): n is a, c, g, or t
  misc_feature (777)..(777): n is a, c, g, or t
  misc_feature (814)..(814): n is a, c, g, or t
  misc_feature (875)..(875): n is a, c, g, or t
  misc_feature (926)..(926): n is a, c, g, or t
  misc_feature (962)..(962): n is a, c, g, or t
  misc_feature (980)..(980): n is a, c, g, or t
  misc_feature (992)..(992): n is a, c, g, or t
  misc_feature (1002)..(1003): n is a, c, g, or t
  misc_feature (1007)..(1007): n is a, c, g, or t
  misc_feature (1010)..(1010): n is a, c, g, or t
  misc_feature (1067)..(1067): n is a, c, g, or t
  misc_feature (1070)..(1070): n is a, c, g, or t
  misc_feature (1073)..(1073): n is a, c, g, or t
  misc_feature (1085)..(1085): n is a, c, g, or t
  misc_feature (1103)..(1103): n is a, c, g, or t
  misc_feature (1122)..(1122): n is a, c, g, or t
  misc_feature (1157)..(1157): n is a, c, g, or t
  misc_feature (1166)..(1166): n is a, c, g, or t
  misc_feature (1175)..(1175): n is a, c, g, or t
  misc_feature (1181)..(1181): n is a, c, g, or t
ggggtagtcccagtaaattcaattccattcctcacgtttgtttctcctctctaatctctctaaccaacaaaaaacacaacaataaaaccaacattttcatacaaagatactcattacacgacaccaagagataaaagataagacatactttacaggctaacgatacttcaccaggctactttgttcggcttgataaaccgagagctgtagacgatctctatataggcaacaacaacaagagagggaagatgcgtaggtggttgtgctgtgtttgccacgtcgaagagccttacccnttcctgaaaacgagcacctgagtagcagccctaagcactatagtgataatnagaaaccacaggctgctgtgaagcctgataatgcgttgaaggagcctccatctatcgacgtccctgcgttgtcattggacgagctgaaagaaaagactgntaactttggatcnaagtgttgatcggtgaaggttcgtacggaagagcctactacgcaactttgaaagatggcaaagctgtggcggtcaagaagcttgataacgcggctgagcctgaatcgaacntcgagttcttgacgcaagtctcgagggtctcgaagctgcggaacgataactttgttcagctgtttggttactgcgtngaagggagtgttcgtntactcgcgtacgagtttgcgacgatgggatctttgcatgatgttttgcacgggaggaaaggagtncanggagcncagccaggtcctactcttgattggatccaacgtgttagnatagcggttgatgcggctaaggacttgagtattacangagaagtcaacctgcggtgatacatagagatgttcggtctagcaatgtgcttctctttgangactttaaagccaagattgctgattttaatctctcgaatcagtctcctganatggctgctcgtcttcactctactagagttttgggnacctttggttaccatgcnccagagtatgcnatgactggtnnactnacncagaagagtgatgtttatagttttggtgtagtgcttttggagctcttgactggtagnaanccngttgatcatacnatgccacgtggtcaacanagtcttgtcacttgggccnctccaaggctgagtgaagacaaagtgaagcaatgngttgatccnaaactcaanggagantatcctcctaaagcagttgcaaagctggcggctgttgcagcgttgtgtgtgcaatacgaatcagagtttaggccgaacatgagcattgtggtaaaagctttacaaccattgttgaagtcatcaaggtcatcaacagcagcagctactccatcccaggaaacttgattcttattatatgcgataatgggagattagtttccgtttcatgtgttgccatatcatatacaaatactgttattcagtgtgtctctttgttgaggtttatatcttcttatatgttt

SEQ ID NO: 6635 - DNA, 1631 bp, Pennisetum glaucum
gtccgactccgacgacgagctcatccatcagcagcgccggcgccgcaccgcaccgcaaacggctcgcccctccctcgagaataggtgtaaattacggtaaagcatatagtgatgtggcgtcgctgggtttgctgcaattgccaagtggatgaatccgatcagcgtggaaatgggcaattcaaggtcacaacgaacaatgctgacgggatgacaaagggattcaaagattctgctactggaaaagtcgagcctccgaatgctgctccccctatcaatatccccgttctatccttggatgaactggtggaaaaaactgatgattttgggtcatcggctttgataggtgaaggttcttacgggagagtatattatgccatccttgataatggaacaaaaatggcagtgaagaaacttgattctactgaaaatgaacccaccactgaattcttgacccaggtttcattggtttcaaggctgaagcatgaaaacttcgtagatatgttgggttactgcacagagcgtaatcttcgcattgtagcctatgaattcgccaccatgggttctctgcatgatgttctacatggaagaaaaggagttcaaggtgctcaacctggcccagctcttaactggatgcagcgagcgaaaattgctgttgatgctgcgaaaggacttgaatatctgcatgagaaagttcagccttcaattgtccacagggatattagatcaagtaacatcctcttatttgaggacttcaaggcaaagatagcagacttcaatctctcaaatcaggctccagatatggctgcccggttgcattctactcgtgtgctaggaacatttggataccatgctccagagtatgcaatgaccggtcagctaacccagaaaagcgatgtatatagctttggagtagttctcttggaacttttgaccggtagaaagcctgtagatcatacaatgcctagagggcagcagagcctggtgacctgggctacaccgagattaactgaagacaaggtgaagcagtgtgtagatcctcggttgatgggtgaatatccagcaaaaggactcgctaagctcgctgctgtagcagctttgtgtgtgcaatacgaagctgagttccggcctaatatgagcattgtggtcaaggctttatccccgctgctcgtaagcaagcagactcctacccctgcacccccacctgccgttgacagttgatgcatagaattaaccaaagctgcaaatatgataggaacaacggcttggatgatagacaaaatggatggattcacctctcggattcggacaactaactacatggaggacatctgcagtgataaccaaacatctgtggttctgcttctgcagcaatgttcatattcatctttcaagaaacatgaattctgaatcaagcctgcagtttggctggctataggaatcggatgcctgtattcgggtcaaatatacaaactggattgtgcatgtgcagatgcctaattgactcactagaattcattcgtattggagtaactcagatcagtcatttgacatatgtaatgttgactggaaaatcagtgctataattgacttagttaaaaaaaaaaaaaaaaaaaaacaaaagtactactacg

SEQ ID NO: 6636 - DNA, 437 bp, Cucurbita pepo
atgctatgacaggacagattactcaaaagagtgacgtttatagttttggcgtagttcttctcgaacttttgacaggacgaaagccagtagatcacacgatgcctaagggacaacagagtcttgttacttgggcaacaccaagattaagtgaggacaaggtgaaacagtgtgtagatcccaagctaaacaacgattacccaccaaaaagctatagcaaagttggcagcagttgcagccttgtgtgttcagtacgaggctgacttcaggccaaacatgacaattgtggttaaggctctccagccgcttctaattcttcaaaccaccgggacctgaagctcaacctcgtccatgagataatacacatttagttaacatacagccagcacaggcacagcactagcgcaagcacagtaatctccctgtagcttgtaatctta

SEQ ID NO: 6637 - DNA, 1098 bp, Ricinus communis
atgttgtgttgtggaggtgcagaggaggaacttgacggcccgcctgctaatcaatatacagctccacctaaaggaggcaataactatgctggcggcggcgagagagcagagccaaggagtaataatcctgccaaaagtggaactccgcaaaaggtcttaccaatagaagttccagcattatcattggacgagttaaacagattaacaggtaactttggcaccaaggctttgattggagaaggttcatatggtcgtgttttctatgccaagttaaataacggtgaggaggctgcaataaagaagctagataccagcacttcacaggaaccagattctgattttgcagctcagttatcagtggtttctaggcttaagcacgagcactttgtggagttgatcggatattgtttggaggcaaacaatcgaatcctaatttatcagtttgcaacaatgggttctttgcacgatgtactgcatggaaggaaaggagtgcaaggggctgaaccaggccctgcacttagctggaaccaaagagttatagttgcctatggtgcagcgaaagggctcgagtatctgcacgaaaaagttcagccttcagtagttcatcgcgatgttagatcgagcaatgtactactttttgatgatttcacgtctaaaatcgcagattttaacttgtcaagtgcgtcttctgatactgcagctaggctgcattcaacaagagtcttaggaacatttggctatcatgctccagagtatgccatgacaggacagataactcagaaaagtgatgtatacagttttggagtggttcttctagagctcttgacaggaagaaagccagtagaccatacaatgcctaagggacaacaaagtcttgttacttgggcaactccaagattgagtgaggacaaggtgaagcaatgtgtggatcctaaactaaacaatgactacccaccaaaggcagttgccaagttagcagcagtggcagcactctgtgttcaatatgaggcagatttcaggccaaacatgacaattgttgtaaaggcactgcagccacttctcaactcaaaaccagcagggccagagtctcacacataa

SEQ ID NO: 6638 - DNA, 1838 bp, Ricinus communis
ccgctaacaaagaaaacatctgcctctgttcctaaacagagaaacttaattcagacgataacaacaccaacaaaccctctttcttcctctgtttcttgcctccttttatatatctcctatgttatcattttcctgctcttttctgttcccacatttttcgccatcatttgaatctgccaattcaatatttctgtcatttcctctattgggttggtcagatctcaaagcttttaggacattttcaagtcaaatataccattttgacagattgatcaagagctgatatgttgtgttgtggaggtgcagaggaggaacttgacggcccgcctgctaatcaatatacagctccacctaaaggaggcaataactatgctggcggcggcgagagagcagagccaaggagtaataatcctgccaaaagtggaactccgcaaaaggtcttaccaatagaagttccagcattatcattggacgagttaaacagattaacaggtaactttggcaccaaggctttgattggagaaggttcatatggtcgtgttttctatgccaagttaaataacggtgaggaggctgcaataaagaagctagataccagcacttcacaggaaccagattctgattttgcagctcagttatcagtggtttctaggcttaagcacgagcactttgtggagttgatcggatattgtttggaggcaaacaatcgaatcctaatttatcagtttgcaacaatgggttctttgcacgatgtactgcatggaaggaaaggagtgcaaggggctgaaccaggccctgcacttagctggaaccaaagagttatagttgcctatggtgcagcgaaagggctcgagtatctgcacgaaaaagttcagccttcagtagttcatcgcgatgttagatcgagcaatgtactactttttgatgatttcacgtctaaaatcgcagattttaacttgtcaagtgcgtcttctgatactgcagctaggctgcattcaacaagagtcttaggaacatttggctatcatgctccagagtatgccatgacaggacagataactcagaaaagtgatgtatacagttttggagtggttcttctagagctcttgacaggaagaaagccagtagaccatacaatgcctaagggacaacaaagtcttgttacttgggcaactccaagattgagtgaggacaaggtgaagcaatgtgtggatcctaaactaaacaatgactacccaccaaaggcagttgccaagttagcagcagtggcagcactctgtgttcaatatgaggcagatttcaggccaaacatgacaattgttgtaaaggcactgcagccacttctcaactcaaaaccagcagggccagagtctcacacataattcaacatagatttcagactcattgtaatatgcagctttccccgtgaccattttcagtcccccttttcatccttctgcaacagcatctgtcaaggtctcaggatactaatcagagaagaaccataatcatatctacctttatacagaaactcaggaactacactgttagtatgcttgatagattgtatattagctgtttggaagacaagaatatgccttgtgtatcacttcaaaactgtagtcttttgtttgttcttgtctttaagcatgtgagaaatgttatggggatgcctgttgctcgtgcaggttgtgttgcagtataattcttccgctcgtcctctccaaccccaatttcatttatttgtttctgaacgtttctttaggaaaatcgttgttcggattagacattccgattgttgatataaaaatgctatataatattttgaacatttcttg

SEQ ID NO: 6639 - DNA, 1112 bp, Populus trichocarpa
ttgatatgttctgttgcggtggtaatgaggaggaaccacatggcccgccggctaatcaatacacagccccacctaaaggagcgaatatatatggcggcggcggtagtagcagcgcgagaggagagccaagaggtgccaatcaggccagaagtggagctccacagaaggtcttacccattgaaatcccatcaataccattggatgagttaaataggatgacaggaaactttggtaccaaggctttgattggagaaggttcttacgggcgagttttttatgccaagttaaaagatggcatgcctgctgcaattaagaagctagacaccagcagttcacaagaaccagattctgattttgaagcacagttgtctgtcgtttcaagacttaaacatgagcactttgtggagttgacggggtattgtttggaggcaaacaaccgaatcttggtttatcagtttgcagtgatgggttctttacatgatgtattacatgggaggaagggcgtagaaggggctgaaccaggtccagttctgaattggaaccagagagttaaaattgcttatggtgctgcaaaaggcctcgagtatctgcacgaaaaggttcagccttctatagttcatcgcgatgttagatcaagcaatgtcctactcttcgatgatttcttgtccaaaattgccgatttcaacctgtccaatgccaattctgacactgctgctcgactgcattcgactagggtcttgggaacatttggctaccatgctccagagtatgccatgaccgggcagataactcagaaaagtgatgtttacagtttcggagttgttcttctagaattgctgacaggaagaaagccagtagaccatacaatgccgaaagggcagcagagtcttgttacctgggcaacgccaagactgagtgaggataaagtgaagcaatgcgtggatcccaagctaaacaatgattaccctccaaaggcagttgccaagttagcagcagttgcagcactttgtgttcagtatgaagcggacttcaggccaaacatgacaattgttgtcaaggctcttcagccacttctcaactcaaaaccagcagggccagagtctcaggcataa

SEQ ID NO: 6640 - DNA, 2146 bp, Cannabis sativa
ttgatactaaggtgtcaaaggatcacaaccaggtctagttctctcatggtctcaaagagttaaaattgctgtaggagcagctagaggtcttgagtatttacacgaaaaggctcaaccccatatcattcatcgcgatataaagtccagcaatatactactttttgagtctgatgttgcgaaaatcgctgattttgatctctcgaatcaagcccctgatgcagcagcgcggcttcattctactcgtgttcttgggactttcggttatcatgctccagaatatgcaatgactggacagctgagttcaaagagtgatgtttacagtttcggtgttgtgttgctggaacttttgactggccgtaaacctgtcgatcacacgttgccacggggacaacagagccttgtgacatgggctacaccgaaactcagtgaagacaaggtgaagcagtgtgttgatgcaagactcaatggagaattccctccaaaggcagttgcaaagttggctgcagttgctgccttgtgtgttcagtatgaagctgatttccgtccaaacatgagcattgtagtcaaagctctacagcctttgttgaatcctcggccagcgccaagtccaggtcccccacagtgaatcgccacgaatgtgaattccctgaatctccgaccgctttatagtggaatataatgctaaagatttgttttgtacacatgatggttcttctattcaatgttttattagttttccttcatcatttggcctcttatggttcttaaattatcattgaactggagctttgtaattgacatgagcattctatagattgaattatacaaagtattgatgttatttgaaacttagtcttgaggatcataaccataacataaaaatgataactttgatattaaaaacagaacaagtggttccacagataatagatttcagttcacaaaaattcaaattccttaatagttatgatcacaaaaatcagttctttttctcttgaatagattttcctttgcaatgaggggattcctagtaattctcacaagctaaaatgacctaaagaggggaaggaataaccccagaactgtacacacaaccagctgtgagggtgcccccatcccccacaaccccacaagatctacaagcaaagtaactcaaaagttcaataaaaaaagaaaaaaaatcatcttcactcatttccgttcgctttgctgtacttcgtctcaaatgaaggcggaaccaagtatttcaaatacttaagaaaaatgcaacctttgccaattggcttatgttcatcaaattctatacatggagatgagctaaacatcatcagtcttatctccccttgttccttctgataggccttgtatctgggttgtcgctcttatctgtatcggaagtctctgtctgggactcggccaatgttgcattactcttacggtgtctacgagcctgtcaaatccaatcagatcatgttaagagtgttttgaaaagcatgtctaggacaacccaacatagaaaaatgactatatatcagttgatactctttcaaattgtttaagaaacaaacctctcgcggtatgggatattcctctgattcaagcattcgaacaacttgacccattttaggccttctgtcagcatcaggatctaaacacctcaaagcagtcaaaagggctcttttaaggtcacttgttgatggtctattatcgattttaggatccaccacctcttccgaacgcctatttgcaaccatcatcttcagccagtccactagattcacctacaagaagaaccatcctagcagatgttatattaaagaagaagtgaatgtagaacttaacttactatctatagaaaaacatttatgcatacctcttgtgatggtcgaccataatcaacggggtctcttccagtaattgcctctaagagcacaacaccgaaactataaacatcactcttctcatttaaaaggccagaattggcatactctggagccacatacctgaaagttaattaaaataacaaaataaaaatgaagttctttccattcatcatgtttgaagtcaatcctaatcttaatttagaactcttaaaagaagaatgactaacccaaaggtacccatgaccctagttgtaatgtgactc

SEQ ID NO: 6641 - DNA, 1369 bp, Pteridium aquilinum
gagagagagagagagagagagaaaagccttcggaatctaagcagccaggaggatcttgtcgtgaaatgcgtgatccctgaagcgtcctaatcatggccagtgtttttgctgcgacaaggaagaagaatacgtcaagccttccgatcacccgtacaatcactcaccagctggtggcaaccctgcagggtatcctggtgcccagaaggtcaatccagcagttcgaaacccagttgcgcagacagtccagcctattgatgccccagctatatccctggatgaattgagggaggcaactgagaattttggaacaaatgcattaataggtgaagggtcttatgggcgagtttatttggcaaagctgaaggatggcagatctgcggctgtcaagaaacttgatgtcagcaatcagcaagaacctgacaacgagtttctagtccaggtgtcgagagtttcgaggctgaagaatgagaatgtggttgagcttattggatactgtcttgatggtaaccttcgagttttggcatatgaattcgcaacaatgggctctttacatgatattctacatggcaggaaaggtgttcaaaatgcacagccagggcctgtccttgactggatgcaacgggtgaaaattgcagttggagctgcaaggggcttagagtacttgcacgagaaagtgcagccttccataattcatcgtgatatcagatctagcaatgttttactctttgacgattacactgcaaaaattgccgattttaatctttcaaatcaggcacctgatatggcagcacggctccactcgactcgtgttcttgggacttttggttatcatgctccagagtatgcaatgacaggtcacttgacacaaaaaagtgacgtttacagctttggagtagttctattagagctactcactgggagaaagccagttgatcacaccctcccacgtgggcagcaaagtttagttacttgggcaactccacgactaagtgaagacaaagtcaagcagtgtgtggatcctaagctgaagccagattatccaatcaaggcagttgccaagatggctgcggttgcggcattgtgtgtgcagtatgaggcagattttcgtccaaatatgagcattgttgtgaaggccttgcaagcattgcttactcctaggccagcgccgggtgcatctccagcttgaatcggaggcaagatcgtgtactgtggtgctgccttaagaattatatttttgctttgtaatcacaataattttgatagtcaagtttggtcgttctcatacatcgccatgatgttgatcatggttgtaaaagttagcctcacctatttgtgagacactctcaacgataatgcattccaagttttg

SEQ ID NO: 6642 - DNA, 1574 bp, Zea mays
ccgcattcgggacgaagccaccaacgacgagctcagcagcgccgacgccgcaacgacaaccagagcaccccgcactgtggagaattcatgtaaattatattaaaaggtagcaatgtggcgccgctgttgctgcaattgccaagtggatgaatccgaccagcatgaaaatgggcatgtcaaggccacaatcaacaacattgatggggcaataatggggttgaaagattctactactggaaaagtcgagccgcaggatgctgctccccaaattgatatccctgttctatccttggatgaactgatagaaaaaactgatgactttggttcaacggctttgataggtgaaggttcttatgggagagtgtactatgcgattcttgataatggaacaaaaatggcagtaaagaaacttgattctactgaaaatgaacccactgctgaattcttgacccaggtttcattggtttcaagattgaaacatgaaaactttgttgacatgttggggtactgtatggagcgtaatcttcgcatagtagcctatgaattcgccaccatgggttctctgcatgatgtactacatggaagaaaaggagttcaaggtgctcaacctggcctggcgcttgattggatgcagcgagtgcaaattgctgttgatgcggcaaaaggacttgaatatcttcatgagaaagttcagccttccattgtccatagggatattagatcaagtaatatcctcttgtttgaagatttcaaggcaaagatagcagactttaatctctcaaatcaggctccagatatggctgcccggttgcattcaactcgtgtcttgggaacctttggatatcatgctccagagtatgcaatgaccggtcaactaacccagaaaagtgatgtatatagcttcggagtagttcttttggagcttttgacaggtagaaagccagtagaccatacaatgcctagagggcagcagagcctagtaacttgggctaccccaaggttaactgaagacaaggtgaagcagtgtgtagatccacggttgatgggggaatatccggcgaaaggactcgctaagcttgctgctgtagcagctttgtgtgtgcaatatgaagctgaattcgcccaaatatgagcattgtggtcaaggctctgtctccactactcgtaacaaagcagactccatcacctgttgttgacagttgacgtacaaaattaacctaagttgcaaatatgagcggcaacagttgggacactacggacatttgatcggttcacctcagtcacagatttcaaacactaactgcatggagatggagggcatctttagtactgcattaacaactttgcatctgcggttctacagcatgtgcaaggcaacaatattccttttcatctctcagtaaatgccagtatcaaggagactactgaaatattcagtgatcaacattgagacttttttttttttgcaaagatgcggaatggtaaaagacccttcttttggtgtcacaaacagcaatgggatctcccagtatacatgttcgactcagaaaccgtaacggtaaaaaaattccact

SEQ ID NO: 6643 - DNA, 1412 bp, Cedrus atlantica
atctccggatattgcgtagaagtggcttcaggtattgggctacaagaatacgccgagcttctctaggcagagtcatgaggtgcttcagttgctgcactgcagacgatattcacaagtcagctgatagtggaagtccctttctatcaaatggcaatgtaacaggtaacagtgggcgtcacaagggtgcagaaactagtaaggatggacaaatcatacaacctctactcattgaagtacctcagattcctatagaggaattgagggaagtaacagataactttggtccaaaatcattgattggagagggttcctatggtcgggtgtattattctgtcttaagaagtggtcgtactgcagccattaagaagcttgatacaagcaagcaaccgatcaagattccttgcacaggtgtccatggtttcaagattgaaacatgaaaatgtattggaacttgttggatattgtgttgagggcagccttcgtctgcttgcatatgaatttgcaacaatgggatcgttgcatgacattcttcatggtagaaaaggtgtaaggggagcacaaccgggtccagtgctcacttggatgcagagagtgaaaatagctgtagaagctgctaaaggtcttgagtacctccatgaaaaagctcagtcgcccattattcaccgtgacataaaatcaagcaatatattactttttgatgattgcacagcaaagattgccgatttcgatgtatcaaaccaagcacctgacatggcagcacggcttcattccactcgtgtgcttggaacatttggctaccatgctccagatatgctatgacgggacaactaagtcaaaagagtgatgtttatagctttggagttgtcctcctggagttgttaactggcagaaagccagttgatcatacaatgccgcgtggtcaacagagccttgtgacatgggcaactccaagactcagtgaagacaaagttaagcaatgtgttgattcaagactgaaaggtgactatccacctaaagcagtggccaagatggctgcagttgctgccttatgtgtgcagtatgaagctgatttccgccccaacatgagcattgttgtgaaagccattcaacctctactgaatgctagaccagttcctgctggcaggagtccataattgtaacattctgtgtggttgattttgtcattctttatggcataaaattgtgtgggagattttggtcatgtttcaaacgattggaaacattgttaaatttgtcttaatttctgattacataattcctgaagtggaatatctaaatgcggaccctatcaaccacataatacataagtgtcagggaaattttagaagtgagactcggtatacccatttatttattggaattccgagatctttgctatatttgagctcttc

SEQ ID NO: 6644 - DNA, 1360 bp, Cephalotaxus harringtonia
tcatcattgcatatgcttaaacaattgggttatactttctttctgcacagagctcgctgcccacaaaagtacccattccaccttggaccctgaaggactttaggcactgggcgggaagagtacggcgagtttctgcaggtagaatcatgaggtgttttggctgctggacggcagatgacattcagaaatctgctgatgcaggaagtcccttcttgtcaaatggcaacatggcaggtaacaacggagctcacaaggctgccgatacaactaataaagatggactagtcctccaacctctacctattggagtacccgagatccctgtagatgaattgagggaagcaacagataactttggtccaaaatcactgattggagagggttcatacggtcgggtgtactactcaagcttaagaagtggccgacctgcagccattaagaagcttgataccagcaagcaatcggatcaagaatttcttgcacaggtgtctatggtttcaagattaaaacatgaaaatgtgttggaactggttggatattgtgttgagggcaaccttcgtgcacttgcatacgagtttgcaacaatggggtcattgcatgacattcttcatggtaggaaaggtgttaaaggagcacaaccgggtccagtactcacttggatgcaaagggtaaaaattgctatagaagctgctaaagggcttgaatacctccatgagaaggctcaaccttcaattattcatcgtgacattaagtcaagcaacattttacttttcgatgattgcacagcaaagattgctgattttgatttatcaaaccaagcacctgacatggctgctcgactccattccacccgtgtgctcggaacatttggttatcatgctccagaatatgctatgacagggcagctaagccaaaagagtgatgtttatagctttggagttgtcctcctggagttgttaactggcagaaagccagttgaccacacaatgcctcgtggtcaacagagccttgtgacatgggcaacacctagacttagtgaagacaaagttaagcaatgtattgattcaaaattgaaatccgactatccacctaaagcagtggctaagatggctgcagttgctgcattatgtgtgcaatatgaagctgatttccgccccaacatgagcattgttgtgaaagcccttcaacctctgttgaatgttaaatcagttcccaacagtggaagtccagcattgtaatgtcctgtatagtcaaatttgtattattctttaaagtgtgtgctatgcaaatactgcaaacattttagtcatgttcggagtgcagatatgtttaaattctcttaattataaatgactttctg

SEQ ID NO: 6645 - DNA, 770 bp, Brassica napus
gcgtgcaaggggctgagccagggccggtgctgaactggaaccaaagggtcaagattgcgtatggagcagccagggggcttgagttccttcacgagaaggtccagccatcagtagtacacagggacgtaaggtcgagcaatgtcttgttgttcaatgactttgtggccaaaatggctgatttcaacttgaccaacgcatcctctgattcagcggctaggcttcattctactcgagtcttgggaaccttcggctatcacgctccagagtatgcaatgacgggacagataacacagaagagtgatgtgtatagttttggtgttgtgcttttggagctcttgacgggaagaaaacctgtagatcataccatgcctaaaggccaacaaagtcttgttacttgggcaacaccgagactaagtgaagacaaagtcaaacaatgcatagatcctaagcttaataatgatttccctcccaaagcagtcgccaagttggcagctgtggcggccttgtgtgttcagtacgaggcagacttccgacccaacatgacaatcgttgtcaaagcacttcagcctcttcttaactctagaccagccggtcctgagtctacttcctaaataacagatttaccatctgtcttgtttttgtgttttgttattattgttatggctatttttttctcctttctgtgtcagataactatgattattggttataagatgctatttaatcgaatgtaacttatatttttattgttataaagctctctttcttta

SEQ ID NO: 6646 - DNA, 1979 bp, Ceratodon purpureus
gcggaagccggagaagcggtcaagattgatccaatcccggcgagcttcgcagcctcggcctgcctggagccgtcttctcgcacactgcatcatcgccgttctccggagctcccccaccagctaccaagcacccaacaacacccacgctcgccacacaaagctcgccaccgagcaactccactcttgtgcgagtactcgccacttcgatctgctgcttctcctccgcgctcgccgtccgccaggttttggagtgtatgtgcttgctgagcatgtgaaggagctgatattgtggagaaagcacgcggttctgattccgtctacagagatgggttggtgttgctgttctgctgaagaggaagattttaataaagtttcaaatgatgcgcacaatcaattctctggtcacaatgggaaccctggtcaccaaggtaatcagcggccacaaggggatcaaccccagagggctggtcaggcgcagaggcttcagcccattgcagctccgcagttgtccattgacgaaataagagaatgcactgataatttcggaccaaagtcattgattggcgaaggttcatatggaagggtgtattatgctcaacttcaagaccgcgtggctgctatcaaaaaattggatgctagtgcacaaccggattcagagtttctgtcacaggtctcgcttgtgtcgagattgaagcacgagaacgttgtggagctcatcggttattgtttggatggacaactgcgggtgctggcttatgaatatgctaccatgggatcccttcatgatattctgcacggaaggaaaggtgtaaagggtgcccagccagggccagtcttggattggatgcagcgtgtgaaaatagctgttggagctgcaaggggtttggaatatttacatgagaaggcgcagccatctattattcatcgggacataaagtctagcaacgtcctgctatttgattcatatgtggcaaagatcgctgatttcaacttgtcgaatcaagcacccgatatggctgctcgtttacattccactcgtgttcttgggacttttggctaccacgcaccagaatatgcaatgacaggccagttgactcagaagagtgatgtttacagttttggagtcgtactcctggaacttcttactggacgaaaacccgtcgatcccacaatgccccgtggacaacagagtctcgtgacctgggcaactccgagactgagtgaagacaaggtgaagcagtgtgttgatccaaaactgagatccgagtatcccgctaaggccgtagccaagatggcagccgttgcagctctgtgtgttcagtatgaggcagattttcgtcccaacatgagcattgttgtcaaagcactgcaaccgttgttgacagcacgacctgctccccaagcaggaggatttcaaggggagtgagacgcgtgggtcaccatcacgtagtctacctcaagtgtctttgtttgagtgaactttgaattttcacatggcatcttttgattttgtggtgttaagttggtttcagattctgcctatagtcatcttataagagttctgactgcttctacagtcagtgcaggaagcttgagaaaagcattccagtgtcttcaactgaagtgattttgatgtactttcacagagaaaaattgtgtgccttagtaatggtctctcagagtggcaagtgcagactgagatagacgtggtgggcaatagtaggatcaagacaactggacattttttagagtacattgacctcttttttccgacattgattagcgatgtcggaagtatgatacttgcgaatagtgtgggtaaattttttagcgccaaggaatagtccagttatggagataagttatgagatatgtgtttgtggactgttctcctaatcatgtgcaaatggaagttgtagatggtgagctctggatttcttctggaccatcatgtgatatatctaccatcattatctcca

SEQ ID NO: 6647 - DNA, 1827 bp, Setaria italica
ggcgaagccgacgacgagctcagcagcgccgacgccgcaccgcaaacggctcgcccctccctcgagaataggtgtaaactacagtaaagtatagtgatgtggtgtcgctgggtttgctgcaattgccaagtggatgaatccgatcagcgtgaaaatgggcaattcaaggtcacaacgaacaatgctgacgggatgacaaagggattcaaagattctgctactggaaaagtcgagcctcagaatgctgctccccctatcaatattcctgttctatccttggatgaactgatagaaaaaactgatgattttgggtcaacggctttgataggtgaaggttcttacgggagagtatactatgccgtccttgataatggaacaaaaatggcagtgaagaaacttgactctactgaaaatgaacccaccaccgaattcttgacccaggtttcattggtttcaaggctgaagcatgaaaacttcgtagatatgttgggttactgcacagagcgtaatcttcgcattgtagcctatgaattcgccaccatgggttctctgcatgatgttctacatggaagaaaaggagttcaaggtgctcaacctggcccagcgcttgattggatgcagcgagtgaaagttgctgttgatgctgcgaaaggacttgaatatctgcacgagaaagttcagccttcgattgtccacagggatattagatctagtaacatcctcttatttgaggacttcaaggcaaagatagcagacttcaatctctcaaatcaggctccagatatggctgcccggttgcattctactcgtgtgctgggaacctttggatatcacgctccagagtatgcaatgactggtcagctaacccagaaaagtgatgtgtatagctttggagtggttctcttggagcttttgacaggtagaaagcctgtagaccatacaatgcctagagggcagcagagcctggtaacctgggctacaccgagattaactgaagacaaggtgaagcagtgtgtagatcctcggttgaagggtgaatatccagcaaaaggactcgctaagctcgctgctgtagcagctttgtgtgtgcaatacgaagctgagttccgcccaaatatgagcattgtggtcaaggctttatctccactgctcgtaagtaagcagactcaaacccctgcacccccacctgccgttgacagttgatgcatataattaaccagagtaaagttcttttcccttggatatcttatcacatatatgggccgggaagttacatttgatgatttgcagtcgtgcagaatgcctgtaacttactgatttggacagtttactctctggaatatctgttaggctgcaaatatgataggaacaacggcttggataatagacaaaatggatcgattcacctctcggattcggacaactacatggaggacgtctttggtactgcagtgacaaccaagcatctgcggtttttcggcaatgttcatattcatcttttaagaaacatgaattctgaagcaagcctgcacttttggctggctataggaattggatgcctgtatttgggtcaaatatataaacgggaatgtgtagatgcctaatttacgagtcactggaatccattcataatagcttcgggctgtcatttgacgtggtctcgttgacatatatattgctcagtgagctacatgtaatgttgactggaaaattggtgacttaattgatttcctaagattctagcatcatttaagatgttggtgttgccgaaagcatgtggcgcccatttgaaaaacaataagtagtgctactgctagctataggcgt

SEQ ID NO: 6648 - DNA, 1382 bp, Brassica napus
tctatctccctctctctccaatctcgccaactaacaagaaaacagaacagctaacacacagagatagacttgacaggccaacgatagatcaccaggctactttgttcggctggataaaccgagagctgtagacgatcttcacataggcaagagagaaaagatgcgcaggtggttgtgctgtgcttgccacgtcgaagagccttaccatactactgaaaatgatcaccggagaagtcctaagcaccataacgggcacaataaaaaccaagaagtgtctgtgagacctgatgctcttaacgtgcctccagctatcgatgtccctgcgttgtcgttagatgagctgaaagaaaagactgataactttggatcaaaggcactgatcggtgaaggctcatacggaagagcttactacgcaactttgaaagatgggagagccgtggcggtcaagaagcttgataactcagctgagcctgaatcgaacttcgagttcttgactcaggtctcaagggtttcaaagctgcagcatgagaactttgttcagctctttggctactgcgttgaagggaacctccgtatacttgcgtacgagtttgccacgatggggtctttacatgacatcttgcacgggaggaaaggagtccaaggagcgcagccaggtcccacgcttgattggactcaacgggttagaatagcggttgaggcagctagaggacttgagtatttacatgagaaagttcaacccgcagttatacacagggatgttcggtctagcaatgtgcttctgtttgaagattttaaagccaagattgctgattttaatctgtctaatcagtctcctgatatggctgctcgccttcattctactagagttttggggacctttggttaccacgcgccagagtatgccatgactggttcactgacacagaagagtgatgtttatagttttggtgtagtgcttttggagctcttgactggtagaaaacctgttgatcatactatgccacgtggtcagcaaagtcttgtcacttgggctgctccaaggctgagtgaagacaaagtgaagcaatgtgttgatccaaaactcaatggagattatcctcctaaagcagttgcaaagctcgcggctgttgcagcgttatgtgtgcaatacgaatcagagtttagaccgaacatgagcattgtggtaaaagctctacaaccattgttaaagtcatcaaggtcatcaacagcagtagctactccatcccaggaaacttgattcttatatctgataatgggagattggtttctgttccatgtgttgccatgtcatatacaaatactgttattcagtgtctttttgttgaggttttattttcttctcttcttatatgtttatt

SEQ ID NO: 6649 - DNA, 1107 bp, Setaria italica
atgtggtgttgcagcggcgcggaggaggagcccctggccgtcccgccggccggcaacccggcctacacgccgccgcgagcaccagcccatccgagagggccgagcatgccgaggcccggcgcggcgtcggcggccaaggtgctgcccatcgacgtgccggcgttcccgctgtcggagctgaaccgcctgacgggcaacttcggggacagggcgctggtcggggaaggctcctacggccgcgtgtaccgcgccaagctcggcaccggggaggcggtggccgtcaagatgttcgacaacggcggctcctccgggcagtcggaggccgagttctgcgagcagctgtccgtggtgtcccggctcaagtgcgagcacttcacccagctgctgggctactgcctcgagctcaacaaccggatcgtgctctaccagttcgccaccatgggctccctctacgacatactccacgggaagaagggggtgcagggggcggagccggggccggtgctgacgtggagccagcgcgccaggatcgcgtacggggcggcgcgggggctggagtacctgcacgagaaggcgcggccgtcgatcgtgcaccgcgacgtgcgctccagcaacgtgctggtcttcgacggccacgacgccaagatcggggacttcaacctcaccaaccagtcccccgactccgccgcgcgcctgcactccaccaaggtgctcggcacgttcggataccacgcgcccgagtatgcgatgacgggccagctgacacagaagagcgacgtgtacagcttcggcgtcgtgctccttgagctcctgaccgggaggaagcccgtggatcacaccatgcccaaggggcagcagagcttggtcacctgggccactccaagattgagcgaggacaaagtgaagcagtgtgtggaccccaagctgaaggacgactacccgccgaaggccgtggcaaagctcgcggcggtggcggcgctgtgcgtccagtacgaggccgacttcaggcccaacatgaccatcgtcgtcaaggccctgcagcccctcgtgactgctcggcctggaggagatcacccgtagcctagatagacagtgcggcatgtgcat

SEQ ID NO: 6650 - DNA, 1007 bp, Sorghum bicolor
cacatccgagagggccgaacatgccgagaagcggcgcggcgtctgcggccaaggtgctgcccatcgacgtcccggccgtggcgctgtcggagctgaaccggctgacgggcaacttcggggacagggcgctggtcggggaaggctcctacggccgcgtctaccgcgccaagctcggcaccggggagaccgtggcggtcaagatgttcgacaacggcagctcctccggccagtcagaggccgagttctgcgaacagctgtccgtggtgtcgcggctcaagtgcgagcacttcacccagctgctgggctactgcctggagctcaacaaccggatcgtgctctaccagttcgccaccatgggctccctctacgacatactccatgggaagaagggggtgaaaggcgcggagcccgggccggttctgacgtggagccagcgcgcgcggatcgcgtacggggcggcgaggggcctggagcacctgcacgagaaggcgcggccgtcgatcgtgcaccgcgacgtgcgctccagcaacgtgctggtcttcgacggccacgacgccaagatcggcgacttcaacctcaccaaccagtccccggactccgccgcgcgcctgcactccaccaaggtgctcggcacgttcggctaccacgcgcccgagtacgcgatgacggggcagctgacgcagaagagcgacgtgtacagcttcggcgtcgtgctccttgagctcttaaccgggaggaagcccgtggatcacaccatgcccaaggggcagcagagcctggtcacctgggccactccgagactgagcgaggacaaggtgaagcagtgcgtggatcccaagctcaaggacgactacccgccgaaagccgtggccaagctcgcggcggtggcggcgctctgcgtgcagtacgaggccgatttcaggcccaacatgacgattgtcgtcaaggctctgcagcccctcgtgaatgctcggccaggaggagaatcaccagtagtccagtactag

SEQ ID NO: 6651 - DNA, 1696 bp, Solanum lycopersicum
taataataacaagaaagaaagagaaatggctgaaattattctaccatgaaatctcttctttcttctttgttgtaatttcttcttccagattcattcatttcctaatttataaaaaaatttcgggaatactgataatgcaacatgtaaatttctcctgggaggcattggattaaattttatttatttatttaaaaaaaaaaggaatatttttagctttgattgaacaaaaatgtcttgctgtggaggtggagaagaagacgtttatagcggcggtcctccgtccaatcagaacacagctcctcctagagctggcaatccatatggtggtggtgctggtggtgcgagtgatagaggagagccaaggagtgctgcaagaggtggaactcctcagaaagtgttaccaattgaggcaccagttttcaccttagatgaactaaacagattgacaggaaattttggtcagaaagctttggttggagagggatcttatggccgcgttttttgcgcgaaattaagcaatggacagcaagtagcaatcaagaagttggatactagtgcttcaccagaaccagattctgattttgcagctcagttatcaatggtttcaaggcttaaaaatgagcattttatgactctgatgggctattgtctcgaagggaacaatcgtatattggtatatgagttcgcgacaatgggatctttacacgatgttttacatggtagaaaaggtgtacaaggtgctgagccaggtccagtacttacctggaatcaaagagttaaaattgcttatggtgcagcaaaaggactagagtatctacacgaaaagattcagccacctgtagttcatcgcgatgtcagatcaagtaatgcattgctctttgatgattttacagccaaagttgctgatttcaacatctcgaaccagtcttctgacactgctgcgcgtctacattccactagagttttgggaacttttggctaccatgcaccagagtatgcaatgacaggacagattactcagaaaagtgacgtttatagttttggcgttgtgctcttagaactgttgacaggaaggaagccagtagatcatacaatgcctaaagggcaacagagtcttgtcacttgggcaactccaagattgagtgaagacaaagtgaagcaatgtgttgatcctaagctaaataatgactatcctccaaaagcaattgctaagttggcagctgttgctgcactttgtgttcaatacgaggccgattttcgacctaatatgacaattgttgtcaaagcactgcaaccacttctcaactcaaaaccagcaggaccagagtctcaagcatagtaaatttctggttttgaaaccagcaggagctgatagccttaatgttacggcaaaaacttactcacactcaatgtttacataataacatatttctcatggttaaatgattaaatgaggtactatacgtgttgattaaccatgattaagtgaatgacgcgtattttgaagacacatgttatgtattgctgtaaacaccgagtgtagataagtttgtcttttcccctttctgatccaatatgtatttttttttcacaattagaatgcttgaaagaactacgaaaaaattctcatagctaggttagtagtgacatttttgggagtttgtataaatataaatatgtaagtttctgattgaac

SEQ ID NO: 6652 - DNA, 1592 bp, Solanum phureja
aagaaagaaaaaaaagaagaataacaagaaagaaagagaaatggctgaaattattctaccatgaaatctcttctttcttctttgttgtgatttcttcttccagattcattcatttcctaattttaaaaataaataaaattggaatactgataatgcagcatgtaaatttctcctgggaggcattggattaatttttttttaaaaggaatatttgcagctttgattgaataaaaatgtcttgctgtggaggtggagaagaagacgtttatagcggcggtccgccgtccaatcagaacacagctcctcctagagctggcaatccatatggtggtggtactggtggtgcaagtgatagaggagagccaaggagtgctgcaagaggtggaactcctcagaaagtattaccaattgaagcaccagttttcaccttggatgaactaaacagattgacaggaaattttggtcagaaagctttggttggagagggatcttatggccgcgttttttgcgctaaattaagcaatggacagcaagtagcaatcaagaagttggatactagtgcttcaccagaaccagattctgattttgcagctcagttatcaatggtttcaaggcttaaaaatgagcatttcatgactctgattggctattgtctcgaagggaacaatcgtatattggtatatgagttcgcgacaatgggatctttacatgatgttttacatggtagaaaaggtgtacaaggtgctgagccaggtccagttcttacctggaatcaaagagttaaaattgcttatggtgcagcaaaaggcctcgagtatctacacgaaaagattcagccacctgtagttcatcgcgatgttagatcaagcaatgcattgctgtttgatgattttacagccaaagttgctgatttcaacatctcgaaccagtcttctgacactgctgcgcgtctacattccactagagttttggggacttttggctaccatgcaccagagtatgcaatgacaggacagattactcagaaaagtgacgtttatagttttggcgttgtgctcttagaactgttgacaggaaggaagccagtagatcatacaatgcctaaagggcaacagagtcttgtcacttgggcaactccaagattgagtgaagacaaagtgaagcaatgtgttgatcctaagctaaataatgactatcctccgaaagcaattgctaagttggcagctgttgcagcactttgtgttcaatacgaggccgattttcgacctaatatgacaattgttgtcaaagcactgcaaccacttctcaactcaaaaccagcaggaccagagtctcaagcatagtaaatttctggttttgagaccagcaggagctgatagcgttgatgatacggcaaaaacttactcacactcgatgtatacataagaaaatatttctcatgataaaatgaggtaaaatacgtgttgattaaccatggttaagtgaataacgcgtatgttgaagacatatgttatgtattggttcgattgttgtaaacaccgagtgtagataagtttgtcttttcccctttctgatccaatatgtattttttt

SEQ ID NO: 6653 - DNA, 1204 bp, Sorghum bicolor
atgtggtgctgccgcggcgcggaggacgagccccacgccgccccgctggcggccgccaacccggccgcgacgccgccgcgagcaccagcacatccgagagggccgaacatgccgagaagcggcgcggcgtctgcggccaaggtgctgcccatcgacgtcccggccgtggcgctgtcggagctgaaccggctgacgggcaacttcggggacagggcgctggtcggggaaggctcctacggccgcgtctaccgcgccaagctcggcaccggggagaccgtggcggtcaagatgttcgacaacggcagctcctccggccagtcagaggccgagttctgcgaacagctgtccgtggtgtcgcggctcaagtgcgagcacttcacccagctgctgggctactgcctggagctcaacaaccggatcgtgctctaccagttcgccaccatgggctccctctacgacatactccatgggaagaagggggtgaaaggcgcggagcccgggccggttctgacgtggagccagcgcgcgcggatcgcgtacggggcggcgaggggcctggagcacctgcacgagaaggcgcggccgtcgatcgtgcaccgcgacgtgcgctccagcaacgtgctggtcttcgacggccacgacgccaagatcggcgacttcaacctcaccaaccagtccccggactccgccgcgcgcctgcactccaccaaggtgctcggcacgttcggctaccacgcgcccgagtacgcgatgacggggcagctgacgcagaagagcgacgtgtacagcttcggcgtcgtgctccttgagctcttaaccgggaggaagcccgtggatcacaccatgcccaaggggcagcagagcctggtcacctgggccactccgagactgagcgaggacaaggtgaagcagtgcgtggatcccaagctcaaggacgactacccgccgaaagccgtggccaagctcgcggcggtggcggcgctctgcgtgcagtacgaggccgatttcaggcccaacatgacgattgtcgtcaaggctctgcagcccctcgtgaatgctcggccaggaggagaatcaccagtagtccagtactagctaggtagacacagagagtgggtgggcataatatatacgtagtgtcgtcgctcgccctgcgccgctgtgatcgagcaagtttttggacgtcgtaaattaatgtctacgg

SEQ ID NO: 6654 - DNA, 1389 bp, Nicotiana tabacum
ccagattcattgctgtctttaattttctccttaaggttttcggataatttaacatgtaaattatttctcctcggaggcattggattttatgtggatttaataaaaaggagcacttaaggagaatttgtggcttccatagttgaacaacaaaaatgtcgtgctgtggaggtggagaagaagacgtctacagtggtggcccaccatccaatcaaaatacagctcctcctagagctggcaatccctatggtggtggtactgggggtgctagtgaaagaggagagccaaggagtgcagcaagaggtggagctcctcaaaaagtattaccaattgaggctccagtgtttactttggatgagctaaatagattgactggcaactttggtcagaaagctttggttggagagggatcttatggccgcgttttttgtgctaaattgagcaatggtcagcaagcagcaatcaaaaagttggatactagttcttcaccagaaccggactctgactttgcagcccagttatcaatggtttcagcacttaaacacgagcatttcatgactctcatgggctattgtctcgagggaaacaatcgtatattggtgtatgagttcgcaacaaagggctctttacacgatgtgttacatggtagaaaaggtgtacaaggtgctgagccaggtccagttcttacctggaatgagagagttaaaattgcttatgggtcagcaaaaggcctcgaatacctacacgaaaaagttcagccacctatcgttcatcgtgatgtcagatccagcaatgtgttactctttgatgattttacagcaaaaattgctgatttcaacatctcaaaccaatcttcagctacagcagcgcgtctgcattccactagagttttgggaacatttggctaccatgctccagagtatgccatgacaggacagattacacagaaaagtgacgtttatagttttggcgttgtcctcttagaactcttgacaggaaggaagccagtagatcatacaatgcccaaaggacaacagagtcttgtcacatgggcaactccaagattgagtgaagacaaagtgaagcagtgtgttgatcccaagctaaataatgactatcctccaaaggcaattgcaaagttggctgctgtagcagcactttgtgtccaatatgaggccgattttcggccaaatatgacaattgttgtcaaagcactgcaaccacttctcaactcaaaaccggcaggaccagagtcccaagcatagtacatttctggtttgaaaccagcacagggcaattcttaggagtctcaacaagtctgtgattcaagttatggtcgcgaggcccttgatgttatgctttctttcgacaaaacttactcataggtcggtg

SEQ ID NO: 6655 - DNA, 1605 bp, Solanum lycopersicum
aagaaagaaaaaaataataataacaagaaagaaagagaaatggctgaaattattctaccatgaaatctcttctttcttctttgttgtaatttcttcttccagattcattcatttcctaatttataaaaaaatttcgggaatactgataatgcaacatgtaaatttctcctgggaggcattggattaaattttatttatttatttaaaaaaaaaaggaatatttttagctttgattgaacaaaaatgtcttgctgtggaggtggagaagaagacgtttatagcggcggtcctccgtccaatcagaacacagctcctcctagagctggcaatccatatggtggtggtgctggtggtgcgagtgatagaggagagccaaggagtgctgcaagaggtggaactcctcagaaagtgttaccaattgaggcaccagttttcaccttagatgaactaaacagattgacaggaaattttggtcagaaagctttggttggagagggatcttatggccgcgttttttgcgcgaaattaagcaatggacagcaagtagcaatcaagaagttggatactagtgcttcaccagaaccagattctgattttgcagctcagttatcaatggtttcaaggcttaaaaatgagcattttatgactctgatgggctattgtctcgaagggaacaatcgtatattggtatatgagttcgcgacaatgggatctttacacgatgttttacatggtagaaaaggtgtacaaggtgctgagccaggtccagtacttacctggaatcaaagagttaaaattgcttatggtgcagcaaaaggactagagtatctacacgaaaagattcagccacctgtagttcatcgcgatgtcagatcaagtaatgcattgctctttgatgattttacagccaaagttgctgatttcaacatctcgaaccagtcttctgacactgctgcgcgtctacattccactagagttttgggaacttttggctaccatgcaccagagtatgcaatgacaggacagattactcagaaaagtgacgtttatagttttggcgttgtgctcttagaactgttgacaggaaggaagccagtagatcatacaatgcctaaagggcaacagagtcttgtcacttgggcaactccaagattgagtgaagacaaagtgaagcaatgtgttgatcctaagctaaataatgactatcctccaaaagcaattgctaagttggcagctgttgctgcactttgtgttcaatacgaggccgattttcgacctaatatgacaattgttgtcaaagcactgcaaccacttctcaactcaaaaccagcaggaccagagtctcaagcatagtaaatttctggttttgaaaccagcaggagctgatagccttaatgttacggcaaaaacttactcacactcaatgtttacataataacatatttctcatggttaaatgattaaatgaggtactatacgtgttgattaaccatgattaagtgaatgacgcgtattttgaagacacatgttatgtattgctgtaaacaccgagtgtagataagtttgtcttttcccctttctgatccaatatgtatttttttttca

SEQ ID NO: 6656 - DNA, 1161 bp, Brassica napus
gaaaataaaatacacattcgttttctccggtgagtttttgttttgtgtttgtaagagaaaagcgcaatgagctgctttggctgttttggtggtggtgaggattttcgtagagtttctgaaaccggaccaaagccattccacaaccgagatggtatcaatgctcaccatcacaaggcagatccgcccaagaactcaccagtcattcagatgcagcctatctctgttcccgccattccagctgacgaactaaaggacataaccgataactacgggtcaaagtccttgattggtgagggctcttatggaagagtgttttacggtgttctcaaaccggaaacgcagctgccatcaagaagcttgattccagtaagcaacctgatcaagagtttctcgcgcaggtatcaatggtttcgagattgcgtcaagacaatgtcgttgcgcttctggggtactgcgtcgatggaccgctccgtgttcttgcttatgaatttgcctctaatggatctcttcatgatattctccacggtagaaaaggtgtgaaaggagcgcagccaggtcctgtcctgtcgtggaaccagagagttaagatcgctgttggtgcggctagagggctggagtacttgcacgagaaggcaaacactcatgttatccacagagacatcaagtctagcaatgtgcttttgttgatgatgatgtcgctaagattgctgatttcgatctgtctaatcaagcccctgacatggctgcacgccttcattcaactcgtgtgctgggaacctttggctatcatgctccagagtatgcaatgacgggaacattgagcacaaagagtgatgtgtatagttttggagttgttctgcttgagctactcacaggtcgtaaaccagttgaccataccttaccacgtggacagcagagtcttgtgacatgggcaacccctaaactgagtgaagacaaggtgaagcagtgcgttgatgcaagactaaacggtgaatatcctcccaaagctgttgccaagctggctgcagtagctgcgctatgtgtgcaatacgaggcagacttcaggccaaacatgagcatagtggtgaaggctcttcagcctctgctcaatcctcctcgctctgctcctcaaactcctcacaggaacaacccttttgattg

SEQ ID NO: 6657 - DNA, 1087 bp, Brassica napus
ctcaccatcataaggcagatccaccaaagaactcaccagtcattcagatgcagcctatctctgttcccgccattccagctgacgaactaaaggacataaccgataactacgggtcaaagtccttgattggcgagggctcttatggaagagtgttttacggtgttctcaaaaccggaaacgcagctgccatcaagaagcttgattcaagtaagcaacctgatcaagagtttctcgcgcaggtatcaatggtttcgagattgcgtcaagacaatgtcgttgcgcttctggggtactgcgttgatggaccgctccgtgttcttgcttatgaatttgcctctaatggatctcttcatgatattctccacggtagaaaaggtgtgaaaggagcgcagccaggtcctgtcctgtcgtggaaccagagagttaagatcgctgttggtgcggctagagggctggagtacttgcacgagaaggcaaacactcatgttatccaccgagacatcaagtctagcaatgtgcttttgtttgatgatgatgttgccaagattgctgatttcgatctgtctaatcaagcccctgacatggctgctcgccttcactcgactcgtgtgcttggaacctttggctatcatgctccggagtatgcaatgacgggaacattgagcacaaagagtgatgtgtatagttttggagttgttctgcttgagctcctcacgggtcgtaaaccagttgaccatacgttaccacgtggacagcagagtcttgtgacatgggcaacccctaaactgagtgaagacaaggtgaagcagtgcgttgatgcaagactaaacggtgaatatcctcccaaagctgttgccaagctggctgcagtagctgcgctatgtgtgcaatacgaggcagacttcaggccaaacatgagcatagtggtgaaggctcttcagcctctgctcaatcctcctcgctctgctcctcaaactcctcacaggaacaacccttattgattgatatcctcacaatcacgcttcatcatccactatttcatttgtttttgcttgaatccaatttgtgtaaattcgtgaatgtatga

SEQ ID NO: 6658 - DNA, 1500 bp, Eutrema halophilum
gaagaaaagtctgccttccttaagcgtaagcttcaccaaccctacgacgaacacgatagaaaaaaacatccggcttcagcgattcgtctcatcttttctcttttgcgatttttggaacagttttgtaagttggtctgagagaaaaaaagcgtaatgagctgctttggttgttgtggtggtgaggatttccgtagagtcgctgaaacaggaccaaagccagtgcacaacgcagcaggttacaatggaggtcaccatcaaagggcagatccgccaaagtacccgccagtcattcagatgcagcctatcgctgttccggccatcccagcagatgagttgaaggatataaccgataactatggttcaaagtcgttgattggtgagggctcatatggcagagtgttttacggtgttctcaaaagcggtaaggcagctgccattaagaaactggattccagtaagcaaccggatcaagaatttcttgcacaggtatcaatggtttcaagattgcgacaagacaatgttgttgcgcttctgggatattgcgttgatggcccactccgtgttcttgcttatgaatatgctcctaatggatctcttcatgatattcttcatggtcgaaaaggtgtcaaaggagcacagccaggtcctgttctgtcgtggcaccagagagtcaaaattgctgttggtgcggctagaggactcgagtacttgcatgagaaggcaaaccctcatgttatccaccgagacatcaaatccagcaacgtacttctgtttgacgatgatgttgccaagattgctgatttcgatctgtccaatcaagcccctgacatggctgcacgccttcactcaactcgtgtgctgggaacctttggctaccacgctccagagtatgcaatgacaggaacattgagcacaaagagtgatgtctacagttttggcgttgttctgctagagctcctcacaggtcgtaaaccagttgatcataccttaccaagaggacagcagagtcttgtgacatgggcaacccctaaactgagtgaagacaaggtgaagcagtgcgttgatgcaagactaaatggagaatatcctcccaaagctgttgctaagctggctgcggtagctgcgctgtgtgtgcaatatgaggcagacttcaggccaaacatgagcatagtggtgaaggctcttcagcctctgctcaatcctcctcgctctgctcctcagactccacacaggaacaacccttattgatatatgctccgatctgtttccacgcttcatcttcactatttcatttgtttttgtttgaacccgatttgtgtaaattcgtgaaataggctattatctctctcataaaaccctactcacttcactgaaactctcacttggaaagctcaacgttgctctattttgtttatgttatatcatgcctgtgatgtaagttttctactaattttacaatatgcgaggaaaggatatatataccgatactgtttatgtgcc

SEQ ID NO: 6659 - DNA, 1468 bp, Arabidopsis lyrata
gaagaaaagtctgcgtttcttcaccaaccctacacgaacaaagagatagaagaaaccttcttctgctttcttctaccatcggagaattcgactcttgtttatcttttgagattctctaattctcgtttttggaaaagtttcgtgtgttagagaagcgtaatgagctgctttggttgttgtggtggtgaggatttccgtagagttgctgaaactggaccaaagccagtgcataacacaggaggttacaatggaggtcatcatcaaagggcagatcctcccaagaaccctccagtcattcagatgcagcctatctctgttgcgcccattccagctgatgaattgagggatataacggataattatggtggaaagtccttgattggtgagggttcatatggaagagtgttttatggtattcttaaaagtggtaaggcagctgccattaagaaactggattctagtaagcaaccagatcaagaatttcttgcccaggtatcaatggtttcgagattgcgacaagacaatgttgttgcgcttctgggctattgtgttgatggcccactccgtgttcttgcttatgaatatgctcctaatggatctcttcatgatattcttcatggtcgaaaaggtgttaaaggagcacagccaggtcctgttctgtcgtggcaccagagagtcaaaattgctgttggtgcggctagaggactcgagtacttgcatgagaaggcgaaccctcatgttatccacagagacatcaaatccagcaatgtacttctgttcgacgatgatgttgccaagattgctgattttgatctgtccaaccaagcccctgacatggctgcacgccttcactcaacccgtgtgctcggaacctttggctatcacgctccagagtatgcaatgacggggacattgagcacaaagagtgatgtatatagttttggcgttgttctgctggagctcctcacaggtcgtaaaccagttgatcataccttaccgcgtggacagcagagtcttgtgacatgggcaacccctaaactgagtgaagacaaggtgaagcagtgtgttgacgcaagactaaacggagaatatcctcccaaagctgttgctaagctggctgcggtagctgcgctgtgtgtgcaatatgaggcagacttcaggccaaacatgagcatagtagtgaaggcccttcagccgttgctcaatcctcctcgctctgctcctcagacaccgcacaggaacccgtattgatatgctccagcctgatttcaccctttatgatgatcactatttcatttgtttttgtttgaatccgatttgtgtaaatttgtgaaataggcttttatttctctcataaaaccctgccacttcaccgaaaatcttacttggaaagacctgaatgttactctatttttatattatttcatgtctgtgatgtaagtttctactaattctactatatgcgagg

SEQ ID NO: 6660 - DNA, 772 bp, Brassica juncea
tggagtacttgcatgagaaggcgaaccctcatgttgtccaccgagacatcaaatccagcaatgttcttctgtttgacgatgatgttgccaagattgctgatttcgatctctccaaccaagcccctgacatggctgctcgccttcactcaactcgtgtccttggaacctttggttatcacgctccagagtatgcaatgacaggaacattgagcacaaagagtgatgtgtatagttttggagttgttctgctagagctgctcacaggtcgtaaaccagttgatcataccttaccacgaggacagcagagtctcgtgacatgggcaactcctaaactgagtgaagacaaggtgaagcagtgcgttgatgcaagactaaacggagaatatcctcccaaagctgttgccaagctggctgctgtagctgcgctatgtgtgcaatacgaggcagacttcaggccaaacatgagcatagtggtgaaggctcttcagcctctcctcaatcctcctcgctctgctcctcaaactcctcacaggaacaacccttattgatgtcctccaatctgatgccacgcttcttcatcatatcacttatttcatttgtttttgtttgaatccggtttgtgtaaattcgtgaaaataggctttttatttctcacaatagacatgaaagtctcacttccaaacctgaatggtgttgctctatttgtttatgttatttcatgcctgcgattgtaagtttctactaattatacaatatatgcgaggaatggatt

SEQ ID NO: 6661 - DNA, 839 bp, Brassica juncea
ggggactcgagtacttgcatgagaaggcgaaccctcatgttgtccaccgagacatcaaatccagcaatgtgcttttgtttgacgatgatgttgccaagattgctgacttcgatctgtctaaccaagcccctgacatggctgctcgccttcactcaactcgtgtgctgggaacgtttggttatcacgctccagagtatgcaatgacagggacattgagcacaaagagtgatgtctacagtttcggggttgttctgctagaactcctcacaggtcgtaaaccagttgatcataccttaccacgaggacagcagagtctcgtgacatgggcaacccctaaactgagtgaagacaaggtgaagcagtgcgttgatgcaagactaaacggagaatatcctcccaaagctgttgccaagctggctgctgtagctgcgctatgtgtgcaatacgaagcagacttcaggccaaacatgagcatagtggtgaaggctcttcagcctctcctcaatcctcctcgctctgctcctcaaactcctcacaggaacaacccttattgatgtcctccaatctgatgccacgcttcttcatcatatcacttatttcatttgtttttgtttgaatccggtttgtgtaaattcgtgaaaataggctttttatttctcacaatagacatgaaagtctcacttccaaacctgaatggtgttgctctatttgtttatgttatttcatgcctgcgattgtaagtttctaccaattatacaatatgcgaggaatggatatattcataatatactcattgtgtttgtgccaaaaaaaaaagaggagaagaacaagaacggaag

SEQ ID NO: 6662 - DNA, 709 bp, Brassica juncea
ggtagaaaaggtgtgaaaggagcacagccaggtcctgttctgtcgtggcaccagagagtaaagattgcggttggtgcggctaaaggattagagtacttgcatgaaaaggcaaaccctcatgttgtccaccgagacatcaaatccagcagtgtacttatgtttgaagatgatgctgctaagattgctgattttgatctgtctaatcaagcccctgacatggctgcacgccttcactcaactcgtgtgcttggaacctttggctatcacgcacctgagtacgcaatgacaggaacgttgagcacaaagagtgacgtgtatagttttggagttgttctgctagagctcctcacaggtcgtaaaccagttgatcataccttaccacgaggacagcagagtctcgttacatgggcaactcctaaactgagtgaagacaaggtgaagcagtgcgttgatgcaagactaaacggagaatatcctcccaaagctgttgccaagctggctgctgtagctgcgctatgtgtgcaatacgaagcagacttcaggccaaacatgagcatagtggtgaaggctcttcagcctctcctcaatcctcctcgctctgctcctcaaactcctcacaggaacaatccttattgatgtcctccaatctgatgccacgcttcttcatcatatcacttattgatgtcctccaatctgatgccacgcttct

SEQ ID NO: 6663 - DNA, 1413 bp, Theobroma cacao
gaccattaggtcaaccctgaaaagcatataatataatattgtttcatttttttttcccatgcaggaaaagatttgattttgcattggattgataaaagagtccttttcactgcatgaaaattggaggtttcaacatcctgagctatgttctgctgcggaggtgcggaggaggaacccaacggcccacctgcaaaccaatatacagccccacctagaggaggaaaccaattcggtggcgctggcagtgggagaggagagccaagggcttccaatgtggttaaaagtggggctcctcagaaagtcctaccaattgaaattccagctatgacattggatgagttaaataggatgactggtaactttggcacaaaggctttgatcggagaaggttcttatggccgagttttctatgcaaagttaagtaatggtcaggatgcagcaataaagaagctggatactagttcttcacaagaaccagattctgattttggagcacagttatcagtggtttcaagacttaaacatgaacattttgtggagttgatggggtattgtttggaagcaaataaccgaatcttggtatatcagtacgcgacaatgggttctttacatgatgtattacatggtaggaaaggtgtacaaggagctgaaccaggtccagttctcacctggaaccaaagagtaaaagttgcctatggtgctgcaaaaggtcttgaatatttgcatgagaaagttcagccttcaatagttcatcgtgatgtcagatcaagcaatgttcttctttttgatgacttcatggccaaaattgccgatttcaacttgacaaatcaatcttctgacacagctgctcgactgcattcgactagagtcttgggtacatttgggtaccatgccccagagtatgctatgacagggcagataacacagaaaagtgatgtatacagtttcggtgttgttcttctagagctgttgacagggagaaaaccagtagaccatacaatgcccaaaggacaacagagtcttgttacttgggcaactccaagattgagtgaggacaaggttaagcaatgtgtggatcccaagctaagcaatgactacccaccaaaggcaattgccaagctagcagcagttgcggcactttgtgtccagtatgaggcagacttccggccaaacatgacaattgttgtcaaagctattcagcctcttcttaatgcaaaaccagcaggagcagagtctcaagcataacccaaaaaggcccaacggttatctcaccggcgcacggtaattgttttagccctcgccaaacggcgtagctttggacctgtcttcaagtcttcggtcttcaggttggtgcacaccgtgtacgcaaaccctggcagatgagagttaaaaaaaaaaattgtaatgtaaaca

SEQ ID NO: 6664 - DNA, 531 bp, Cleome gynandra
gtatctgtccaatcaagcccccgacatggctgcccgccttcactccactcgtgtacttggaacctttgggtatcacgcaccagaatacgcaatgactggaacattgagcacaaaaagcgatgtgtacagcttcggtgttgtactgctggagctcctcacgggacgtaaacctgttgatcatacattaccgcgcggacagcagagccttgtgacttgggcaactcctagactgagtgaagacaaggtgaagcagtgtgttgatgcacgactcaacggggagtacccaccaaaagccattgcaaagctagcggcggtggcagcgctgtgtgtgcaatacgaggcggacttcagaccgaacatgagcatagtggtgaaggctcttcaacctcttctaaaccctccacgctctgctcctcagactccccagagaaacctctactgagagacaaacacaccccttttgtttctccaataccctttgtccatcaggtgtgtgctattacaaacgccctttcttccatttctcaattg

SEQ ID NO: 6665 - DNA, 1549 bp, Brassica napus
gtgcgcatctgctccaagtccaacaccttataagaaatttccgccgggaagaaagaaaagtctctgccctctcttctcaagcctacagcttccgccaaccatacgtacaaacaagatagacacaatcctccgtacttcctttttctatcttcatcgaaagattcaaccacactcaagtcttctctctctcttttggaaagaaaaagaagttcgtgtgtgagagagaaatagcgtaatgagctgctttggttgttgtggtggtgacgattttcgtcgagttgctgaaactggtcctaagccagtctacggcgcaggaggtcacggtggaggtcaccatccaagggcagacccacccaagaacacgccagtcattcagatgcagcctatctccgtgccggctattccagctgatgagttgaaggatataactgataactacggttcaaagtccttgattggtgagggctcttatggaagagtgttttacggtgttcttagaagcggtaaggcagctgctattaagaaacttgattccagtaagcagcctgatcaagagtttctcgcacaggtatcaatggtttcgagattgagacaagacaatgttgttgcacttctgggatattgcgttgatggcccactccgtgttcttgcttatgagtttgctcctaatggatctcttcatgatattcttcatggtagaaaaggagtgaaaggagcgcagccaggacctgttctgtcgtggaaccagagagttaaaattgctgttggtgcggctaggggactcgagtacttgcatgagaaggcgaacccgcatgttgtccaccgagacatcaaatccagcaatgtgcttctgtttgacgatgacgttgccaagattgctgatttcgatctctccaaccaagcccctgacatggctgctcgccttcactcaactcgtgtgctgggaacctttggttatcacgctccagagtatgcaatgacagggacattgagcacaaagagtgatgtctatagttttggagttgttctgctagagctcctcacaggtcgtaaaccagttgatcataccttaccacgaggacagcagagtctcgttacatgggcaactcctaaactgagtgaagacaaggtgaagcagtgcgttgatgcaagactaaacggagaatatcctcccaaagctgttgccaagctggctgctgtagctgcgctatgtgtgcaatatgaggcagacttcaggccaaacatgagcatagtggtgaaggctcttcagcctctcctcaatcctcctcgctctgctcctcaaactcctcacaggaacaatccttattgatgtcctccaatctgatgccacgcttcttcatcatatcacttatttcatttgtttttgtttgaatacaatttgtgtaaattcgtgaaaacaggctttttatttctcataaaaaaacctgaaagtctcacttccaaacctgaatgttgctctatttgtttatgttatttcatgcctgcgatgtaagtttctactaattaatacaatatgcgaggaatggat

SEQ ID NO: 6666 - DNA, 1196 bp, Brassica napus
ttccgaaaccggaccaaagccattccacaacagagatggtatcaatgctcaccatcacaaggcagatccgcccaagaactcaccagttattcagatgcagcctatctctgttcccgctattccagctgacgaactaaaggacataaccgataactacggttcaaagtccttaatcggtgaaggctcttatggaagagtgttttatggtgttctcaaaaaccggaaacgcagctgccatcaagaaacttgattccagtaagcaacctgatcaagagtttctcgcgcaggtatcaatggtttcgagattgcgtcaagacaatgtcgttgcccttctcgggtactgcgtcgatggaccgctccgtgttcttgcttatgaatttgcctctaatggatctcttcatgatattctccacggtagaaaaggtgtgaaaggagcgcagccaggtcctgtcctgtcgtggaaccagagagttaagatcgctgttggtgcggctagagggctggagtacttgcacgagaaggcaaacactcatgttatccacagagacatcaagtctagcaatgtgcttttgttgatgatgatatcgctaagattgctgatttcgatctgtctaatcaagcccctgacatggctgctcgccttcactcgactcgtgtgcttggaacctttggctatcacgctccagagtatgcaatgacaggaacattgagcacaaagagtgatgtgtatagttttggagttgttctgcttgagctactcacaggtcgtaaaccagttgatcatactttaccacgtggacagcagagtcttgtgacatgggcaacccctaaactgagtgaagacaaggtgaagcagtgcgttgatgcaagactaaacggtgaatatcctcccaaagcagttgccaagctggctgcagtagctgcgctatgtgtgcaatacgaggcagacttcaggccaaacatgagcatagtggtgaaggctcttcagcctctgctcaatcctcctcgctctgctcctcaaactcctcacaggaacaacccttattgattgatatcctcacaatcacgcttcatcaaccgctatttcatttgtttttgcttgaatccaatttgtgtaaattcgtgaaagtatgacttttaactcctattatatatcatcattaatgtaaaattttctatataaatatttatttttg

SEQ ID NO: 6667 - DNA, 1481 bp, Fraxinus spp
cttataacaggagaaggaggtaatctttacgagtaaaacaaacattgagctgttttggctgttgtgaagaagatgatattggtaaacacgctgatggtgaggccagtatatgatgaaaaatgcagttggaaatgaaggaaattatcataaaacagatgctgcactgaaagctcaagctgttaatgtccagcctattgcagttccgtcgattcctaggtgatgaattgaaagaaattacagataactttggctctgattctttaattggggaaggctcatatggacgagtatattatggaatccttaagaatggtcgggctgctgcgataaagaagttggatgcaagcaagcaaccagatgacgaattcttagcccaggtttctatggtgtcgaggctaaagcatgaaaattttgttgaattacttggttattgtgttgatggaaatcagcgcgttcttgcatacgaatttgcatctaatggttctcttcacgatattcttcatggaaggaaaggtgttaaaggagcacaacctggtcctgttctttcatgggcacagcgtgtaaagattgcagtaggtgctgctaagggacttgagtatttgcatgaaaaagcagatcctcacatcatccaccgtgatgttaagtccagcaatgtcttaatttttgatgatgatgctgctaaaattgctgactttgatttgtcaaatcaagctcctgatatggcagcacgtcttcactcaactcgtgttcttgggacatttggttatcatgctcctgaatatgcaatgactgggcagctgaactcaaagagtgacgtctacagctttggtgttgtccttctagagcttcttacaggacgtaagcccgttgatcatacattacctcgtgggcagcaaagtctagttacatgggctacgccaaagctgagtgaagacaaggtcaagcaatgtgttgatggaagactgggaggagaataccctcctaagtcagtcgctaagatggctgctgttgctgccttgtgcgtccaatatgaagctgatttccggccaaacatgagcatcgtagtcaaagccctccagccacttttaaatgctcggccaggacctgctggtgaagctggccagacatgagatttgcagctaagctactgattgtgctgcttgggcgggatgagttggtgagtagaagcatggtaatgtttcattcttctccatgtctaagttatccgtgatttttgtgagtgaagtgcattaaagatgtttcagtcagtttattcgattgttgtttataatttatgcaatgattgtgttgatcaagaatcaaaaggtctttcagaaatgacagtcattattctcgagttaatatctagaaataagaaaatttaaaagtaaaattaccaataccaaaatggaatatggatattgatgaatatttaccacaccccaagcaacgagaacacaaataactcttgttttacaaat

SEQ ID NO: 6668 - DNA, 1684 bp, Pinus pinaster
atggcaacaagcttcggtgtgcaagttcccccagttttataagctaacatcctctcttactctggaactaggattacttgatggctctgcctgttgttaagtggcttcctcgggttttatggttactctacttttaggctgatgataaatatgtgtactatgcgcagtgtgggtggccattcccattgatgttggcaatgctcattgataacacaccaatgggtgttacattctaagtaatttgtttattgctctacttcctctgctctaagtgatttaattgttggaaacagtggcttaagttactgggctacaagaatacgtcgagcttctatgggcagagtcatgaggtgcttcagctgctgcactgcagatgacattcgcatgtcagctgatagtggaagccctttctatcaaatggcaatataacaggtaacagtggggggtcacaagagtgcagaaactagtaaggacggacaaattgtacaacctatactcattgaagtacctcagatccctatagaggaattgaaggaagcaacagataactttggtccaaaatcattgattggagagggttcctatggtcgggtgtattattcagtcttaagaaatggtcgtactgcagccattaagaagcttgatacaagcaagcaacctgatcaagaatttcttgcacaggtgtccatggtttcaagactaaaacatgaaaatgtattggaacttgttggatattgtgttgagggcagccttcgtgttcttgcatatgagtttgcaacaatgggatcgttgcatgacattcttcatggtagaaaaggtgtaaggggaaggcacaaccaggtccagtactcacttggatgcagagagtgaaaattgctgtagaagctgctaaaggccttgagtacctccatgaaaaggctcagttgcccataattcaccgtgacataaagtcaagcaatatattactttttgatgattgcacggcaaagattgctgattttgatgtatcaaaccaagcacctgacatggcagcacggcttcattccactcgtgtgcttggaacttttggctaccatgctccagaatatgctatgacaggacaactaagtcaaaagagtgatgtttatagttttggagttgtcctcctggagttgttaactggcagaaagccagttgatcatacaatgccgcgtggtcaacagagccttgtgacatgggcaactccaagacttagtgaagacaaagttaagcaatgtgttgattcaagattgaaaagtgactatccacctaaagctgtggctaagatggctgcagttgctgccttgtgtgtgcagtatgaagctgatttccgccccaacatgagcattgtggtgaaagcccttcaacctctactgaatgctagaccagtttctgctggcagaagtccttaattgtaacatcctatatggttgattttgtcaacctctactgaatgctagaccagtttctgctggcagaagtccttaaattgtaacatcctgtatggttgattttgtcattctttacagcattaaagatgctgtggaagattttggtcatgtttggaacgatcggaaacattgttaaatttgtgttagtcgctgactctgtaattcctgttgtgaaatatctaattgtggacttcatcaatcgattaataaaacta

SEQ ID NO: 6669 - DNA, 1643 bp, Phaseolus coccineus
  misc_feature (1573)..(1573): n is a, c, g, or t
accgaacataacttaacaaaacatttcttcttcttcgtcttcaaacctcttcttcttcatcttcaaacctcttcatcatccattttctgttccaaacaatacaaaagctgtaaccacacacaccgtcttcgctttgaattccgaaagaattcaggatcatgggttgctttggcttctgcaaaggagatgacagtgtggcaatttctgacagaggacctttcatgcaaaacactcccactgggaacgcaagttatcatggcagacataatgcagtgactgctcctcggccaataaattttcaacctattgctgtcccttctattacagtagacgaattgaagtctttaacagatagctttggctcaaaatctttcattggtgagggtgcatatgggaaagtatatcaagctacattgaaaactgggcgtgcagtggtaatcaaaaagctagattccagtaatcagccagaacaagaatttctttctcaggtctccatagtatcaaggctaagacatgaaaatgttgttgagcttgttaactattctgttgatggttcttttcgtgccctttcctatgagtatgctcctaaaggatcccttcatgatattctacacggacgaaaaggtgtcaagggtgcacaacctggtgcattactctcgtgggctcagagagttaaaattgctgttggagcagccaggggacttgaatatcttaatgaaaaggcagagattcatataatccatcgttatattaagtctagtaacatacttctttttgacgatgatgttgcaaagattgctgattttgatttgtcaaatcaagcccctgatgcagcagcacgtcttcattctacccgtgttcttgggacttttggttatcatgctcctgaatatgcaatgacgggacaactcacttcaaaaagtgatgtttatagctttggagttatactgctggaactcttaaccgggcgcaaaccggttgatcatacactaccccgaggacagcaaagccttgtcacctgggcaacaccaaagcttagtgaagataaggtgaagcagtgtgttgatgttagactaaagggagagtacccttcaaagtccgttgcaaagatggctgctgttgctgcattgtgtgtacaatatgaagctgagtttcggccaaacatgagcattatagtgaaagctttacagcctctactgaatactcgttctactccctcaaaggaatcaccaaacatgtaaattctaaaatcattcattccttctttcagattgcagattgcagatttcattcaccaattgtccttgtgacagttgtcagtaatttactcgttttgtggcatacagcattaaagtaccattattatatttgtggctcaactaaccgatgctatataaatagtgatgtaggtgacaggagcctatcatagatacttaagtttatggcttttgaatactttttttttaatttttgtttggatttccttttcgacaagtcatgtaaaagtgaatgtatattaccatatacctttcatggacaacacatgatgtctggttgaattgcaatctttaanttacatttcttcatttttttcctttttgatgttattaagttttatattgaataaggtgtttggcaggaaa

SEQ ID NO: 6670 - DNA, 829 bp, Cleome gynandra
actgtgttgatgggagctcacgtatacttgcatatgaatttgccaaaaatgggtctcttcatgacattcttcatgggaggaaaggtgtcaagggagcacagccaggtcctgtcttatcgtggcatcagcgagtgaaaattgcagttggagctgcaagaggcctagaatatttgcatgaaaaggcagagcctcacatcatccaccgagacatcaagtctagcaatgttctaatctttgatgacgatgttgctaaaattgctgattttgatctctccaatcaagctccagatatggctgcacgccttcattccactcgtgttcttggtacctttgggtatcatgcccctgaatatgcaatgactggacaattgaatgctaagagtgatgtatacagttttggggttgtattactcgagcttcttacaggtcgaaaacccgttgatcatacattacctcgagggcagcaaagtttggtcacatgggctacaccgaaactcagcgaggataaggttaagcagtgtgtggacgcaagacttggaggagagtaccctcctaaagctgtcgctaagttagccgcggttgctgcattgtgtgtacaatacgaggctgatttccgacctaacatgagcatagttgtgaaagcactacagccattgttgaacgcacggcctggtcctacaggagaaggagccgtcccttagccaccacttcttcatatacaggtactggagatttataattttccagttcattgaattcgatataatgtttataataccttaatgatttcattaagtttttatttacttctaaataatgaatcttttgg

SEQ ID NO: 6671 - DNA, 1602 bp, Cryptomeria japonica
ggagctgcagaaaatcaacaaaattgaatctgaaatagatatagaagaaagaaatcgaaaacaattagacgacaatctcagagatccactccactacggaggaaggaaacagccaaacctcgtgaggatttcaaaatatttgggctgtgaaaattagacatctttgctttggtataatcatgatatgctttagctgctgtagagaagatgaaattcaacacacatctgatggtacaagcccttttatgccaaatgcgcacctgacaggaaatgatggaatctacaagagtgcagacacagctttcaagggtaatcaaaacataaaacctcagcctattgctgtccctgagattacagtggaggaattgagggaggcaacagataattttggagagaaatcattgatcggagagggttcttatggtcgagtatatcatgcaactttaagaaatggccgtgtgacggcaattaagaagttagattctagcaaacaaccagatcaggaattacttgcacaggtttccatggtttcaaggttgaaacatgaaaatgtggtggaacttgttgggtattgtgttgatgggattcttagaacacttgcatatgagtttgcaacaatgggatcacttcatgacatccttcatggcaggaaaggtgtaaaaggagcacaaccaggtccagttctctgttggatggaacgagtgaaaatcgcagtagggtctgcaaaagggcttgagtatctccatgaaaagttacaaccaccaataattcaccgtgatattaagtcaagcaatgtcttactttttgatgactacttggcaaagattgctgattttgatctgtctaatcaagctcctgacatggctgcacgacttcattccactcgtgtccttggaacatttggttatcatgctccagaatatgcactgacaggacaacttagtcaaaagagtgatgtttacagctttggtgttgtacttctagagctgttgacggggagaaagccagttgatcatacattgccacgtggtcagcagagtcttgtaacttgggcaactccaagacttagtgaggacaaagtgaagcaatgtgtggatccaaggttgaaaggagactatccacctaaagcaattgccaagatggcagcagttgctgccttgtgtgtacagtatgaagctgattttcgcccaaacatgagtattgtcgtcaaagctctccaacctctgttgaatgcaagacctgctcatgctaatgacagtccatctatgtaatctgcaccatgtatcaaaatatattattccttacactaagactgattatgtgagatattcttttttttgttcttgtacaaacaggtatatattttctgaattgcttcagaatatttggacccaaaacataagtgatgaaaataatttgattatgaattatttgagactgaaggaaatctcaaaagacagcaaatatcacctgaacatgtgcagttgaaggcctgtaattcaattgcaatgtttttcctattgtttccttttcattaccatgtttgtacatatatttacacttaatttataatgtgtcataagaaagttgattccatgacct

SEQ ID NO: 6672 - DNA, 1404 bp, Setaria italica
aaatgagtcgcagccaccacccctctgcttcttcatccttgcctttcgctgaggagccgccagccaagaacatccaccgatccgagcccgccagcctccattgcctcccggcgcagcagataagaaagaagagcaggaagagttcaacaggtcactatgcgccggtggttttgctgcactcatttcgacacaccatatcttgaaaatgaaaatggatttacaagcagtccggatagaacaagtggaaacggtcttacttcaaacagtgatcctgctaaaccaccttccattgaagtacctgcattgttatttgatgaactgaaagaaaagacagatgattttgggtcaaagactttggttggtgaggggtcatatggaagagtatattatgctgttctggaaaatggaaagcatgcagctgtgaagaagcttgatgcttcagcggaccccgagcccgacaatgaatttctagcacaggtctccgttgtttcaagattaaaacatgaaaattttgtggacatgcttggttattgtattgaaagagatcaacgtctgtggctatgaatcgctacaatgggctccctacatgatattttgcatggaagaaaaggtgttgcaggtgcgcagcctggtcctgctctcgactggatgcaaagagtcagaattgctgttgatgctgcaaaaggtcttgagtaccttcatgagaaggtccaaccgtccatagtccatcgagacatacggtctagcaatgttcttttatttgaggactacaaggctaaaattgcagacttcaatctttcaagccaatctccagatatggctgctcgcctacattctacccgtgtccttggaacttttggatatcatgctccagagtatgctatgactggccagctgactcaaaaaagtgacgtttatagtttccttttagagcttctaactggaaggaaacctgtagatcatacaatgccaagaggccagcagagtcttgttacttgggcaacaccaaggctcggtgaggacaaggtgaaacaatgtattgatccaagattaaatggagagtaccctccaaagggagttgctaagcttgcggcagtggcagctctctgcgttcaatacgaatctgagttcagaccaagcatgagcattgtagtcaaggcattgtcaccccttcttgcaaatgcaccatatcaggctgctgctgctactgatacaccttcagatgcctgacaacatgttcaattaagcattcatgtaaagaagtagcatttgtttctcggtatgccatttttatgaattattgtctttcatacatctgaataatgtgtgcttactgtagatgaagggaagaataggagtaatgcaatgatttttgaacacatgtacttcataatgcttgaaaac

SEQ ID NO: 6673 - DNA, 1543 bp, Pennisetum glaucum
atctgctgtggctagcctgcgccaccgccccgcttccgcccttccgcgggcgcggccctccggaagccggaaggtcttggcttagtttgaacatgtcgtgtctggcatgctgtggtggtgaagacactcaaagagcacctgacagtggaggtccataccctggtggctacccagcaaggaatgatgcttatcgcactgctgatccaactcccagaggtacacaacctgtgaaagtgcagccaattgctgtccccactattcctgtagaagaaatcagggaggtcacaaagggttttggtgatgaagctttgattggtgagggttcttttggcagagtgtattttggtgtacttaaaaatggtagaagtgcggcaatcaaaaagttagattcaagtaaacagccggaacaagaatttttggcacaggtctccatggtgtccagacttaagcatgacaatgttgtggagttgcttggttactgtgttgatggaaacactcgtatccttgcttatgaatttgctactatgggttctcttcacgatattctacatggacggaaaggtgtgaaaggagctcagccaggtccagtcctgtcctggacacaacgagttaaaattgctgttggagcagcaaaaggcttggagtatcttcatgagaaagcgcagcctcatatcatacacagggacatcaaatccagcaatgtacttctatttgatgatgatatgtctaaaatagctgattttgacttgtcaaaccaagctcctgatatggcagctcgacttcactcgactagggttcttggaacatttggatatcatgcacctgagtacgcgatgactggacaacttagctctaagagcgatgtctacagttttggagttgttcttctagagctcctgactggaagaaagcccgtggatcatacattgcctaggggacagcagagtctcgtgacatgggcaactccacggcttagtgaagacaaagtcaggcaatgtgttgactcaaggcttggaggggaatatcctcctaaatctgttgcaaagtttgcagcagttgccgcattgtgcgttcaatatgaggctgattttcgaccaaacatgagtattgtggtgaaggcactccagcccctgctaaatgcacgagcatccaaccaccctggatgagaatgactgatcttgcttgtacctgacgcgagtatctgattcagacaatcatgtagcattgtattaagacaaaaatgtggtgtttggcttgatgcacttgtcctagcgtatacaagtatatactatatgccgtttgtttggttgcatttcatacggcgcgctttgatcctcgagaaatgattccgtagaactcctcattccagcctctggttctaggtgattccgtagcctcattacctgttgcggccttaaagttcactcttggtctgccgggcttccagtcaccatcatcagatgaaaatgaacgtgctaaatgcgtatttgacctagaggtcatcttccaagatggttgtatatattattatcgtaagataaaa

SEQ ID NO: 6674 - DNA, 1140 bp, Mimulus guttatus
aaaaaaaaaaatcgaacaatgatgtgttgtggaggtgcagaagaggagccctatagtggtcctccggccaataattataactccgccccgccgaaaactggcaacaattacggcggcgccggtggaggtgacagaggagagccaagaagtggtgctgcaagaaatggacaagctcagaaagttctgcctattgaactcccatcacttccacttagtgagctaaatcgacttacaagtaatttcggcactaaagctcttattggagagggctcttacggtcgagttttctacgccaaattatcggatggtcaacccgcagctatcaagaagctcgattctagttcttcccccgaaccagataacgattttacagcccagttatccacagtttcgaggcttaagaatgagcatttcgtggggttgctagggtactgtcttgaatcagacaaccgaattttggtctacgaattcgccaccatgggttctttacacgatgttttacatggtagaaaaggggtgcaaggggcagaaccaggtccggttcttacgtggggtcaaagggtgaaggttgctttaggagctgcaaaagggctcgaatttcttcacgagaaatgtcagccgtcgatcgtacatcgagatgtaagatcaagcaatgtgcttctcttcgatgattttgtggccaagattgcagattttagtttgaccaatcagtcttctgatactgcggctcgtcttcattccaccagagtactcggaacattcggctaccacgcaccagagtacgcgatgacagggcagataactcagaagagtgatgtttacagtttcggagttgttcttttagagcttcttacagggagaaagccagtagatcacactatgcctaaaggacaacagagtttagtcacatgggcaactccaagattgagtgaagataaagtgaagcaatgtgtggatcccaagctaaatgatgattatccaccaaaggctattgcaaagatggctgctgtagcagcactttgtgtacaatacgaagcggattttcgaccgaacatgacaatagtggtgaaggctttgcagccattactgaactcaacaaaaccagctggacctgattctaatgcataataaatattactt

SEQ ID NO: 6675 - DNA, 1487 bp, Pinus taeda
ctcaacatctcctctggttctgtacacacattgtcagtttgctgatagtttgtgtaccaagaagctttatctgtcatatctctatatatattttgttgtttcttctatcaaaagtttagttatgtatatccggatattgcgtagaagtggcttgagttattgggctacaagaatacgtcgagcttctatgggcagagtcatgaggtgcttcagctgctgcactgcagatgacattcgcatgtcagctgatagtggaagcccctttctatcaaatggcaatataacaggtaacagtgggggtcacaagagtgcagaaactagtaaggatggacaaatcatacaacctatactcattgaagtacctcagatccctatagaggaattgaaggaagcaacagataactttggtccaaaatcattgattggagagggttcctatggtcgggtgtattattcagtcttaagaaatggtcgtactgcagccattaagaagcttgatacaagcaagcaacctgatcaagaatttcttgcacaggtgtccatggtttcaagactaaaacatgaaaatgtattggaacttgttggatattgtgttgagggcagccttcgtgtgcttgcatatgagtttgcaacaatgggatcattgcatgacattcttcatggtagaaaaggtgtaaggggagcacaaccaggtccggtactcacttggatgcagagagtgaagattgctgtagaggctgctaaaggccttgagtacctccatgaaaaggctcagttgcccataattcaccgtgacataaagtcaagcaatatattactttttgatgattgcacggcaaagattgctgattttgatgtatcaaaccaagcacctgacatggcagcacggcttcattccactcgtgtgcttggaacttttggctaccatgctccagaatatgccatgacgggacaactaagtcaaaagagtgatgtttatagttttggagttgtcctcctggagttgttaactggcagaaagccagttgatcatacaatgccgcgtggtcaacagagccttgtgacatgggcaactccaagacttagtgaagacaaagttaagcaatgtgttgattcaagattgaaaagtgactatccacctaaagctgtggctaagatggctgcagttgctgccttgtgtgtgcagtatgaagctgatttccgccccaacatgagcattgtggtgaaagctcttcaacctctactgaatgctagaccagtttctgctggcagaagtccttaattgtaacatcctgtatggttgattttgtcattctttacagcattaaagatgctgtggaagattttggtcatgtttggaacgatcggaaacattgttaaatttgtgttagtcgctgactctgtaatttctgtagtgaaatatctaattgtggactccatcaaccgattaataaaactagcatcaaggaaaaaaaaaaaaaaggccg

SEQ ID NO: 6676 - DNA, 1313 bp, Prunus persica
cttctctgaaaactgaaaacccaattgccagaaccttctcatcataccaaaggagaagagatcatgagctgcttcagttgttgtgtacaagatgatatccgcaaagcttccgagaatggaccgtttgtagcaaataactcagcaggcagtagtggaggttactatcacagagaaactgcaccaaaggatactcagactgtaaatatcctacccattgctgtccctgccattccagtcgatgaattaaaagatttgacagataattttggcacaaagtccttaattggtgagggttcatatggaagagtatatcatggtgttctgaaaagtgggccagctgcagctattaaaaagttagattccagtaaacaacctgaccaagaatttctatcacaggtctccatggtttcaagactaaaacatgaaaatgttgttgagcttgttggttattgtattgatggtcctctccgtctccttgcctatgagtatgctcctaatgggtcacttcatgatattctccacggacggaaaggtgttaagggagcacaggcaggtccagttctgtcatgggtgcaaagggttaaaattgctgttggagcagcaagaggacttgaatatttacatgaaaaggctcagcctcatataatccatcgtgatattaagtcctgcaatatactgctttttgatgatgatgttgcaaagattgctgactttgatctgtccaatcaagcccctgatatggctgcacgtcttcattccactcgtgttcttgggacttttggttatcatgctccagaatatgcaatgaccggacagctgagttcaaaaagtgatgtttacagctttggtgtagttctgcttgaactcttgactgggcgcaaacctgttgatcacacattgccacgtggacagcagagccttgtgacatgggcaacaccgaaactcagtgaagataaggtgaagcagtgtgttgatgctagactcaatggagaatacccttccaaggcagttgcaaagctggctgctgttgctgccttgtgcgtccaatatgaagctgattttcggccaaatatgagcattgtcgtcaaggctctacagccgctattgaatgctcggtccggcccccaccattgaaacaaaaaacgcttggcttcgcgacctgtcaatctctcttgcagacaatattgttgaagattcatttggtaaacatagttgtgtagatcatgtaacatcctctggttcccttgagtcatcaaaatcttactgatcctatatagttcacattgattctgctaccggtttaaaagttgctt

SEQ ID NO: 6677 - DNA, 1488 bp, Oryza sativa
ttttgaaagtgacatacaagttacactatagttacagtgtaattacatgcaagttacagtgtaattatactatgattgtactgtaattacatctgtcaaatttttgagagaaaatttatcgataaatatatagcaaaatcgaaatataatggtgcatcaaaaattctatgcgagggtcgcacgtcgcgagaccggccttgtcgttgtcttcccgcgtgcgtgcatttcgcgcgagtttgtcgcggcaaactcggcgcgtcgcgatgtatatatgctatagtagtagtatcgttgaaccagctagctccgaatccttcaacgtgcgagaggagcggctaattaagctaagttattagctgaattaatcgttcttgcacagctagctagctaagctgtctgtctagctatctgcgtcgcacgatgtggtgttgcagcggcgccgaggaggagctccacggcgcgccggccgccaacccggcggcgccgccaccgcgagcaccagggccgccgagagggccgaacgcgccgagagccggcggcgcgccggcgaaggtgctgccgatcgacgtcccggccgtggcgctggcggagctcaaccgtctcaccggcaacttcggcgacaggtcgctggtcggggagggatcctatggccgcgtgtaccgcgccacgctgagcaccggcgaggccgccgccgtcaagatgttcgacaacaacggcggctccggccagtcagaagccgacttctgcgcgcagctgtccgtggtgtccaggctcaagtgcgaccacttcacccagctgctgggctactgcctggagctcaacaaccgcatcgtgctctacgagttcgccaccaaaggctccctctacgacatcctccacgggaagaagggggtgaagggggcggagcccgggccggtgttgacgtggagccagcgagcacggatcgcgtacggcgcggcgaggggactggagtacctgcacgagcgcgcgcagccaccgatcgtccaccgcgacatccgctccagcaacgcgctcgtcttcgacggccacgacgccaagatcggcgacttcaacctcaccaaccagtcgccggactccgccgcccgcctccactccaccaaggtgctcggcaccttcggctaccacgcgccagagtatgcaatgacgggacaattgacccagaagagcgatgtttacagcttcggtgttgtccttcttgagcttttgactgggaggaagcctgtggatcacaccatgcccaaggggcagcagagcttggttacctgggccactccaaggttaagcgaggacaaggttaagcagtgcgtggatcccaagctgaacgacgagtacccaccaaaggcagtggccaagctcgcggcggtggcggcgctgtgcgtccagtacgaggctgatttcaggcccaacatgacgatcgtcgtcaaggctctgcagcctctcatcagtgctcgtccaggagatcattag

SEQ ID NO: 6678 - DNA, 2009 bp, Sorghum bicolor
agaattcccaaggaaagaccgaagactcggaaccagtacaccactacaccagctttccttctctcctactctcgcttctgcggcgaattttcttggcccgcgccggccgccgtggctaccctgcgccaccgcccccttccgacgccttccgggaagacaaaaggtcttggctaagtttgaacatgtcgtgcttggcatgctgtggaggcgaagatactcaaagaacacctgataatggaggtccataccctggtggctacccagcaagggatgatgcttatcgcactgctgatccaactcccaggggtgctcaacctttgaaagtgcagccaattgtccccactattcctgtagaagaaattagagaggtcacaaaggcttttggcgatgaagctttgattggcgaggggtcttttggcagagtatattttggtgtactagaaaatggtaggagtgctgcgataaaaaagttagattcaagcaagcagccagagcaagagtttttagcacaggtctccatggtgtcaaggcttaagcatgacaatgtcgtagagttgcttggttactgtgttgatgggaacacccgcatccttgcttatgaatttgctactatgggttctcttcacgatatgcttcatggacgcaaaggtgtgaaaggagctcagcctggtccagtcttgtcctggatacaacgagtgaagattgctgttggagcagcaaaaggcctcgagtatcttcatgagaaagcgcagcctcatatcatacacagggacataaagtccagcaatgttcttctatttgataatgatgtatccaaaatagctgattttgatttgtcaaaccaagctcctgatatggcagctcgacttcattcgaccagggttcttggaacatttggctatcatgcacctgagtatgcaatgactggacaacttagctctaagagtgacgtctacagttttggagttgttcttctggagctcctgactggaagaaagcctgtggatcatacattaccaagaggacagcaaagccttgtgacatgggcaactccacggcttagtgaagataaagttaggcaatgtgttgattcaagacttggaggagaatatcctcctaaatctgttgcaaagtttgcagctgttgctgcactctgtgtgcaatatgaagctgactttcgaccaaacatgagcatcgtggtgaaggcgctccagcccctgctgaatgcacgtgcatccaacaaccctggatgaatgaatgactgccgttgcttttacctgacgagagtatcagaatcagacaaatcatgcagcattgaattaagataaatatggtgtttggcttatacacttgaccctggatgttcatcaggagataatctcttgcagtttctggatgttacctactagtgtctgtatcctgagtgccatagactataaactgtgacctattgttcggttgcattccatctggtgtcggttagatccatgaggtcaagcagcatccagtttgaggatccagtaaaattcctcattgtagcctccgattcaaaatgattcgttacagttaatacatggtctggctttctgttatcaccacacgaagacgagggtattagagcctgcttgtttgaaggcgagtaggctaaaatgtaaggcacacaaatattagggcaagccaatattttgatagagcaatcgaatcaaggtccttggttcgctaccaacaagataaagatggtgccttgccaatattttggaaggcattgccaaaaatttagtaaaaatttgcttacagccattaatgcatattttacattgccatcctgtgatgagtatcaccataattttacatcacacattttcccatttcaaatggcaaaggctatagtgtggcttggacatggtacagtcacactgatatgtcatgggcgtgatgccaacaaatttggtttggatcgtaaagcaaaatttggtgatcaattacatagataatggcatatctttctt

SEQ ID NO: 6679 - DNA, 1309 bp, Picea glauca
  misc_feature (905)..(906): n is a, c, g, or t
  misc_feature (909)..(909): n is a, c, g, or t
gtcatgaggtgcttcagctgctgcactgcagatgacattcacaggtcagctgatggtggaagtccctttctatcaaatggcaatacaacaggtaacaatgggggtcacaagagtgcagaaactagtaaagatggacaaatcatacaacctctactcattgaagtacctcagattcctatagaggaattgaaggaagcaacagataactttggtccaaaatcattgattggagagggttcctatggtcgggtgtactattcagtcttaagaaatggtcgtactgcagccattaagaagcttgatacgagcaagcaacctgaccaagaattccttgcacaggtgtccatggtttcaggattaaaacatgaaaatgtattggaacttgttggatattgtgttgagggcagccttcgtgtgcttgcatatgagtttgcaaccatgggatcgttgcatgacattcttcatggtagaaaaggtgtaaggggagcacaaccgggtccggtactcacttggatgcagagagtgaaaattgctgtagaggctgctaaaggccttgagtacctccatgaaaaggctcagtctccaattattcaccgtgacataaagtcgagcaatatattactttttgatgattgcacggcaaagattgctgattttgatgtatcaaaccaagcacctgacatggcagcacggcttcattccactcgtgtgcttggaacatttggctaccatgctccagaatatgctatgacgggacaactaagtcaaaagagtgatgtttatagctttggagttgtcctcctggagttgttaactggaagaaagccagttgatcatacaatgccgcgtggtcaacagagccttgtgacatgggcaactccaagacttagtgaagacaaagttanncantgtgttgattcaagattgaaaggtgactatccacctaaagcagtggctaagatggctgcagttgctgccttgtgtgtgcagtatgaagctgatttccgccccaacatgagcattgttgtgaaagcccttcaacctctactgaatgctagaccagttcctgctggcagaagtccttaattgtaacatcctgtatggttgattttgtcattctttatggcattaatgatgctgtggaagattttggtcgtgtttggaacaatcggaaacattgttaaatttgcgttaatcgctgactacataattcctgaagtgaaatatgtaattgtggactctatcaaccatataatacaccagtatcagggaaactctagaagtgagactcggtatgcccaagaaaaaa

SEQ ID NO: 6680 - DNA, 1546 bp, Saccharum officinarum
ctccgaaccagtacaccagcttttccttctctcctactctcgcttttgcggcgaattttcttgccccgcgccggccgccgtggctaccctgcgccaccgcccccttccaacgccttccgggaagacaaaaggtcttggctgagtttgaacatgtcgtgcttggcatgctgtggaggcgaagatactcaaagaacacctgataatggaggtccataccctggtggctacccagcaagggatgatgcttatcgcactgctgatccaactcccaggggtgctcaacctgtgaaagtgcagccaatcgctgtccccactattcctgtagaagaaattagggaggccacaaaggcttttggcgatgaagctttgattggtgaggggtcttttggcagagtatattttggtgtactagaaaatggtaggagtgctgcgatcaaaaagttagattcaagcaagcagccagagcaagagtttttggcacaggtctccatggtgtcaaggcttaagcatgacaatgtcgtagagttgcttggttactgtgttgatgggaacacccgcatccttgcttatgaatttgctactatgggttctcttcacgatatgcttcatggacgcaaaggtgtgaaaggagctcagcctggtccagttttgtcctggatacaacgagtgaagattgctgttggagcagcaaaaggcctcgagtatcttcatgagaaagcgcagcctcatatcatacacagggacatcaagtccagcaatgttcttctatttgatgatgatgtatctaaaatagctgattttgatttgtcaaaccaagcccctgatatggcagctcgacttcattcgaccagggttcttggaacatttggctatcatgcacctgagtatgcaatgactggacaacttagttctaagagtgacgtctacagttttggagttgttcttctggagctcctgactggaagaaagcctgtggatcatacattaccaagaggacagcaaagccttgtgacatgggcaactccacggcttagtgaagataaagttaggcaatgcgttgattcaagacttggaggagaatatcctcctaaatctgttgcaaagtttgcagctgttgccgcactctgtgtgcaatatgaagctgactttcgaccaaacatgagcatcgtggtgaaggcgctccagcccctgctgaatgcacgtgcatccaacaaccctggatgaatgaatgactgcggttgcttttacctgacgagagtatcagaatcagacaaatcatgtagcattcaattaagataaatatggtgtttggtttaatacacttgacccgggatgttcatcaggagataacctcttgcagtttctggatgttacctactagtctctgtatcctgagtgccatagactataaactgtaacctactgttcggttgcattccatccggtgtcggttagatccatgaggtcaagcagcaaccaatttgaggatcccaataaaattactcattgtagcccccgattcaaaatgattcggtacaggttaagg

SEQ ID NO: 6681 - DNA, 1437 bp, Panicum virgatum
  misc_feature (125)..(125): n is a, c, g, or t
  misc_feature (515)..(515): n is a, c, g, or t
  misc_feature (535)..(535): n is a, c, g, or t
  misc_feature (820)..(820): n is a, c, g, or t
  misc_feature (868)..(868): n is a, c, g, or t
ccgcgacgagacggccgtcccctcggtcgtccggtcgccacacgtcctccgcctcgtcggcgagggggagcggcggcagtcacctccgccttgaatccaacaattcatcagaaaaaaggctcccnggccgatccgatccaccggatcggccacacataacgccacggtggtgtgagggaagccggccggcaagatgatttgctgctgcggtggcgcggaggagacgtacgccgtgcctgccagccggcacccagcagcgcctacgtcgcagaacaatgcagctcccggcaagccaagagggcccaatgcgccgaggaccggcggcccgccgaaggtcctccccgtcgacgtgccggccatatccatgggcgagctgaacagcatcaccgggaatttcggccagaaggccctcatcggggaaggctcctacggcaagatctacaaggccgtgctcgcctccggggagcccgtcgccatcaagaagctcgaccccagcgtgtccagcgattccctcncagacttctctcagctgtcnatggtctcgaggctcaagaacgagtacttcctccagctgatgggctactacctggacgacagccacaggatcctcgtctaccagttcgcctcaaacggctccctgcacgacaccctgcacggcaagaagggcgtgaaggacgcgacgcccgggccggcgctgagctgggcgcagcgggtgaagatcgcgtacggcgcggcgagggggctcgagtacctgcacgagaaggtgcagccgtccatcgtgcaccgggacgtgcgctccagcaacgtcctcctcttcganggctacgagtccaagatcgccgacttcaacctcaccagccagccgccngacggcgccgcgcggctccactccacgcgcgtcctggggaccttcggctaccatgcgcccgagtacgcgatgacaggagtcttgacgcagaagagtgatgtatacagctttggagtgatactcctggaactactgaccggcaggaagcccgtggaccacaccatgcccaagggacagcagagccttgtaacatgggcgacgccgaggctgagcgaggacaaggtcaagcaatgcgtggacccgaagctgggggaggattatcctccgaaagcagtagccaagttggcagcggtggcggccttgtgcgtgcaatacgagtccgatttccggccgaacatgaccatcgtggtgaaggcgttgcagccgcttgtcaaggcagccgcagccgcagctgaggggccggcctagcagtacatgatagacgacacacaaccatctctccaccacctgtactcaaacctcttcttgtgtaactgccacgttttgcgtacatcttcagtggttgtaatgtaatcaacatgtactctctgatcgatctgcaaaggattcaagcaaatgtgttcatcacc

SEQ ID NO: 6682 - DNA, 1726 bp, Hordeum vulgare
agaggcctgctacgccacgccacgccaaagacactcggaatcgggacgtaaacccctccccccaccaccactaccggtaatagtccgtctcccttcctccgccccgccccccagctgcccgccagcccgtcgcccgccgcgcctccccaactcctcgcctcgccgccggagcgacggaggccgagcccgatcgcggatcgggtgcccccaaagttcggccgccctcccgggttgacccctcgcagtacccagaggcagatagataggaagaagtaaaataaaaggaggtcattatgcgccgatggttttgttgcagtcagtttcatgcttcatatcgtgaacatgaacatgaatttccttccagcccagatgagaaagaaggaaatggttttgataccaaaagtgatccaacaaaagcacctcctcccattgagatacctgaattgtcacttgatgaactgaaagaaaagaccgacaactttgggtcaaaagctttgatcggtgaaggatcatacgggagagtatattatgctattctagacagcggaaaacatcttgctgttaaaaagcttgatacctcagcagaccctgagcctgataatgaatttctgacacagctctcgattgtgtcgagattaaagcatgaaaattttgtggaaatgcttggctactgtgtggaaggaaatcaacgtctggtagcctatgaatttgctacgatgggttctctacatgatattttgcatggaagaaaaggtgtccctggcgcacagcctggcccagcacttgactggatgcagcgagtcaaaattgctatagatgctgctaaagggctggcatatcttcatgagaaggttcaaccttcgatagtccatcgggacatacggtctagcaatgtccttctatttgaggactacagagcgaaagtcgcagattttaatctttcaaaccagtctcctgatatggctgctcgtttgcattccacccgtgtgcttggaacctttggctatcatgctcccgagtatgccatgactggccagctaactcagaaaagtgatgtatatagctttggagttgttcttttagagcttctaacaggaaggaaaccagtagatcatacaatgcctagaggccagcagagtctggttacatgggcgacgcctcgtttgactgaggatacagtgaagcaatgtattgacccaaggttgaagggagagtgccccccgaaaggcgttgccaagcttgcggcggtggctgccctctgcgtgcagtacgaatcggagttcagacccagcatgagcatcgtcgtcaaggcgctctcgccccttcttcagcagaaacctcaagctccaccagcggctgctcccaacacagcgacttcagacgcctgacctacccagttcaacaaacaaggatgtaaaaaaaagagagtgccaagacacatgttgttctgtttttaccgagagtaccaccgtcgctttgctgagttctagaacggaccgtgtgattctgccgagtgatgcgctcttgctgcatttgttggcggtcaccttaataagctgtgttctgggtggtatatatggatatgctgtaacatgggaacttgggaaggttgtagttggtccgtggcttgatgtttctgggtttgccgttgtgattttgagccgacacccattgatttgtataacctgctgaactcgaagttggtgtgagatgtgagaaatggtaa

SEQ ID NO: 6683 - DNA, 1141 bp, Pseudoroegneria spicata
  misc_feature (1129)..(1131): n is a, c, g, or t
gtatagataggaagaagtaaaataaaaggaggtcactatgcgccggtggttttgttgcagtcagtttcatgcttcatatcgtgaacatgaacatgaatttccctctagcccggatgagaaagaaggaaatggttttgattccaaaagtgatccaacaaaagcacctcctcccattgaaatacctgaattgtcacttgatgaactgaaagaaaagaccgacaactttggatcaaaagctttgatcggtgaaggatcatacgggagagtgtattatgctattctagacagcggaaaacatcttgctgttaaaaagcttgatacctcagcagaccctgagcctgataacgaatttctgacacagctctcgattgtgtcgagattaaagcatgaaaattttgtggaaatgcttggctactgtgtggaaggaaatcaacgtctggtggcctatgaatttgcgacgatgggttctctacatgatattttgcatggaagaaaaggtgtccctggtgcacagcctggcccagcacttgactggatgcagagagtcaaaattgctatagatgctgctaaagggctggcatatcttcatgagaaggttcaaccttcgatagtccatcgggacatacggtctagcaatgtccttctatttgaggactacagagcgaaagttgcagattttaacctttcaaatcagtctcctgatatggctgctcgtttgcattccacccgtgtccttggaaccttcggctatcatgctcctgagtatgccatgactggccagctaactcagaaaagtgatgtatatagctttggagttgttcttttagagcttctaacgggaaggaaaccagtagatcatacaatgcctagaggccagcagagtctggttacatgggcgacacctcgtttgactgaggatacagtgaagcaatgtattgacccaaggttgaagggcgagtggcccccaaaaggcgttgcgaagcttgcggcggtggcagccctctgcgtgcagtacgaatcggagttcagacccagcatgagcatcgtcgtcaaggcgctctcaccccttcttcagcagaaacctcaagctccaccagccgctgctcctaacacaacgacttcagacgcnnnggaagaattc

SEQ ID NO: 6684 - DNA, 640 bp, Raphanus sativus
gggggcacagccaggtccaacgcttgactggacaacaatggtgaaaatagctgtggaggcagctaggggtttggaataccttcatgagaagtcgcagcctcctgtaatcctcagaagagtgatgtgtacagctttggggtcgttcttctagaacttctaacagggaggaaacctgtggaccacaccattcctcgtggtcaacaaagtcttgtaacttgggcgacaccaagactcagtgaagatcaagtcaaacaatgcattgatccaaagctaaaagcggattaccccccgaaagcagttgctaagctagcagcagtggcagcattgtgtgtgcaatatgaatctgagtttagaccaaatatgagcatagttgtgaaagctctgcagccgctcctcaaacttgcagctccagctcctccctctccagcaccagcaccagaatcttgaaactttttctttcatttgaaactttactataaaagatgatattatgtttcatttgttggatgattgattttgcacacagttttgttgtgctagaagaggagagatcatgtcaaagtttataagagtttccattttggtgactgagacagataacaaagacttttgactattaattaataatatcattattgca

SEQ ID NO: 6685 - DNA, 1657 bp, Triticum aestivum
gtcgcccgccgcgcctcccctcctcctccccctcgtcgagccgccggaggccgagcccgatcgcggatcgggtccccgggtgcccctccagtccagaccagccgcgctcccgggttgacccctcgcaggaaccagaggcagatagataggaagaagtaaaatagaaggaggtcattatgcgtcggtggttttgttgcagccagtttcatgcttcatatcgtgaacatgaacatgaatttccttccagcccggatgagaaagaaggaaatggttttgattccaaaagtgatccaacaaaagcacctcctcccattgaaatacctgaattgtcacttgatgaactgaaagaaaagaccgacaactttgggtcaaaagctttgatcggtgaaggatcgtacgggagagtgtattatgctattctagacagcggaaaacatcttgctgttaaaaagcttgatacctcagcagaccctgagcctgataacgaatttctgacacagctctcgattgtgtcgagattaaagcatgaaaattttgtggaaatgcttggctactgtgtggaaggaaatcaacgtctggtggcctatgaatttgctacgatgggttctctacatgatattttgcatggaagaaaaggtgtccctggtgcacagcctggcccagcacttgactggatgcagcgagtcaaaattgctatagatgctgctaaagggctagcatatcttcatgagaaggttcaaccttcgatagtccatcgggacatacggtctagcaatgtacttctatttgaggactacagagcgaaagttgcagattttaatctttcaaaccagtctcctgatatggctgctcgattgcattccacccgtgtccttggaaccttcggctatcatgctcctgagtatgccatgactggccagctaactcagaaaagtgatgtatatagctttggagttgttcttttagagcttctaacaggaaggaaaccagtagatcatacaatgcctagaggccagcagagtctggttacatgggcgacacctcgtttgactgaggatacagtgaaacaatgtatcgacccaaggttgaagggcgagtgtcccccgaaaggcgttgccaagcttgcagcggtggcagccctctgcgtgcagtacgagtcggagttcagacccagcatgagcatcgtcgtcaaggcgctctcgccccttcttcagcagaaacctcaagctccaccagccgctgctcctaacacaacgacttcagaagcctgacctgtccagttcaacaaggatgtatgtaaaaaaaaaagtgctaagacgcatgtcctggcgtgtgcgttgttttgcttttaccgagagtaccgtgtcgctttgctgagttcaagaacggggctgtgtggttctgccgagtgatgtgctcttgctgcattcgttggcgatcaccttaataagctgtgttctgggtcgtatatatatgctgtaacatgggaacttgggaaggttgtagttggtccgtggcttgatgtttctgggtttgccattgtgattttgagctgacacccattgatttgtataatctgctgaactcgaagttggtgtgagatgtgaggaatggtaacattattgtccatttttattacctgcttgcctgatcaaaa

SEQ ID NO: 6686 - DNA, 1385 bp, Citrullus lanatus
cgatgttctgctgcggaggtgtggaggaggaaaattttggcgcgccttcgagtcaatatacagccccaccgaggggcaatacatacggtggcagcgagagaggagaacccaggagttccaatgttgtcagaactggagctccccagcaagttttgcctattgaaacaccagtcattccactggatgagttaaataggttgacgggtaattttggtacgaaatcttttattggtgaaggttcttacggccgggtttattacgcgacattaaagagcggtcaggctgctgcaataaagaaactggatactagttcttcaccagagcctgacactgattttgccgctcagctatcaactgtttctagacttaagcaagagaactttttggagttaattgggtattgtttggaggcaaataatcgaattttggtatatcagtttgccaaaatgggttctttgcacgatatattacatggaagaaaaggagtacaaggggctgagcctggtccagttctcacttggaatcagagagttaaaattgcctatggtgcagcaaaaggccttgaatatttacatgagaaggttcagccttcaatagtacatcgtgatatccggtcgagcaatgtccttctatttgatgacttccttgcaaagatcgctgatttcaacttgactaatcagtcatccgacacagcagcacgacttcattcaactagggtcttaggaacatttggataccatgctccagagtatgctatgacaggacagattactcagaagagtgacgtgtatagtttcggtgtagttcttctcgaacttttgacaggacgaaagccagtagatcacacgatgcctaagggacaacagagtcttgttacttgggcaacaccgagattaagtgaagacaaggtgaaacagtgtgtagatcccaagctaaacaacgattacccaccaaaagcgatagcaaagttggcagcagttgcagccctgtgtgttcagtacgaggctgacttcaggccaaacatgacaattgtggttaaggccctccagccacttctgaattcttcaaaaccaccgggacctgaatctcaaccacatccatgagattattcacattttggttaacatacaggtgcaggcgaaggcacagcgtgagcacagtaaatctctcctataatttgtaattttattccattaatcttcagttaaaagcatctttgaaaggaaattgtcaagacgcccaaatcttgctcatttagttattatcatttttcacctatacccaacttaggaacttgatctgattcaggatttcataaaatagtatgtactgtaccattgataaatgataaaacagcaaaattttgtttatccaaatcacaaaag

SEQ ID NO: 6687 - DNA, 1372 bp, Cucumis sativus
cgatgttttgctgtggaggtgtggaggaggaaaattttggtgcgccttcaagtcaatatacagccccacctaggggaaatacatacggtggcagcgagagaggagagcccaggacttccaatgttgtcagaagtggagctccccagcaagttttgcctattgaaactccagtcattccactggatgagttaaataggttgacgggtaattttggtacgaaatcttttattggtgaaggttcttatggccgggtttattacgcaacgttaaagagcggtcaggctgctgcaatcaagaaactagatactagttcttcaccagagcctgacactgattttgccgctcagctatcctctgtttctagacttaagcaagagaactttttggagttaattgggtattgtctggaggcaaataatcggattttggtatatcagtttgccaaaatgggttctttgcacgatatactacatggaagaaaaggagtacaaggggctgagcctggtccagttcttgcttggaatcagagagttaaaattgcttatggtgcagcaaaaggccttgaatatttacatgagaaggttcagccttcaatagttcatcgcgatatcaggtcgagcaatgtccttctctttgacgacttcctagcaaagatcgctgatttcaacctgactaatcagtcatctgacacagcagcacgacttcattcaactagggtcttaggaacgtttggataccatgctccagagtatgctatgacaggacagattactcaaaagagtgacgtgtatagtttcggtgtagttcttctcgaacttttgacaggacgaaagccagtagatcacacaatgcctaaaggacaacagagtcttgttacttgggcaacaccaagattaagtgaagacaaggtgaaacagtgtgtagatcccaagctaaacaacgattacccgccaaaggcaatagcaaagttggcagcagttgcagccttatgtgttcagtacgaggctgacttcaggccaaacatgaccattgtggttaaggctctccagccacttctcaattcctcgaaaccaccaggacctgaatctcaaccacacccatgagaatattcacattttgattaacatacaggttcaaggcacaaccgtagcacgtgcacagtcatctcttctgtaatttgtaatcttattccattattcttcagttaaaagcatcgttggaaagaaaatgtcaagatgcccaaatcttgctcatttagttattatcatttttcacctaaacccaacataggaacttgacctgcttcaggatttcataaaatagtatgtattgtaccaattataaatgataaaaatggcaaaattttgtttat

SEQ ID NO: 6688 - DNA, 1463 bp, Sorghum bicolor
ccctcttctctcgtaggtgccgtcggagcttgcttttggggaggtcgtgcggcatgatctgctgaccgaccccaaatcaaccccggccgcgcatcgaccgtcgccgccatccagtccggaggaggaggagaggaaccgacaattaaagatgtcttgctgcggtggcgccgaggaggacagctacggcccgccggccaaccaggcggttccgccacccaatgccaatgcccccggcaaccgaggtgggccgaggggaccgggcgcgcccagggtcggcggccccgccaagcccgtgagcatcgacgtgcccgccatccccttcgacgagctcaagaagatcaccaacaacttcagcgaccgcgccctcatcggcgagggctcctacggccgcgtctacaacgccaccctcagcgacggccgcgccgccgtcatcaagaagctcgacaccaacgcctcgcaagactccgacaccgacttcgccgcgcagatagcgatggtctccaagctcaagaacgagtatttcctggagctcttggggtactgcttggaggacggcacccgcatgctagcctaccagtttgccacaatgggttctttgcataacatactacacgggaagaaaggagttcagggtgcggagccaggccccgtgctcaactgggctcagcgagtgaagatagcttacggagcagcaagagggctagagtacctccacgagaaggtccagccgtcgatcgttcaccgagacatccggtccagcaacgtcctcatattcgacgatttcagctccaagatcgctgatttcaacctcaccaaccaggggaccgacaccgccgcacggttgcactccactcgtgtgctagggacttttggataccatgccccagaatacgctatgacaggccagatcaaccaaaagagcgatgtctacagcttcggcgtgatccttctagagttgctgaccggaaggaagccggtcgatcacaccatgccgaaaggccaacaaagtcttgttacttgggccactccaaggttgagtgaagataaagtgaagcagtgtgttgatccgaagctcaacagtgactaccctccaaaggctgttgcaaagctggcagcagttgcagcgttgtgcgttcagtacgaatccgatttccgaccaaacatgaccatcgtggtgaaggcgatcacgcctcttctaaatgcacccaaaccagccgctccagcagcagcaccacaatcctgatcaaccagatgacagaattagcctgctcatatctgactcctgaacacgatcgtagaagtatgttaaggaaccacgcatccttgctccatcgatccagcgcctatgcttttgtaaaaaccactaatctgctggtactgcaggacacatataggggaattttgtaaaatgttaatccagtactctgaattcgtgtgcttttttgtttgtcttgtgatataac

SEQ ID NO: 6689 - DNA, 1745 bp, Sorghum bicolor
gcgcgatcgatcgatccatccagcagttaaaacgggtgggacgcctcctttcccgcggaaaaaggagctcccaccgctaatctatcgtcctcctccctccctccctcccccgcggccggccacccacgccgttgctgctgttctcgccctcttctctcgtaggtgccgtcggagcttgcttttggggaggtcgtgcggcatgatctgctgaccgaccccaaatcaaccccggccgcgcatcgaccgtcgccgccatccagtccggcgaggaggaggagaaggaggaggaggagaggaaccgacaattaaagatgtcttgctgcggtggcgccgaggaggacagctacggcccgccggccaaccaggcggttccgccacccaatgccaatgcccccggcaaccgaggtgggccgaggggaccgggcgcgcccagggtcggcggccccgccaagcccgtgagcatcgacgtgcccgccatccccttcgacgagctcaagaagatcaccaacaacttcagcgaccgcgccctcatcggcgagggctcctacggccgcgtctacaacgccaccctcagcgacggccgcgccgccgtcatcaagaagctcgacaccaacgcctcgcaagactccgacaccgacttcgccgcgcagatagcgatggtctccaagctcaagaacgagtatttcctggagctcttggggtactgcttggaggacggcacccgcatgctagcctaccagtttgccacaatgggttctttgcataacatactacacgggaagaaaggagttcagggtgcggagccaggccccgtgctcaactgggctcagcgagtgaagatagcttacggagcagcaagagggctagagtacctccacgagaaggtccagccgtcgatcgttcaccgagacatccggtccagcaacgtcctcatattcgacgatttcagctccaagatcgctgatttcaacctcaccaaccaggggaccgacaccgccgcacggttgcactccactcgtgtgctagggacttttggataccatgccccagaatacgctatgacaggccagatcaaccaaaagagcgatgtctacagcttcggcgtgatccttctagagttgctgaccggaaggaagccggtcgatcacaccatgccgaaaggccaacaaagtcttgttacttgggccactccaaggttgagtgaagataaagtgaagcagtgtgttgatccgaagctcaacagtgactaccctccaaaggctgttgcaaagctggcagcagttgcagcgttgtgcgttcagtacgaatccgatttccgaccaaacatgaccatcgtggtgaaggcgatcacgcctcttctaaatgcacccaaaccagccgctccagcagcagcaccacaatcctgatcaaccagatgacagaattagcctgctcatatctgactcctgaacacgatcgtagaagtatgttaaggaaccacgcatccttgctccatcgatccagcgcctatgcttttgtaaaaaccactaatctgctggtactgcaggacacatataggggaattttgtaaaatgttaatccagtactctgaattcgtgtgcttttttgtttgtcttgtgatataacatgtgcagttttagaaagtacacatgttgtttccagctagaaaggtagacataacctcaaaattctttttaataattcacataaagtgatgctgaacaaaagcttgctaattatgtgct

SEQ ID NO: 6690 - DNA, 1590 bp, Amorphophallus konjac
ctcctcctcgttaccgcattcctcaaaaccctaacgctgatctgagcgcagcagatctatctctctctcgctcgctcacccccacgctgtgcgctcatccgggtggttgcagacggatgcaccttcagctatcttccctggtaacgtgagtagtcctactagggacgaattgtgaggaagcaggacaggatgcggcggtggttgtgctgcgttcgtcatctggaagattctcgccattcaaatgagaatgactacatgagaagcccaaagaatcacctggatggtaatctaaagaactcaaagctttccaatgttgttaactctgaagcacataaggcactacccactattgatgtacctgcaatatctctagatgaactcaaagaaaaaactgataattttgggtcaaagtgtttgattggggaaggttcatatggaagggtatattatgcacgtttgaacaatgggaaagatgttgcagtaaaaaacttgatgtttcatctgagcccgagtccaacaatgaatttttaactcaggttgcaatggtcgcaaagctgaagcatgacaatgttgttgaattactgggttattgtgttgaaggaaatctccgtgtgttgtcatacgagtatgcaacaatgggctctctgcacgatgttttgcatgggcggaaaggagttcaaggtgcacaacctggtcctgtgcttgactggatgcagcgagtgagaattgctgttgatgccgcaagagggctagagtatctgcatgagaaggttcaaccttctataatacacagagatatcagatcaagcaatgtactcttattcgaggacttcagagccaaaattgcggatttcaatcttttaaatcaggctccagatatggctgcacgtcttcattctacacgtgttttggggacctttggctaccatgcaccagaatatgctatgactggtcaattgaccatgaagagtgatgtgtatagctttggtgttgttcttttggagcttctgactggcaggaagccggtggatcatacgatgcctaggggtcagcagagtctagtgacgtgggcaactccaaggttgactgaagataaagttaaacagtgcgtggacccgagattgaagggggagtatccacccaaaggagttgctaagctagcggcagttgcagctctatgtgtgcagtatgaagctgacttcaggccaaatatgggcattgtagttaaagcacttcagccacttcttgcacagaagcatgttgctcccacacctgctcccgcggccgcccccgtccctaccgccgacctggagacttgaaagaataagctcatgcatgagaaccctgagattcccctctggtttagtttggttttccagagaatgcgtccattgttcaaatatttgcttttattggtttggtggctgatgtgcacaacatttgctgtgcttttcattcgaggatatgcaggttgccatactgcgtttcgttttcttgttttgtacattcgaaaaactgtaaatcataaattagacctatatcaggatattgaaaacgaatatttctgtatatgtttactctagaaatgag

SEQ ID NO: 6691 - DNA, 1015 bp, Eucalyptus grandis
aggtggcgagagaggggagacaaggagctccaatgtcgtcagaagtggagctacgcaaaaggttttgcccattgaaataccggctttgccattaaacgaactgaataggttgacagggaacttcggttcaaaagcgttgattggggaaggttcttatggccgcgtgttctacgcgaggttaagtactggagaggaagcagcagtaaagaaattagataccagtgcttcacaagaacccgactcggatttcgcagcgcagctgtcgactgtttcgaggcttaagaatgaacatttcgtggagctgattggatactgcttggaggcgaataacagaatcttggtgcatgagtttgctaccatgggttctctacatgatgtcttacatggaaggaagggtgtgcagggtgctgagcccggtcctgttcttacttggaatcagagagtcaaaattgcttatggtgcagcaaaaggccttgattatctgcatgaaaaggttcagccttctattgttcatagggatgtcagatccagcaacgtcctactattcgacgattttgtcaccaagattgcggactttaacttgtcgaatcagtcttcggacacggctgctcgactgcattcgactagagtcttgggaacctttggataccatgctccagaatatgcaatgacggggcagataactcagaaaagtgatgtttacagttttggggttgttctactagagcttttgacaggaagaaagcctgtagaccatacaatgcccaaaggacagcagagtcttgtaacttgggctacgccaagactgagtgaagacaaagtgaaacaatgcgttgacccaaagcttaatgatgactacccacctaaggcaatcgcaaagctagctgcagttgcagcactgtgtgtgcagtatgaggcagatttccggccgaacatgacaatcgttgtcaaggcactgcagccgctgcttcattctaaaccagcaggcccggactctcatttgtagaattttaag

SEQ ID NO: 6692 - DNA, 1380 bp, Setaria italica
gaggaggaggagaggagccagagatgtcttgctgcggaggcgccgaggaggacagctacggcccgccggccaaccaggcggctccgccacccaatgccaacgcccccggcaacagaggcgggccgagggggccgggcgcgcccaggcctgggggccccgccaagcccgtcagcatcgacgtgcccgccatacccttcgacgagctcaagaagatcaccaacaacttcagcgaccgtgccctcatcggcgagggctcctacggccgcgtctacaacgccacgctcagcgacggccgcgccgccgtcatcaagaagctcgacaccagcgcatcgcaggactccgactccgacttcgccgcgcagatagcgatggtctccaagctcaagaacgagtacttcctcgagctcatggggtactgcttggaggatggcaaccgcatgctggcctatcagtttgccaccatgggttctttgcataacatactacacgggaagaaaggagttcagggtgccgagcccggtccggtcctgaactggttgcagcgagtgaagatagcttacggagcggcgagagggctagagtacctccacgagaaagtccagccgtcgattgtgcatcgagatattcggtccagcaacgttcttatattcgacgacttcagctccaagattgctgatttcaacctgaccaaccaggggaccgacaccgctgcccggttgcactcgacccgtgtgctaggaacgtttggataccatgccccagaatatgctatgacgggccaaatcaaccaaaagagtgatgtatacagttttggtgtgattctcctagagctactgacaggaaggaaaccggtcgatcacaccatgccgaaagggcagcaaagtcttgttacttgggccactccaaggttgagtgaagataaagtgaagcagtgtgttgatcccaagctcaacaacgactaccctccaaaggctgtcgcaaagctggcagctgttgcagcgttgtgcgttcagtatgaatccgacttccgaccgaacatgaccatcgtcgtgaaggcaatccagcctcttctaaatgctcccaaaccagccgctccagcagcgccacaatcctgatcaatcggatgagagtattagtcttgcacattgctgattcctgaacttggttcccctctgtttctgattgcaaatgtatgttttaaggaaccacgcatccttgctccatcagtccagcgcctatgcttctgtaaaaagccacttatctgccagtactgcaggatacatataggggaattttgtaaaatgttaatctggtacgctgaattagcgtgttttttttgtatgtctcgtgagtgtgacataacatgtgcattttttttgc

SEQ ID NO: 6693 - DNA, 1656 bp, Setaria italica
gatcgatccagcagctaaaacgggcgggacgcctcctttcccgcggaaaaagggagctcccaccgctcgccaccactaatctttcatcgttctccaccctacccccgcggccgggcaccaacgccgcggctgttctcctgcgctccctccggccctgcttctcgctcgtaggtgccgccggagcttgcttttggggaggtcgtgcggcatgatctgctgaccgcccccaaatcaaccccgcgcatcgtcgtcatccagtccggcgaggaggaggaggaggaggaggagaggagccagagatgtcttgctgcggaggcgccgaggaggacagctacggcccgccggccaaccaggcggctccgccacccaatgccaacgcccccggcaacagaggcgggccgagggggccgggcgcgcccaggcccgggggccccgccaagcccgtcagcatcgacgtgcccgccatacccttcgacgagctcaagaagatcaccaacaacttcagcgaccgcgccctcatcggcgagggctcctacggccgcgtctacaacgccacgctcagcgacggccgcgccgccgtcatcaagaagctcgacaccagcgcatcgcaggactccgactccgacttcgccgcgcaaatagcgatggtctccaagctcaagaacgagtacttcctcgagctcgtggggtactgcttggaggatggcaaccgcatgctggcctatcagtttgccaccatgggttctttgcataacatactacacgggaagaaaggagttcagggtgccgagcccggtccggtcctgaactggttgcagcgagtgaagatagcttacggagcggcgagagggctagagtacctccacgagaaagtccagccgtcgattgtgcatcgagatattcggtccagcaacgttcttatattcgacgacttcagctccaagattgctgatttcaacctgaccaaccaggggaccgacaccgctgcccggttgcactcaacccgtgtgctaggaacgtttggataccatgccccagaatatgctatgacgggccaaatcaaccaaaagagtgatgtatacagttttggtgtgattctcctagagctactgacaggaaggaaaccggtcgatcacaccatgccgaaagggcagcaaagtcttgttacttgggccactccaaggttgagtgaagataaagtgaagcagtgtgttgatcccaagctcaacaacgactaccctccaaaggctgtcgcaaagctggcagctgttgcagcgttgtgcgttcagtatgaatccgacttccgaccgaacatgaccatcgtcgtgaaggcaatccagcctcttctaaatgctcccaaaccagccgctccagcagcgccacaatcctgatcaatcggatgagagtattagtcttgcacattgctgattcctgaacttggttcccctctgtttctgattgcaaatgtatgttttaaggaaccacgcatccttgctccatcagtccagcgcctatgcttctgtaaaaagccacttatctgccagtactgcaggatacatataggggaattttgtaaaatgttaatctggtacgctgaattagcgtgttttttttgtatgtctcgtgagtgtgacataacatgtgcattttttttgc

SEQ ID NO: 6694 - DNA, 1355 bp, Eutrema halophilum
atattattaacagataaaacagagattggcaaaaacagaaccgaaacacaaagacaaaaacacacgtgtttgtccaaaagatctgaaaatatgttctgttgcggtggtgcggatgaggaacccgccggtccgcccgcaaaccagtatgcggcccctcctaacaaggccggaaatcccaattttggcggcggaaatagaggagagccgaggaatccgaacgcaccgagatcgggagctcctgcaaaggttttacccatagagatcccagctgttgcattggatgagttaaacagaatggctggtaacttcggcaacaaggcattgattggtgaaggttcttatggtcgtgtcttctacggcaagtataagggcaatgatgttgctatcaagaagcttgacgctagttcttctgaagaacctgactcagatttcacatcacagttatcggtggtatcacggctcaaacacgaacattttgtggagttgatgggttactgcttggaagcaaataaccgcattctcatctacgagtttgcaaccaaaggttctttacacgatgtattacacgggagaaagggcgtgcaaggggctgagccagggccggtactgaactggaaccaaagggtgaagatcgcgtatggagcagccaaggggcttgagttccttcacgagaaggtccagccaccaattgtccacagggacgtgaggtcgagcaatgtcttgttgtttaatgactttgtggccaaaatggctgatttcaacttgaccaacgcatcctccgatactgcggctaggcttcactctactcgtgtcttgggaaccttcggctatcacgctcctgagtatgctatgacggggcagataacacagaagagtgatgtgtacagttttggtgttgtgcttttggagctcttgacgggaagaaaacccgtagatcataccatgcctaaaggccaacaaagtcttgttacttgggcaactccgagactaagtgaagacaaagtcaaacaatgcatagatcctaagcttaacaatgacttccctcccaaagcagtcgccaagttggcagccgtggcggctttgtgtgttcagtacgaggcagacttccgaccaaacatgaccatcgttgtcaaggcacttcagcctcttcttaactctaaaccggccggtcctgagtctgcctcctaaataaccaatttaccatttctcttatttttgttgttgttgttattgttaatttgttatggctcttttgctctcttttctgttcaaataactctgattcttgtttataagttgttgttattttatcgaatgtaacttatatttttcattggattaaagccctctttctt

SEQ ID NO: 6695 - DNA, 1466 bp, Eutrema parvulum
agaaatcaaacgtacttttattcaaacttcctagaaacagatcgtttgtggttttctgaagtactcactcttatcatcatcattattttctggggttgtttaatggcagaattttcaatatgttattaatagaacaaacagagattgacagaaacagaatcgaaacacaagaataagacaaaacacaagtgttggcgaaagatctgaaaacatgttctgttgcggaggtgcggatgaggaaccagctggtccgcccgcaaaccagtattcagcgcctcctaacaaggccggtaatcccaattttggcggcggaaatagaggggagccgaggaatccgaacgcaccaagatcgggagctcctgcaaaggttttgccgatagagatcccagctgttgcattggatgagttgaacagaatggcaggtaacttcggcaacaaggcactgataggtgaaggttcctatggacgtgtcttctacggcaagtataaaggagatgatgttgctatcaagaagcttgacgctagctcttctgaagaacctgactcggatttcacctcacagttatcggttgtatcacggctcaaacacgaacattttgtggagttgttggggtactgcttggaagcaaataaccgtattctcatctacgagttcgctaccaaaggttctttacacgatgtattacacgggagaaagggcgtgcaaggggctgagccagggccggtgctgaactggaaccaaagggtcaaaatcgcgtatggagcagccaaggggcttgagttccttcacgagaaggtccagccaccaatagtccacagggacgtaaggtcgagcaatttcttgttgtttaatgactttgtggccaaaatggctgatttcaacttgaccaacgcatcctccgataccgctgcgaggcttcactctactcgtgtcttgggaacgttcggatatcacgctccagagtatgctatgacgggacagataacacagaagagtgatgtgtatagttttggtgttgtgcttttggagctcttgactggaagaaaacccgtagatcataccatgcctaaaggccaacaaagtcttgttacttgggcaactccgagactaagtgaagacaaagtcaaacaatgcatagatcctaagcttaacaatgactttcctcccaaagcagtcgccaagttggcagctgtggcggccttgtgtgttcagtacgaggcagacttccgacccaacatgaccatcgttgtcaaggcacttcagcctcttcttaactctaaaccggccggtcctgagtcttcttcctaaataaacaatttaccatttctctttgtttttgttgttattgttatgggtctttttatctcttttctgttcaaatatataactacgattattggttataagatgttgttatttaatcgaatgtaacttatatttttccttctttaaaagtcctttcttt

SEQ ID NO: 6696 - DNA, 1493 bp, Arabidopsis lyrata
taagaaaattaatttcttttttcctcaaactttcttttccagatttctaaattttttcaggctcgttgatatttttcccgacattattcaaagttttcagaaacagatccttcctttgtggttttctgaagtattttcactcatcatcattttcttgggttgattctatggcattaccgagataaaaaacagagatcgatagaaacagaatcgaaaagacataaataagacaaaacccgtgttggcaaaagatctgaagatatgttctgttgcggtggtgcggatgaggaacccgccggtccgcccgcaaaccagtatgcagcccctcctaacaaggccggaaatcccaattttggcggtgggaatagaggggaaccgaggaatccgaacgcaccgagatcaggagctcctgcaaaggttttgcccatagagatcccttctgttgcattggatgagttgaacagaatggccggtaacttcggaaacaaggcactgatcggtgaaggttcttatggacgtgtcttctgcggcaagtttaagggagaagctgttgctatcaagaaacttgatgctagctcttctgaagaacctgactcagatttcacctcacagttatcggtggtatcgcggctcaaacacgaccattttgtggagttgctggggtactgcttggaggcaaataaccgcattctcatctaccagtttgcaaccaaaggttctttacacgatgtattacacgggagaaagggagtgcaaggggctgagccaggacctgtgctgaactggaaccaaagggtaaagattgcatatggagcagccaaagggcttgagttccttcacgagaaggtccagccaccaatagtccacagggacgtgaggtcgagcaatgtcttgttgtttgatgacttcgtggccaagatggctgatttcaacttgaccaatgcttcctccgataccgcggctaggcttcactctactcgtgttttgggaacattcggctaccacgctccagagtatgcaatgacaggacagataacgcagaagagtgatgtgtatagtttcggtgttgtgctattggagctcttgacaggaagaaaacccgtagatcataccatgcctaaaggccaacaaagtcttgttacttgggcaacaccgagactaagtgaagacaaagtgaaacaatgcatagatcctaagcttaacaacgactttcctcccaaagcagtcgccaagttggcagccgtggcggccttgtgtgttcagtatgaggcagatttccgaccaaacatgaccatcgttgtcaaggcacttcagcctcttcttaactctaaaccgaccggtcctgagtctacgtcctaaataaacaatttaccatttctcttgtttttgttccttgttgttgttattatggctatttttctctcttttctgttccaagaactatgattattggttataagatgttgttatttaatcgaatgtaatttatattt

SEQ ID NO: 6697 - DNA, 1525 bp, Arabidopsis thaliana
aaacagagagactttcaataattctaagaaaattaatttccttttttctcaaactatctttttccagatttctaaacattttcaggctcgtttgatcttttttttcccgacatttattcaaacttttcagaaacagatccttcctttgtgattttctgaagtatttactctcatcatcattttcttgggttgattcaatggcagaatcaaggtaaaaacagagattggctgaaacagaatcggaacataagaataagacaaaacccgtgttggcaaaagatctgaagatatgttttgttgcggtggtgcggatgaggaacccgccggtccgcccgcaaaccagtatgcagcccctcctaacaaagccggaaatcccaattttggcggtgggaatagaggggaaccgaggaatccgaatgcaccgagatcaggagctcctgcaaaggttttgcccatagagatcccttctgttgcattggatgagttgaacagaatggcgggtaacttcggaaacaaggcactgatcggtgaaggttcttatggacgtgtcttctgcggcaagtttaaaggagaagctgttgctatcaagaaacttgatgctagttcttctgaagaacctgactcagatttcacctcacagttatcggtggtatcgcggctcaaacacgaccattttgtggagttgctggggtactgcttggaggcaaataatcgcattctcatttaccagtttgcaactaaaggttctttacatgatgtattacacgggagaaagggagtgcaaggggctgagccaggaccggtgctgaactggaaccaaagggtaaagattgcatatggagcagccaaagggcttgagttccttcacgagaaggtccagccaccaatagtccatagggacgtgaggtcgagcaatgtcttgttgtttgatgactttgtggccaaaatggctgatttcaacttgaccaatgcttcctccgataccgcggctaggcttcattctactcgtgttttgggaacattcggctaccacgctccagagtatgcaatgacaggacagataacgcagaagagtgatgtgtatagttttggtgttgtgctattggagctcttgacaggaagaaaacccgtagatcataccatgcctaaaggccaacaaagtcttgttacttgggcaacaccgagactaagtgaagacaaagtgaaacaatgcatagatcctaagcttaacaatgactttcctcccaaagcagtcgccaagttggcagccgtggcggccttgtgtgttcagtatgaggcagatttccgaccaaacatgaccatcgttgtcaaggcacttcagcctcttctaaactctaaaccggccggtcctgagtctacgtcctaaactaaacaatataccatttctcttgtttttgttcatgttgttgttattatggctattttctccctcttttctgttccaagaactatgattattggttgtaagatgttgttatttaagcgaatgtaacttatatttttc

SEQ ID NO: 6698 - DNA, 1385 bp, Sciadopitys verticillata
gcactgggtaggaggaatacgccgagcttctttaggtagaatcatgaggtgtttcggctgctggagtgcagatgacattcaaaagtctgctgatgcaaatagccccttcttgtcaaatggcaatatgacaggtaacattggagttcaaaagattgccgatataactagcaaggagggacaagtcctacaaactctacctattgaagtacctgagatccctatagaggaattgagggatgcaactgacaactttggtccaaaatcattgattggggagggttcatatggtcgggtgtattactcaaccttaagaagtggccgtcctgcagccattaagaagcttgattccagcaagcaagcagatcaagaatttcttgcacaggtgtctatggtttcaaggttaaaacatgaaaatgtgttggagctggttggatattgtgttgagggcagcattcgttcacttgcatatgagtttgcaacaatgggatcattgcatgatattcttcatggtaggaaaggtgttaaaggagcacaaccgggtccagtactcacttggatgcagagagtgaaaattgctgtagaagctgctaaagggcttacatacctccatgaaaaggctcaaccacccattattcaccgagacatcaagtcaagcaacatcttactttttgatgactgcacagcaaagattgctgattttgatttatcaaaccaagcacctgacatggcagcacggctccattcaactcgcgttcttggaacatttggctaccatgctccagaatatgctatgacagggcaactaagtcaaaagagtgatgtttatagctttggagttgtcctcttagagttgctaactggcagaaagccagttgaccacacaatgccacgcggtcaacagagccttgtgacatgggcaactcctagacttagtgaagacaaagttaagcaatgtgttgattcaagattgaaaggtgactacccacctaaagcagtggctaagatggctgcagttgctgcattgtgtgtgcagtatgagtctgattttcgtccgaacatgagcattgttgtgaaggcccttcaacctctgttgaatgctagatcagtttccaacaatggaattccagcattgtaacatcctgtattgtcaattttgttttattctataaagtgtgtactctacaggtagtgcagaacatgttagttgtgattggagagcatatatgttcaaattgtctttattatggattatttcttcaagttgatatgtaatcatggacaccatgcccatataatacaagaggatcatggaaatattaggaccgagactctagtatgctcatttatccattggaatctggagaaccatgcttatattagaaatc

SEQ ID NO: 6699 - DNA, 898 bp, Panicum virgatum
ggatggcaaccgcatgctggcctaccagttcgccaccatgggttccttgcataacatcctacacgggaagaaaggagttcagggcgccgagcccgggccggtcctcaactggatgcagcgagtgaagatagcttacggcgcggcgagagggctagagtacctccacgagaaagtccagccgtcgatcgtccatcgagacatccggtccagcaacgttcttatcttcgacgagtttagctccaagattgcggatttcaacctgaccaaccaggggacggacaccgctgcccggttgcactccactcgtgtgctagggacgtttgggtaccatgccccagagtacgctatgacgggccaaatcaaccagaagagcgacgtctacagttttggggtgattctcctagagctactgacagggaggaaaccggtcgatcacaccatgcccaaagggcagcagagtcttgttacttgggccactccaaggttgagcgaagacaaagtgaagcagtgtgttgaccccaagctaaacaacgactaccctccaaaggctgtcgcaaagctggcagcagttgcagcgttgtgcgtgcagtatgaatccgacttccgaccgaacatgaccatcgtcgtcaaggcgatccagccacttctaaatgctcctaaaccagccgcgccagcagcgccgcaatcctgatcgatcagatgagagtattagcctgcgcattgctgattcctgatgaactcggtttctgatcgcagatgtacgtttcagaatcatgcatccttgctccatcagtccagcgcctatgcttctgtaaaagaaccactaatctaccagtactacaggatacatatatagggaattttgtaagatgttaatctgatacactgaatttgtgtc

SEQ ID NO: 6700 - DNA, 1255 bp, Fagopyrum esculentum
gcttgctttggctgttttggaggaggcaatgcatacaaaacttctgagaatggaggcacttatgtgatgaaacctgtaccaggaagagacgggaatcttcgtgctcccgaaaatgcacccagcaaagctccagttgttaaagtgcagcctattttgatccctctcatttctgttgatgaacttaaggaagttacagatgactttgggacaagtgctttgataggaggaggctcatacggaagagtatactatggtgttttgaaaagtgggcgtgctgcagctattaagaagttggataccagcaaacaacctgatgatgaatttctagctcaggtgtccatggtttcacgtatgaagaacgatcattttgttgaattgcttggatactgtgtggatggaaatgtccgtatgcttgcttatgagtttgcatctagtgggtcacttcatgatatacttcacggaagaaagggtgttaaaggtgcacagcctggacctgttttgtcctgggcacaacgtgttaaaatcgctgtaggggcagcaaaaggactcgagtatttgcatgagaaggctgatcctcatataattcatcgtgatattaagtccagcaatgtgcttatatttgatgatgatgtgtctaagattgccgattttgatttgtctaatcaagcccctgatatggcagcacgtctccattcaactcgtgttctaggaacttttggttatcatgcaccagagtatgcaatgactggacagctgaatgcaaaaagtgatgtatatagttttggggttgtgctattggagctcctcactggacgcaaacctgttgatcataacttgcctcgtggacaacaaagtctggtgacttgggcaacgcctaggctcagcgaagataaggtgaagcagtgtgttgatccaagactaaacggagaatatcctcccaaggctgttgcaaagatggcagctgtggctgcattgtgcgtgcaatacgaagctgatttccgaccaaacatgagtattgtcgtcaaggctttgcagcctctgtcgaacgcgcgagctggaggtggggctgttaccgagtcacccagatcatgaaacttcttgatccccaattcctcatcgtaactacattatcctatttcaggagtggattgcatattgctgcatagggttcatgatcttgtttaaattttttgagttctatgcatctgatttgttgatacacaacgtgatcagttgtactatctgtgttaccaaa

SEQ ID NO: 6701 - DNA, 433 bp, Pteridium aquilinum
tctctcaaatcaagcacctgacatggcagcacgtctccactcaacccgtgttcttggaacttttggttatcatgctccagagtatgcaatgacaggactgttgacgcagaaaagcgacgtatatagttttggagtggttttgttggagttgctcaccggtagaaagccagttgaccatacactaccacgaggacagcaaagtctggttacgtgggcaactccaagactaagtgaagacaaagtcaagcagtgtgtggatccaaagcttaagtcagattatccaattaaggcagttgccaagatggcagcagtagcagctctgtgtgtgcagtatgagtctgatttccgcccgaatatgagcattgttgcaaaggcattacaagctttgctgttacccaggccggcagtcggaggtgctatcgatgctggcatt

SEQ ID NO: 6702 - DNA, 1376 bp, Eutrema parvulum
acagtttcgcaagtttgtgtgtgagagaaaagcgtaatgagctgctttggttgttgcggtggtgaggatttccgtagagttgctgaaaccggaccaaagccagtgcacaactcagcaggttacaatggtcaccatcaaaaggcagatccacccaagaacccgccagtcattcagatgcagcctatcgctgtgccggccattccagcagatgaattgaaggatataacagataactatggttccaagtccttgattggtgaaggttcatatggaagagtgttttatggtgttcttaaaagcgaaaaggcagcagccatcaagaaactggattccagtaaacaaccggatcaagaatttctcgcccaggtttccatggtttcgagattgcgacaagacaatgttgttgcactgctgggctattgcgttgatggcccactccgtgttcttgcttatgaatatgctcctaatggatcccttcatgatattcttcatggtcgaaaaggtgtcaaaggagcacagccaggtcctgttctgtcgtggcaccagagagttaaaattgctgttggtgcggctaggggactcgagtacttgcatgagaaggcaaaccctcatgttatacaccgagacatcaaatccagcaatgtacttctgttcgacgatgatgttgccaaggttgctgatttcgatctgtccaaccaagcccctgacatggctgcacgtcttcactcaacccgtgtgctgggcacctttggctatcatgctccagagtatgcaatgacaggaacattgagcacaaagagtgatgtctatagttttggggtcgttctgctcgagctcctcacaggtcgtaaaccagttgatcataccttaccacgtggacagcaaagtctcgtgacatgggcaacccctaaactgagtgaagacaaggtaaagcagtgtgttgatgcaaggctaaatggagaatttccccccaaagctgttgccaagctggctgcagtagctgcgctttgtgtgcaatacgaggcagacttcaggccaaacatgagcatagtggtgaaggctcttcagcctctgctcaatcctcctcgctctgctcctcaaactccgcagaggaacaacccttattgatatcctccgatctggtttcaaacttcatcaccactatttcatttgtttttgtttgaatccgatttgtgtaaattcgtgaaataggcttttatttctctcataaaaccctaccacttcactgaaaatctcacctgaaagacctgaatgttgctctgctgtttatgttatttcatgccctgtgatgtaagtttctactaattctacaatatgcgaggaaaggctatatacaccaatactgtttttgtgcc

SEQ ID NO: 6703 - DNA, 1504 bp, Sorghum bicolor
atgttctgctgcggtggtaccgaggaggatacgtacgccgcacctgcgagccgtcacccagcagcacctaggaatacgtcgcaacacaacgcaggccgcggcaaaccaagagggcccaatgcgccgaggagcagcgggccgccgaaggtcctccccgtcgacgtgccggccatttccatgggcgagctgaacaacatcacggggagcttcgggccgaatgccctgatcggggaaggctcctacggcaaaatctaccgcgccgtgctgacctccggggagcccgtcgccatcaagaagctcgatcccagcgtgtccagcgactctctggctgacttctctgctcagctgtcgatggtctcgaggctgaagaacgagtacttcctgcagctgatgggctactacctggacgacagccacaggatcctcgtctaccagttcgcctcacacggctcgctgcacgacacgctgcacggaaagaagggcgtgaaggacgcgacgccgggcccggcgctgagctgggcgcagcgggtgaagatcgcctacggcgcggcgaggggactcgagtacctgcacgagaaggtgcagccgtccatcgtgcaccgggacgtgcgctccagcaacgtcctcctcttcgacggccacgactccaagctcgccgacttcaacctcaccagccagccgcccgacggcgccgcgcggctccactccacgcgcgtccttggcaccttcggctaccatgctcccgagtacgcgatgactggagtgttgacgcacaagagcgacgtgtatagctttggagtgatactgctggagctgctaaccggcaggaagcccgtggaccacaccatgcccaagggacagcaaagtctggtgacttgggccacgccgaggttgagcgaggacaaggtcagccaatgcgtggacccgaagctaggggacgactatcctccaaaagcagtagcaaagatggcggcagtggcggcgttgtgtgtgcagtacgagtcggatttccggccgaacatgaccatcgtggtgaaggcgctgcagcctcttgtgaaggccgccgcagccacagctgggggggcctagcagtacatgaacatgatagatgataatgatacacaagcatatatatctccagcacatgtcctccaaagatgtgttcttggttatctgtcgcttgtgtgtacatctcaccttcagtgtggttgtaatgcaacatgtactgactgatcaatctgcaaaggattcaagtgttcatcacctttttggggactcttcaatatatagtatgtagtttagactccacatcaccagtcctccttgtccccttccgttggtaggaaaggaacttgctgcttgccccacaggcagagagacctgccgcactgctttgttcttatcctgttcctgactacggatcaaagattccacggaaccagaaaatgctaagcgagaggagacgatggacccaccttgtgcagttgcaatccgtaatcatcgg

SEQ ID NO: 6704 - DNA, 1605 bp, Sorghum bicolor
agcaactattcatcagaaggtactcggccgatccgatccaccggatcggccgccaaaccgcatatctccacggtggtgcaagggaaagccggggcaacacgatgttctgctgcggtggtaccgaggaggatacgtacgccgcacctgcgagccgtcacccagcagcacctaggaatacgtcgcaacacaacgcaggccgcggcaaaccaagagggcccaatgcgccgaggagcagcgggccgccgaaggtcctccccgtcgacgtgccggccatttccatgggcgagctgaacaacatcacggggagcttcgggccgaatgccctgatcggggaaggctcctacggcaaaatctaccgcgccgtgctgacctccggggagcccgtcgccatcaagaagctcgatcccagcgtgtccagcgactctctggctgacttctctgctcagctgtcgatggtctcgaggctgaagaacgagtacttcctgcagctgatgggctactacctggacgacagccacaggatcctcgtctaccagttcgcctcacacggctcgctgcacgacacgctgcacggaaagaagggcgtgaaggacgcgacgccgggcccggcgctgagctgggcgcagcgggtgaagatcgcctacggcgcggcgaggggactcgagtacctgcacgagaaggtgcagccgtccatcgtgcaccgggacgtgcgctccagcaacgtcctcctcttcgacggccacgactccaagctcgccgacttcaacctcaccagccagccgcccgacggcgccgcgcggctccactccacgcgcgtccttggcaccttcggctaccatgctcccgagtacgcgatgactggagtgttgacgcacaagagcgacgtgtatagctttggagtgatactgctggagctgctaaccggcaggaagcccgtggaccacaccatgcccaagggacagcaaagtctggtgacttgggccacgccgaggttgagcgaggacaaggtcagccaatgcgtggacccgaagctaggggacgactatcctccaaaagcagtagcaaagatggcggcagtggcggcgttgtgtgtgcagtacgagtcggatttccggccgaacatgaccatcgtggtgaaggcgctgcagcctcttgtgaaggccgccgcagccacagctgggggggcctagcagtacatgaacatgatagatgataatgatacacaagcatatatatctccagcacatgtcctccaaagatgtgttcttggttatctgtcgcttgtgtgtacatctcaccttcagtgtggttgtaatgcaacatgtactgactgatcaatctgcaaaggattcaagtgttcatcacctttttggggactcttcaatatatagtatgtagtttagactccacatcaccagtcctccttgtccccttccgttggtaggaaaggaacttgctgcttgccccacaggcagagagacctgccgcactgctttgttcttatcctgttcctgactacggatcaaagattccacggaaccagaaaatgctaagcgagaggagacgatggacccaccttgtgcagttgcaatccgtaatcatcgg

SEQ ID NO: 6705 - DNA, 1528 bp, Panicum virgatum
ggagaacctccaaggaaagaccgaagagtcggaaccagtacacaccgagctttgttctccccggccctcgctgctgcggcgaattttcttgccctgcaccggccaccgtggctagcctgcgccaccgtcgcccttccgccctcctccgggaagccgaaagatcttggataattttgaacatgtcatgtctggcatgttgtggcggcgaagacactcaaagagcacctgatagtggaggtccataccctggtggctacccagcaaggaatgatgcttatcgcactgctgatccaactcccagaggtgttcaacctgtgaaagtgcagccaattgctgtccccactattcctgttgaagaaatccgggaggtcacacagggttttggtgatgaagctttggttggtgagggttcttttggcagagtgtattatggtatactgaataatggcagaagtgcggcgatcaaaaagttagattcaagtaaacagccagaacaagaatttttggcacaggtttccatggtgtcaagacttaagcatgacaatgtcgtggagttgcttggttactgtgttgatggaaacacccgtatccttgcttatgaatttgctactatgggttctcttcatgatatgcttcacggccggaaaggtgtgaaaggagctcagccaggtccagtcctgtcttggacacaacgagtgaaaattgctgttggagcagcaaaaggccttgagtatcttcatgagaaagcacagcctcatataatacacagggacatcaaatccagcaatgtacttctgttcgatgatgatgtatctaaaatagctgattttgacttgtcaaaccaagctcctgatatggcagctcgacttcattcaactagggttctgggaacatttggatatcatgcgcctgagtatgcgatgactggacaacttagctctaagagtgacgtctatagttttggagttgttcttctggagctcctgactggaagaaagcctgtggatcatacattaccaaggggacaacagagtctcgtgacatgggcaactccacggcttagtgaagacaaagttaggcaatgtgtcgattcaagacttggaggggaatatcctcctaaatctgttgcaaagtttgcagcagttgctgcattgtgcgtgcaatatgaagctgattttcgaccaaacatgagcattgtggtgaaggccctccagcccctgctgaatgcacgtgcatccaacaaccctggtgggcactctggatcataatcttcagttcaccatttgtgacgtagaatattgcattgccaaggttttttttttcctggaggagaagctgtttgtatgtagattatgttgtgatctccgttttgccttagtagtccctcattgagttttctgatgcgttgcaggctgagtgaatgactgcttttgcttgtacttgacgacagtatctgattcagacaaatcatctagcattgtaatttgtaataagacaaaagtatggtgcttcttgaccttggatgttc

SEQ ID NO: 6706 - DNA, 1500 bp, Ambrosia trifida
cttggtacaatatagtctccccctttttccacctccatttgcatgcctttgttaacctacgccctatccggtgcatgttagccgccttctccaccaattaaaaatatccaaagacacacctgtctaatttgccttcctttttctccttccttcaaagcaacccaacccctcttgttgatcaaacccacctccaaacacaagatctttgatttttcgagtaaagaaagcgaacatgagttgcttcggctgctgtggagaagatgatatgcacaaggcttacgataatggaccctacatgccgaataatgcagcaggacacaatgcaggttatcgtgccactgaggccgcacccaaggacacgcaggctgtagccgttcaacctattgctgtccctgctctacaagtggatgaactgaaagaaataactgataattttggtacaaaagcgttaatcggggaggggtcatatggacgagtgtaccatggtgtcttgagaagtgggcaggcagctgctatcaagaagttagactccagcaagcaaccggatcaagaatttttagctcaggtttctatggtatcaaggcttaagaacgacaacgttgtgggtttactcgggtattgcattgatggtggtctaagagtgttggcctatgagtacgcatcaaatggatctcttcatgatattcttcatggaagaaaaggtgttaaaggtgcacagccgggtccagttttatcatggtctcaaagagttaaaattgctgttggtgctgcaaaaggacttgaatacttgcatgaaaaggcacagcctcatattattcatcgtgatataaagtctagtaacgttctgctttttgatgatgatgtggccaagattgctgattttgatttatcaaatcaagcacctgacatggcagcccgccttcattccacccgtgttctcggtacttttggctatcatgctcctgaatacgcgatgactggacagttgagttcaaagagtgatgtttacagttttggagtggttcttctagaactcttgaccggccgaaaacccgttgaccacactttaccccgtggtcagcagagtttagtcacatgggcaacacctaaactgagtgaagataaggtgaaacagtgtgttgacactagactcaatggagaatacccccctaaggcagttgccaagatggcggcggtggcagccttgtgtgtgcaatatgaagccgatttcaggccaaacatgagcattgtggttaaagcactgcagccattgttgaacgcgcgcgctggaccccaaaccgaagcaccacacttgtgaatccctgcctagagccgggcctcggccactactactgctgcttgaccataatcatgtcattcttgctgatgacaagataaagttggcagatatttatgtttgttatgtagaaaagttattcacagctgatgcgcattcttttgtttgactaagctttcaagattttcttgtggtaaatagtg

SEQ ID NO: 6707 - DNA, 1362 bp, Ambrosia trifida
tcaagtagaagaaagcgaacatgagttgcttcggctgttgtggagaagatgatatgcacaaggcttatgataacggaccctacatgcagaataatgcagcaggacacaatgcaggttatcgtgccactgaggccgcaccaaaggacacacaggctgtagccgttcaaccgattgctgtccctgctctacaagtggatgaactgaaagaaataactgataattttggtacaaaagcgttaataggagaggggtcatatggacgagtgtaccatggtgtcttgagaagtgggcaggcagctgccatcaagaagttagactccagcaagcaaccggatcaagaatttttggcccaggtttctatggtatcaaggcttaagaatgataacgttgtgggtttactcgggtattgcattgatggtggtttaagagtgttggcctatgagtacgcgtcaaatggatctcttcatgatattctgcatggaagaaaaggtgttaaaggtgcacagccaggtccagttttatcatggtctcaaagagttaaaatcgctgttggtgctgcaaaaggacttgaatacttgcatgaaaaggcgcagcctcatattattcatcgcgacataaagtctagcaacgttctgctttttgatgatgatgtggccaagattgctgattttgatttatcaaatcaagcacctgacatggcagcacgccttcattccacccgtgttcttggtacttttggttatcatgctcctgaatacgcgatgactggacagttgagctcaaagagtgatgtttacagctttggagtggttcttctagaactcttgacaggccgaaagcccgttgaccacactttgccccgtggtcagcagagtttagtcacatgggcaacacctaaactgagtgaagataaggtgaaacagtgtgttgacactagactcaatggagaatacccccctaaggcagttgccaagatggcggcggttgcagccttgtgtgtgcaatatgaagccgatttcaggccaaacatgagcattgtggttaaagcattgcagccattgttgaacgcgcgcgctggaccccaaactgaagcaccacacttgtgaatccccgcctagagccgggcctcggccactactactgctgcttgatcataatcatgtcattgttgctgatgacaagataaagttagcagatatttatgtttgtatgtagaaaagttattctacagctgatgcgcattcttttgtttgactaagatttcaagattttcttgtggtaaatagtgaaggatttatttaggtgaaacggaactcttttgtactgctgaaacaagttttatttgattcctggaaaaaagaa

SEQ ID NO: 6708 - DNA, 1067 bp, Arnica chamissonis
atcaagaagttagactccagtaagcaaccagaccaagaatttttagcccaggtttctatggtatcaaggcttaaaagtgataatgttgtggggttactcgggtattgcgttgatggtggtctaagagtgttagcttacgagtatgcttcaaatggatctcttcatgatattctgcacggacgaaaaggcgttaaaggtgcacagcccggtccagttttatcgtggtctcaaagagttaaaattgcggtcggtgctgccaaaggacttgaatacttgcatgaaaaggcacagcctcatattattcatcgtgatataaagtctagtaatgttctgctttttgatgatgatgttgctaagattgctgattttgatttatcaaatcaagcacctgacatggcagcacgccttcattccacccgtgttcttggtacttttggttatcatgcacctgaatacgcgatgactggacagttgagttcaaagagtgatgtttatagctttggagttgttcttctagaactcttgacaggccgaaaaccagttgaccacacgttgccccgtggtcagcagagcctagtcacatgggcaacacctaaactgagtgaagataaggtgaaacagtgtgttgacactagacttaatggggaatacccccctaaggcagttgccaagatggcggctgtggcggccttgtgtgtgcaatatgaagctgatttcaggccaaacatgagcattgtggttaaagcattgcagccactgttgaatgctcgcgctggaccccaaaccgaagccccacacttgtgaatccccatctagagcagggcctctacgactacgactacgactactactactactgctcgattgtaatcatgtcattcaagatcatgacggataaagttagccaatatttatgtttgttgtgtagaggaattattctacagctgatgcgcattcttttgtttgaagattttcttgtggtaaatagtgaagggatttatttaggtgcaaaggagctcttatgtactgcagaaacaaaacaagtttatttgattcctgaaaatggg

SEQ ID NO: 6709 - DNA, 1483 bp, Cirsium arvense
ttcttcttcttcttctaacctacgcgcttttctctcatccggtgcaccttagccatcttctgatctccgccaattaattatctttcttttcttccgtttgcttctttttcttccctcaatcaaggtttccagccataaacaaaagatcctagtaaaggaaagcgattatgagctgctttagctgctgtggagaagatgatatgcaaaagtcttatgataatggaccattcatggcaaataatgcagcagggcataatgcaggttatcgtgccacagaggctgcaccaaaggacacacaggccgtagctatccaacctattgctgtccctgctcttcaagtggacgagttaaaagaaatcaccgataactttggtacaaagtctttgattggtgaaggatcatatggacgagtttaccatggtgttttgagaagtgggcaagcagcagctatcaaaaagctcgactccagtaagcaaccagatcaagaattcttagcacaggtttctatggtatcaaggcttaaacatgataatgtcgttgggctactcgggtattgcgttgatggtggtctaagagtgctggcttatgaatatgcttcaaatgggtctcttcatgatattctgcacggaagaaaaggcgttaaaggtgcacagcctggtccagttctatcatggtctcaaagagttaagatagctgttggggctgcaaaaggacttgaatacttgcatgaaaaggcgcagcctcatattatccatcgcgatataaagtcaagtaacgttctgctttttgatgatgatgtcgctaagattgctgattttgatttatcaaatcaagcacctgacatggctgcacgccttcattccacccgtgttcttggtacttttggttatcatgcacctgaatatgctatgactggacagttgagttcaaagagtgatgtttacagctttggagtggttcttctagaactcttgacaggccgaaagccggttgaccacactttgcctcgtggtcaacagagtctagtcacatgggcaacaccaaaactcagtgaagataaggtgaaacagtgtgttgatattcgactgaatggagaatatccgcctaaggcagttgccaagatggcggcggttgcagccttgtgtgtgcaatatgaagcggatttcaggccaaatatgagcattgtggttaaagcactgcagccattgttgaatgctcgtcctggacctcaaactgaagcaccacatttgtgaaatgaaaatttcaatctcaatctcaatctcaatctctagggctggatggctggaccttttaccactgcttattgtttagcagatatatttattatgttgttgtgtaaaatcaatcaatttacatattcttttgtttgaaaaaggtgttttgtttgttctttctttgtaatttgtcgtaaatatggaagggattttaggtgtggctcatgatcaccaaacgaaactttatg

SEQ ID NO: 6710 - DNA, 1395 bp, Flaveria ramosissima
ctcttgttagattaaagattcaacccccaactccatacacagcatcatttgatttgtcaagtagaggaatctgaacatgagttgcttcagctgctgtggtgaagatgacatgcataagtcttttgacaacggaccatacatgccgaataatgcagcgggacctaatgcaggttatcgtgccactgaggctgcaccaaaggacacacaggctgtagctgtccaacctattgctgtccctggtctacaagtggatgaactgaaagaaataactgataattttggtacaaaatgtttgattggagagggatcatatggaagagtgtaccatggtgtcttgagaagtggccaggcagcagctatcaagaagttagactccagtaagcaacctgaccaagaatttttagcccaggtttctatggtatcaaggcttaaaaatgataatgttgtggggctactcgggtactgtattgatggtggtctaagagtgttggcctatgagtatgcttcaaatggatctcttcatgatattctgcacggaagaaaaggtgttaaaggtgcacagccaggtccagttttatcatggtctcaaagagttaaaattgctgttggtgctgcaaaaggacttgaatacttgcatgaaaaggcacaacctcatattattcatcgcgatattaagtctagtaatgttctgctttttgatgatgatgttgctaagattgctgattttgatttatcaaatcaagcacctgacatggcagcacgccttcattccacccgtgttcttggtacttttggttatcatgcacctgaatatgcgatgactggacagttgagttcaaagagtgatgtttacagctttggagttgttcttctagaactcttgacagggcgaaaaccagttgaccacactttgcctcgtggtcagcagagcttggtcacatgggcaacacctaaactgagtgaagataaggtgaaacagtgtgttgacactagactcaatggggaatacccccctaaggcagttgccaagatggcggctgttgcggccttgtgtgtgcaatatgaagcggatttcaggccaaacatgagcattgtggttaaagctctgcaaccattgttgaacgctcgtgctggaccccaaaccgaagcaccacacttgtgaacccgtctagaacctgagccaggcctttgctactactgctgcttgatcgtcatcagatgatgacagataaagttggcagatatttatttatgtttgttttgtagaagaattatttaatctacagccgatgcacattcttttgtttgactttgtatcaaaaaaggttctaagattatcttctggtaaatagtgaaggatttgcttaattgcataaacgtgttcatttggagcgg

SEQ ID NO: 6711 - DNA, 1222 bp, Phalaenopsis aphrodite
gctgttttgaaattgaagttcaagatgccaaagtggctttgttgttcatgtaaggtggatgagtctgatggcctgcatttcaatgaatccttgaggagtccaaagccctatatggattataggactggcctgcaaaaaggttcaaagttttctgctgtaactaaaaatgaaccacaaaaagcaccgccctctattgatgtgcctgcattgtcttttaatgaactgaaggagaagaccgacaattttgggtcaaaagacttttgttggggagggttcttatggaagggtatattttgcttttttaaatggtaaacgagtggctataaaaaagcttgatgtctctcaagagcctgagtccaatacagagtttttaactcaggttgcaaaggtttcaaaattgaagcacgagaattttgtagaattgctgggttattgtctggaggggaatcttcgtttattatgctatgagtttgcaaccatgggttcattgcatgatgttctgcatggcagaaaaggagtgcaaggtgcacgacctggtcttgtccttgattggatgcagcgtgtgaggattgccattgacacagcgaaggggctagagtttctccacgagaaggttcagccttcaataatacatagagatatccggtcaagcaacattcttttatttgagcacttcagagcaaaaattgcagatttcaatctttcaaatcaagcccctgatatggctgctcgtcttcattctacccgtgtgctaggaacctttggttatcatgctccagaatatgccatgactggacagctgacacaaaaaagcgatgtatatagctttggtgttgttcttttggagcttctcactggaagaaagcctgttgatcatacaatgcctagaggacagcagagtctcgttacttgggctactccacggttgagtgaggataaggtaaaccaatgcatcgatccaagattaacaggtcaatatccaaccaaaggagttgcaaagcttgcagcagttgctgctctatgcgtgcagtatgaagctgagttcaggccaaacatgagcattgttgtaaaggcactctcacccgcctctataagaggcgcctccgcagcgcggccgtaccgtacgcttgttgatgtgccacctgtgagaggtttgtttattcttctctcttgttatagtacgacgatctcggtgtgtgtcgctactctctcgtttagtttg

SEQ ID NO: 6712 - DNA, 1009 bp, Plantago ovata
tctgcatgacattctacatggacgaaaaggtgtgaaaggagcacagccaggtccagttctttcatgggcccagagagttaaaattgctgttggtgctgcaaaaggactagaatacttgcacgagaaggcacagccccgtattattcaccgggatatcaagtccagcaatgtcttgttgtttgatgatgacgttgctaagattgcagattttgatttgtctaatcaagctcctgatatggcagctcgtcttcattccactcgtgttcttgggacttttggttatcatgcccccgaatatgcaatgaccggccagctgagctcaaagagtgatgtctacagctttggtgtggtactcctggaactgttgactggccgtaaaccagttgatcatacactgccgaggggacaacaaagtcttgtgacatgggcaactccgaagctcagtgaagataaggtaaagcagtgcgttgatgctagactgaatggagaataccctccaaaggcagttgccaagatggctgcagttgctgccttatgtgtgcaatacgaagctgattttcggccaaacatgagcatagtagtaaaagctctccaacctctgttgaatactagatctggacatcctggggaatcaccaagcgtataatcgccttccatctcctgagggaggtgtcaaggttaataaacacgaaagttgtctacaggtcgacgtggtgggatatataagatctaagggaaattcatcagttcaatgtggtcctcatcattatgtgaaggaaatatacatgaagaagaaactgtgaagattatattgttcatctctttgatttttattttttataaaaacttatattcaggtttttggtattctgacagaattgagtttgttccagatacgcaagcaattgatattacagaatacagatacataaaaatgtataatagtgagcattctttggtggacaaattatcatagtagagcttgtataaaagaaatattcagagttga

SEQ ID NO: 6713 - DNA, 1781 bp, Citrullus lanatus
ggataaatatgaaacgtaatggctctgtatgaatgcgtattacaaaggaagtaggaagctttgaggacttatttccgttctacgaagttgatcggaagtaggagacgactggcgaagttgaacgaagtcaagtcaaaagtaagctcgacgactccgttctacgacgcagtcggctgctttgaggttttcgcttttatattttataacagcctccgctccgaacgcgaaggcgaccggtcgttactctgattgaagcattgagggcttgtttccgtcgaatttgatatctgatcgacgttggcgcatccgtgagcaaagaaaacaatgggatgctttggttgctgcgaagaagatggtatccagaagcctgctgataacagcagcatgtaccaagtaaaagcttcagcaggaactgatgaaggctatcacaaacggcaaactgcacctaaaagtcctccaatagtgaaaatgcggcccattgaagtccctgccatatcatttgaggaactgaaggaggttacgaaaaatttcgatgctgactgtttgattggagagggttcctacggtagagtatactatggggtatttacaagtgggcagactgtgggaatcaaaaagttggatgccagcaaacaatcggatgatgaattcttatcccaggtctccatggtttcaagactaaagcaccataattttctaaacttgattgggtactgtgttgatggcaattctcgaattcttgcatatgagtatgcttcaaatggatctcttcacgacattttacacgggaggaaaggagtcaaaggagcacaacccggccctgttctttcctgggcacagagagtaaaaattgctgtaggtgctgcaaagggtttggagtatttgcatgaaaaggtcgatcctcatatcatccatcgggacataaaatccagcaacgtactaatatttgatgatgatttggcgaaaattgctgactttgatttgtcgaaccaagcccctgatatggctgcacggcttcattccacccgtgttcttggaacctttggctatcatgctcctgaatacgcaatgactggacaattgaatgccaagagtgatgtgtacagctttggtgttgtcctgcttgaacttttgacaggaagaaagccagttgatcatacattgcctcgaggacagcaaagcctcgtgacatgggccacgcccaaactttgcgaggataaagttaagcaatgtgttgatgcaaaactaggagatgagtaccctccaaagtcagttgcaaagtttgcagcggttgctgcattgtgcgttcaatatgaagcagatttcagaccaaacatgagtattgtggtcaaagccctgcagcctctgttaaatgtccgacctggtcctggcggtgaagcaccaactctttaaacagtaaaatctctctcttcttcttttctttcttgtgggttcctgttccttcttggggtccacgtgctgacacgtgacgtgtgagcgtgcaaattattacccaggaattaaatttccagtaggtggtgatcatcaatttgtttacaaaatcagtgagataccataattatgatttttaagtgatatatgacgtgacacttttttttttttttcttttttttcccttttgtgcctctcttttgtgtgcttcttagcctcttcacaagcccacgtgcatgatggcccattttccccacaaaaaattctagagggggagaaaaaaaaaaaaaaaaaggtaaattaaagttgttagctttcctttttctatt

SEQ ID NO: 6714 - DNA, 1290 bp, Aquilegia formosa
ggacgataatcaccggaccctgggcagatatttggatttttttcaacaagttgaaatgttcaattgaaaatctgcgtgggtttttcttgttatgtgtggattctgcagtatgttgtgttgcggtggtgccgaagaagaaaacaatggtcctcctgtgaataatcaatatacagctccacccaaagccgcccacaatggtcctggacctggggatcgagcagagcctaatagaggttcccatgcctcgaggagtcaagctccagcaaagatcttacccattgaaacaccggcaatacccttggatgaacttaatagactgactaataacttcggacaaaagtcgttagttggagaagggtcttacggtcgggttttctacgcgaccttaagtgatggtcaggttgctgctgtaaagaagcttgatcccagttcatcaaatgagccagattctgattttgcagctcagctatcaacagtttctaggcttaagcaggagcattttgtggaattaattggttactgtttggaggcaaataatcgaatcttggtgtatcaatttgcaaccatgggttctttacatgacattctacatggaaggaagggagcacaaggggctgaacctggccctgttctcacctggaatcaaagagtcaaaattgcttatggtgcagcaagagggcttgagtatcttcatgaaatggttcaacctggtatagttcatcgggatgttagatccagcaatgttctcgtatttgatgactttgcagcaaagatagccgatttcaatctgacaaaccagtccccagatacagcagcacgcttgcattcgactcgagtgttaggaacttttggatatcatgctccagagtatgcaatgacaggatttttgacacaaaaaagtgatgtctacagttttggtgttgttcttctagaacttttaacagggaggaagccagtagatcacacaatgcctaaaggacaacagagtcttgttacttgggcaactccaaggttgagtgaagataaagttaagcagtgcatagatcccaagctaaacaacgactacccgccgaaggctattgcaaagttggcagctgtagcagctttgtgcgttcaatatgaagcagacttcaggccaaacatgaccatcgttgtcaaggctattcaaccacttcttacctcaagaccagcaggacccgaacactaacttataaattctttgtttgtaatcccctctcttgttattatttgcactccttaaactcaatttatgtcttgtattcaaaagaa

SEQ ID NO: 6715 - DNA, 1435 bp, Artemisia annua
agcaacacaaaccctttttgtgattcatccaaacttcaaacaaatcataatcttttaattgctagtagaggaaatcaatcatgagttgtttcggttgttgtggagaagatgatatgcacaagtcgtatgataacggaccgtacatgacaaataatgcagcaggaaataatgcaggttatcgtgccactgaggctgcaccaaaggacacacaggctgtagccatccaacctattgccgtccccgctcttcaagtggatgagttgaaagaaataactgataattttgggacaaagtctttaattggagagggttcatatggacgagtgtaccatggtgttttgagaagtgggcaggcagcagctatcaaaaagttagactccagtaagcaaccagaccaggaatttttaggccaggtttctatggtatcaaggcttaaacatgatcatgtggttgggctactcgggtattgtgttgatggtggattaagagtgctcgcctacgagtatgcttccaacggatctcttcatgatattctgcacggaaggaaaggtgttaaaggtgcacagcccggtccagtgttatcatggtctcaaagagttaaaattgctgttggtgctgcaaaaggacttgaatatttacatgaaaaggcacaacctcatattatccatcgcgatataaagtctagtaatgtattgctttttgacgatgatgttgctaagattgcggattttgatttatcgaatcaagcacctgacatggcagctcgccttcattctacccgtgttcttgggacctttggttatcatgcacctgaatatgcgatgactggacagttgagttcaaagagtgatgtttatagctttggagtggtccttcttgaactgttgacaggccgaaaaccagttgaccacactttgcctcgtggtcaacagagtctagtcacatgggcaacacctaaacttagtgaagataaggtgaaacagtgtgttgacactagacttaatggtgaatacccaccaaaggcagttgccaagatggcagctgttgcggcattgtgtgtgcaatatgaagctgatttcaggccaaacatgagcattgtggtaaaagcgctgcagccattgttaaacgctcgtcctggaccccaaacagaagcaccacacatgtgaattcctaaatagggcggaccctctactactgcttgcttaatcatgtcaatccggatcatgactagacaaaaatttagcagatatttatgtttgttgtgtagaaatgattctacaccagatacacattcttttgtttgacttaatttgtatcgaaatggtttttcctttctttttgtggttatttgtcgtaaatagtgatgaaggggtttagtgtgattcgtattcagcaaagactgcagaaacaaacgttaaaatttactatctggaaa

SEQ ID NO: 6716 - DNA, 1457 bp, Cucumis sativus
aaaacgatgggatgctttggttgctgcgaagaagatgctatccagaaggctgctgataatagcaacacgtaccaagtaaaaacatcagcaggaactgatgaaagctatcacaaacggcaaactgcacctaaaagtcctccaatagtgaaaatccagcccattgaagtccctgccatatcatttgaggaactaaaggaggtaaccaaaaattttgatgccgactgtctgattggagagggttcctacggtagagtatactatggggtatttacaagtgggcagactgtgggaattaaaaagttggatgccagcaaacagtcagatgatgaattcttatctcaggtctccatggtttcaagactaaagcacgataattttctaaacttgattgggtactgtgttggtggcaattctcgaattcttgcatatgagtatgcttcaaatggatctcttcacgacattttacatgggaggaaaggagtcaaaggatcacaacccggccctgttctttcctgggcacaaagagtaaaaattgctgtaggtgctgcaaaggggttggagtatttgcacgaaaaggtcgatcctcatatcacccatcgtgacataaaatccagcaacgtactaatatttgatgatgatttggcaaaaattgctgactttgatttgtcaaaccaagcccctgatatggctgcacggcttcactccacccgtgttcttggaacctttggctatcatgctcccgaatacgcaatgactggacaattgaattccaagagtgatgtgtacagctttggcgttgtcctgcttgaacttttgacaggaagaaagccagttgatcatacattacctcgaggacagcaaagcctcgtgacatgggccacgcccaaactttgcgaagacaaagttaagcagtgtgttgatgctaaacttggaaatgagtaccctcctaagtcagttgctaagtttgcagcagtggctgcattatgcgtccaatacgaagcagatttcagaccaaacatgagtattgtagtcaaagctcttcaaccactcttaaatgcccgtcctggtccttgaggtgaaaccaccaactcttaaaaatctctctgtttcttttcttttttctttcctgtggattcttgtttgttactacctcttgggtccacgtgctgacacgtgacgtgaggcttccaaattattacccgggtattaaatttttcgttggtggtgggtgatcatcaatttgtttacaaaaacagtgagataccacaatcatcatttttcatgtcatatatgaacgacgtgtcgtcgtttcttcttctttttctctctctctctctcttttggttggcctctcgtttatgtgcttcttttgcctcttcacccacgtgcatgatggcccattttctcccagaaaaaaagaagaaagggtaaagtaaagtttttagctttttctattc

SEQ ID NO: 6717 - DNA, 1379 bp, Cynara scolymus
  misc_feature (1294)..(1294): n is a, c, g, or t
gcggggaaagaaagagagaaaaacaatctctgatatttgcattcctcctcctattcttcttcttcttcttctaacctacgcgcttttccctcatccggtgcaccttagccgtcttctgatctacgccaattatttgcttctgtttgctaaagttcccttcttttgtttccctcaatcttgattccagtcccaactacaaaagatcctagaggtgtcagtaagggcaagcgattatgagctgcttcaactgctgtggagaagatgatatgcacaagtcttatgataatggaccattcatggcaaataatgcagcagggcataatgcaggttatcgtgccacagaggctgcaccaaaggacacacaggccgtagctatccaacctattgctgtccctgctcttcaagtggacgagttaaaagaaattacagataactttggtacaaagtccttgattggtgaaggatcatatggacgagtttaccatggtgtcttgagaagtgggcaagcagcagctatcaaaaagcttgactccagtaagcaaccagaccaagaattcttagcacaggtttctatggtatcgaggcttaaacatgataacgtcgtcgggctacttgggtattgcgttgatggtggtctaagagtgctggcctatgaatatgcttcaaatgggtctcttcatgatattctgcacggaagaaaaggcgttaaaggtgcacagcccggtccagttctatcatggtctcaaagagttaagatcgctgttggggctgcaaaaggacttgaatacttgcatgaaaggcgcagcctcatattatcatcgtgatattaagtctagtaatgtctgctttttgatgatgatgttgctaagattgctgattttgatttgtcaaatcaagcacctgacatggcagcgcgccttcattccacccgtgttcttggtacctttggttatcatgcacctgaatatgctatgactggacagttgagttcaaagagtgatgtttacagctttggagtggttctcctagaactcttgacaggccggaagccggttgaccacactttgcctcgtggtcagcagagcctggtcacatgggcaacaccaaaactcagtgaagataaggtgaaacagtgtgttgatattagactgaatggggaatacccgcccaaggcagttgccaagatggcggcggttgcagccttgtgtgtgcaatatgaagcagatttcaggccaaacatgagcattgtcgttaaagcactgcagccgttgttgaatgctcgtgctggaccccnaactgaagcaccacatttgtgaaatgaaatctcatctctagggctggctggaccctttactctgctaatcatcatgtcattgtta

SEQ ID NO: 6718 - DNA, 685 bp, Solanum melongena
tgatgacgatgttgctaagatagcagattttgatttatcaaatcaagctcctgatatggcagcacgtcttcactctacacgtgttcttggaacctttggttatcatgctcctgaatatgcaatgactggtcagctaagttcaaagagtgatgtttacagctttggtgttgtactccttgaactactcactggccgtaaacctgttgatcatacattaccacgtggccaacagagtcttgtgacatgggcaacacctagacttagtgaagataaagtgaagcaatgtgttgatgctagactcggtacagattaccctcccaaggccgttgcaaagatggctgcagttgctgctttgtgtgtacaatacgaagctgatttccggccaaacatgagcattgtggtaaaagctcttcaacctctgttgcacgctcgacctgcacctagtgaaacatcaaacttgtgattctctccgcagcctctactacatggaatgacagtgattgagatttgttttgttgagttgaaaatgatatattatactagtagttatctgggaaaatggctgacatactgtgttttccccccttcttttactggtctcaattgaatgtggataaatttatacatgcactaatgaaagtaactttgcctattcttttaatgaattgttcttgatgtcttgaat

SEQ ID NO: 6719 - DNA, 1084 bp, Zea mays
gatgtggtgttgcagcggcgcggacgacgagccccacgccgccccgctggccgccaacccggccgcgacgccgccgcgagcaccagcccaggcgagggggccgagcatgccgaggaccggaggcgccgccgcgtccgctgccaaggtgctgcccatcgacgtgccggccgtcgcgctgtcggagctcaaccgcctcacgggcaacttcggggacagggcgctggtcggggaaggctcgtacggccgcgtctaccgcgccacgctcgccaccggggaggtcgcggcggtcaagatgttcgacaacggcagctcctccggccagtccgaggccgaattctgcgagcagctgtccgtggtgtcgcggctcaagtgcgagcacttcacccagctgctgggctactgcctagagctcaacaacaggatcgtgctctaccagttcgccaccataggctccctctacgatatactccacgggaagaagggggtgaagggcgcggcgcccgggcccgtgctgacgtggatccagcgcgcgcggatcgcctacggggcggcgaggggcctggagcacctgcacgagaaggcgcggccgtcgatcgtgcaccgcgacgtgcgctccagcaacgtgctggtgttcggcggccacgacgccaagatcggcgacttcaacctcaccaaccagtcccccgactccgccacgcgcctgcactccaccaaggtgctcggcacgttcggctaccacgcgcccgagtacgcgatgacggggcagctgacgcacaagagcgacgtgtacagcttcggcgtcgtgctgcttgagctcttgacggggaggaagcccgtggaccacaccatgccaaagggacagcagagcctggtcacctgggccactccgaggctgagcgaggacaaagtgaagcagtgcgtggaccccaagctcaaggacgactacccgcccaaggccgtggccaagctcgcggcggtggcggcgctgtgcgtccagtacgaggccgatttcaggcccaacatgaccatcgtcgtcaaggctctgcagcccctcgtgaacgctcggccaggaggagagtagcta

SEQ ID NO: 6720 - DNA, 1096 bp, Medicago truncatula
tatgttgtgttgcggaggttcagaagaagataccagcgggccacctgcaaaccaatacactgcaccatcaagagggggtaactcatatggcgccggcggtggaggagagccaaggagcaacattaccaagagtggtggtccacagaaagtattaccaattgagataccctcgatatcattggctgagttaaatagattaacaggaaactttggttcaaaggccttcattggtgaaggttcgtatggaagggtttactatgcaaaaatgaatgatggtactgaagctgcaatcaaaaggctggatacaagttcttcacctgattccgactccaacgatttcgcggctcagttatcagttgtttcaagactcaagcatgacaattttgtagagttgacgggatattgtctagaagcagacaacagaattttggtttatcaatatgcaagtttgggttctttgcatgatgtattacacggaaggaagggcgtacaaggtgctgaacctggtccagttttaagctggaaccaaagagcaaaaattgcatttggtgcagcaaaaggattagagtttcttcatgaaaaggttcagccttctatagttcaccgtgacgttcgatccagcaatgtcttattattcaatgactatgaggccaagattgctgatttcagcttgacaaatcagtcttctgatacggcagctcggctacattcaacaagagtcttgggaacatttggctatcatgctccagagtatgcaatgacagggcagataacacaaaaaagtgatgtttatagttttggagttgtgcttttagaactcttgactggaagaaagccagtagaccacacaatgcctaaagggcaacaaagtcttgtgacttgggcaactccaaggttgagtgaggacaaagtgaaacaatgtgtggatcctaaactaaacaatgactaccccccaaaggcaattgctaagttggcagctgttgcagcactgtgtgtgcaatatgaagctgatttccggccaaacatgacaattgttgtcaaagctctccagccacttctcaatgcaaaaccggctggtcctgaccctaatgcttga

SEQ ID NO: 6721 - DNA, 849 bp, Cucumis melo
caaaggatctcagcccggccctgttctttcctgggcacaaagagtaaaaattgctgtaggtgctgcaaaggggttggagtatttgcacgaaaaggtcgatcctcatatcgtccatcgtgacataaaatccagcaacgtactaatatttgatgatgatttggcaaaaattgctgactttgatttgtcaaaccaagcccctgatatggctgcacggcttcactccacccgtgttcttggaacctttggctatcatgctccggaatacgcaatgactggacaattgaatgccaagagtgatgtgtacagctttggtgttgtcctgcttgaacttttgacaggaagaaagccagttgatcatacattacctcgaggacagcaaagcctcgtgacatgggccacgcccaaactttgcgaagataaagttaagcagtgtgttgatgcaaaactaggaaatgagtaccctcctaagtcagttgctaagtttgcagcagtggctgcattatgcgttcaatacgaagcagatttcagaccaaacatgagtattgtagtcaaagctcttcaacctctcttaaatgcccgtcctggcccttgaggtgaaaccaccaactctttaaaatctctctttatctcttttacttttcctgtggattcttgtttgttactacttcttgggtccacgtgctgacacgtgacgtgagggttccaaattattacccgggggtattcaatttttagttggtggtgggtgatcatcaatttgtttacaaaaacagtgagataccataatcatgatttttttatgtcatatatgaacgacgtgtcgtcgtttcttcttcttcttaaaaaaaa

SEQ ID NO: 6722 - DNA, 1442 bp, Avena sativa
ctccccgctcccccgctccccgcttcgcttccttctccgccaccagcttcttcgctcctccgcctccgccccgccgtcgccgggacacgccaaaggacttcttttcagataggatatgtcgtgctttggatgctgtggtgatgaagacactcaacgagcaccggacaacaggaatcaatacccaggaagccatccagcaaggaatgatgcatatcgcactgctgatccaactccaaagggtcctcagcctgtgaaagtgcaaccaattgcagtccccaccattccgatggatgaaatcagggaggtgactaagggtttcggcgatgaagctttgattggtgagggctccttcggcagagtatattttggtgttctaagaaatggcaggagtgctgcagtcaaaaagttagattctagcaagcagccagaccaagaattgttggcacaggtgtctatggtgtcaaggcttaagcatgaaaatgttgtcgagttgcttggctactgtcttgatggggccacccgtgtccttgcttatgagtttgccactatgggttctcttcatgatatgcttcatggaaggaagggtgttaaaggggctcaacccggtccagtcttatcatgggtacagcgggtgaagatagctgttggtgcagcgaaaggtctagagtatcttcatgagaaagcacagcctcatatcatacacagggacatcaagtccagcaacgttcttctttttgatgatgatgtagctaaaatagccgacttcgatttgtcaaaccaagctcctgacatggcagcccggcttcactcaactagggttctcggaacatttggataccatgcacctgagtatgcaatgactggacaacttagctccaagagcgatgtgtacagtttcggagttgttcttctggagctattgactggaaggaaacctgtcgaccatacattaccgagggggcaacagagccttgtcacatgggccaccccaagactgagtgaagataaggttaggcaatgtgttgactcaagacttggaggggactttcctcctaaagctgtcgcaaagtttgctgctgtcgccgcgttatgcgtccaatacgaggctgactttcggcctaacatgagcatcgtcgtgaaggcgctccagcccctgctgaacgctcgagcagcccaccccggagaacatgctggtcgttaagctccactccaaccttttgtatgatatagggaaaaggagcatttggcaggcagtgcgtgtgtacgtttgtgattattcttctcgagttgtaaccctcaaaattctagtaccaaaaaaaaacggattctttctatctgttgcaagattggcaattggtgacttgactaacttgcgtatgtctacatggaacattttattagccagttaaaaaaggaaaagaaatgaactctgcagcttaaga

SEQ ID NO: 6723 - DNA, 1589 bp, Avena sativa
ggcgaggacagacgcagctacgaccggtagaccagcccccagccccagcccagcagctctcccctccctccctctgtgtacataaagctcgctcgccgccgcggctgaccagacagctcacagacgctggctgttcctgctccgctccctcctcgctcccccggtccccgcttcgcttccttctccgccaccagcttcttcgctcctccgcctccgccccgccgtcgccgggacacgccaaaggacttcttttcagataggatatgtcgtgctttggatgctgtggtgatgaagacactcaacgagcaccggacaacaggaatcaatacccaggaagccatccagcaaggaatgatgcatatcgcactgctgatccaactccaaagggtcctcagcctgtgaaagtgcaaccaattgcagtccccaccattccgatggatgaaatcagggaggtgactaagggtttcggcgatgaagctttgattggtgagggctccttcggcagagtatattttggtgttctaagaaatggcagaagtgctgcagtcaaaaagttagattctagcaagcagccagaccaagaattgttggcacaggtgtctatggtgtcaaggcttaagcatgaaaatgttgtcgagttgcttggctactgtcttgatggggccacccgtgtccttgcttatgagtttgccactatgggttctcttcatgatatgcttcatggaaggaagggtgttaaaggggctcaacccggtccagtcttatcatgggtacagcgggtgaagatagctgttggtgcagcgaaaggtctagagtatcttcatgagaaagcacagcctcatatcatacacagggacatcaagtccagcaacgttcttctttttgatgatgatgtagctaaaatagccgacttcgatttgtcaaaccaagctcctgacatggcagcccggcttcactcaactagggttctcggaacatttggataccatgcacctgagtatgcaatgactggacaacttagctccaagagcgatgtgtacagtttcggagttgttcttctggagctattgactggaaggaaacctgtcgaccatacattaccgagggggcaacagagccttgtcacatgggccaccccaagactgagtgaagataaggttaggcaatgtgttgactcaagacttggaggggactttcctcctaaagctgtcgcaaagtttgctgctgtcgccgcgttatgcgtccaatacgaggctgactttcggcctaacatgagcatcgtcgtgaaggcgctccagcccctgctgaacgctcgagcagcccaccccggagaacatgctggtcgttaagctccactccaaccttttgtatgatatagggaaaaggagcatttggcaggcagtgcgtgtgtacgtttgtgattattattctcgagttgtaaccctcaaaattctagtaccaaaaaaattggattctttctatctgttgcaagattggcaattggtgacttgactaacttgcgtatgtctacatggaacattttattagccagttaaaaaaggaaaagaaatgaactctgcagcttaaga

SEQ ID NO: 6724 - DNA, 1580 bp, Arachis hypogaea
tgggggaacattttctctttctttttaaaagtttgatattattatcgcttacaattacgacacacttttcctccttcttcttcttctcggtgaagtcaatgcacaataactagtaggaaaacaaaaacagaacgcccctgttgccatattcaaaccgaatattcattcttttctttgtttccatatttgcccctcttactttcttcctctttctctgttacttcacaagtctaaaggagaggatcatgggttgctttggcttctgcaaacaagatgatagttataaaccttctgataaccgatccttaatgccaacaaattctactgggaataccggttatagtaccagaccaactgcagtaaccactcctaagattatagaattcaaaccgattgccgtcccttccctttcattagatgaattgaagtctttgacagacaattttggggcaaaatgtttcattggtgagggtgcatatgggaaagtgtatcgcgcaacattgaaagacggccgtgatgttgtaattaagaagttagattccagcaggcaaccagaccaagaatttcttgcacaggtctcgatcgtatcgaggttaaagcatgaaaatgttgttgaactagttagctattgtgttgatggtcctcttcgcgcccttgcctatgagtatgctcctaaaggatcccttcatgatattctacatggacgcaaaggcgtgaagggtgcgcagcctggtccagttctctcatgggctcaaagagtcaaaattgctgttggagcggccagaggacttgaatatcttcatgagaaggcagagattcatatcatccatcgatacatcaagtcgagcaacataatgctttttgatgatgatgttgcgaagattgctgattttgatttgtcaaatcaaaacccggatgctgcagcgcgtctccattctacccgtgttctaggcacctttggttatcatgctccagaatatgcaatgactggaacactcactgccaagagtgatgtgtatagttttggagtgatattgctggagctgttaactggccgtaaacctgttgatcacacgctgcctcgaggacagcaaagccttgtgacatgggcaacaccaaggcttagtgaagataaggtgaagcagtgtgttgatgttagattaaagggagactaccctccaaaggcagttgcaaagttggctgctgttgctgcgttgtgtgtccaatatgaagccgagttccggccaaacatgagcattgtagtgaaagctctacaaccactactcaatacccgttccggtcaaccaaaggaatcagcacacaagatgtaaattctcagaagccccttcattccttcttgcaaactgcagcagaatgccttccattgagtgtcaataatcagtatctcaaaggcatagatatagtcttgatatttttgtttgtgtgattgtattggtaactcagcaactagtttagttttgctgtttttgaatgacacaatggaacctacctactgtgttgttgttcagattctacaatctacttttatatttatatatataggtaaacatggattattt

SEQ ID NO: 6725 - DNA, 1612 bp, Arachis hypogaea
agttcatttcaagtcaaggcacctgcaccgctttatcctacgcaccatcttccttatcctgcgcatatccggcgagatcttcaactgcatcctcttccttctcagctgcacagcttccctatttcgattccagcaggaggaatcatgagttgtttcagctgttgtgaaggcgatgacttgcacaatactactgatagtggagcgccgtttgctgtgaaaaattcagcaggaaatgatggaaatcatcatgcttcagaaactgcaaagcagggtgctcaaactgttaaagttcagcccattgaagttcctgctataccagtggatgaactaaaagaattacagataacttgggaaaatgctctgattggagagggttcctatggaagagtatatcatggtgttcttaaaagtgggcagactgccgcaataaagaagttagatgccagtaaacagcctgatgatgaatttttagcccaggtttcgatggtttcacggttgaagcatgacaattttgttcaattgcttggttattgtgttgatggaaactcccgtgttcttgcttatgagtatgcatctaatgggtctctgcatgatattctacacggcagaaaaggtgttaaaggagcaaaacctggtcctgttttgacctgggcacagagagttaaaattgctgtaggggctgcaaaagggcttgagtacttgcatgagaaggctgatcctcacattatccaccgggatatcaagtcaagcaatgttctaatatttgatgatgatgtcgcaaaaattgcagattttgatttgtcaaatcaggcccctgacatggcagcacgtcttcattccacccgtgtccttggaaccttcggttatcatgcaccagaatatgcaatgactgggcaattgaatgctaagagtgatgtatacagttttggtgttgtccttctggagcttttgacaggaagaaaacctgttgatcatacattaccacgtgggcagcagagcctagttacttgggctactccaaaactcagtgaggataaagtcaggcagtgtgtagatgcaagactaggaggagaatacccccccaaagctgttgctaagttggctgctgttgctgcactgtgtgtgcaatacgaagctgatttcagaccaaacatgagcattgtagtcaaagctctgcaacctttgttgaatgcacgacctggccctgctggtgaaacaccaaactaaactgtctatatctctttgtacctctatctgtgagtatgtgcacatttgcttgcaaaatataagaaaaagactggttcagaagctggtggtaaatttctcaaacaacaaacatggttcccattgtttacactgcattcattttgttcataatccatgagggttttttgaggtatacttgcttcttttatttatttattaatttttttgttgcttgtttacataccttttttaagtgttcccttttgcgggttattgccttcttacctgaaactcttggggaactgcaaaacagaaatgagagtgcgcagagtaaataggcatagcatgtcattgccgtatttattcttcggaaaagagagtgagaatgggcaaatcctattcttgt

SEQ ID NO: 6726 - DNA, 1630 bp, Populus trichocarpa
attctgtcaagcttagcgcgtatctgccaatctcataaaaaaaaaaaaaattgtatttaaatttgcaattttcctgcgttaacttcaaaactcagtctaaacaagtcgtaaaagaaacccctccttctctccttctgtcaatctatccctccctatcctgcgcacacttggccgccttccacgtctcagatcctcctgctctctcccacacactgactggtcaagcatagtgattgtcagctctttagtgggatttataaagattttgaatcatgagttgcttcggctgttgtgaagaagatgacatccataaagctgctgactatggaggccagtatacagttaaaagctcagctggcaatttaggaaattatcatgcatcagaaacagctcccaagggcgctcaggcttttaaaatccagcctattgaagtccctgaaatatcgggggatgaacttaaggaagttacagataactttgggacaagttcattgataggggaaggatcatatggaagagtatattatggtgctcttaaaagtgggcaggatgcgtcaataaaaaaattagatgccagcaaacaacctgatgatgaattcttatcccaggtctccatggtatcaaggttgaagcatgaaaattttgtacagttgcttgggtattgtgtagatgggggttcccgtgtactcatctatgaatttgcttctaatggatcgcttcatgatattcttcatgggaggaaaggtgttaaaggagcacagcctggtcctgtccttacatggcctcagcgtgtaaaaattgctgttggtgctgcaaaagggcttgaatacttgcatgaaaaggctgatcctcacatcgttcatcgtgacattaagtccagcaatgttcttatttttgatgatgatgttgcaaaaattgctgacttcgatttgtcaaatcaagctcctgatatggcagcacgtcttcattccactcgagttttgggaacatttggttatcatgctcctgaatatgcaatgactggacaattgaatgcaaagagtgacgtgtacagttttggtgttgtcctgcttgagcttctgactgggaggaaacctgttgatcacactttaccacgtggacagcagagtctagtgacatgggctacaccaaaacttagcgaggacaaggttaagcagtgtgttgatgcaagattacaaggagagtacccacccaaggcagttgcaaagatggctgccgttgctgccttgtgtgtgcaatatgaggctgatttccggccaaacatgagcatcgtggtcaaagccctccagcccctgttaaatgcccggccgggacctgctggagaagcaccaagcatataattctttctcccggctcagtgtatgtttgtgcaggtgaaagtgggcatccctgagcaagaataatatatcaaggttttgttactgacgtatgtagcaaaacatttggacatcgttccctgagctcccattatttgatgcgcatttgattttttcataatgtgtgaagcggtccatgttgtcatatgatttttttgtataccatctctcccagatgtgaataaaagatgatatattctatgaatgagatttattcattaattacgtggaca

SEQ ID NO: 6727 - DNA, 1099 bp, Populus trichocarpa
aattcatatgttctgttgtggagataaagaggaggaaccccatggcccgcctgctaatcaatacacagccccgcctagaggagggaatccatatggcagcgggagaggagagccgagaagcgccaatccggccagaaatggagctccacagaaggtattacctattgaaattccagcaataccattggatgagttaaataggatgacaggaaactttggtacaaaggctttgatcggagaaggttcttatggccgagttttctatgccaagttaagtgatggcatgcgtgctgcaattaagaagctagacaccagcagctcacaggaaccagattctgattttgcagcacagctgtctgtagtttcaagactcaagcatgaacactttgtggagttgacggggtattgtttggacgcaaacaaccgaatcttggtttatcagtttgctgtaatgggttctttacatgatgtactacatgggaggaaaggtgtacaaggggctgaaccaggtccagttctgaactggaaccagagagttaaaattgcatatggggcagcaaaaggcctcgagtatctgcacgaaaaggttcagcctcctatagttcatcgcgatgtcagatcaagcaatgtcctactctttgacgacttcatgtccagaattgccgattttaacttgtcaaatgcccattctgacactgctgctcgactgcattcaaccagggtcttgggaacatttggctaccatgctccagagtacgccatgactggacagataactcagaaaagtgatgtttacagttttggagttgttcttctagagttgttgacaggaagaaagccagtagaccatacaatgcctaaagggcaacagagtcttgttacttgggcaacaccaagattgagtgaggataaagtgaagcaatgtgtggatccgaagctaaacaatgattaccctccaaaggcagttgccaagttagcagcagttgcagcactttgtgttcaatatgaagcagactttaggccaaacatgactattgttgtgaaggctcttcagccacttctcaactcaaaaccagcagggccagacgctcatgcataa

SEQ ID NO: 6728 - DNA, 1732 bp, Pseudotsuga menziesii
gcaggattacggagtcttcatggtatatatacagatttctctctcgctattgcgggaagttggtaaagggctctttgttcagttgattgcagtgctgtctgcttctctttaaagcgagtttgaattattcaggttgtgggaatcagacacatttctgttggtagaagtttagaaccatgtggtgttttagctgctgtgcagaagatgaaattcaaaatgcagccgatggcacgaggcctattatggtaaatggaaatttcccaggaaatgatggagtttacgaaaatgcaaacacagctctcaggagtggtcaaaatctgaaacttcagcctattgctgttcctgaaatcacagtggatgaattgagggaggtaacagataacttcagtcaaaattcgttgattggagagggttcttatggtccagtatatcatgggatcttaaaaaatggccgtgattcagccattaaaaagttggatgccagaaaacaaccagatcaggagttacttgcacaggtttccatggtttcgaggttgaagcatgaaaatttagtggaactggttgggtattgtgttgatgggagcctgcgagtgcttgcttatgagtttgcaactatgggatcgcttcacgacatccttcatggtaagaaaggtgttaaaggagcacaaccaggtccagttctcacttggacgcagagggtaaaaattgcagtaggtgctgcaaaagggcttgagtacctccatgagaaagcacaaccatctatcattcaccgtgatattaagtctagcaatgtcttacttttcgatgactatacagcaaagatagctgattttgatctatcaaaccaagctcctgacatgtcagcacggcttcattccactcgtgtgcttggaacatttggttatcatgctccagaatatgcgatgacaggacaatcaactcaaaagagtgatgtttacagctttggcattgtcctccttgagttattgactggcaggaaaccagttgatcacacattgccacgcggtcaacagagccttgttacatgggcaaccccaagacttagtgaggacaaagtgaagcagtgtgtggatccaaggttgaaaggagactatccacctaaagcagtggctaagatggcagcagttgctgccttgtgtgtgcaatatgaagctgattttcgtgcaaacatgagtattattgtgaaagctcttcgacctctattgaatgcacaatcagctcctgttggtgggagcgcagctgagtaatctgatgtctgtcatattataccttaccttatgatattccaaatttgtgcgttgtttagtttggcatatcttctatctgcttgcatatatatcgacctggaatttgaaaattgtaaagaattggattactaatcatgtggaaacagaagggaatcaaggcagcaaatgcatacaattggacatgggcattcaaatttgctggcccatgctgagttttcaggatatgcaagtatgatgtctactgtgctgctttctattaggttgtcatgattcatgtttgtatgtatattcatacttaagtataatgtgtcataaacattagtttcattgtctagaagtgacccaagactcagttaaggagaggtatggccattgttcggtttacggcacagtcgctatttaaattggtttattttcagtatcttcttattattttcatagctgaaagcatatgttatttgaat

SEQ ID NO: 6729 - DNA, 1882 bp, Oryza sativa
gccttctccttcttctccgacggcgaacaccgtccatcgcgagaactcttacctcgtcggcgtcggcgtcggcgtcggcgaggaggagcaaacatttacggctggcttgcaatcttaatcttttgcagtgttcgtcattcaggaggctcccggccgatccggtggatcggatcggagcgggagcacaaactgcaaattgccacggtccttgcacttgatttccggagccaggaggatgatttgctgcggcggcgaggaggaggagacgtacgctccccgtgcagccagtcgcagtcgcagcaggcgcccgacacctgcgacgcagtacaatgcaggccctcgtaagccaagaggaccaaatgcacccaggagcggcggcccgccaccgaaggtgctctccatcgacgtgccagccatctccatgggcgagctgaacaacatcaccggacactttggacagagtgccttgataggagaaggttcgtacggtcgaatctacagggcggtgctgacctccggggagccggttgccataaaaaagcttgatcccagcgtgtcaagcgactctgaagcagacttctctgctcagctgtcaatggtttcgaggctcaagaacgagtatttcatccggctgatgggctactacctggatgcaaaccgaagaatcctggtctaccagtttgccacgcacggctccctgcatgacatcctacacgggaagaagggcgtgagggacgcggcgccggggccggcgctgaactggagccagcgggtgaaggtggcgtacggcgccgcgagagggctcgagtacctccacgagaaggcccagccgcccatcgtccaccgcgacgtgcggtcgagcaacgttctcctcttcgacggctacgagtccaagctcgccgacttcaacctcaccacccagcctcccgacggcgccgcgcggttgcactccacccgcgtcctcggaaccttcggctaccacgcgcccgagtacgcgatgacgggacagcttaatcagaagagcgatgtgtacagtttcggagtcatcctactggagttactgaccggcaggaagccagtggaccataccatgccgaagagacagcagagtcttgtaacctgggcgacgccaaggttgagcgaggacaaggtgaggcagtgcgtggatccgaaactcggggatgactatcctccaaaagcagttgccaagatggcggcggtagcggcgttgtgcgtgcaatacgagtcagatttccggccgaacatgaccatcgtggtgaaggcgctgcagccacttctcagcaagccagccggagcaggagggccctagcagcacatgcatactaacaccagcccatgcatcaaaccaacttagcatccaaaacacattatgtgctctgttcttcttggatgctgagacttgttaaacagctggtgattgtaccatgtactactcacaaatcaatcaaactgctaaaagggtccaagggctcacagagtttcaggtcattggctgtgattctccattgttccttcagtccttacctttgtttaggtttcagatcagtagatatttttgcaatttcgctgtcccgttctgtaggtacgtaagggtccattccactgcatgactgcaagctacgtcgtgttcttatcttaagacatttattgacatcacaccgatgggagacaaactgacaaccgaaggactgtagagaaaataggaggcctccttatcaaagagagaaacattaatagagacaatatctcagtgtagctgcagtttgtgatgactgtggcttgattgttcgcattacgctgtcagctgttatgggttagtagttataactttctcactatgaacagatgatattttcatttc

SEQ ID NO: 6730 - DNA, 1104 bp, Glycine max
ttatgttgtgctgcggaggtgcagaggaggagagcaccgggtccccggcaaatcaatacccaactgcaccacctagagggggtaacacatacggtggaggaggtaatgatagaggagagcctaggggcaatgttgcaaagagtggtgccccgcagaaagtattgccaattgagataccctctatgccgttggatgagttaaacaggttaacagggaactttggtacaaaggcttttattggcgaaggttcatatggacgagttttctatgcaaaattgagtgatggcactgatgctgcaattaagaagctggataccagttcttccccggaacctgactcggattttgcggctcagttatcgattgtttcgagaatgaagcatgacaattttgtggagttgattggatattgtctagaggcagataacagacttttggtttatcaatatgcaagtttgggttctttgcatgatgtgttacatggaaggaagggtgtacaaggggctgaacctggtccagttttaagctggaaccagagagcaaaaattgcatttggcgcagcaaaaggacttgagtttcttcatgaaaaggttcagccttctatcgttcaccgcgatgttagatccagcaatgtcttactattcaatgactatgaggccaagatagctgatttcagcttgacaaatcagtcttctgacacagccgctaggctacattcaacaagagtcttgggaacatttggctatcatgccccagagtatgccatgactggacagataacccagaaaagtgatgtttacagttttggggttgtgcttttagaactcttgactggaagaaagccagtagatcacacaatgcccaaaggacaacaaagtcttgtaacttgggcaactccaaggcttagtgaggacaaagtgaaacaatgtgtggatcctaagctaaacaatgattatccgccaaaggctattgctaagttggctgctgtggcagcactttgtgttcagtatgaagctgacttcagaccaaacatgaccattgttgtcaaagctctccagccacttctcaatgcaaaaccgtctggtcccgatcctcatgcttgat

SEQ ID NO: 6731 - DNA, 1120 bp, Glycine max
ctatgttgtgttgtggaggtgcagaagaggattttggcattccacctggaaatcaatataatgcatcacctaaaaagggtaatgcatataatggtggaggaggaggtgacagaggcgagcctaggggtaatgttgtaaaaaatggtgctccacaaaaaacattgccaattgagatacccgctatttcattggatgagttagatcgattaacaagcaactttagtacagaggctttgataggagaaggttcttatgggaaggtttactatgcaaaattgagcgacggtatggaagctgcaatcaagaagctggatacaagttcttccccagaccctgactctgattttgcagcacaattatcaattgtttcaagattgaagaatgagcattttgtggagttgatggggtattgtcttgaggaaaattatagaattttggtttatcaatatgcaagtttgggttctttgcatgatgtgttacacggaagaaaaggagtgcaaggtgctgaacctggtccaattttaaattggagtcaaagaataaaaattgcatttggtgcagcaaaaggacttgagtttcttcatgaaaagtgtcaaccttctatagttcatcgcgatgttagatctagcaatgtcttactcttcaatgactatgagtccaaggttgcagatttcaacttgacaaatcaatcttctgacactgcagcacgactacattcaacaagagtcttaggaacatttggctatcatgctccagagtatgccatgacaggccaaataacccaaaaaagcgatgtttatagttttggagttgtgcttttggaacttttaacaggaagaaagccagtagaccatacaatgcctaaagggcaacaaagtcttgtcacttgggcaactccaagattgagtgaggacaaagtgaaacaatgtgtggatcctaaactaaacaatgaatacccacccaaggcaattgctaagttagcagcagttgcagcactttgtgtacaatatgaagctgactttaggccaaacatgactattgttgtcaaagctcttcaaccacttcttaattcaaaaccgactagtgttgatccagacacttgactttttagccatagata

SEQ ID NO: 6732 - DNA, 1595 bp, Helianthus annuus
ctaaccttcgccctatccggtgcatattagccctcttccccaccaattaaagatatccaagacacactgtgtttccatttctcttttcttcatccttcaagcaaccccttttcttgattcaacccacctgcaaaaacaagatctttgatttgtcaagtagagcaaactaaacatgagttgcttcggctgttgtggagaagatgatatgcacaagtcgtacgataacggaacctacatgccgaataatgctgcaggaaacaatgcaggttatcgtgccactgaggctgcaccaaaggacacacaggctgttgccgtccaacctattgctgtccctgctctacaagtggatgaactgaaagaaattactgataatttcggtacaaagtcgttaatcggagagggatcatatggaagagtgtaccatggtgtcttgagaagcggccaggcagcagctatcaagaagttagactccagcaagcaacccgatcaagaatttttagcccaggtttctatggtatcgaggcttaaaaacgataatgttgtgggattactcgggtattgcattgatggcggtctaagagtgttggcctatgagtatgcttcaaatggatctcttcatgatattctgcatggaagaaaaggtgttaaaggtgcacagccaggtccagttttatcatggtctcaaagagttaaaattgctgtcggtgctgcaaaaggacttgaatacttgcatgaaaaggcgcagcctcatatcattcatcgcgatataaagtcgagtaatgttctgttgtttgatgatgatgtggctaagattgctgattttgatttatcgaatcaagcacctgacatggcagctcgccttcattccactcgtgttcttggtactttcggttatcatgcacctgaatatgcaatgaccggacagttgagttcaaagagtgatgtttacagctttggcgtggttctcctagaacttttgactggccgaaagcccgttgaccacactttgcctcgtggtcaacagagtctggtcacatgggcaacacctaaactgagtgaagataaggtgaaacagtgtgttgacactagactcaatggggaatacccccctaaggcagttgccaagatggcggcggttgcagcgttgtgtgtgcaatatgaagccgatttcaggccaaacatgagcattgtggttaaagcactgcagccattgttgaacgcgcgtgcggggcctcaaaccgaagcgccacacttgtgaatccccacctagagccgggctacggccgctactgctactgcttgatcataatcatgtcattcctgcagatgacagataaaactagcagatatttatgtttgtaatgtggaagaatattccacagctgatgcgcattcttttgtttgaggtttcaagattttcttgtggtaaatagtgaagggatttatttaggtgcaaagatacttactatgatgtactgcagaaacaagtttattttatttctggaaattggttttattcccttgtgaaaaacaaagaaaaaaaagagtgaacaaaatgacaatgtcaaagaaaaagatgaactaaacatactaac

SEQ ID NO: 6733 - DNA, 1538 bp, Nicotiana tabacum
  misc_feature (57)..(57): n is a, c, g, or t
  misc_feature (231)..(231): n is a, c, g, or t
  misc_feature (437)..(437): n is a, c, g, or t
gctctttcctttatactgtttccgtttctattatacttttctcactctgattcttcnattcaatacatattatttctatatttgactccctttattagtctctcttccatttctatctcagtcttcagatcacattttctttcacttcacaaccaattttgtcatcgcgcgttgttttcgaagccgattgcctctaagtattttccagaatatctcaagggtataggaagnaggaaaactatgggctgctttggttgttgtgatgatgatgacatgcacaaagctgctgatcatggaccattcatgaccaataattcagcaggctacaatgcagggcagcgtgcaacagaaagtgcgcagaaggagacacaaactgttaacatccagcccattgctgttccttctatagctgttgatgagttaaaggacatcacagncaactttggtacaaaagccttgataggtgaaggttcatatggaagggtataccatggtgtcttgaaaagtgggcgggctgcagccattaaaaagttagactcgagtaagcagcccgatcgagaatttttggcgcaggtttctatggtatcaagattaaaacatgaaaatgtggttgaattactcggttattgtgtggacgttggtcttcgtgtgttggcctatgagtatgccccaaatggatctcttcatgacattcttcatggacgaaaaggcgtgaaaggtgcacagccagggccggtattgtcatgggcacaacgagttaaaattgctgttggggctgcaaaagggctagagtacttgcacgaaaaagcacagccgcatatcatccatcgtgatattaagtctagcaatgttttactctttgatgatgatgttgctaaaattgcggattttgatttatcaaatcaagctcctgatatggcagcacgtcttcactctacacgtgttcttggaacctttgattatcatgctcctgaatatgcaatgactggtcagctgagttcaaagagtgatgtttacagctttggtgttgtactcctcgaactccttactggccgtaaacctgttgatcatacattgccacgtggccaacagagtcttgtgacatgggcaacaccaagacttagtgaagataaagtgaagcaatgtgttgatgctagactgggtacagaataccctcctaaagccgttgcaaagatggctgcagttgctgctttgtgtgtgcaatatgaagctgattttcggccaaatatgagcattgtggtaaaagcgcttcaacctctgttacatgctcgatctgcacctagtgaaacatcaaacgtgtgaattctctcttttcctacagccactactgcatgaaatgataacgattaagatttgttttgttgagttgaagatgatattatactacgaatagtagtagttatttgggaaatcagcggacatagtatgatttcccttttgctttttccctggtcgattgaatgtgtataaatttataaatgcactaatggaagtagctttgcctattcttttcgaaa

SEQ ID NO: 6734 - DNA, 1520 bp, Tragopogon dubius
tcggggctatgatattttcccatttgcatttacctacgcgcttttcctcatccactgctctttagccgtcttctttgtacccaacagcgcctaaaacacactgtcttcacatttttcttttcttcagtttactaaagttcctttcttttttcttttcaagcaacccctcttcttcattcaacccaactgcaaaagatctctgtgtaattgtcaatagaggaaggcgatcatgagttgcttcagctgctgtggagaagatgatatacacaagtcttatgataatggaccattcatgactaataatgcagcagggaataatgcgggttatcgcgccacagaggctgcaccaaaggacacacaagctgtagccattcaaccaattgctgtccctgctcttcaagtggacgaattgaaagaaatcaccgataattttgggacaaaatctttaattggtgaaggctcatatgggcgagtgtatcatggggtgttaagaagtggccaggctgcagctatcaaaaagttagactccagtaagcaaccagatcaagaatttttagcacaggtttctatggtatcaaggcttaaacatgataatgttgttgggctactcgggtattgcattgatggtggtttaagagtgttagcctatgagtttgcttcaaatggatctcttcatgatattcttcatggaaggaaaggtgtgaaaggtgcacagccaggtccggttttatcgtggtctcaaagagttaaaattgctgttggtgctgcaaaagggcttgaatacttgcatgaaaaagcacagcctcatattattcatcgcgatataaagtctagtaatgttcttctttttgacgatgatgtggcaaagattgctgattttgatttatcaaatcaagctcctgatatggctgcacgccttcattccacccgtgttcttggtacctttggttatcatgcacctgagtatgcgatgaccggacaattgagttcaaagagtgacgtttacagctttggagtggttcttctagaactgttaactggccgaaaaccagttgaccacaccttgccacgtggtcagcagagcttagtcacatgggcaacacctaaactgagtgaagataaggtgaaacagtgtgttgacactagactgaatggggaataccctccaaaggcagttgccaagatggcggcagttgcagccttgtgtgtgcaatatgaagcagatttcaggccaaacatgagcattgtggtgaaggcgttgcagccattgttgaatgctcgagctggacctcaaacagaagcaccacacttgtgaattcccctctgctaatcattgacaaacaaaatttagcagatatttatgtttcttgtgtagaatcattcttttgtttgacttttgtaccgaaaaaaaggtttttaagattctcttggtaatttgtggtaaatagtgaaggattttggtgtggttgatggacagtaaacaactcttatgtaatgcagtaacaagttctttcgttaag

SEQ ID NO: 6735 - DNA, 1734 bp, Oryza sativa
gcgagcgtaggttcttcccatttggcggttggcagcggaaggaaaggagagaaaagagggggggaaggccaggccaaccggagcgaaggaaagccagggagtaataaatcgagagagaaacggccaaaaaagaaaccaacaacaagaaagaaatcaagcaagcaagaagagacgagacgagggagagaaggagaagagggggccggccgcgggcgtcgtcgtgttcctccccccctctctctcctctcctctcctctcgatctccatccttccttccatccattcctccccgcacccttcgcattgctctcgtcgtctcgattcggtcgaggatctccaggaaaagaggaggaagcgatatgggttgcttttcatgctgcggagcggatgatgtcggcaagaagaagaagcgcgacgatccttacgtcccgatccctgatccaggtggtaactatggacgtagcaagcccgggcccccagccccttcgcgttctccccccaccagcagaaatctgccaattgcagtaccggcaattccccttgatgaaataaagggaataaccaagaacttcagcagtgatgctctcatcggagaaggctcgtacgccagagttttctttggtgtgctgagagatggcaggagatctgcggtgaagaagctcgactccagcaaacagcctgatcaagaattccttgtgcaggtttcagccgtttcacgactgaagcatgagaatattatccaacttatcggatattgcgctggagggagcatccgtgttcttgcttatgagtatgcaccgaggggctccttgcatgacattctccatggtaaaaagggtgtgaagggagctcagccaggaccagctctatcatggatgcagcgagtgaagattgccttgagtgctgcaaaggggcttgagttcctgcacgagaaggcggagcctcgtgtcgtccaccgtgacatcaaatccagcaacattatgctctttgacaacgatgttgcgaaagtaggagacttcgatgtatccaatcagtccccggacatggcggctcgcctccactccactcgtgttcttggcaccttcggttatcatgctcctgagtacgcgatgacagggcagcttagcacgaagagcgatgtctatagcttcggagtcgtgttgctggagcttttaactggtcgcaaaccggtcgatcatacgctgccccgtggccagcagagtcttgtgacatgggctactccaaggctaagtgaagacaaggtgaagcaatgcgtggatccaaggcttgaaggggattatcctcccaaggctgttgccaagatggctgccgtagctgcgctgtgcgtgcagtacgaggcggacttcaggcccaacatgagcatcgtcgtcaaggctctgaacccactcctcaacagccgcccgaacaatcgccccgcctccttcaccgacgccggcgagcgatccggattatgagcacgccatgaccatttttctcatcggactccggtgacaccacgacgacgggagggaaggctcggtttccatggattccaaatgtgtaaaaattcagtggaaatgaagagggtagctctgctgctgcctgtcttgttcttgcctcgatctccagactcctgttgctgtaaattgtcgcaatccctcctgattatgtgttcctctcgacctcttgtagtagtttgagaaatggatgaatatatatacttcttgcttgtcc

SEQ ID NO: 6736 - DNA, 1099 bp, Leymus cinereus x Leymus triticoides
ccgttgctgtcgccgttgctgtcgccttggtttcaagattgaaacatgacaacttcgtagatatattgggatactgtatggagcgtaatcttcgcatagcagcctatgagtttgccaccatggggtctctacatgatgttctacatggaagaaaaggagtacaaggtgcacaacctggtccaccacttaattggatgcagcgaatgaaaattgctgttgatgctgccaaaggacttgaatatctgcatgagaaggtccagccttctattgtacatagagatgttagatccagtaacatcctcttatttgaggacttcaaggccaagattgcagacttcaatctttcaaatcaggctccagatatggctgctcggttgcattctactcgtgtgttgggaaccttcggttatcacgccccagagtatgcaatgactggtcagctgacccagaaaagtgatgtatatagttttggggttgttctcttggaacttctgacaggaagaaagcctgtggaccatacagcgcctcgagggcagcagagcctggttacatgggctacaccaagattaaccgaagacaaggtgaagcagtgcatagatccccggttggagggtgattatccgccgaagggagttgcaaagctcgcggcggtagcagctctgtgtgtgcaatatgaagccgagttccgtccaagcatgagcattgtggtgaaggctttaactcccctgaccatgagcaggcaaactccgcctgcaccaccaccagctctggacagttgatccacagaattaaccaaagaaataagatacctcttaactgaagacggtctggatgaacatagtccgcttgcctcatgctgctgtctcttttaccgaaagctgatgatatgcaagtcaagatatgaagaaattggagccttgtcagatcactttaactaactgaattaagattgtgtgttttggtggaacacagagacgtccttttctgtatgtgtgaaacttgggagttatctgtagcgaacaatatctgcaatattcacattcattgagagtgggttgtagaacttccttgtgggtcgaaatacctttcttaggatcca

SEQ ID NO: 6737 - DNA, 1420 bp, Silene vulgaris
acatttactaacttccatttctccaaattctcgccggaatattttctctctctaccgtcaacaccacccttctccaccggccaacggcggtatctccgccgtcttcttcctattcttcttctcactcttcttcttaaggtcaaagagagagaacatgagttgctttggctgttttggaggaggcgctacccatagacctgcagagaatggaggtggctacatgcccccaaaaccagcaggaagagatggttatcgaacggttgaaagtcagcctagcaagcccccggtgaagatccagcctatagctgtccctgcaatttctgcggacgaactgagggatgttacagagaattatgggtccggtgctttaataggagagggctcttatggcagagtttactatgggacgctaaagaatggacgtgaagcagcaatcaagaaactggatgcaagcaagcaacctgatgatgaatttctagccgaggtttcaatggtttctaggctaaaacacgacaactttgttgaactacttggttactgtgttgatggcagctcacgtgttcttgcttatgagtttgcaccaaaaggatctatccatgatgtccttcatgggagaaagggtgtgaagggagcacagccgggacctgtattgtcatgggctcagcgcgttaaaattgcagtaggtgctgctagagggcttgagtatttgcacgagaaggctgatcctcacatttttcatcgtgatatcaagtctagtaacgtactgctgttcgacgatgatgtagctaagattggtgattttgatttgtccaatcaagctcctgatatggcagcccgacttcattctactcgagttcttggaacttttggctatcatgcaccagagtatgcaatgactgggcagctaaatgctaagagtgatgtatacagttttggcgttgtcttgcttgagttactcactggtcgaaagcccgtagatcatactttgccacgtggccagcaaagtcttgtgacttgggctacacctaagcttagcgaagacaaagtgaagcagtgtgttgatcctaggttaaatggagagtatcctcccaaggctgttgccaagatggcggcagttgctgcattgtgtgtccagtatgaagcagatttccgaccgaacatgagtattgttgtgaaagcacttcagccattgttaaataccccaagaacaggagccagtagtgtcccagctaatcatctgtgatgccttctttcaccctctactcatcatttttccatctcagcttttagtgatggtgcttgtttgcggagagaaaatagaaaagacgctttttcctaaaaaataatgattaaatttataaactttgtgcagggttttggttggataaaagtaatgtgattgtcgattgtatttaatgtt

SEQ ID NO: 6738 - DNA, 1302 bp, Solanum lycopersicum
cagcaatgaaacaaatctcttaattcttccatgtgatcattaattgctcttcttttccctaagatttttggaaattcttttgtgcatcatataaaattcaattacattgttgaaatttatatggattgatatataaaaccaacatttttggaagagatattgaaccttccataattgaacaaaaaaaatgtcttgctgtggaggtagagaagaagacgtttacagcggcggtccgccgtctaaccaaaatacagtacctcctagagctggaaatccctacgctggtgctagtgatagagcagagccaaggggtggtacaagaaatggaactccacagaaagttttacctatcgaaataccggttttacccttggacgaactgaataaactgaccggaaactttggtcagaaggctttgatcggagagggatcatatggacgcgtattttttgctaaattaagcaatggacaggaagcagcaatcaaaaagttggatactagttcttcaccagaaccagattccgactttacagcacagttatcaatggtttcaaggcttaagcatgagcattttgtgaatcttatggggtattgtttagaagcaaacaatagaatcttgatatatgaatttgcagccatgggatctctacatgatgtattacatggtagaaaaggtgtccaaggcgcggagcctggtccagttcttacctggaatcagagagttaaagttgcttttggtgcagcaaaaggcctcgaatacttacatgaaaaaattcagccagctattgttcatcgcgatgtcagatccagcaatgtgcttctctttgatgattttacagctaaggttgctgatttcaacttgacaaaccagacttccgatacagcagctcgtcttcattccactagagttttggggacatttggctatcatgctccagagtatgcaatgacaggacagataacacagaaaagcgatgtctatagttttggagtcgttcttttggaactcctgacgggaagaaagccagtagatcatacaatgcccaaaggacaacagagtcttgtcacttgggcaactccaagattgagtgaagacaaagtgaagcaatgtgtcgatccaaagctaaacaatgactatccagcaaaagcaattgctaagatggcagctgttgcagcactctgtgtacaatatgaggcagattttcgaccaaatatgacgatagtcgtcaaggcactgcaaccacttctcactgcaaaaccagcaggacctgagtctaatacataggcaatacaaaaattata

SEQ ID NO: 6739 - DNA, 1230 bp, Setaria italica
gccgtcacccagtagcacccacgtcgcgaaacaatgcaggccccggcaagccaagagggcccaatgcgccgaggagcggcggcccaccgaaggtcctccccgtcgacgtgccggccatttccatgggcgagctgaacaacatcacgggcaatttcgggcagaaagccctgatcggggaaggctcctacggcaaaatctacaaggccgtgctgatatccggggagctcgtcgccatcaagaagctcgaccccagcgtgtccagcgactccctcgcggacttctccgctcagctgtcgatggtctcgaggctgaagaacgagtacttcctccagctgttgggctactacaggatcctcgtctaccagttcgcctcacacggctcccttcacgacgctctgcacggcaagaagggcgtcaaggacgcggcgccggggccggtgctgagctgggcggagcgggtgaagatcgcgtacggcgcggcgaggggcctcgagtacctgcacgagaaggtgcagccgtccatcgtgcaccgcgacgtgcgctccagcaacgtcctcctcttcgacggctacgactccaagatcgccgacttcaacctcaccagccagccgcccgacggcgccgcgcgtgcactccacgcgcgtcctgggcaccttcggctaccatgctcccgagtacgcgatgacaggagtcttgacgcacaagagcgatgtgtatagctttggagtggttctcctagagctactcaccggcaggaagcccgtggaccacaccatgcccaagggacagcaaagtctagtaacttgggcgacgccgaggctgagcgaggacaaggtgaagcaatgcgtggacccgaagctgggggacgattatcctccaaaggcagtagcgaagatggcggcggtggcggcgttgtgcgtgcagtacgagtccgatttccggccgaacatgaccatcgtggtgaaggcgctgcagcctcttgtcaacaaggcagccgcagccacagctgggggccctagcagtacatgatagatgatacacaaccatctctccagcactactcaaaatctgttctttgtttaacggtcacctgcgtacgcgcatcttcagtggttgcaatgtaacatgtactaactgatcaatctgcaaaggattcaagtgttcatcatcctttgggccaattcagggaattcgtcaattcatcatcctttggacttcagatcaccacca

SEQ ID NO: 6740 - DNA, 1497 bp, Setaria italica
atgatttgctgctgcggtggcgcggaggaggacacgttcgccgcacctgccagccgtcacccagcagcacccacgtcgcgaaacaatgcaggccccggcaagccaagagggcccaatgcgccgaggagcggcggcccaccgaaggtcctccccgtcgacgtgccggccatttccatgggcgagctgaacaacatcacgggcaatttcgggcagaaagccctgatcggggaaggctcctacggcaaaatctacaaggccgtgctgatatccggggagctcgtcgccatcaagaagctcgaccccagcgtgtccagcgactccctcgcggacttctccgctcagctgtcgatggtctcgaggctgaagaacgagtacttcctccagctgttgggctactacctggacgacagccacaggatcctcgtctaccagttcgcctcacacggctcccttcacgacgctctgcacggcaagaagggcgtcaaggacgcggcgccgggaccggtgctgagctgggcggagcgggtgaagatcgcgtacggcgcggcgaggggcctcgagtacctgcacgagaaagtgcagccgtccatcgtgcaccgcgacgtgcgctccagcaacgtcctcctcttcgacggctacgactccaagatcgccgacttcaacctcaccagccagccgcccgacggcgccgcgcgcctgcactccacgcgcgtcctgggcaccttcggctaccatgctcccgagtacgcgatgacaggagtcttgacgcacaagagcgatgtgtatagcttcggagtggttctcctagagctactcaccggcaggaagcccgtggaccacaccatgcccaagggacagcaaagtctagtaacttgggcgacgccgaggctgagcgaggacaaggtgaagcaatgcgtggacccgaagctgggggacgattatcctccaaaggcagtagcgaagatggcggcggtggcggcgttgtgcgtgcagtacgagtccgatttccggccgaacatgaccatcgtggtgaaggcgctgcagcctcttgtcaacaaggcagccgcagccacagctgggggccctagcagtacatgatagatgatacacaaccatctctccagcactactcaaaatctgttctttgtttaacggtcacctgcgtacgcgcatcttcagtggttgcaatgtaacatgtactaactgatcaatctgcaaaggattcaagtgttcatcatcctttgggccaattcagggaattcgtcaattcatagtttggacttcagatcaccaccagagttttccttgtctcctttccgttgggcgttggtacgaaagggatttgtttgccctggcctacaggcccgcccacgtacaggcagggtactgctgcactgcttgttcttatcctgacaccacaccagagatcgagttggacaacaaccactattactgcagatcgagttgagacgtcagaagacatcatttttttttcaa

SEQ ID NO: 6741 - DNA, 1727 bp, Zea mays
gcgcgaccgatacggcagttaaaaagggtgggacgccacctttcccgcggaaagaggagctcccaccgctaatccatcgtcctcgtccctccctacccgcggccggccacccacgccgttgctgctgttctggcgcgccctccacctcttcgtctctcgtaggtgccgtcgtcggagcttgcttttggggaggtcgtgcggcatgatctgctgaccgccccaaatcaacccggccgcgcatcgaccgtcgtcatccagtccgacgaggaggaggaggaggagagggagaggggggagccacaaaactaagatgtcttgctgcggtggcgccgaggaggacagctacggcccgccggccaaccaggcggttccaccacccaatgccaacgcccccggcaacagaggcgggccgagaggaccgggggcgccgagggtcggcggccccgccaagcccgtcagcattgacgtgcccgccatacccttcgacgagctcaaaaggatcaccaacaacttcagcgaccgcgccctcatcggcgagggctcctacggccgcgtctacaacgccacgctcagcgacggccgcgccgccgtcatcaagaagctcgacaccagcgcctcgcaggactccgacaccgacttcgccgcgcagatcgcgatggtctccaagctgaagaacgagtatttcctggagctcctagggtactgcttggaagacggcaaccgaatgctaacctatcagttcgccacaatgggttctttgcacaacatactacacgggaagaagggagtccagggcgcggagcccggtcccgtcctcaactgggctcagcgagtcaagatagcctacggggcagcgagagggctggagtacctgcacgagaaggtccagccgtccatcgtccaccgggacatccgctccagcaacgtcctcatcttcgacgacttcagctccaagatcgccgatttcaacctcaccagccagggcaccgacaccgccgcgcggttgcactccactcgcgtgctagggactttcggataccacgccccagaatacgctatgacaggccagatcaaccaaaagagcgacgtctacagcttcggcgtgattcttctagagttgctgaccggaaggaagccggtcgaccacacaatgccgaaaggccagcagagtcttgttacttgggccactccgaggttgagtgaagacaaagtgaagcagtgtgttgatccaaagctcgacagtgactaccctccgaaggccgttgcgaagctggcagcagttgcggcgttgtgcgttcagtacgaatccgacttccggccaaacatgactatcgtggtgaaggcgatcacgcctcttctgaacgcgcccaaaccggcagctccagccgcgccacagtcctgatcaacccagacgacagaattagcctggacctggacacggttcccctgatctgttcctcattgcagatgtatgctaaggaaccacgcatccttgctccatccatccattgcatacaggggaattttgtaaaatgttaatccggtactctgaattcgtgtgcttttccttgtttgtttgcctggcttgttgtgagtttgtgatataacatgtgcagctttagaaagtacacatatgctgtttccagctagaaaaattacgcgagacctccaaaacctttttagttcacatgaagtgatactgaacaagagcttgcagattgagtgct

SEQ ID NO: 6742 - DNA, 1819 bp, Zea mays
gcgcgctccccgcctcttcttctcttctaggtgccgtcggagcttgcttttggggaggtcgtgcggcatgatctgctgaccgaccccaaatcaacccggccgcgccgcgcatcgatcgtcgtcatccagtccggcgaaggtggagaggaaccgagaaattaaagatgtcttgctgcggtggcgccgaggaggacagctacggcccgccggccaaccaggcggtcccaccacccaacgccaacgcccccggtaacagaggcggtccgagggggccgggcgcgcccagggtcggcggccccgcaaagcccatcagcatcgacgcgccctccatacccttggacgagctaaagaagatcaccaacaacttcagcgagcgcgccctcatcggcgagggctcctacggccgcgtctacaacgccacgctcggcgacggccgcgccgccgtcatcaagaagctcgacaccagcgcctcgcaggactccgacaccgacttctccgcgcagatagccatggtctccaagctcaagaacgagtatttcctggagctcctggggtactgcttggaggacggcaaccggatggtagcctaccagttcgccacgatgggttccttgcataacatactacacgggaagaaaggagtccagggcgcggagcccggccccgtcctcaactgggctcagcgcgtgaagatagcctacggagccgcgagaggtctggagtacctgcacgagaaggtgcagccgtcgatcgtccaccgggacatccgctccagcaacgtcctcatcttcgacgatttcagctccaagatcgccgacttcaacctcaccaaccagggcaccgacacagccgcgcgcttgcactctactcgtgtgctggggacctttgggtaccatgctccagaatacgccatgacaggccagatcaaccagaagagcgacgtctacagtttcggtgtgatccttctggagctactcaccgggcggaagccagtcgaccacaccatgccgaaaggccagcaaagccttgttacctgggccactccaaggttgagcgaagacaaagtgaagcagtgtgtcgatccgaagctcaacagcgactaccctccaaaggcggttgcaaagctggcggcggttgcagcgctgtgcgttcagtacgagtccgacttccggccaaacatgaccatcgtggtgaaggcgatcacgcctctcctgaacgcacctaaaccggctgctccggccgcgccgcaatcctgatcaaccaaccagccagatgacagaatttagccaacaccgcggtttccctctgtttctgatcatagatatgtgtttcaaggaaccgcgcatccttgctccatccatccagcgcttatgcttctgtaaaggaaaaaacaacactgatctgctggtgctgcaggacacatataggggaatttttaaaaatgttaatctgctactctgaattcgtgtgcttcttgctgtaagtttgtgttataccatgtgcagttttagagagtacacatgcagtttctagctacaaaagtaggcacgacgatggtttccagcttttccaaatataaaacaaattcacagccacagctacaggagtgcatcagatcaagatagtattggctctttttcaccatatataattgctggtaccaattacaaaaaggagcaaactctgatgactccaaagtttgcttacgcttaaaccaaaactttggtgagcaactggaaaaactactacatagaatggacatgcaaaactttcaccggttgtttgcattatgaccactagggaggcattgcacatgtgt

SEQ ID NO: 6743 - DNA, 1897 bp, Oryza sativa
gggtgtggctcctttggcgcggaaagagggggagctcccgccattccccaccattaacctcttctcccggggaacaaaacaccgctgttcttccctttgccccccctcgatcgatcgccatcgatcgatctcgtgcgggaagcgatcgatctcgtgcgggaatctttgggggagggatttaatctgttggtgtgcacgcgaggaattaatcgaaaatggtttgcaggtcgtgcgcgatgatccgctgagcggggggcggccaccagatcagcccgcgcatccaactccggcgagaggaggaggaggaagaagaagatgtcttgctgcggaggcgccgaggaggacagctacggcccgccggcgaaccaggccgctccgccgcccaacgtcaatgctcccgggaatagaggcgggccgagagggccgggggcggcgcggccgggcgggccgccgaagccggtgaacatcgacgtgccggcgataccgttcgaggagctgaagaagatcaccagcaacttcagcgaccgcgccctcatcggcgagggctcctacggccgcgtctacaacggcacgctcagcgacggccgcgccgccgtcatcaagaagctcgaccccggcgcctcccaggagaccgactccgagttctccgcccagatagcgatggtgtccaagctcaagaacgagtacttcctggagctcttgggctactgcttggaagacggcaaccgcatgctggcctaccagtttgcaaccatgggttctttacacaacattcttcacggtaagaagggagtccagggcgcggagcccggcccggttctgaactgggcgcaacgggtcaagatagcttatggggcggcgagagggctggagtacctccatgagaaagtgcagccatcgatcgttcatcgagatgttcggtctagcaatgttcttatattcgacgagttcagctcgaagatcgccgatttcaacctgacgaaccagggcaccgacaccgctgcccggttgcattcgactagggtgctaggaacatttggataccatgctccagaatatgccatgacagggcaaataaatcagaagagcgatgtttacagctttggcgtgattctattggagctactaaccggaaggaaaccagttgatcacaccatgccaaaagggcaacaaagtcttgtcacttgggctactccaagattgagcgaagataaagttaagcagtgcgtcgatccaaagctcaacaatgattaccctccgaaggctgtcgcaaagctagcagcagttgcagcattgtgcgttcagtacgaagccgacttccgaccgaacatgacgatcgtcgtgaaggcaatccagcctcttctgaatacaaaaccagctgggcctgcagagccaccacctgcctgatcagattgtatgggagttctgctctaggcagacaggggaaaaaaaaccacacaaactttgcatggtttcctgtgttttcacatcaggcagtgtatgttttaagaagccatgcaacttggaggagcaccaattcggcatgattttttgtaaaacactgatccattggtaccacagggtatattacatatagagggggtattttgctaactggtgtaatgaattaagttattctttgtcgtgtcatggtgtaattttaaggtccttcaaaagcttgcatagaaccaaggattgcatgatgcattcccaagaacttccatggctgcctctttttcttatatttgtatagaactttggaattaatagtagtttttcttcttctttttttctgttggaactacaaagctggggctaaaatcctgttcctgaattcaggttttggccaggatggagattaaatggtgcacattgcatagatgtacacctaagatgc

SEQ ID NO: 6744 - DNA, 1101 bp, Glycine max
ttatgttgtgctgcggaggtgcagaggaggagagcagcgggcccccggcaaaccaatacccaactgcaccacctagagggggtagcacatacggaggaggtaatgatagaggagagcctaggggaaatgttgcgaagagtggtgccccgcagaaagtattgccgattgagataccctctatgccattggatgaattaaacaggttaacaggaaactttggtacaaaggcttttattggcgaaggttcttatggacgagtttactatgcaaaattgagtgatggtactgatgctgcaattaagaagctggataccagttcttccgcagaacctgactcagattttgcggctcagttatcgattgtttcaagactgaagcatgacaattttgtggagttgattggatattgtctagaggcagataacagacttttggtttatcaatatgcaagtcttggttctttgcatgatgtgttacatggaaggaagggtgtacaaggggctgaacctggtccagtattaagttggagccagagagcaaaaattgcatttggtgcagctaaaggtctagagtttcttcacgaaaaggttcagccttctattgttcatcgcgatgttagatctagcaatgtcttactgttcaacgactatgaggccaagatagctgatttcagcttaacaaatcagtcttctgacacagccgccaggctacattcaacaagagtcttgggaacatttggctatcatgccccagagtatgccatgacagggcagataacccagaaaagtgatgtttacagttttggggttgtgcttttagaactcttgacaggaagaaagccagtagatcacacaatgcccaaaggacaacaaagtcttgtaacttgggcaactccaaggcttagtgaggacaaagtgaaacaatgtgtggatcctaagctaaacaatgactatcctccaaaggctattgctaagttgggtgctgtggcagcactttgtgttcagtatgaagctgacttcagaccaaacatgaccattgttgtcaaagctctccagccacttctcaatgcaaaaccagctggtcccgactctcatgcttgac

SEQ ID NO: 6745 - DNA, 1317 bp, Nicotiana tabacum
cttggaaatctgctgtgtaacatataaaattttactcggaagcattatatggattgataaaatcagcattttgggaagagagattgtgccttccataattgaacgacaatgtcgtgctgtggaggtggagaagaagacgtatacagcggtggtccgccgtctaaccaaaatacagcccctcctagagccggcaatccctacggtggtgccagtgatagaggagaaccagggggtggtgcaaaaactggaactccgcagaaagttttaccaattgagatacccgttgtgtcattggatgagctaaataaattgactggtaattttggtcaaaaagctttgattggagaaggatcttatggacgcgtattttttgctaaattaagcgatggccaacaagcagcaattaaaaagttggatactagttcttcatcagaaccagattctgactttacagcccagttatcaatggtttcagcacttaagcatgagcattttgtgacacttatggggtattgtctagaagcaaacaatcgaatcttggtatacgagtttgcagctatgggctctctacatgatgttttacatggtagaaaaggtgtacaaggtgctgagcctggtccagttcttacctggaatgagagagttaaaattgcttatggggcagcaaaaggcctcgagtacttacacgaaaaagttcagccacctattgttcatcgtgatgtcagatccagcaatgtacttctctttgatgattttacagcaaaaattgctgatttcaacttgacaaaccagtcttccgatacagcagctcgtctgcattccactagagttttggggacatttggctaccatgctccagagtatgccatgacaggacagattacacagaaaagtgatgtctatagttttggagttgttctcttagaactcttgacaggaaggaagccagtagatcatacaatgcccaaaggacaacagagtcttgttacatgggcaactccaagattgagtgaagacaaagtgaagcagtgtgttgatcccaagctaaataatgactatcctgcaaaagcaattgctaagatggctgctgttgcagcactttgtgttcaatatgaggcagattttcggccaaatatgacgatagtcgttaaggcattgcaaccacttctcaatgcaaaaccagcaggaccagagtctaatacataggcactgtctgcttaaaatcagcagaactaatacatctgtctcaacaaatctatgacaaactatgcatgattgatgtttcttgaacttctgaaagaagggaatttcttgagc

SEQ ID NO: 6746 - DNA, 1237 bp, Eutrema halophilum
cagtttagttatctcttgtgagagaagactgtaatgagctgttttggttggtgtgggagtgatgattttcgtaaagctgctgactccgggccaatgccagcgcacaacccagcaggttacaatggaggccactatcaaagagctgctcccctcatgaaccagccagtaattcagatgcagcctgtttctgtaccagccattccagcggatgaactgagagatataaccgataactatggttcaaaggccttgatcggtgagggttcatatggaagagtgttttacggtgttcttaaaagcggtagtgtagctgccatcaagaaacttgactctagtaagcagcctgatcaagaatttctttcccaggtctcaatggtttcgagattgcgacacgacaatgttattgcacttattgggtactgtgttgatggtcctctccgtgttcttgcttatgaatatgctcctaacggatctcttcatgatattcttcatggtcgaaaaggtgtcaaaggagcattgcgaggtcctgttatgacgtggcaacagagagtcaaaatcgctgttggtgcagccagaggacttgagtacttgcatgagaaggtgaaccctcaggttatccaccgagacatcaaatccagcaacgtacttctgtttgatgatgatgttgccaagattgctgatttcgatctttctgatcaagcccctgacatggctgcgcgccttcactcaactcgtgtgctaggaacctttggctatcacgctccagaatatgcaatgacaggaacattgagcacaaagagcgatgtgtacagttttggtgttgttctgctggagctcctgacgggtcgtaaaccagtcgatcctaccttaccacgtggacaacaaagtctggtgacatgggcgacccctaaactaagtgaagacaaagtgaagcaatgcattgacgcaagactactcggagaataccctcccaaagctgttgccaagctagccgcggtggctgcactctgtgtacaatatgaggcaaattttagaccaaacatgagcattgtggtgaaggcacttcaacctcttctaaaccctcctcgctctgctccacagactccacataggaacccttattgaccaaatatctaaatcaaattctcatcttcttcatgatgatgattcaattgtgtattcgttttttttttctgtttgtatgtgtgtaaatttctatgtactctcattaactctt

SEQ ID NO: 6747 - DNA, 1378 bp, Eutrema parvulum
tttaattcgtgtgtgatgggctgttttggttggtgtgggactgatgattttcgtaaaactgctgatactggaccaatgccagcccacaacccagcaggttacagtggaagccactatctaagaaatgatccacccatgaatcagccagtagttgcgatgcagcctattgctgtaccagccattccagtggatgaattgagagatataactgataactatggtcccaaggccttgatcggtgagggttcatatggaagggttttttatggtgttcttaaaagcggcaggatatctgccatcaagaaactcgactctagtaagcagccagatcaagaatttctttcccagatatcaagggtttcgagattgcaacacgagaatgttattgcacttgtgggttattgcgttgatggccctctccgagttcttgcttatgaatatgctcctaacggatctgttcatgatattcttcatggccgaaaaggtgtcaaaggagcactgcgaggtcctcttatgacgtggcaacagagagtcaaaatcgctgttggtgcagccagaggacttgagtacttgcatgagaaggtgagccctccggttatccaccgagacatcaaatcctgcaacatacttctgtttgatgatgatgttgccaagattgctgatttcgatctctctgatcaagcccctgacatggctgcgcgccttcactcaactcgtgtgctaggaacgtttggctatcacgctccagagtatgcaatgacgggaacattgagcacaaagagcgatgtgtacagttttggcgttgttctgctggagctccttacaggtcgtaaaccagttgatcataccttacctcgtggacaacaaagtgtagttacatgggcaacccctaaactgagcgaagacaaggtgaagcaatgcgttgatgcaagactactcggagagtaccctccaaaagctgttgccaagctagctgcagtggctgcactatgcgtgcaatttgaggcaaattttagaccaaacatgagcatcgtggtgaaggcacttcaacctcttctaaaccctcctcgctcggctccacagactccacataggaacccttattgatcaaaagatccaaatcacatctcagctgctacttgatgactaatcaaatgtgtgttattcattttgtttttgtaattgtgtaaatttctggttcttaattcctatatgccttatttcataaactcttcattcaagtcccacttttgaagagctatgtatgtgttctatatttttctgtcttctgtgatgtagtttgcgagtgggaagacaaagaacctaattttctttgtttattgttaacttgtttttcacaaatcttactattaaattt

SEQ ID NO: 6748 - DNA, 1499 bp, Cirsium arvense
ccgcgaatgccggatggcaccagaggattctccatgggccgggaaaggcggtcgccgttctttgctgatagtagcgtatcgtgataacgtaatctaagaaaagcaggagcagtggtggtgagtatgggagagatgggttggttggttccaatagtcttgttctaaccttacgcgcttttctctttctctcatccggtgcactttagccgtcttctatctcttcccccaattaatcatctttctttcttttatattttttccattaatcaatcaattactcatcttgattccagccaaactacacaagatcctaagaggtgtgagtagaggaaagcgattatgagctgcttcaattgctgcggagaagatgacatgcataagtcttatgataacggaccattcatggcaaataatgcagcagggcataatgcaggttatcgtgccacagaggctgcaccaaaggacacacaggctgtagctatccaacctattgctgtccctgctcttcaagtggatgagttaaaagaaatcacagataactttggtacaaagtctttgatcggtgagggatcatatggacgagtttaccatggtgtcttgcgaagtggccaagcagccgctatcaaaaagctcgactccagtaagcaaccagaccaagaatttctggcacaggtttctatggtatcgaggcttaaacatgataatgtcgttgggctactcgggtattgtgttgatggtggtctaagagtgctggcttatgaatatgcatcaaatgggtctcttcatgatattctgcatggaagaaaaggcgttaaaggtgcacagcctggtccagttctctcatggtctcaaagagttaagatagctgttggggctgcgaaaggacttgaatacctgcatgaaaaggcacagcctcatattatccatcgtgatataaagtccagtaatgttctgctttttgatgatgatgtcgctaagattgctgattttgacttatcaaatcaagcacctgacatggcagcacgccttcattccacccgtgttcttggcacctttggttatcatgcccctgaatatgccatgactggacaactgagttcaaagagcgatgtttacagctttggagtggttcttctagaactgttgacaggccgaaagcctgttgaccacactttgcctcgtggtcaacagagtctagtcacatgggcaacgccaaaactgagtgaagataaggtgaaacagtgtgttgatactaggctgaatgcggaatacccccccaaggcagttgccaagatggcggcggttgcagccttgtgtgtgcaatatgaagcagatttcaggccaaacatgagcattgtggttaaagcactgcagccgttgttgaatgctcgacctgggccccaaaccgaagcaccacatttgtgaatttccccaatctcttaaggaatctcaatctactgccactgcttaaccatgttattgtttagcagatattattt

SEQ ID NO: 6749 - DNA, 2037 bp, Citrus clementina
acaactgaaaattatttttaaacattaaaccaaggccattttaataattccattccgggaccgagacagcaacccgaagtcaaaaagcgctttatacgtttttcttcatcctgcgcacctatcgtcgtcttatcctgcgcacctcacgccggctccagagtgattcattcaaaatatccagctcgttgcttttctctatatctcagctagctttcatagaggggcattattgtggcagtgaatcatgagctgcttcggctgttgtgaagaagatgatatgcataaagctgctgacaatggcaatgcatacatggttaaaagttcagcaggaactgatggagcctatcatgcatctgaagcagcacctaagggtgctcaagctgtgaaagtccagcccattgaagtcccagcaatttcagtggatgaattgaaggaaattactgagaactttgggactaatgctttgattggagaaggttcatatggaagagtatattatgggattcttaaaagtggacatgctgcagcaataaaaaagttggatgccagcaagcaacctgatgaggagtttttagcacaggtttccatggtatcaaggttgaagcatgaaaactttgttcagctgctcgggtattgtgttgatgggacttcccgtgtgcttgcctacgagtttgcatctaatggatctcttcatgatattcttcatgggaggaaaggtgtaaaaggagctcagcctggtcctgttttgtcatggcaacagcgagtgaaaattgctgtaggggctgcgaaagggcttgaatacttgcatgagaaggcagatcctcatattatccatcgcgatattaagtccagcaatgtactaatttttgatgatgatgtagcaaagattgccgactttgatttatctaatcaagctcctgatatggcagctcgccttcattctactcgtgttcttggaacttttggttatcatgctcctgagtatgcaatgactggacagttgaatgcaaagagtgatgtatacagctttggtgttgttctgcttgagcttctgacaggtcgaaaacctgtcgatcatacactaccacgtggacagcagagtctagtgacatgggccacaccgaaacttagtgaagataaggttaggcaatgcgttgatgcaagactaggaggagattatcctcccaaggcagttgcaaagatggctgcagttgctgctctgtgtgttcagtatgaagctgatttccgtccaaatatgagcattgttgtcaaagccctccagcccctgctaaatgcacggcctggacctgctggtgaatcagcaagctagtcaagctagtgactctctctctcccccatttgtgtgtgggcaagtatgcgcacacatgcaggcttgcaaactattaaaaaagaaaaagaaaaaaagagattgtttagtagcactggtagattatctgagcaaggttcgaaatccttccattatacactgtaattttttttgtggttggttttgttcatagtatgtgagattgtttctttcttacagctggctgccttagcgtttcccctaatgcttattgttggcttcaaattctgtcctttaccttgaccttcatgcctgcaatggtcggcatcttaacttcaatttattcttcatttttaaatcctatccaggtggtcgcctgagtataaaatttaatactgatactaactgggcagggaaatccctgctgatagtgctctatgaatcagtacgcagtcccatttaaggatcttagaaagagtgaagctatcaagaataaatgaatggtagacatttttcattgtttccttttacccaaattctctatgaatccaccagcacatgtaaagaaagttatcttgtaggtgtccaataatatcaatgctaacaagtaataactgcagaaggtggaataaattttttatcctggtttaaatgcagatacaaatttaaatatgtttccttcctcgagaatgtctctctcatcttggttgaaatcggcaatctacttcccc

SEQ ID NO: 6750 - DNA, 1098 bp, Citrus clementina
ctatgttgtgctgcggaggtcaagaagaggagcctcagccacctgctagccaaacaacagccccacctcgaagcggaaacacacaacctggaggcagtgctagaggggagccgagaactaatgtggtcaaaacaggaacccctcagaaagcattgccaattgaaatcccacaaattaaattggacgagttgaatagattaacaagcaattttggtacaaaagctttgatcggagaaggatcatatggtcgtgtattttatgcaaagctaactgatggcacccctgctgctatcaagaagcttgacaccagttctgctccagagcctgaatcagattttgcagcacagttgtcagtagtttcaagactaaagcatgaacattttgttgagctattgggctactgcttggaatcaaataacaggattttggtttatcaatttgcaacaatgggatcattacatgatgtgttacatgggagaaaaggtgtacaaggggccgagccaggtccagttctaacatggaatcagagagttaaagttgcatatggcgcggcaaaaggccttgaatttctacatgaaaaagttcaacctcccatagttcatcgcgatgtcagatcgagcaatgtgttactttttgatgattttaagtctaaaattgctgatttcaacttgacaaatcagtcttccgatacagcagctcgtttgcattcgactagagtcctgggaacatttggttaccatgccccagagtatgcaatgacagggcaaatcacccagaaaagtgatgtttacagttttggtgttgtgcttttagagctattaacaggacgaaagccggtagatcatacaatgcctaaagggcaacaaagtcttgttacttgggccaccccaagactaagtgaagacaaagtgaaacaatgtgtggatccaaagctaaacaatgattacccaccaaaggcaatcgctaagctagcagcagttgcagcattgtgtgttcaatacgaagccgattttcggccaaacatgaccattgttgtaaaagctcttcagccactactcaactcaaaaccagcaggaccagaagctcaagcataactta

SEQ ID NO: 6751 - DNA, 1627 bp, Eucalyptus grandis
ggaaaagaaatcgaccaacggcggaaccgtccaaagcttgtaataattccacccgagaggtgtgtgggacaagtcaacaccacttttgctcccaataggcgctatcctgcgcacgcccccgcttttttttgcgcacccttcgccggcttccgacttcacttcttcagatctcccctctctactccagtggtctcccgagcggcctccttcgtttctcttgcgcttgcgatttccggggtcgaattccaggggaggtccatttggtgagtgaagaaagccatgagctgctttagctgttgtgaagatgatgatattcataaagctccagatagtggaggcatgtacccgatgaagagctcaacaggaaatgatggggcatatcatgcctctgaatctgcaccaaaaggtgcacaagcggtaaaagttcagcccattgaagtccctgctattccagtggatgaacttaaggaaatcactgataactttgggacaactgctttgattggggagggatcatatggcagagtgtactatggggttctaaagagtgggcaggctgcagctattaagaagttggatgcaagcaagcaacctgatgatgaatttttagcccaggtttccatggtgtcgagattgaaagatgaaaattttgttgaattgcttggttattgtgttgatggaagttcccgagttctcgcttacgagtttgcatctaatggttcgctccatgatattctccatggtagaaaaggagttaaaggggcacagcctggtcctgttctttcttgggcacagcgggtaaagattgcagtaggggctgctaaaggacttgagtatctgcatgaaaaagcagaacctagagtaattcatcgtgatattaagtccagcaacgtcttaatatttgatgatgatgttgcaaagatagctgattttgatttgtccaaccaagctcctgatatggcagcccgtctccattcaactcgtgttcttggcaccttcggttatcatgctcctgaatatgcaatgactggacagctaaatgccaagagtgacgtatatagttttggtgttgttctgctggagcttctgactgggcggaaacctgtggatcatacgttaccacgggggcagcagagtcttgttacatgggctacacctaagctgagtgaagacaaagttaggcagtgtgtagatgcaagacttggaggagaataccctgcgaaggcagtcgcaaagctggctgctgtcgccgccttatgcgtgcagtatgaggctgattttaggccaaacatgagcattgttgtgaaggcattacagcctcttttgaatgcacggccaggaccagcgggggaggcacgaaccttgtaattttctctccgtctctctgtgtgagcgtgcatggaaaaatgtaacgaacggatttgtagatggtgttcctatatgggttttttgtgaatttgtgtatggatccctcattgggaacattctatttattaatagtgtgaggatatgacaaatgttctcttcgtaataatctgcctttctcttgttggcggatcctatttcctccgttttacggataattaacaaaaaaaaacaaaaaacaaaaaaagacttaaatttaatt

SEQ ID NO: 6752 - DNA, 1092 bp, Eucalyptus grandis
atgttgtgctgcggaggatccgaggaggaaaactacggccctcctgcaagtcaatacacagccccgcccagaggaggcgacccatacggaaatgcgagaggagagccaaaaccttctaatgtggctaggggtggagctccacaaaaggtcttgcccatcgaggtgcctgctttgtcgctgggtgagttgaatcggacgaccggcaactttggttccaaggctttggttggcgaaggctcctatggccgggttttcctagccaagttaagcaatggtcaacgggcagctgtaaagaaattagacaccagctcatctgaggaaccagactccgaattcgaggctcagctttccatggtttcaagactcaagcatgagaatttcacagagttgatcggatactgcttggaggctaataaccgcatcttggtgtatcagtttgccactcagggctctttacatgatatactacacggtaggaaaggcgtgcaaaatgctgaaccgggtcctgtgcttagttggaaccagagagtgaaaattgcctacggtgcagcaagaggccttgagtacctgcacgagaaagttcagcctccaatagtccatcgagatatcagatctagcaacgtgcttctgtttgacgatttcctggcgaagattgcggatttcaacttgtcaaaccagtcgtctgataccgcagcgcggctgcattcaactagggtcttgggaacttttggctaccatgctccagagtacgccatgacagggcagatcacccagaaaagcgatgtctacagtttcggggtggtccttctggagctcttgacggggaggaagcctgtggatcacacaatgcccaaaggacagcagagtcttgtcacttgggcgactccgagattgagcgaagacaaagtgaaacagtgtgttgatccgaaactaaacaacgactacccacccaaggcaattgccaagctagcagcagttgcagctttgtgtgtccagtacgaggcagatttccgaccaaacatgacgatcgttgtgaaggctcttcaaccactcctaaattcgaaacctgcaggtcctgactctcaagcgtag

SEQ ID NO: 6753 - DNA, 1741 bp, Euonymus alatus
atcaataaagaaataagaaacacattattgacgggtaaatggcagaagaaaaatccttttcctgtaataataattcatccactctcgcccaactgagtcaagtatctcgacagtctcgtctctcacacgcttaatcccacgcaatctccagcgcttcacctctgccgccttcagagtattggatcccaacctcatacacgagcgaagatcacactctctgagtttcagctttttgctgcggttcgagtcttgatctatctgatttcatagtttcattcagaaaagggcatttctgaagggtgatcatgggctgcttcagctgttgtgcagatgatgatatgcacaaaacttctgacaatggagggcaatacatgttcaaaaattcagcaggaaatgatggaggttatcatacttcggaaactgcatcaaagggtgctcaagctgtgaaaattcagcctattgaagtaccagcactaccagtggatgaactgagggaagttacagacaatttcgggacaaatgctttgattggagagggctcatatgggagagtatattatggggttcttaaaagtgggcaggctgcagcaatcaaaaagctagatgctagcaaacagcccgatgatgaatttttggcccaggtatccatggtatctaggctgaagcatgaaaattttgttcagttgcttggatactctgttgaagggggttctcgtgtacttgcctatgaatttgcatctaatggatctcttcatgatattcttcatggaaggaaaggcgttaaaggtgcacaacctggtcctgtcttgtcgtgggcgcagcgagtgaaaattgctgtaggagctgcaaaagggctggattacttgcatgagaaggctgatcctcgtgttgtccatcgtgacattaagtctagcaatgttttaatttttgatgatgatgttgcaaagattgcagattttgatttgtcaaaccaagcacctgatatggctgcacgtcttcattccactcgtgtcttgggaacatttggttatcatgctcctgaatatgcgatgactggacagttgaatgccaagagtgatgtatacagctttggtgttgtcctgcttgagcttctcactggcagaaaacctgttgatcatacattaccacgtggccagcagagtctagttacatgggcgacaccaaagcttagtgaagacaaagttagacagtgtgtcgatgcaagactaaatggtgaataccctcccaaggcagttgctaagatggctgctgttgctgccttgtgtgtgcaatatgaagctgatttccggccaaacatgagcattgtagtcaaagctctccagcccctgttaaacgctcgcccaggacctactggtgaaacggcaagttcgtgatccgcttccccttctttccctttccactccgtctctcgtctgtctgtgcggatgcaaagttcataggcgttcaaaatgtaacaaagtactggtttatatggtggtggtaaattgtttgcttgagtctcttctctcatttatattttttacttacatttgtttataatgcgtgaagctgtttcctcctcccaaattctttaatagcattctatgtcaccagttcattcttgtgcttccattcatttggattcgatgaatgtcataatgtaactggcgcacagtttcttatttactaggctccttggactgaaaaagaacaggtaatatggggttctacttttgagttc

SEQ ID NO: 6754 - DNA, 2037 bp, Citrus sinensis
acaactgaaaattatttttaaacagtaaaccaaggccattttaataattccattccgggaccgagacagcaacccgaagtcaaaaagcgctttatacgtttttcttcatcctgcgcacctatcgtcgtcttatcctgcgcacctcacgccggctccagagtgattcattcaaaatatccagctcgttgcttttctctatatctcagctagctttcatagaggggcattattgtggcagtgaatcatgagctgcttcggctgttgtgaagaagatgatatgcataaagctgctgacaatggcaatgcatacatggttaaaagttcagcaggaactgatggagcctatcatgcatctgaagcagcacctaagggtgctcaagctgtgaaagtccagcccattgaagtcccagcaatttcagtggatgaattgaaggaaattactgagaactttgggactaatgctttgattggagaaggttcatatggaagagtatattatgggattcttaaaagtggacatgctgcagcaataaaaaagttggatgccagcaagcaacctgatgaggagtttttagcacaggtttccatggtatcaaggttgaagcatgaaaactttgttcagctgctcgggtattgtgttgatgggacttcccgtgtgcttgcctacgagtttgcatctaatggatctcttcatgatattcttcatgggaggaaaggtgtaaaaggagctcagcctggtcctgttttgtcatggcaacagcgagtgaaaattgctgtaggggctgcgaaagggcttgaatacttgcatgagaaggcagatcctcatattatccatcgcgatattaagtccagcaatgtactaatttttgatgatgatgtagcaaagattgccgactttgatttatctaatcaagctcctgatatggcagctcgccttcattctactcgtgttcttggaacttttggttatcatgctcctgagtatgcaatgactggacagttgaatgcaaagagtgatgtatacagctttggtgttgttctgcttgagcttctgacaggtcgaaaacctgtcgatcatacactaccacgtggacagcagagtctagtgacatgggccacaccgaaacttagtgaagataaggttaggcaatgcgttgatgcaagactaggaggagattatcctcccaaggcagttgcaaagatggctgcagttgctgctctgtgtgttcagtatgaagctgatttccgtccaaatatgagcattgttgtcaaagccctccagcccctgctaaatgcacggcctggacctgctggtgaatcagcaagctagtcaagctagtgactctctctctcccccatttgtgtgtgggcaagtatgcgcacacatgcaggcttgcaaactattaaaaaagaaaaagaaaaaaagagattgtttagtagcactggtagattatctgagcaaggttcgaaatccttccattatacactgtaattttttttgtggttggttttgttcatagtatgtgagattgtttctttcttacagctggctgccttagcgtttcccctaatgcttattgttggcttcaaattctgtcctttaccttgaccttcatgcctgcaatggtcggcatcttaacttcaatttattcttcatttttaaatcctatccaggtggtcgcctgagtataaaatttaatactgatactaactgggcagggaaatccctgctgatagtgctctatgaatcagtacgcagtcccatttaaggatcttagaaagagtgaagctatcaagaataaatgaatggtagacatttttcattgtttccttttacccaaattctctatgaatccaccagcacatgtaaagaaagttatcttgtaggtgtccaataatatcaatgctaacaagtaataactgcagaaggtggaataaattttttatcctggtttaaatgcagatacaaatttaaatatgtttccttcctcgagaatgtctctctcatcttggttgaaatcggcaatctacttcccc

SEQ ID NO: 6755 - DNA, 1098 bp, Citrus sinensis
ctatgttgtgctgcggaggtcaagaagaggagcctcagccacctgctagccaaacaactgccccacctcgaagcggaaacacacaacctggaggcagtgctagaggggagccgagaactaatgtggtcaaaacaggaacccctcagaaagcattgccaattgaaatcccacaaattaaattggacgagttgaatagattaacaagcaattttggtacaaaagctttgatcggagaaggatcatatggtcgtgtattttatgcaaagctaactgatggcacccctgctgctatcaagaagcttgacaccagttctgctccagagcctgaatcagattttgcagcacagttgtcagtagtttcaagactaaagcatgaacattttgttgagctattgggctactgcatggaatcaaataacaggattttggtttatcaatttgcaacaatgggatcattacatgatgtgttacatgggaggaaaggtgtacaaggggccgagccaggtccagttctaacatggaatcagagagttaaagttgcatatggcgcggcaaaaggccttgaatttctacatgaaaaagttcaacctcctatagttcatcgcgatgtcagatctagcaatgtgttactttttgatgattttaagtctaaaattgctgatttcaacttgacaaatcagtcttccgatacagcagctcgtttgcattcgactagagtcctgggaacatttggttaccatgccccagagtatgcaatgacagggcaaatcacccagaaaagtgatgtttacagttttggtgttgtgcttttagagctattaacaggacgaaagccggtagatcatacaatgcctaaagggcaacaaagtcttgttacttgggccaccccaagactaagtgaagacaaagtgaaacaatgtgtggatccaaagctaaacaatgattacccaccaaaggcaatcgctaagctagcagcagttgcagcattgtgtgttcaatacgaagccgattttcggccaaacatgaccattgttgtaaaagctcttcagccactactcaactcaaaaccagcaggaccagaagctcaagcataactta

SEQ ID NO: 6756 - DNA, 1396 bp, Phalaenopsis aphrodite
ccgtcctgctcctctttgctaccctgggcttctacatcgccacaaccgctaccttctgtcggcgtgcttctcgatcgcgcggtcgatctgttctgtgagagagtaggaggtatttctcctaaaggacagaactaaaataaagaagcatgtcgtgctttgcttgctgcggagaacaagatatttacagtgcacctgataagggtggtgcttttcctgcaaaccaggctgcaggctatgatggatctaatcgagcatctgatcctgccccgaagggtgttcaaactgtgaaagtgcaacctattgaagtgcctataattcctgtagaagaaataaaagaagtaactgataattttgggaacaatgctttgattggagagggttcgtacggtagagtgtattatggtctcttaaaaaatggtaaagctgcagccttaaagaaattagattctagtaaacagccagatcaagaatttctggcccaggtatcaatggtgtcaaggttaaagaatgaaaatgttgttgagctgcttggctattatgttgatggtggtctccgtgttcttgcatatgagtttgcaacaatgggatctcttcatgatattcttcatgggcgcaagggactcaaaggtgcgcaaccaggcccagttctctcttggactcaaagagttaaaattgctgtaggagcagcaaggggactggaatacctccacgagaaagcacaaccccgtattattcatcgagatatcaagtctagcaatatactactttttgacgaagacgtggcaaaaattgctgatttcgatctttccaatcaatccccggacatggcagctcgtcttcactcgaccagggtactcggaacctttggatatcatgcccctgagtatgcaatgactgggcagcttagtgccaagagtgatgtttatagctttggagttgttcttttagaactattgaccggccgcaaacccgtcgatcatacattaccacggggccaacaaagtctcgtcacatgggcggcaccaaggctgagtgaagataaggttaagcagtgtgttgatacgagattaggaacagactatcctcccaagtctgtcgccaagtttgctgctgtagctgccttgtgtgtacagtatgaagccgatttccggccaaacatgagcattgttgtgaaagcgctgcagcctctactaaacgcgaggtcaggtggaccagctgttgaatcttaatgattttgtttgtgatttctcctcttggtttttcctgaacctgtcatgcaatttgtttgttagtgattttagtgtcatgcagtaatatatatatgttgtagtggtttgaaaattatttggaacgagatgtgttgtaatttgtaagttcttattaatttaattgaagg

SEQ ID NO: 6757 - DNA, 1401 bp, Phalaenopsis aphrodite
aagggctacgcgccgtcctgctgctctttgctaccctgggcttctacatcgccacaaccgctaccttctgtcggcgtgcctctcgatcgcgcggccgatctgttctgtgagagagcaggaggtatttctcctaaaggacagaactaaaataaagaagcatgtcgtgctttgcttgctgcggagaacaagatatttacagtgcacctgataagggtggtgcttttcctgcaaaccaggctgcaggctatgatggatctaatcgagcatctgatcctgccccgaagggtgttcaaactgtgaaagtgcaacctattgaagtgcctataattcctgtagaagaaataaaagaagtaactgataattttgggaacaatgctttgattggagagggttcgtacggtagagtgtattatggtctcttaaaaaatggtaaagctgcagccttaaagaaattagattctagtaaacagccagatcaagaatttctggcccaggtatcaatggtgtcaaggttaaagaatgaaaatgttgttgagctgcttggctattatgttgatggtggtctccgtgttcttgcatatgagtttgcaacaatgggatctcttcatgatattcttcatgggcgcaagggactcaaaggtgcgcaaccaggcccagttctctcttggactcaaagagttaaaattgctgtaggagcagcaaggggactggaatacctccacgagaaagcacaaccccgtattattcatcgagatatcaagtctagcaatatactactttttgacgaagacgtggcaaaaattgctgatttcgatctttccaatcaatccccggacatggcagctcgtcttcactcgaccagggtactcggaacctttggatatcatgcccctgagtatgcaatgactgggcagcttagtgccaagagtgatgtttatagctttggagttgttcttttagaactattgaccggccgcaaacccgtcgatcatacattaccgcggggccaacaaagtctcgtcacatgggcggcaccaaggctgagtgaagataaggttaagcagtgtgttgatacgagattaggaacagactatcctcccaagtctgtcgccaagtttgctgctgtagctgccttgtgtgtacagtatgaagccgatttccggccaaacatgagcattgttgtgaaagcgctgcagcctctactaaacgcgaggtcaggtggaccagctgttgaatcttaatgattttgtttgtgatttctcctcttggttttcctgaacctgtcatgcaatttgtttgttagtgatttagtgtcgtgcagtaatatatatatatatatgttgtagtggtttgaaaattatttggaacgagatgtgttgtaatttgtaagttcttattaat

SEQ ID NO: 6758 - DNA, 822 bp, Platanus occidentalis
atggagttctgaaaaatgggaggcaaacagccatcaaaaagttagattccagtaagcaacctgaccaagaatttttagcacagttttccatggtgtcgaggctgatccatgaaaatgtcgttgagctggttggttattgtgttgatggaaatcttcgtgttcttgcctatgagtttgctactatgggatctcttcatgatattcttcatggacggaaaggcgtcaaaggagcacaaccgggtccagtcctgtcatgggcacaacgtgtaaaaattgctgtaggcgctgcaaaaggacttgagtacttacatgaaaaggctcagcctcacattatccaccgagacattaagtccagcaatgttttactttttgatgatgatgttgccaaaattgctgattttgatttgtacaaatcaagctcctgacatggcagcacgcctccattcgactcgtgttcttggaacttttggttatcatgctccagaatatgcgatgaccggacagttgagttcaaagagtgatgtttacagctttggcgttgtcctcttggagctcttgactggacgtaaacctgtcgatcatacattacctcgtggacaacagagtcttgtgacatgggccacaccaagactcagtgaagacaaggtgaggcagtgtgtggatacaagactaggaggagaataccctcccaaggcagttgctaagatggctgctgtagctgctctgtgtgtgcaatatgaggctgattttcggccaaacatgagcattgtcgtcaaagctctccagcctcttttaaatgctcggtctggacctcctggtgaa

SEQ ID NO: 6759 - DNA, 618 bp, Scabiosa columbaria
ttaaaggagcacagcccggtccagtattatcctggtcccaaagagttaaaattgcggttggtgctgcaaaagggcttgaatatttacatgagaaggcacagccccacataatacatcgtgatattaagtcgagtaatgttttactctttgatgatgatgtggcaaaaatcgcagattttgatttatcaaatcaagcacctgatatggcagcacgtcttcattcaactcgtgttcttggaacttttggctatcatgctcctgagtatgcaatgactggtcagctaagttcaaagagtgatgtatacagctttggcgtggtgcttttggaattgctgacagggcgcaaacctgttgatcatacattgccccgtggacagcagagtttggttacatgggccacaccaaagctaagtgaagataaggtgaaacagtgtgtggacactagactaaacagtgaataccctcccaaagcagtcgcgaagatggcagcagttgcagctttgtgcgtgcaatatgaagctgatttcaggccaaacatgagcattgtggttaaagcactacaacctctgttgaatacgcgatctggaccacccactgaatcacaccacttgtgaattc

SEQ ID NO: 6760 - DNA, 1296 bp, Silene vulgaris
agtgatgagctgcttcagttgctgtggtgacgatgatttcagagaggaggtgacaatggagctttcatgacaagtaatcctgctggccacaattcagcttatccaatgaggaagacaaaccgaaggacacacaaactgtaaattttcagccgccggctgtttctgctatcaccgtggatgagttgaaggaagttactgacaattttgggacaaaggctctgattggcgagggttcttatggaagagtttactatggtgttctaaagaatggacaggctgcagcactaaaaaaattagattcttgtaagcaacccgagcaagagtttttgggacaggtttcaatggtgtcaagacttaagcatgataatgtccttgagttggttgggtattgtcttgatagcacccttcgggtccttgcctatgaatacgctcctaatggttcactccatgatattctacacggacggaaaggtgttaaaggtgcacagcctggtcctgtgctgacctgggcacaaagagtcaaaatcgctgttggggcagcaagaggcctcgagtatttgcatgagaaagctcagcctcacattattcatcgtgatataaagtcaagcaatgttctcctgtttgacgaagatgttgctaaaatcgctgattttgacctgtcaaaccaagcccctgatatggcagcgcgtttacattctacgcgtgttcttggcacatttggttaccatgctcccgaatatgctatgacagggcagttaagttcaaagagtgatgtttacagttacggtgttgtccttttggagcttttaacaggacgcaaacctgttgaccatacactacctcgtggacaacagagtcttgtaacatgggcaactccaaaactcagtgaggacaaggttaagcaatgtgttgatccaagattgggatcagattatcctcccaaagcagttgcgaagatggcagctgttgctgctctgtgtgtacagtatgaatctgacttccgacccaatatgagcatcgttgtaaaagctcttcaacctttgttgaacacccggactgggcctcagccatgaagcctcgaaaggcataaagttgcctccttccagcaaaggagtttgtagtgaatgttacattgaaatgtgcaaatagcttgattgtctattattatgtaatatatatgaataattccagctcttgtaatctcgtgatacatagactgtttccgcaactcttacaccttctcctagggtgacattttttttcaagatttcttttattggtttgcaagggttatgt

SEQ ID NO: 6761 - DNA, 1244 bp, Solanum lycopersicum
aacaatatgatttgctgtggaggtgctgaagaagacagttatatcagcggtccaccggttaatcaaaataccgcacctccgaaagcgggcaatccgcaatcttatggtgctgcaggtagtgaaagaggagaggcaagaagtggtggtgctgctcctaagagtggacctcctcaaaaaattttacctattgaggtaccagaaatgtctttggctgagctaaatagacttactgccaatttcggaaagaaaactctgattggagagggatcttatggacgcgtttttgctgctaaattaagcaacggccaacaagcagcaataaagaaattggatactgcttgttcaccagaaccagattctgacttcaccgcccagttatcaatggtttcaagacttaagcacgagcattttgtaacactgttaggatgttgcctcacagcaaacaatcggatcttggtttttgagtttgcaactatgggctcgctgcatgatgtattacatggtagaaaaggagtacaaggtgctgagcctggtccagttcttacctggaatcagagagttaaaattgcttatggtgcagctaaaggccttgaatatctacacgaaaaagttcaaccgccaattaaacatcgggatgtcagatccagcaatgtactactgtttgatgattttactgcaaaaattgctgatttcaacttgacaaaccagtgttcggacacagcagctcgtctgcattcaactagagtactggggacatttgggtaccatgctccagagtatgctatgacaggacagataacacagaaaagtgatgtttatagttttggagttgttctgttagaacttttgacaggaaggaaaccagtagatcatacaatgccaaaagggcaacagagtcttgtcacatgggcgactccacgactaagtgaagacaaagtaaagcagtgtgtagatcctaagctaaataatgagtaccctccaaaggcaattgctaagatggcagctgttgcagcactttgtgttcaatacgaggcagatttccgcccaaacatgacaattgtcgtcaaggcactgcaaccactactcaatgcaaaaccagcaggagcacaaccgcatgcatagatacaaacaaacacaacattcttcgttcaaacaaaaaggaattcttcagttattttattacttgtggcagatcatatgttttgtttttttcttttgatccactctgtttcaacattttgcct

SEQ ID NO: 6762 - DNA, 1615 bp, Solanum lycopersicum
gactatagagaactgaaatgtactgagggaatactatttatgactaataaaacctataataaatattcacttttgtctttgcgtattgatttgagttttttgattattctctttccttttgttgctctttcagttcacagatcaaaaccccccacactttcaagaagattttgttgactgagctatgagctgcttcagttgttgtgatgatgatgatatgcacagagctactgataatgggccattcatggcacacaattcagcaggcaacaatggaggtcagcgtgccacagaaagtgcacaaagagagacacagactgtgaatatccagcccattgctgttccttccatcgctgttgatgagttaaaggatatcactgataactttggttcgaaagctttgataggtgagggatcatatggaagggtataccatggtgtcctgaaaagtggacgtgctgcagccattaaaaaattagactcaagtaagcagcctgatcgagaatttttagctcaggtctcaatggtctcaagactaaaagatgaaaatgtggttgaattactcggttattgtgtggatggcggttttcgtgtgctagcctatgagtatgccccgaatggatctcttcatgacattcttcatggaaggaaaggcgtgaaaggtgcacagccaggtccagtattgtcatgggctcaacgagttaaaattgcggttggggctgcaaaaggactggagtacttgcatgaaaaagcacagcctcatatcattcaccgtgatattaagtctagcaacattttactctttgatgacgatgttgctaagatcgcagattttgatttatcaaatcaagcccctgatatggcagcacgtcttcattccacccgtgttcttgggacctttggttatcatgcaccagaatatgcaatgactggtcagttgagttcaaagagtgacgtttatagctttggcgttgtgctcctggaactacttactggccgtaaacctgttgatcatacattgccacgtgggcaacagagtcttgttacttgggcaacgccaagacttagtgaagataaagtgaagcagtgtgttgatgctagattaaatacagattaccctccgaaggcaattgcaaagatggctgcagttgctgccttgtgtgtgcaatatgaagctgacttccggccaaacatgagcattgtcgtaaaggctcttcagcctctgttgcctcgacctgtaccaagttagacatcaagcttgtgaattttctccttacccctgcctttacgtcatgaaatgagaaagattgatatcgacattgaaattggtatgagtcacaagaggatcgtgaattcgtgatactgatagtcacctggacaactactccacaacaatgttacctccacccccccccccctttttttttttcttcttgttgattgaatgccaaagaaattgtatattcactgtaatggaaattactttgcagattgattttcatggatttgtgttgagattttgacattctaccaagccacagttatattagtagattgttgaagttgtagtttttgttgttactgctttcacttctgtattccctttctcaaattg

SEQ ID NO: 6763 - DNA, 1536 bp, Trigonella foenum-graecum
tttattttattttatcacaacaacaatcatagttgctttgtgtttccaactcaactcaaagctagtcaaaagctttgctggttctactttattctacgcaccctttctgcttatcctacgcttctttcacccctttcgaacattcaaatcatctttatactctcactatccaccgcttcaacactctcaactccacaatttctctctttactttcatttcaattttcaggaaagaatcatgagttgtttcagctgttgcgaagaggatgagttccacaaggctgctgaaagtggtggaccgtatgttgtaaaaaatccagcagggaatgatggaaattatcatgcttctgagactgcaaaacagggagctcaaactgttaaagtgcagcccattgaagttcccgagatacaggctgatgaacttaaagaagttacggataactttggacaagattctctgattggagagggatcctacggaagagtatattacggagttcttaaaagcgggcaggctgcagcaatcaagaagttggatgccagtaaacagcccgatgaggaattcttggcccaggtttcaatggtatcaaggctgaaacacgataattttgtccagttgcttggatattgtgttgatggaaactcccgtattcttgcttatgagtttgcatctaatgggtcccttcatgacattttacatggtagaaaaggtgttaaaggagcacaacctggtccagttttgacatgggcacagagagtaaaaattgctgtaggggctgcaagggggcttgaatacttgcatgagaaggctgatcctcatattatccaccgggacatcaagtcaagcaatgtgctaatctttgatgatgatgttgctaaaattgcagactttgatttgtcaaaccaggctccagacatggctgcacgtcttcattccactcgtgtccttggaacctttggttatcatgcacctgaatatgcaatgactgggcaattgaacgctaagagtgacgtatacagttttggtgttgttcttcttgaacttttgaccggaaggaaacctgttgatcatacactaccacgtggacagcagagtctggttacttgggctacaccaaaactcagtgaggataaagtcaggcagtgtgttgacacaagactaggaggagaatacccaccaaaagctgttgccaagatggctgctgttgctgcattgtgtgtgcaatatgaagctgatttcagacctaacatgagcattgtagtcaaagcacttcaacctttgttgactgctcgagctggacctgctggtgaaacagcaaattaatatttctttatctctttctatatctgtgagtatgttcacaagtgtgcatgcaaagtataagagactgcttcagaagctggtattaaattggtcgaacaaggctttttgtcccaaaggttacactgcattcatttgttcataatccatgaggttgtttaaggtttctttgcttcctctattctttttaatattatttgtggtttctatttttt

SEQ ID NO: 6764 - DNA, 1118 bp, Tripterygium wilfordii
atggggttcttaaaagtgggcagactgcagcaatcaaaaagctagatgctagcaaacagcctgatgatgaatttttggcccaggtatccatggtatctaggctgaagcatgaaaattttgttcaattgcttggatactctgttgaagggggttctcgtgtacttgcctatgaatttgcgtctaatggatctcttcatgatattcttcatggaaggaaaggtgttaaaggtgcacaacctggtcctgtcttgtcatgggcgcagcgagtgaaaattgctgtaggagctgcaaaagggctggagtacttgcatgagaaggctgatcctcacattgtacatcgtgacattaagtcaagcaatgttttgatttttgatgatgatgttgcaaagatcgcagattttgatttgtcaaaccaagcacctgatatggctgcgcgtcttcattctactcgtgtcttgggaacatttggttatcatgctcctgaatatgcgatgactggacagctgaatgccaagagtgatgtatacagctttggtgttgtcctgctcgagcttctaactgggagaaaacctgttgatcatacattaccacgtggtcagcagagtttagttacatgggccacgccaaagcttagtgaagacaaggttagacagtgtgtcgatgcaagactaaatggtgaataccctcccaaggcagttgcgaagatggctgctgttgctgccttgtgtgtgcaatatgaagctgatttccggccaaacatgagcattgtagtcaaagctctccagcccctgttacacgctcgccctggacctactggcgaaacagcaagttcatgatcccctaccccttctttccctttccacaccttccctcttctgtctgtgcagatggaagttcataggcgttcaaagtataccagaagtactggtttatatggtggtggtaaattgttgcttgaggctcctgtcatttctgttgtttacttcatttgttcataatgcttgaagctctttcgttatcctaaactgtttaatatctattttatgtcagcagtcattattgtgattcgttttctttgcttacattcatttggatttgatgaatgttataatgtaagt

SEQ ID NO: 6765 - DNA, 1627 bp, Valeriana officinalis
cgccaatcaacctccctctccctctctatatatctatgttgtacagataaaccaaaccaaaccaaagcatcgcgtcagagttaagacttcttccccgctaaattcctcctccgattcatctcatctccagccgttacaacttcattcacacagattgatctcaactaggggaaacttcaccgatcattcgtaaggttgaggttgctgatagaatatcaccaaagggaaaaggacaatgagctgctttggatgctgcgcagacgatgaaatgcaaaaggcgtctgataatggaccatttatggcaaataacacagcaggaggccacaatgctggttattatgccacacaagacgcaccaagagacacaaaggctgtacctatccagcctattgctgtcccttcaatccaagtcgatgaattgaaggagataacagacaactttggtactaaatctttaattggtgaaggctcttatggaagagtctatcacggtgttttaagaagtggcgccgctgctgctataaaaaagttagactctagtaaacaacctgatcacgaattcttagctcaggtttctatggtatctagacttaaacatgacaatgtcgttgagctactaggttattctgtggatagcagtcttcgcgtgcttgcctatgagtacgcttcaaatggatctcttcatgatattcttcacggacggaaaggtgtgaaaggggcgcaaccgggtccggtattatcatggtctcaaagagttaagattgcagttggtgctgcaaaagggcttgaatatttgcatgagaaggcacaaccccatattattcatcgcgatatcaagtcgagtaatgttctgctttttgatgatgatgtggcaaagattgctgattttgatttgtcgaatcaagcacctgatatggcagcacgtcttcattccacccgtgttcttggaacatttggctatcacgctcctgaatatgcaatgactggacagctgagctcaaagagtgatgtgtacagtttcggagtagtgcttttggaattgctgactgggcgtaagcctgtcgatcatacgttgccacgtggacagcagagtctagtcacatgggcaacacctaaactgagtgaagacaaggtcaaacagtgtgttgacactagactcaacagtgaatatcctcccaaagcagtcgcaaagatggcagcagttgcagcattgtgtgtgcaatacgaggctgatttcaggccgaacatgagcattgtcgtaaaagcattacaacctcttttgaatacgcgatctggaccgcccactgaatcacaccactagtgaattcttcaatcttgatctccgaaaaaacatctcccactatttatgtaatttgtgatcgtaatcatttaccgttaatatatatacacggaaccctatatgacttgcaagattctttatttctttttacaacattcgtatgtatacaattattctctattgatgcagcagggggtgcaagcatacatggggtctattcctttggtttgtgttagaaaagtgagtgaattctgtaagatattttttttgaaaattatgtaactggattatattatcatcaagtattatgatatgaagtattgaata

SEQ ID NO: 6766 - DNA, 1560 bp, Aquilegia formosa
cagattctctctttctctcactaaattttctacactttgtatctcgacttgtccgaaaaggaaacaaaaacataccgaaactatacggaaaaaaagaagaagaggttggtatctcacagagaaggataatgggctgcttcggttgctgcgaagaagatgataattacaaagcttctgataatcgagttccagttatggcgaataattctgcaggacataatcatgccacagatacagcacctaagggtgctcagagcgtaaaagttcagcctatagccgttccctccatttcagtagatgaattgaaggaggtaacagataactttgggacaaaggctttagttggagagggctcatatggaagagtatattacggtgtgatgagaaatggtttgactgcagcaataaaaaagttagatgctagtaagcaaccagaccaagaatttttagcacaggtctccatggtatcaagactgaaacacgaaaatgttgttgagctgattagttactgtgtagatggaaaccttcgtgttcttgcttatgagtttgctacaatgggatcccttcatgacattcttcatgggaggaaaggagttaaaggagcacaaccaggtccagttctgtcatgggcccaacgagtgaaaattgctgtaggtgcagccaaaggactggaatacttgcatgaaaaggcgcagccccatgtaatccatcgagatatcaagtctagcaatgtacttctttttgatgatgatgttgctaaaattgctgattttgacttgtcaaatcaagctcctgatatggcagcacgactccattccactcgtgttcttgggacatttggttaccatgctccagaatatgcaatgactggacaactgaattctaagagtgatgtgtatagctttggggttgtgcttttggagctcttaactggccgtaaacctgttgatcatacattgccaagagggcagcagagccttgtcacatgggccacaccaagactgagtgaagacaaggtgagacaatgtgtcgaccaaagactaggaggcgactacccacccaaggcagttgcaaagatggccgcggtagctgctttatgtgtacagtatgaagctgatttccggccaaacatgagtattgttgtcaaagccctccaacctctgttgaatgctcgctctggtgcccctggtcctggtgaaactcccaacttgtgaattctctcttgttgttctgctccttcacactgtttgggtaacaaacgaatactgattgagaattggattgttcgtgtcatcccaaacacttcctgagtaacaaaatttgagttgatattctttatagttgttacatttctgcctatatttaatataagcggcaggctaatttctggcgtgggcgttatttctctgtagaatatgatgtgattacatggttactataattgattctttttaattctttccttttgatttgtaaaagatatgaatacacattgagtgctgatgacacatactgagctgaatgaagttctgaattatcgatgctgtagtttgttttatt

SEQ ID NO: 6767 - DNA, 1272 bp, Arabidopsis lyrata
agatacaatgagctgttttggctgttgccgcgaagatgatttgcctggagctgctgattatggagctcacaatatgaccaaacaatctggaggaaatgatggaaggcgcaacggttctgaaactgcacaaaaaggtgctcaaagtgtgaaggtgcagcctatagaagtagctgctattctcgctgctgaactgatagaggcaactaatgattttggaacaaattctcttatcggtgaaggctcgtatgcgagagtatatcacggggtgttaaagaatggccagcgtgcctcggttaaaaagttagattctaacaaacagcctgatgaagaatttcttgctcaggtttccatggtttcgaggttgaagcatgctaactttattgagctgcttggttactctgttgatgggaatacgcggatacttgtctttgagtttgctcaaaatggatctcttcatgatattcttcatgggagaaaaggtgtgaagggagcaaagcctggtccactcttgtcttggcatcaacgagtgaagattgcggttggagcagcaagagggcttgagtacttacatgaaaaggcgaatccacatgtcattcaccgtgacataaagtccagcaacgttctaatctttgataatgatgtagctaaaattgctgacttcgatctgtcaaatcaagctcctgatatggcagcacgccttcattcgactcgtgttcttggaacctttggttaccatgcccctgaatatgcaatgactgggcaactgagtgccaaaagtgatgtatacagtttcggagttgtactactcgagcttcttacaggtcgaaagcctgttgatcatacattgcctcgaggccagcaaagtctagtcacatgggctacaccaaagctaagcgaagacaaggttaagcagtgtgttgattcaagactcggaggagattaccctccaaaagctgttgctaagttagctgctgttgctgcattgtgtgtacaatacgaagctgatttcagaccaaacatgagtattgtcgtgaaggctctgcaaccattgttgaatgctcggaccggacctgcgggagaaggagcaccttagtgttaagtgttaacccttagccgtcaccgtttaaagttcttttatttatactggaaaaatcattctcaaacaacattcaacatagtgttcatagaattctgacattgatacttattatgatttgaccactaaagtctcctgttttgttttaaatttaaactaaaacccagtgggagtaa

SEQ ID NO: 6768 - DNA, 1367 bp, Arabidopsis thaliana
cgaaacctctctctctctctctctctctctctctctctctctctctctctctctctctctctctctctcgttcgtttggtttttggatcagtatacagagattcaatgagctgttttggctgttgccgtgaagatgatttgcctggagctaatgattatggaggtcacaatatgaccaaacaatctggaggaaatgatggaaggcgcaacggctctgaaactgcacaaaaaggtgctcagagtgtgaaagtgcagcctatagaagtagctgctattctcgctgatgaactgattgaagcaacgaatgattttggaactaattctcttatcggtgaaggctcgtatgcgagagtgtatcacggggtgttaaagaatggtcagcgtgcagccattaaaaagttagattctaacaaacagcctaatgaagagtttctagcacaggtttccatggtttcgaggttgaagcatgttaactttgttgagctgcttggttactctgttgatgggaattcgaggatacttgtctttgagtttgcccaaaatggatctcttcatgatattcttcacgggagaaaaggtgtgaagggagcaaagcctggtccactcttgtcgtggcatcaacgagtgaagattgctgttggagcagcaagagggcttgagtatttacatgaaaaggcaaatccacatgtcatccaccgtgacataaaatccagcaatgttctaatctttgataacgatgtagccaagatagctgactttgatctctcaaatcaagctcctgatatggcagcacgccttcattcaactcgtgttcttggaacctttggttaccatgcccctgaatatgcaatgactgggcaattgagtgccaagagtgacgtatacagtttcggagttgtactgctcgagcttcttacaggtcgaaagcctgttgatcatacattgcctcgaggccagcaaagtctagtcacatgggctacaccaaagctaagcgaagacaaggttaagcagtgtgttgattcaagactgggaggagattaccctccaaaagctgttgctaagttagctgctgttgctgcattgtgtgtacaatacgaagctgatttcagaccaaacatgagtattgtcgtgaaggctctgcaaccattgttgaatgctcggaccggacctgcaggagaaggagcaccttagtgttaacccgtagccgttaccgtttaagaagttcttttatttatactggaaacataattttctcatacaacaacaaacatagtgttcatagaattctgacattggaacttattatgatttgaccactaaagtctcctgttttgttttaaatttaaattaaatacaagtgggagtaa

SEQ ID NO: 6769 - DNA, 1621 bp, Aristolochia fimbriata
ataggaaagcaaaaaatactccaaaattgcggcagtcttcgccgcgataaaccgagcgaggaggtttcagacacagcttcgtttcgttattcgcggtcgcggctgattgggcggcaaaacttgcccggggttttgttggagtttacaggtttagatccgcagagttttcaggtgaagcaacttatttccttcagaagaagttccttggagaaaaaccatgggctgctttagttgctgtgaagatgatgatttcaataaagcagcagaaagtgggggatcttatatggcaaacaattcagcaggtaatgctggagcttatcatgcctctgatcctgtgcccaaaggtccacaggctgtaaagtcacaaccaccggcagttcccgccattccagttgatgagctcaaagaagtgacagacaattttggtcagaaggctttaattggagaaggttcatatgggcgagtgtatcatggagttctaaaaaatggacaaacagctgctataaaaaagttagatgcaagtaaacaaccagacctagaatttctagcacaggtttccatggtttcaaggctaaaacatgaaaatgttgttgagctgattggatactgtgtggatgggagtctgcgtgttcttgcttatgagtttgctactatgggctctcttcatgatattctgcatggtcgaaaaggagtgaaaggagcacaacctggtcctgttctttcatgggctcaacgagtaaaaatagctgtaggagcagcgagaggacttgagtacttgcatgagaaggcccagcctcacataatccatcgtgatattaaatcgagtaatgtcttattgtttgatgatgatgtggcaaaaatagctgattttgacttgtcaaatcaagctccagacaatgcagctcgtctgcattcaactcgtgttcttggaacctttggttatcatgctccagaatatgcaatgactggacagctgagtgcaaaaagtgacgtttacagttttggcgttgtccttttagagctcttgactggcaggaaaccggttgatcacacactaccacgaggacagcaaagtcttgtgacatgggccacaccaagactcagtgaagacaaagtgaggcaatgtgttgacacacggcttggaggagaatatcctcccaaggcagttgcaaagatggctgctgtagctgccttatgtgttcaatatgaagctgacttcaggccaaacatgagcattgtagttaaagctctccaacctcttctgaatacccggtcaggacctcatggtgaggcctcaaatttgtgaattcccttctgttctttgcaaactggggcactgtgcttggtttgtttctgagtgattgtagattgtataccatctttgcttgacaacaattatttgagaacaacaatagtcaaggcatcaaagaatttcggcttgtcaccatgctgtaccaacttcatgttcatgttttagtggcgggagaaggatattattatggtccgtagaattataagtacatatacgagtctaaaatttgatactttccaggttgatgtccgtgtagccgaagcgctattcaagtagaagttcctctctattcgcatcatcgtgattaat

SEQ ID NO: 6770 - DNA, 1563 bp, Hordeum vulgare
gttgctacttccttcctccctccccctccttgcctgcttccgccgctacctgctcctccgcctccgctccgccctcctcccctccgccgtcgccgtcgccgtcgccgggacacgctcaagccaggacttgttttccgaagaatatgtcttgctttggatgctgtggtgatgaagatactcaaagagcaccagacaacaggaatcaatacccaggaagccatccagcaaggaatgatgcatatcgcactgccgatccaactcctaaaggtcctcaacctgtgaaagtgcaacccattgcagttcctgccattcctatggatgaaattagggaggctactcagggttttggtgatgaagctttgattggtgagggttcctttggtagagtatattttggtactctaagaaatggcagaggtgcagcaatcaaaaagctggattccagtaagcagccagaccaagaattgctggcacaggtatctatggtgtcaaggcttaagcatgaaaatgttgttgagttacttggttactgtcttgatggcaacacccgtgtcctagcttatgagtttgccactatgggctctcttcatgatatgcttcatggaaggaaaggtgttaaaggggctcagccaggtccggtcttatcatggatacaacgggtgaagatagctgttggtgcagcgaaaggcctagagtatcttcatgagaaagcacagcctcacgtcatacacagggacatcaagtccagcaatgttcttctctttgatgaagatgtagctaaaatagctgacttcgatttgtcaaaccaagctcctgacatggcagcccggcttcactcaactagggttctgggaacatttggataccatgcacctgagtatgcaatgactggtcaacttagctctaagagtgatgtgtacagttttggagttgttcttctggagctattgactgggaggaaacctgtcgaccatacattaccgagggggcagcagagccttgtcacatgggccaccccaagactgagtgaagataaggttaggcaatgtgttgactcaagacttggaggggactatcctcctaaggctgttgcaaagtttgcagctgttgcggcattgtgcgtccaatacgaagctgacttccggccaaacatgagcatcgtcgtcaaggcgctccagcccttgctgaacgcgcgagcagcccatcccggggctgaacatgctgggcgctaagctccagtcggaccttttgtatgatataatagttaaggaaaaatgagccatcaattgttgttctcgcggggcggggcgcgtggcaggcggtttttgtacatttgtgattattcttcccaagttgtaaccctctgagattctagtaccagaaatattcgattctttgtatcggttgcaagatcagcaagtatctagtacctagaacaccgttcatcagacgagaaaagaaggaagaaaataaacactgctgcgtgtgatcttatgccatttgcttcccagttcagattctagattggctgcaaatcattcaatcaacaaatttcacattttg

SEQ ID NO: 6771 - DNA, 1429 bp, Phaseolus coccineus
cccacgcgtccgccaattccatgtgagtcaagaacttcttccactcttttatcctacgcacttctccctgcttatcctgcgcctcctttgcgagatcctccccttgcaccgtcactctccgcgcctctacactcttaattccgctattttgtcatcttatttcgtttcagtgagaaagaatcatgagttgtttcagctgttgtgaggaggatgaactccagaagtctgctgaaagtggaggaccctatgtagtaaaaaacccagcaggaaatgatggaaattatcatgcttctgaaactgcaaagcagggcactcagccggttaaagctcagcccattgaagttccaaatataccagcagatgaactaaaagatgttacagataactttggtcaagatgctctgattggagaggggtcatatggaagagtatattatggtgttcttaaaagtgagcaggctgccgcaatcaagaagttggatgccagtaaacagcctgatgaggaatttttagcccaggtttcaatggtatcaaggctgaagcatgaaaattttgttcggttgcttgggtactgcattgatggaagctcccgtattcttgcttatgagtttgcatctaatggatctcttcatgatattttacatggcagaaaaggtgttaaaggtgcacagcctggtccagttttgtcatgggcacaaagagtaaagattgctgtaggggctgcaagaggacttgaatacttgcacgagaaggctgatccccacattatccaccgggacatcaagtcaagcaatgtgttaatctttgatgatgatgttgctaaaattgcagattttgatttatcaaatcaagctccggacatggctgcgcgtcttcattctactcgtgtccttggaacctttggttatcatgcaccagaatatgcaatgactggacaattgaatgcaaagagcgatgtatacagttttggcgttgtccttctggaacttctgactggaaggaaacctgttgatcatacactgccacgtggacagcaaagtctggttacttgggctacaccaaaactcagtgaggataaagtcaggcagtgtgttgatacaagactaggaggagaatacccacccaaagctgttgctaagatggctgctgttgctgcactttgtgtgcaatatgaagctgatttcagaccaaacatgagcattgtagtcaaagctcttcaacctttgctggctgcacgacctggacctgccggtgaaacaccaaattagttctctgtttctctgtctctatatttgtgagtatatgcacaagtttgcatgcaaaatataaaagtgcttcagaagatggtggtaaattgctccaacatgactttatattcaattgtttacactgcattcattttgttcataatccatgagggtctttgctt

SEQ ID NO: 6772 - DNA, 1530 bp, Beta vulgaris
gcacgaggaattcataaatttgcagcgtgatcttttcttacaaaattcttcctaaagactaaagtacgcgtttctctctcatcctacccgcaccttttgctcactcgcttttccttcttacccttgcctactttttgctaaactccaaaaactctgctaatatctccaatttcttctccttcatttacactaatcaatcttttgttttgggaattcatcgcgtacttgctgtattaatcttgcttgctactcttgagggacaaccatgagctgttttagttgctgtggagatgatgattttcagagaggtggtgataatggagcatttatgacacataatccatctggtaatcatacagcttatccaacaaaagaagataagccaaaggacacccaaactgtaaattttcagcctcctgcagttcctgctataactgtagatgagttgaaagaaattacagaaaacttcggaacgaaggctttgattggtgagggatcttatggaagagtttattatggcacactaagaagtggacaagcggctgccttgaaaaaattagattccagtaaacaaccagaccaagagattttgggacaggtgtcaatggtatcaagacttaaacatgagaatgtgcttgagcttgtgggttattgtcttgatggcaactttcgagtccttgcatacgagtatgctgcaaatggttctcttcatgatattcttcatggacgaaaaggtgtcaaaggagcacagcctggtcctgtcctctcatgggcacagagagttaaaattgctgttggagcagccaaagggcttgagtatttgcatgagaaagctcaacctcacattatacatcgtgatattaagtccagcaatgttcttttattcgacgatgacgttgcaaaaattgctgattttgacttatcaaaccaagccccagatatggcagcacgtctacattccacacgtgttctcggaacatttggataccatgctcccgaatacgctatgactggacaattgagctcaaagagtgacgtctatagtttcggtgtcgttctcctggagctcttaaccgggcgtaaacctgtagaccatacactacctcgtggacagcagagtcttgtgacatgggcaactccaaagcttagtgaagataaggtaaagcaatgtgttgatccaagattaggatcagactatcctcccaaggctgttgctaagatggccgctgtagccgcgctatgtgtgcagtatgaatctgattttcgcccaaatatgagcatcgttgttaaagctcttcaaccgttgttaaatacacggacaggccctcataatgaagcttcacatgtgtaattgtaaaatccccatttgctaaggaatgtctgatgtgtatcaaagtattacattgatttctttcatacatgatttgagtaattagtgcaatgtattttgttgaatgtggattctggtcagctgctgtaagtctgttgtaatgcataaaatgttgctataacttaaaaacttcaacttaa

SEQ ID NO: 6773 - DNA, 1113 bp, Brachypodium distachyon
aacgatgtggtgctgcgcgggcgtggaggaggagcgacacggcccgcccgccggctacccggccacgccgccgccgcgagctccagcgcaagcgagagggcctcacgcgccgaggaacggcgtcgggccagccaaggtgctgccgatcgacgtgccggccgtgtcgctggcggagctgaaccgtgcgacgggcaacttcggcagccggtcccttgtcggggaaggctcctacgggcgcgtgtaccgcgcgaagctgaatagcagcacgggggagacgaccaccgtggccgtgaagatgttcgacaacggcgggtccgggcagccggagcccgagttctgcgcgcagctgtcggtggtgtcgcggctcaagagcgagcacttcacccagctgctgggctactgcctggagctcaacaaccggatcgcgctctacgagttcgccaccgagggctccctctacgacatcctccacgggaagaagggcggcgccggcgggcagcatcagcaagggcccagcgggccggcgctgacgtgggcccagcgggccagggtggccctcggggcggcgaaggggctggagtacctccacgagaaggcccagccgtccgtgatccaccgcgacgtgcggtccagcaacgtgctcgtcttcggcggccacgtgggcaagatcgccgacttcaacctcagcaaccagtccgccgactccgccgcccggctgcactccaccaaggtgctcggcaccttcggctaccacgcgcccgagtacgccatgactggccagctcacgcacaagagcgacgtctatagcttcggcgtcgtgctcctcgagctgctcacggggcggaagcccgtggatcacaccatgcccaagggccagcagagcctcgtcacctgggccactccaaggttgagcgaggacaaggtgaagcagtgcgtggaccccaagctgaacaacgactacccaccaaaggcagtggccaagctcgcggcggtggcggcgctgtgcgtgcagtacgaagccgatttcaggcccaacatgaccattgtcgtcaaggctctccagcctcttgtcagtgcccgtccgggaggagatcagcactagctacagaaacg

SEQ ID NO: 6774 - DNA, 1907 bp, Theobroma cacao
atgcaacctaagggaactgccaagtgccaacaaagtcaagtcttcgattttcccttttatcctacgcacccctcggttttcttaacctgcgcacatttggccggcttcaccgttttagatctccagctcaactaataagcacagtctcttgttggactgatccaagtataagtgcttgctccacttcatcggcgctaaatttcagcctcaatacctacaatgctcgtaaagcttttgttaagctgttttttcatcgaattatttttagacacttgtatttattacgcttccttgaatttctagatttggagtttacaaattagagaaaattctcaaaggattgaaccatgagttgctttggctgttgcgaagaggatgatttccacaaagctgctgataatggaggccaatacatggttaaaaattcggcgggaaatgatggaggctaccatacatctgaaactgcatcaaagagtgctcaaactgtgaaggttcagcctattgaagtccctgctattccagcagatgaattaaaggaaatcacagataactttgggacaaattctctgattggtgaaggttcatatggtagagtttattatggagttcttaaaagtgggcaggctgcagcaatcaaaaagttagatgccagcaagcaacctgatgatgagtttttagcccaggtttccatggtatcaaggttgaagcatgaaaactttgttcaattgcttggttactgtgttgatgggagctcccgtatacttgcctatgagtttgcatctaatggatcgctgcatgatattctacatgggagaaaaggtgttaagggagctcagccaggccctgttctgacatgggcacaaagagtaaaaattgctgtaggagctgcaaaagggcttgagtacttgcacgagaaggctgatcctcacatcattcatcgtgacattaagtccagcaatgtgctaatttttgatgatgatgtggccaagatcgcagacttcgatttatctaatcaggctcctgatatggcagcccgtcttcattccactcgtgttcttggaacctttggttatcatgctcctgaatatgcaatgactgggcaattaaatgccaagagtgacgtttacagctttggtgttgtgctgcttgagcttctaactgggaggaaacctgttgatcatactttaccccgtggacagcaaagtcttgtgacatgggctacgccaaaacttagtgaagacaaggttaggcagtgtgttgatcaaagactaggaggagagtatcctcccaaggctgtcgcaaagatggctgctgttgctgcgttgtgtgtgcaatatgaagctgattttcggccaaatatgagcatcgttgtcaaagctcttcagcccctgttaaatgcacgacctggacctgctggtgaaacaccaagcacataacgatatctatttctctctcactcctccctctctttctatctctctgtgcctgcgtgtgcgggaagtgttcacacattcaagtgtccaaaaatatataatgaggggacaattttagaaggtgatgataaatttgtttattcaaagttccatatgcatccattatacactttgtattcgatttgttcataatgtgtgaggttgtttctttcttgcatgtatgtcgatggtcgccttccttttcaccctgacgtttcttaactttgatggaatggatatcattccttttgtgagcaaatagtaatgcacctttgattgcctggataacaggccatcaccaagaaagaaaggaaatggcggcttcatggttttcctgaaatgccatatggcatatagaagcatctttctccttcgcgttgaacatcttatgcattggtctgtgtcggaagaaaagaatgaaaaatagttgaaaaa

SEQ ID NO: 6775 - DNA, 1579 bp, Citrus sinensis
aaaagcgctttatacgtttttcttcatcctgcgcacctatcgtcgtcttatcctgcgcacctcacgccggctccagagtgattcattcaaaatatccagctcgttgcttttctctatatctcagctagctttcatagaggggcattattgtggcagtgaatcatgagctgcttcggctgttgtgaagaagatgatatgcataaagctgctgacaatggcaatgcatacatggttaaaagttcagcaggaactgatggagcctatcatgcatctgaagcagcacctaagggtgctcaagctgtgaaagtccagcccattgaagtcccagcaatttcagtggatgaattgaaggaaattactgagaactttgggactaatgctttgattggagaaggttcatatggaagagtatattatgggattcttaaaagtggacatgctgcagcaataaaaaagttggatgccagcaagcaacctgatgaggagtttttagcacaggtttccatggtatcaaggttgaagcatgaaaactttgttcagctgctcgggtattgtgttgatgggacttcccgtgtgcttgcctacgagtttgcatctaatggatctcttcatgatattcttcatgggaggaaaggtgtaaaaggagctcagcctggtcctgttttgtcatggcaacagcgagtgaaaattgctgtaggggctgcgaaagggcttgaatacttgcatgagaaggcagatcctcatattatccatcgcgatattaagtccagcaatgtactaatttttgatgatgatgtagcaaagattgccgactttgatttatctaatcaagctcctgatatggcagctcgccttcattctactcgtgttcttggaacttttggttatcatgctcctgagtatgcaatgactggacagttgaatgcaaagagtgatgtatacagctttggtgttgttctgcttgagcttctgacaggtcgaaaacctgtcgatcatacactaccacgtggacagcagagtctagtgacatgggccacaccgaaacttagtgaagataaggttaggcaatgcgttgatgcaagactaggaggagattatcctcccaaggcagttgcaaagatggctgcagttgctgctctgtgtgttcagtatgaagctgatttccgtccaaatatgagcattgttgtcaaagccctccagcccctgctaaatgcacggcctggacctgctggtgaatcagcaagctagtcaagctagtgactctctctctcccccatttgtgtgtgggcaagtatgcgcacacatgcaggcttgcaaactattaaaaaagaaaaagaaaaaaagagattgtttagtagcactggtagattatctgagcaaggttcgaaatccttccattatacactgtaattttttttgtggttggttttgttcatagtatgtgagattgtttctttcttacagctggctgccttagcgtttcccctaatgcttattgttggcttcaaattctgtcctttaccttgaccttcatgcctgcaatggtcggcatcttaacttcaatttattcttcattttt

SEQ ID NO: 6776 - DNA, 1333 bp, Gossypium hirsutum
agggaaactgccagcaaagtcaaggctccgatttttcactttcatcatacgctacgcgcccttcaagttctcttaatcttcgcatctttcgccggcttcaccgtctcagatctccggcccaactgtttcgctcactctcttattggactgatcgaagtccaagtgcttcttcactttatcggcggctattttcagattggtattttacaaattagagataattgtcaaaggatagagccatgagttgttttggctgttgtgaagaagataatatccacaatgccacagacaatggaggccaatacatggttaaaaactcagcaggaaatgttgggggttaccatacatctgaaactgcatcgaagagtgctcaaaccgtgaaggttcagcctattgaagtccctgctattctggcagatgaattgaaggaaatcacagataactatggtaacgatgctttgattggagaaggttcatatggtcgagtttattatggagttcttaaaagtggagaggctgcagcgataaaaaagttagatgccagcaagcaaccagatgatgaatttttagcccaggtttccatggtatcaaggttgaagcatgaaaactttgttcagttgcttggttattgtgttgatgggagttctcgtatacttgcctatgagtttgcttctaatggttcactgcatgatattctccacgggagaaaaggtgttaagggagctcagccaggccctgttctgacatgggcacaaagagtgaaaattgctgtaggagctgcaaaagggcttgagtacttgcatgagaaggctgatcctcacatcattcatcgtgacataaagtctagcaatgtgctcatatttgatgatgatgtggcaaagattgcagattttgatttatctaatcaggctcctgatatggcagcccgtcttcattccactcgtgtacttggaacctttggttatcatgctcctgaatacgcgatgactgggcaattaaatgccaagagtgatgtatacagctttggtgttgtgctgctggagcttttgactggaagaaaacctgttgatcatactttaccccgtggacagcaaagcctagtgacatgggctacaccaagacttagtgaagacaaggttaggcagtgtgttgatcaaagactaggaggagattatcctcccaaggctgtcgccaagatggctgcagttgctgcattatgcgtgcaatatgaagctgattttaggccaaatatgagcatcgttgtcaaagctcttcagccactgttgaatgcccggcctggacctgccggtgaaacaccaagcacataaatatg

SEQ ID NO: 6777 - DNA, 1582 bp, Solanum melongena
tgggagtcctatttatgactaataaaaactcataataaagtgacttttttccttgcgtgttgatttggggttttttgattattctctttccctttgttgctctgtcaattcacagatcaaaacccccacactttcaagaagaatttgttgattgaactatgagctgcttcggttgttgtgaggatgatgatatgcacagagctgctgataatgggccattcatggcacaccattcagcagacaacaatggaggtcagcatgccacagaaagtgcacaaaaagagacacagactgtgaatatccagcccattgctgttccttccatcgctgttgatgagttaaaggatatcactgacaactttggctcgaaggctttgattggtgagggatcatatggaagggtataccacggtgtcctgaaaagtggacgtgctgcagccattaaaaaattagactcaagtaagcagcctgatcgagaatttttagctcaggtctcaatggtctcaagacttaaagatgaaaatgtggtagaattactcggttattgtgtggatggcggttttcgtgtgctagcttatgagtatgccccgaatggatctcttcatgacattcttcatggaagaaaaggtgtgaaaggtgcacagccaggtccagtattgtcatgggctcaacgagttaaaattgcagttggggctgcaaaaggactggagtacttgcatgaaaaagcgcagcctcatatcattcatcgtgatattaagtctagcaacattttgctctttgatgatgatgttgctaagatagcggattttgatttatcaaatcaagcccctgatatggcagcacgtcttcattccacacgtgttcttgggacctttggttatcatgcaccagaatatgcaatgactggtcagttgagttcaaaaagcgatgtttatagcttcggtgttgtgctcctggaactacttactggccgtaaacctgttgatcatacattgccgcgtgggcaacagagtcttgtaacttgggcaacgccaagacttagtgaagataaagtgaagcagtgtgttgatgcaagactaaatacagattaccctccgaaggcaattgcaaagatggctgcagttgctgccttgtgcgtgcaatatgaagctgacttccggccaaacatgagcattgtagtaaaggctcttcagcctctgttgcctcggcctgtaccaagttaaacatcaagcttgtgaatttcctccttaccccggccttcatgttgtggatgagaaaaatgagattggcattggtattagtcgcaagagaacggtgatactggtggtcacctggacaactactgcacaacaatgtcacctcccacccgccctttttcttcctgtcgattgaatgacaaagtaatattgtatattcactgtaattgaaatgactttgcatatttattttcatggatttgtattgaggttttgaaattctaccaagccacagttatatttgtagacagtagaagttgtaacttttgttgttactgttttcatttctgtattccctttttcaaattgctttcctatgcttttta

SEQ ID NO: 6778 - DNA, 916 bp, Festuca arundinacea
  misc_feature (883)..(883): n is a, c, g, or t
ggcacgaggcagatatttcccctcctacaattgacgtcccagaattgtcatttgaggacttaaaacaaaagaccgacaattttggatcgagttctctgattggtgaaggttcgtatggacgagtatatcatgctactatggatgatggcaggcaagcggctattaagaaattcgatgcatctgaaaatgagcctaacgacgaattcttgaaacaggtctcacttgtatcaaggctgaaacatgacaatcttgttgagatgttgggttactatgtggagggcaactatcgtatactggcatatgaatttgcaacaatgggttctcttcatgatgttctgcacggaagaaaaggagttcaaggtgcccagcctggccctgtgcttgattgggtgcagagggtcaaaattgctattgaggcggcaaaaggtatagagtacctgcatgagaaggttcagccttcaatcatccatcgggacatcagatcaagcaatgttcttctgtttgaggacttcaaggcgaaaattgcagacttcaacctcttaaatcaagctccagatatggcagcacgtctccattcaactcgtgtattagggacatttggatatcatgcaccagaatatgctatgactggccagctgacacagaaaagtgatgtctacagctttggcgtggttcttctcgaacttctgactggaaggaaacctgtggatcatacaatgcctcgggggcagcaaagtttagtcacttgggccactccaagattgagtgaagataaggtcaaacagtgcatagatcctaggttgaagggagaataccctccgaagggagttgctaagcttgctgcggtggcggctctgtgcgtgcaatacgaggcggagttcangcccaacatgagcatcgtcgtcaaggcactcac

SEQ ID NO: 6779 - DNA, 430 bp, Setaria italica
cctgacatggcagcccggcttcactcaactagggttctgggaacatttggataccatgcacctgagtatgcgatgactggtcaacttagctctaagagcgatgtgtacagttttggagttgttcttctggagctattgactgggaggaaacctgtcgaccatacattaccgagggggcagcagagccttgtcacatgggccaccccaagactgagtgaagataaggttaggcaatgtgttgactcaagacttggaggggactatcctcctaaggctgttgcaaagtttgcagccgtcgcggcattgtgcgtccaatacgaagccgacttccggccaaacatgagcatcgtcgtcaaggcgctccagcccctgctgaatgcgcgagcagcccaccccggggctgagcatgccggacgctaagcaccactcc
